(12) United States Patent
Bentwich et al.

(10) Patent No.: US 7,795,419 B2
(45) Date of Patent: Sep. 14, 2010

(54) VIRAL AND VIRAL ASSOCIATED MIRNAS AND USES THEREOF

(75) Inventors: Itzhak Bentwich, Misgav (IL); Amir Avniel, Henderson, NV (US); Yael Karov, Tel Aviv (IL); Ranit Aharonov, Tel Aviv (IL)

(73) Assignee: Rosetta Genomics Ltd., Rehovot (IL)

( * ) Notice: Subject to any disclaimer, the term of this patent is extended or adjusted under 35 U.S.C. 154(b) by 0 days.

(21) Appl. No.: 11/511,035

(22) Filed: Aug. 28, 2006

(65) Prior Publication Data

US 2007/0003575 A1 Jan. 4, 2007

Related U.S. Application Data

(63) Continuation of application No. PCT/IB2005/002352, filed on May 26, 2005, which is a continuation-in-part of application No. 10/709,739, filed on May 26, 2004.

(60) Provisional application No. 60/522,459, filed on Oct. 4, 2004, provisional application No. 60/665,094, filed on Mar. 25, 2005, provisional application No. 60/522,450, filed on Oct. 3, 2004, provisional application No. 60/522,451, filed on Oct. 3, 2004.

(51) Int. Cl.
C07H 21/04 (2006.01)

(52) U.S. Cl. .................................. 536/24.5; 536/24.32

(58) Field of Classification Search ...................... None
See application file for complete search history.

(56) References Cited

U.S. PATENT DOCUMENTS

| | | | | |
|---|---|---|---|---|
| 6,001,806 | A * | 12/1999 | Hilbert et al. .................. 514/12 |
| 6,018,036 | A * | 1/2000 | Mosmann et al. ........... 536/23.5 |
| 6,451,977 | B1 * | 9/2002 | de Sauvage et al. .......... 530/350 |
| 6,458,943 | B1 * | 10/2002 | Byrne ........................ 536/23.5 |
| 6,573,099 | B2 | 6/2003 | Graham |
| 6,720,138 | B2 | 4/2004 | Sharma et al. |
| 6,753,139 | B1 | 6/2004 | Baulcombe et al. |
| 7,056,704 | B2 * | 6/2006 | Tuschl et al. ............... 435/91.1 |
| 2002/0086356 | A1 | 7/2002 | Tuschl et al. |
| 2003/0108923 | A1 | 6/2003 | Tuschl et al. |
| 2003/0204075 | A9 * | 10/2003 | Wang ........................ 536/24.3 |
| 2003/0228691 | A1 | 12/2003 | Lewis et al. |
| 2004/0053411 | A1 | 3/2004 | Cullen et al. |
| 2004/0086884 | A1 | 5/2004 | Beach et al. |
| 2004/0102412 | A1 * | 5/2004 | Broschat et al. ............... 514/44 |
| 2004/0106566 | A1 | 6/2004 | Lin et al. |
| 2004/0152112 | A1 | 8/2004 | Croce et al. |
| 2004/0171037 | A1 | 9/2004 | Li et al. |
| 2004/0175732 | A1 | 9/2004 | Rana |
| 2004/0210951 | A1 | 10/2004 | Baulcombe et al. |
| 2004/0221337 | A1 | 11/2004 | Baulcombe et al. |
| 2004/0229266 | A1 | 11/2004 | Tuschl et al. |
| 2004/0253604 | A1 | 12/2004 | Lin et al. |
| 2004/0259247 | A1 | 12/2004 | Tuschl et al. |
| 2004/0259248 | A1 | 12/2004 | Tuschl et al. |
| 2004/0268441 | A1 | 12/2004 | Vance et al. |
| 2005/0026278 | A1 | 2/2005 | Tuschl et al. |
| 2005/0037988 | A1 | 2/2005 | Zamore et al. |
| 2005/0059005 | A1 | 3/2005 | Tuschl et al. |
| 2005/0059011 | A1 | 3/2005 | Sin et al. |
| 2005/0074788 | A1 | 4/2005 | Dahlberg et al. |
| 2005/0075492 | A1 | 4/2005 | Chen et al. |
| 2005/0079614 | A1 | 4/2005 | Reinhart et al. |

FOREIGN PATENT DOCUMENTS

| | | |
|---|---|---|
| EP | 1 281 758 A2 * | 5/2003 |
| WO | WO 01/68836 | 9/2001 |
| WO | WO 02/44321 | 6/2002 |
| WO | WO 02/094185 | 11/2002 |
| WO | WO 01/75164 | 2/2003 |
| WO | WO 03/029459 | 4/2003 |
| WO | WO 03/070884 | 8/2003 |
| WO | WO 03/070903 | 8/2003 |
| WO | WO 03/070918 | 8/2003 |
| WO | WO 03/074654 | 9/2003 |
| WO | WO 2004/009779 | 1/2004 |
| WO | WO 2004/031412 | 4/2004 |
| WO | WO 2004/057017 | 7/2004 |
| WO | WO 2004/066183 | 8/2004 |
| WO | WO 2004/072248 | 8/2004 |
| WO | WO 2004/111191 | 12/2004 |
| WO | WO 2005/012523 | 2/2005 |
| WO | WO 2005/017111 | 2/2005 |
| WO | WO 2005/019453 | 3/2005 |

(Continued)

OTHER PUBLICATIONS

Krutzfeldt et al (2006) Nature Genetics 38:514-519.*
Parker et al (Virology 179: 339-346, 1990).*
Buck et al. (Biotechniques, 1999, 27:528-536).*
Edwards et al (J. Virol. 82(18): 9094-9106, 2008).*
MacDiarmid, R. RNA Silencing in Productive Virus Infections Annu Rev Phytopathol Apr. 12, 2004.
Chen, J., W. X. Li, D. Xie, J. R. Peng and S. W. Ding. Viral virulence protein suppresses RNA silencing-mediated defense but upregulates the role of microrna in host gene expression Plant Cell May (Epub Apr. 20, 2004) 2004 1302-1313 16.
Yekta, S., I. H. Shih and D. P. Bartel. MicroRNA-directed cleavage of HOXB8 mRNA Science Apr. 23, 2004 594-596 304.

(Continued)

*Primary Examiner*—Richard Schnizer
(74) *Attorney, Agent, or Firm*—Polsinelli Shughart PC; Teddy C. Scott, Jr.; Paul A. Jenny

(57) ABSTRACT

Described herein are novel polynucleotides associated with viral infections. The polynucleotides are miRNAs and miRNA precursors. Related methods and compositions that can be used for diagnosis, prognosis, and treatment of those medical conditions are disclosed. Also described herein are methods that can be used to identify modulators of viral infections.

2 Claims, 6 Drawing Sheets

FOREIGN PATENT DOCUMENTS

| WO | WO 2005/023986 | 3/2005 |
|----|----------------|--------|
| WO | WO 2005/033271 | 4/2005 |
| WO | WO 2005/035769 | 4/2005 |
| WO | WO 2005/041859 | 5/2005 |
| WO | WO 2005/042705 | 5/2005 |

OTHER PUBLICATIONS

Lamontagne, B., R. N. Hannoush, M. J. Damha and S. Abou Elela. Molecular requirements for duplex recognition and cleavage by eukaryotic RNase III: discovery of an RNA-dependent DNA cleavage activity of yeast Rnt1p J Mol Biol Apr. 23, 2004 401-418 338.

Barrick, J. E., K. A. Corbino, W. C. Winkler, A. Nahvi, M. Mandal, J. Collins, M. Lee, A. Roth, N. Sudarsan, I. Jona, J. K. Wickiser and R. R. Breaker. New RNA motifs suggest an expanded scope for riboswitches in bacterial genetic control Proc Natl Acad Sci U S A Apr. 27, 2004 6421-6426 101.

Pfeffer, S., M. Zavolan, F. A. Grasser, M. Chien, J. J. Russo, J. Ju, B. John, A. J. Enright, D. Marks, C. Sander and T. Tuschl. Identification of virus-encoded microRNAs Science Apr. 30, 2004 734-736 304.

Dorsett, Y. and T. Tuschl. siRNAs: applications in functional genomics and potential as therapeutics Nat Rev Drug Discov Apr. 2004 318-329 3.

Mallory, A. C. and H. Vaucheret. MicroRNAs: something important between the genes Curr Opin Plant Biol Apr. 2004 120-125 7.

Ogita, S., H. Uefuji, M. Morimoto and H. Sano. Application of RNAi to confirm theobromine as the major intermediate for caffeine biosynthesis in coffee plants with potential for construction of decaffeinated varieties Plant Mol Biol Apr. 2004 931-941 54.

Storz, G., J. A. Opdyke and A. Zhang. Controlling mRNA stability and translation with small, noncoding RNAs Curr Opin Microbiol Apr. 2004 140-144 7.

Kim, V. N. MicroRNA precursors in motion: exportin-5 mediates their nuclear export Trends Cell Biol Apr. 2004 156-159 14.

Jabri, E. RISCy business Nat Struct Mol Biol Apr. 2004 300 11.

Nakahara, K. and R. W. Carthew. Expanding roles for miRNAs and siRNAs in cell regulation Curr Opin Cell Biol Apr. 2004 127-133 16.

Ota, A., H. Tagawa, S. Karnan, S. Tsuzuki, A. Karpas, S. Kira, Y. Yoshida and M. Seto. Identification and characterization of a novel gene, C13orf25, as a target for 13q31-q32 amplification in malignant lymphoma Cancer Res May 1, 2004 3087-3095 64.

Marillonnet, S., A. Giritch, M. Gils, R. Kandzia, V. Klimyuk and Y. Gleba. In planta engineering of viral RNA replicons: efficient assembly by recombination of DNA modules delivered by Agrobacterium Proc Natl Acad Sci U S A May 4, 2004 6852-6857 101.

Kiriakidou, M., P. T. Nelson, A. Kouranov, P. Fitziev, C. Bouyioukos, Z. Mourelatos and A. Hatzigeorgiou. A combined computational-experimental approach predicts human microRNA targets Genes Dev May 15, 2004 1165-1178 18.

Vaucheret, H., F. Vazquez, P. Crete and D. P. Bartel. The action of ARGONAUTE1 in the miRNA pathway and its regulation by the miRNA pathway are crucial for plant development Genes Dev May 15, 2004 1187-1197 18.

Chapman, E. J., A. I. Prokhnevsky, K. Gopinath, V. V. Dolja and J. C. Carrington. Viral RNA silencing suppressors inhibit the microRNA pathway at an intermediate step Genes Dev May 15, 2004 1179-1186 18.

Bejerano, G., M. Pheasant, I. Makunin, S. Stephen, W. J. Kent, J. S. Mattick and D. Haussler. Ultraconserved elements in the human genome Science May 28, 2004 1321-1325 304.

Tanzer, A. and P. F. Stadler. Molecular evolution of a microRNA cluster J Mol Biol May 28, 2004 327-335 339.

Pooggin, M. and T. Hohn. Fighting geminiviruses by RNAi and vice versa Plant Mol Biol May 2004 149-152 55.

Bartel, D. P. and C. Z. Chen. Micromanagers of gene expression: the potentially widespread influence of metazoan microRNAs Nat Rev Genet May 2004 396-400 5.

Dunoyer, P., C. H. Lecellier, E. A. Parizotto, C. Himber and O. Voinnet. Probing the microRNA and small interfering RNA pathways with virus-encoded suppressors of RNA silencing Plant Cell May (Epub Apr. 14, 2004(2004 1235-1250 16.

Arias, C. F., M. A. Dector, L. Segovia, T. Lopez, M. Camacho, P. Isa, R. Espinosa and S. Lopez. RNA silencing of rotavirus gene expression Virus Res Jun. 1, 2004 43-51 102.

Takamizawa, J., H. Konishi, K. Yanagisawa, S. Tomida, H. Osada, H. Endoh, T. Harano, Y. Yatabe, M. Nagino, Y. Nimura, T. Mitsudomi and T. Takahashi. Reduced expression of the let-7 microRNAs in human lung cancers in association with shortened postoperative survival Cancer Res Jun. 1, 2004 3753-3756 64.

Ge, Q., L. Filip, a. Bai, T. Nguyen, H. N. Eisen and J. Chen. Inhibition of influenza virus production in virus-infected mice by RNA interference Proc Natl Acad Sci U S A Jun. 8, 2004 8676- 8681 101.

Suh, M. R., Y. Lee, J. Y. Kim, S. K. Kim, S. H. Moon, J. Y. Lee, K. Y. Cha, H. M. Chung, H. S. Yoon, S. Y. Moon, V. N. Kim and K. S. Kim. Human embryonic stem cells express a unique set of microRNAs Dev Biol Jun. 15, 2004 488-498 270.

Cole, K., V. Truong, D. Barone and G. Mcgall. Direct labeling of Rna with multiple biotins allows sensitive expression profiling of acute leukemia class predictor genes Nucleic Acids Res Jun. 17, 2004 e86 32.

Jones-Rhoades, M. W. and D. P. Bartel. Computational identification of plant microRNAs and their targets, including a stress-induced miRNA Mol Cell Jun.18, 2004 787-799 14.

Mallory, A. C., D. V. Dugas, D. P. Bartel and B. Bartel. MicroRNA regulation of NAC-domain targets is required for proper formation and separation of adjacent embryonic, vegetative, and floral organs Curr Biol Jun. 22, 2004 1035-1046 14.

Liu, C. G., G. A. Calin, B. Meloon, N. Gamliel, C. Sevignani, M. Ferracin, C. D. Dumitru, M. Shimizu, S. Zupo, M. Dono, H. Alder, F. Bullrich, M. Negrini and C. M. Croce. An oligonucleotide microchip for genome-wide microRNA profiling in human and mouse tissues Proc Natl Acad Sci U S A Jun. 29, 2004 9740-9744 101.

Brandenberger, R., H. Wei, S. Zhang, S. Lei, J. Murage, G. J. Fisk, Y. Li, C. Xu, R. Fang, K. Guegler, M. S. Rao, R. Mandalam, J. Lebkowski and L. W. Stanton. Transcriptome characterization elucidates signaling networks that control human ES cell growth and differentiation Nat Biotechnol Jun. 2004 707-716 22.

Engstrom, E. M., A. Izhaki and J. L. Bowman. Promoter bashing, microRNAs, and Knox genes. New insights, regulators, and targets-of-regulation in the establishment of lateral organ polarity in Arabidopsis Plant Physiol Jun. 2004 685-694 135.

Murchison, E. P. and G. J. Hannon. miRNAs on the move: miRNA biogenesis and the RNAi machinery Curr Opin Cell Biol Jun. 2004 223-229 16.

Novina, C. D. and P. A. Sharp. The RNAi revolution Nature Jul. 8, 2004 161-164 430.

Ji, Y., X. Xu and G. D. Stormo. A graph theoretical approach for predicting common RNA secondary structure motifs including pseudoknots in unaligned sequences Bioinformatics Jul. 10, 2004 1591-1602 20.

Okamura, K., A. Ishizuka, H. Siomi and M. C. Siomi. Distinct roles for Argonaute proteins in small RNA-directed RNA cleavage pathways Genes Dev Jul. 15, 2004 1655-1666 18.

Karlas, A., R. Kurth and J. Denner. Inhibition of porcine endogenous retroviruses by RNA interference: increasing the safety of xenotransplantation Virology Jul. 20, 2004 18-23 325.

Kent, O. A. and A. M. MacMillan. RNAi: running interference for the cell Org Biomol Chem Jul. 21, 2004 1957-1961 2.

Souret, F. F., J. P. Kastenmayer and P. J. Green. AtXRN4 degrades mRNA in Arabidopsis and its substrates include selected miRNA targets Mol Cell Jul. 23, 2004 173-183 15.

Meister, G., M. Landthaler, A. Patkaniowska, Y. Dorsett, G. Teng and T. Tuschl. Human Argonaute2 mediates RNA cleavage targeted by miRNAs and siRNAs Mol Cell Jul. 23, 2004 185-197 15.

Allawi, H. T., J. E. Dahlberg, S. Olson, E. Lund, M. Olson, W. P. Ma, T. Takova, B. P. Neri and V. I. Lyamichev. Quantitation of microRNAs using a modified Invader assay Rna Jul. 2004 1153-1161 10.

Hall, J. Opinion: Unravelling the general properties of siRNAs: strength in numbers and lessons from the past Nat Rev Genet Jul. 2004 552-557 5.

Silvestri, L. S., Z. F. Taraporewala and J. T. Patton. Rotavirus replication: plus-sense templates for double-stranded RNA synthesis are made in viroplasms J Virol Jul. 2004 7763-7774 78.

He, L. and G. J. Hannon. MicroRNAs: small RNAs with a big role in gene regulation Nat Rev Genet Jul. 2004 522-531 5.

Achard, P., A. Herr, D. C. Baulcombe and N. P. Harberd. Modulation of floral development by a gibberellin-regulated microRNA Development Jul. 2004 3357-3365 131.

McHale, N. A. and R. E. Koning. MicroRNA-directed cleavage of Nicotiana sylvestris Phavoluta mRNA regulates the vascular cambium and structure of apical meristems Plant Cell Jul (Epub Jun. 11, 2004) 2004 1730-1740 16.

Bonnet, E., J. Wuyts, P. Rouze and Y. Van De Peer. Detection of 91 potential conserved plant microRNAs in Arabidopsis thaliana and Oryza sativa identifies important target genes Proc Natl Acad Sci U S A Aug. 3, 2004 11511-11516 101.

Calin, G. A., C. G. Liu, C. Sevignani, M. Ferracin, N. Felli, C. D. Dumitru, M. Shimizu, A. Cimmino, S. Zupo, M. Dono, M. L. Dell'Aquila, H. Alder, L. Rassenti, T. J. Kipps, F. Bullrich, M. Negrini and C. M. Croce. MicroRNA profiling reveals distinct signatures in B cell chronic lymphocytic leukemias Proc Natl Acad Sci U S A Aug. 10, 2004 11755-11760 101.

Chang, S., R. J. Johnston, Jr., C. Frokjaer-Jensen, S. Lockery and O. Hobert. MicroRNAs act sequentially and asymmetrically to control chemosensory laterality in the nematode Nature Aug. 12, 2004 785-789 430.

Mallory, A. C., B. J. Reinhart, M. W. Jones-Rhoades, G. Tang, P. D. Zamore, M. K. Barton and D. P. Bartel. MicroRNA control of Phabulosa in leaf development: importance of pairing to the microRNA 5' region Embo J Aug. 18, 2004 3356-3364 23.

Kurihara, Y. and Y. Watanabe. Arabidopsis micro-RNA biogenesis through Dicer-like 1 protein functions Proc Natl Acad Sci U S A Aug. 24, 2004 12753-12758 101.

Famulok, M. Chemical biology: green fluorescent Rna Nature Aug. 26, 2004 976-977 430.

Morris, K. V., S. W. Chan, S. E. Jacobsen and D. J. Looney. Small interfering RNA-induced transcriptional gene silencing in human cells Science Aug. 27, 2004 1289-1292 305.

Miska, E. A., E. Alvarez-Saavedra, M. Townsend, A. Yoshii, N. Sestan, P. Rakic, M. Constantine-Paton and H. R. Horvitz. Microarray analysis of microRNA expression in the developing mammalian brain Genome Biol Epub Aug. 31, 2004 R68 5.

Wang, X. J., J. L. Reyes, N. H. Chua and T. Gaasterland. Prediction and identification of Arabidopsis thaliana microRNAs and their mRNA targets Genome Biol Epub Aug. 31, 2004 2004 R65 5.

Bagasra, O. and K. R. Prilliman. RNA interference: the molecular immune system J Mol Histol Aug. 2004 545-553 35.

He, Z. and E. J. Sontheimer. "siRNAs and miRNAs": a meeting report on RNA silencing Rna Aug. 2004 1165-1173 10.

Luciano, D. J., H. Mirsky, N. J. Vendetti and S. Maas. RNA editing of a miRNA precursor Rna Aug. 2004 1174-1177 10.

Levanon, E. Y., E. Eisenberg, R. Yelin, S. Nemzer, M. Hallegger, R. Shemesh, Z. Y. Fligelman, A. Shoshan, S. R. Pollock, D. Sztybel, M. Olshansky, G. Rechavi and M. F. Jantsch. Systematic identification of abundant A-to-I editing sites in the human transcriptome Nat Biotechnol Aug. 2004 1001-1005 22.

Friedrich, I., A. Shir, S. Klein and A. Levitzki. RNA molecules as anti-cancer agents Semin Cancer Biol Aug. 2004 223-230 14.

Mathews, D. H. Using an RNA secondary structure partition function to determine confidence in base pairs predicted by free energy minimization Rna Aug. 2004 1178-1190 10.

Aravin, A. A., M. S. Klenov, V. V. Vagin, F. Bantignies, G. Cavalli and V. A. Gvozdev. Dissection of a natural RNA silencing process in the Drosophila melanogaster germ line Mol Cell Biol Aug. 2004 6742-6750 24.

Sunkar, R. and J. K. Zhu. Novel and stress-regulated microRNAs and other small RNAs from Arabidopsis Plant Cell Aug (Epub Jul. 16, 2004) 2004 2001-2019 16.

Yoo, B. C., F. Kragler, E. Varkonyi-Gasic, V. Haywood, S. Archer-Evans, Y. M. Lee, T. J. Lough and W. J. Lucas. A systemic small RNA signaling system in plants Plant Cell Aug (Epub Jul. 16, 2004) 2004 1979-2000 16.

Gooch, B. D. and P. A. Beal. Recognition of duplex RNA by helix-threading peptides J Am Chem Soc Sep. 1, 2004 10603-10610 126.

Liu, J., M. A. Carmell, F. V. Rivas, C. G. Marsden, J. M. Thomson, J. J. Song, S. M. Hammond, L. Joshua-Tor and G. J. Hannon. Argonaute2 is the catalytic engine of mammalian RNAi Science Sep. 3, 2004 1437-1441 305.

Sontheimer, E. J. and R. W. Carthew. Molecular biology. Argonaute journeys into the heart of RISC Science Sep. 3, 2004 1409-1410 305.

Song, J. J., S. K. Smith, G. J. Hannon and L. Joshua-Tor. Crystal structure of Argonaute and its implications for RISC slicer activity Science Sep. 3, 2004 1434-1437 305.

Zeng, Y. and B. R. Cullen. Structural requirements for pre-microRNA binding and nuclear export by Exportin 5 Nucleic Acids Res Sep. 8, 2004 4776-4785 32.

Parizotto, E. A., P. Dunoyer, N. Rahm, C. Himber and O. Voinnet. In vivo investigation of the transcription, processing, endonucleolytic activity, and functional relevance of the spatial distribution of a plant miRNA Genes Dev Sep. 15, 2004 2237-2242 18.

Ambros, V. The functions of animal microRNAs Nature Sep. 16, 2004 350-355 431.

Baulcombe, D. RNA silencing in plants Nature Sep. 16, 2004 356-363 431.

Meister, G. and T. Tuschl. Mechanisms of gene silencing by double-stranded RNA Nature Sep. 16, 2004 343-349 431.

Kasashima, K., Y. Nakamura and T. Kozu. Altered expression profiles of microRNAs during TPA-induced differentiation of HL-60 cells Biochem Biophys Res Commun Sep. 17, 2004 403-410 322.

Smalheiser, N. R. and V. I. Torvik. A population-based statistical approach identifies parameters characteristic of human microRNA-mRNA interactions Bmc Bioinformatics Sep. 28, 2004 139 5.

Baba, S., M. Kajikawa, N. Okada and G. Kawai. Solution structure of an RNA stem-loop derived from the 3' conserved region of eel LINE UnaL2 Rna Sep. 2004 1380-1387 10.

Bowman, J. L. Class III HD-Zip gene regulation, the golden fleece of Argonaute activity? Bioessays Sep. 2004 938-942 26.

Ohler, U., S. Yekta, L. P. Lim, D. P. Bartel and C. B. Burge. Patterns of flanking sequence conservation and a characteristic upstream motif for microRNA gene identification Rna Sep. 2004 1309-1322 10.

Simmonds, P., A. Tuplin and D. J. Evans. Detection of genome-scale ordered RNA structure (GORS) in genomes of positive-stranded RNA viruses: Implications for virus evolution and host persistence Rna Sep. 2004 1337-1351 10.

Seitz, H., H. Royo, M. L. Bortolin, S. P. Lin, A. C. Ferguson-Smith and J. Cavaille. A large imprinted microRNA gene cluster at the mouse Dlk1-Gt12 domain Genome Res Sep. 2004 1741-1748 14.

Hobert, O. Common logic of transcription factor and microRNA action Trends Biochem Sci Sep. 2004 462-468 29.

Laufs, P., A. Peaucelle, H. Morin and J. Traas. MicroRNA regulation of the CUC genes is required for boundary size control in Arabidopsis meristems Development Sep. 2004 4311-4322 131.

Rye, P. D. and T. Stigbrand. Interfering with cancer: a brief outline of advances in RNA interference in oncology Tumour Biol Sep.-Dec. 2004 329-336 25.

Sigova, A., N. Rhind and P. D. Zamore. A single Argonaute protein mediates both transcriptional and posttranscriptional silencing in Schizosaccharomyces pombe Genes Dev Oct. 1, 2004 2359-2367 18.

Lee, Y., M. Kim, J. Han, K. H. Yeom, S. Lee, S. H. Baek and V. N. Kim. MicroRNA genes are transcribed by RNA polymerase II Embo J Oct. 13, 2004 4051-4060 23.

Nelson, P. T., D. A. Baldwin, L. M. Scearce, J. C. Oberholtzer, J. W. Tobias and Z. Mourelatos. Microarray-based, high-throughput gene expression profiling of microRNAs Nat Methods Oct 21 2004 155-161 1.

Kadotani, N., H. Nakayashiki, Y. Tosa and S. Mayama. One of the two Dicer-like proteins in the filamentous fungi Magnaporthe oryzae genome is responsible for hairpin RNA-triggered RNA silencing and related small interfering RNA accumulation J Biol Chem Oct. 22, 2004 44467-44474 279.

Duensing, S., A. Duensing, D. C. Lee, K. M. Edwards, S. O. Piboonniyom, E. Manuel, L. Skaltsounis, L. Meijer and K. Munger. Cyclin-dependent kinase inhibitor indirubin-3'-oxime selectively inhibits human papillomavirus type 16 E7-induced numerical centrosome anomalies Oncogene Oct. 28, 2004 8206-8215 23.

Antonarakis, S. E., R. Lyle, E. T. Dermitzakis, A. Reymond and S. Deutsch. Chromosome 21 and down syndrome: from genomics to pathophysiology Nat Rev Genet Oct. 2004 725-738 5.

Altuvia, S. Regulatory small RNAs: the key to coordinating global regulatory circuits J Bacteriol Oct. 2004 6679-6680 186.

Bracht, J., S. Hunter, R. Eachus, P. Weeks and A. E. Pasquinelli. Trans-splicing and polyadenylation of let-7 microRNA primary transcripts Rna Oct. 2004 1586-1594 10.

Cobb, J. and D. Duboule. Tracing microRNA patterns in mice Nat Genet Oct. 2004 1033-1034 36.

Duxbury, M. S., E. Matros, H. Ito, M. J. Zinner, S. W. Ashley and E. E. Whang. Systemic siRNA-mediated gene silencing: a new approach to targeted therapy of cancer Ann Surg Oct. 2004 667-674; discussion 675-666 240.

Dugas, D. V. and B. Bartel. MicroRNA regulation of gene expression in plants Curr Opin Plant Biol Oct. 2004 512-520 7.

Howard, M. T., R. F. Gesteland and J. F. Atkins. Efficient stimulation of site-specific ribosome frameshifting by antisense oligonucleotides Rna Oct. 2004 1653-1661 10.

Isken, O., C. W. Grassmann, H. Yu and S. E. Behrens. Complex signals in the genomic 3' nontranslated region of bovine viral diarrhea virus coordinate translation and replication of the viral RNA Rna Oct. 2004 1637-1652 10.

Mansfield, J. H., B. D. Harfe, R. Nissen, J. Obenauer, J. Srineel, A. Chaudhuri, R. Farzan-Kashani, M. Zuker, A. E. Pasquinelli, G. Ruvkun, P. A. Sharp, C. J. Tabin and M. T. McManus. MicroRNA-responsive 'sensor' transgenes uncover Hox-like and other developmentally regulated patterns of vertebrate microRNA expression Nat Genet Oct. 2004 1079-1083 36.

Opdyke, J. A., J. G. Kang and G. Storz. GadY, a small-Rna regulator of acid response genes in Escherichia coli J Bacteriol Oct. 2004 6698-6705 186.

Rehmsmeier, M., P. Steffen, M. Hochsmann and R. Giegerich. Fast and effective prediction of microRNA/target duplexes Rna Oct. 2004 1507-1517 10.

Rodriguez, A., S. Griffiths-Jones, J. L. Ashurst and A. Bradley. Identification of mammalian microRNA host genes and transcription units Genome Res Oct. 2004 1902-1910 14.

Pillai, R. S., C. G. Artus and W. Filipowicz. Tethering of human Ago proteins to mRNA mimics the miRNA-mediated repression of protein synthesis Rna Oct. 2004 1518-1525 10.

Stix, G. Hitting the genetic off switch Sci Am Oct. 2004 98-101 291.

Chen, S., A. Zhang, L. B. Blyn and G. Storz. MicC, a second small-RNA regulator of Omp protein expression in Escherichia coli J Bacterial Oct. 2004 6689-6697 186.

Gebauer, F. and M. W. Hentze. Molecular mechanisms of translational control Nat Rev Mol Cell Biol Oct. 2004 827-835 5.

Jones, S. W., P. M. Souza and M. A. Lindsay. siRNA for gene silencing: a route to drug target discovery Curr Opin Pharmacol Oct. 2004 522-527 4.

Mattick, J. S. The hidden genetic program of complex organisms Sci Am Oct. 2004 60-67 291.

Trainor, P. A. Developmental biology is "Cruzing" Dev Cell Oct. 2004 481-486 7.

Arai, R., K. Ito, M. Wakiyama, E. Matsumoto, A. Sakamoto, Y. Etou, M. Otsuki, M. Inoue, Y. Hayashizaki, M. Miyagishi, K. Taira, M. Shirouzu and S. Yokoyama. Establishment of stable hFis1 knockdown cells with an siRNA expression vector J Biochem (Tokyo) Oct. 2004 421-425 136.

Thomson, J. M., J. Parker, C. M. Perou and S. M. Hammond. A custom microarray platform for analysis of microRNA gene expression Nat Methods Oct (Epub Sep. 29, 2004) 2004 47-53 1.

Krol, J., K. Sobczak, U. Wilczynska, M. Drath, A. Jasinska, D. Kaczynska and W. J. Krzyzosiak. Structural features of microRNA (miRNA) precursors and their relevance to miRNA biogenesis and small interfering RNA/short hairpin RNA design J Biol Chem Oct. 1 (Epub Aug. 2, 2004) 2004 42230-42239 279.

Shen, B. and H. M. Goodman. Uridine addition after microRNA-directed cleavage Science Nov. 5, 2004 997 306.

Davidson, T. J., S. Harel, V. A. Arboleda, G. F. Prunell, M. L. Shelanski, L. A. Greene and C. M. Troy. Highly efficient small interfering RNA delivery to primary mammalian neurons induces MicroRNA-like effects before mRNA degradation J Neurosci Nov. 10, 2004 10040-10046 24.

Ying, S. Y. and S. L. Lin. Intron-derived microRNAs—fine tuning of gene functions Gene Nov. 10, 2004 25-28 342.

Denli, A. M., B. B. Tops, R. H. Plasterk, R. F. Ketting and G. J. Hannon. Processing of primary microRNAs by the Microprocessor complex Nature Nov. 11, 2004 231-235 432.

Gregory, R. I., K. P. Yan, G. Amuthan, T. Chendrimada, B. Doratotaj, N. Cooch and R. Shiekhattar. The Microprocessor complex mediates the genesis of microRNAs Nature Nov. 11, 2004 235-240 432.

Poy, M. N., L. Eliasson, J. Krutzfeldt, S. Kuwajima, X. Ma, P. E. Macdonald, S. Pfeffer, T. Tuschl, N. Rajewsky, P. Rorsman and M. Stoffel. A pancreatic islet-specific microRNA regulates insulin secretion Nature Nov. 11, 2004 226-230 432.

Soutschek, J., A. Akinc, B. Bramlage, K. Charisse, R. Constien, M. Donoghue, S. Elbashir, A. Geick, P. Hadwiger, J. Harborth, M. John, V. Kesavan, G. Lavine, R. K. Pandey, T. Racie, K. G. Rajeev, I. Rohl, I. Toudjarska, G. Wang, S. Wuschko, D. Bumcrot, V. Koteliansky, S. Limmer, M. Manoharan and H. P. Vornlocher. Therapeutic silencing of an endogenous gene by systemic administration of modified siRNAs Nature Nov. 11, 2004 173-178 432.

Couzin, J. Molecular biology. RNAi shows cracks in its armor Science Nov. 12, 2004 1124-1125 306.

Rao, M. Conserved and divergent paths that regulate self-renewal in mouse and human embryonic stem cells Dev Biol Nov. 15, 2004 269-286 275.

Tomari, Y., C. Matranga, B. Haley, N. Martinez and P. D. Zamore. A protein sensor for siRNA asymmetry Science Nov. 19, 2004 1377-1380 306.

Belostotsky, D. mRNA turnover meets RNA interference Mol Cell Nov. 19, 2004 498-500 16.

Bonnet, E., J. Wuyts, P. Rouze and Y. Van De Peer. Evidence that microRNA precursors, unlike other non-coding RNAs, have lower folding free energies than random sequences Bioinformatics Nov. 22, 2004 2911-2917 20.

Koziczak, M. and N. E. Hynes. Cooperation between fibroblast growth factor receptor-4 and ErbB2 in regulation of cyclin D1 translation J Biol Chem Nov. 26 (Epub Sep. 17, 2004) 2004 50004-50011 279.

Esquela-Kerscher, A. and F. J. Slack. The age of high-throughput microRNA profiling Nat Methods Nov. 2004 106-107 1.

Jackson, A. L. and P. S. Linsley. Noise amidst the silence: off-target effects of siRNAs? Trends Genet Nov. 2004 521-524 20.

Huang, M., Y. Wang, M. Collins and L. M. Graves. CPEC induces erythroid differentiation of human myeloid leukemia K562 cells through CTP depletion and p38 MAP kinase Leukemia Nov. 2004 1857-1863 18.

Lovett-Racke, A. E., A. E. Rocchini, J. Choy, S. C. Northrop, R. Z. Hussain, R. B. Ratts, D. Sikder and M. K. Racke. Silencing T-bet defines a critical role in the differentiation of autoreactive T lymphocytes Immunity Nov. 2004 719-731 21.

Jin, P., R. S. Alisch and S. T. Warren. RNA and microRNAs in fragile X mental retardation Nat Cell Biol Nov. 2004 1048-1053 6.

John, B., A. J. Enright, A. Aravin, T. Tuschl, C. Sander and D. S. Marks. Human MicroRNA targets PLoS Biol Nov. 2004 e363 2.

Bao, N., K. W. Lye and M. K. Barton. MicroRNA binding sites in Arabidopsis class III HD-ZIP MRNAs are required for methylation of the template chromosome Dev Cell Nov. 2004 653-662 7.

Eshed, Y. and J. L. Bowman. MicroRNAs guide asymmetric DNA modifications guiding asymmetric organs Dev Cell Nov. 2004 629-630 7.

Babak, T., W. Zhang, Q. Morris, B. J. Blencowe and T. R. Hughes. Probing microRNAs with microarrays: tissue specificity and functional inference Rna Nov. 2004 1813-1819 10.

Chattopadhyay, S., Y. Wang, R. Zhao and I. D. Goldman. Lack of impact of the loss of constitutive folate receptor alpha expression, achieved by RNA Interference, on the activity of the new generation antifolate pemetrexed in HeLa cells Clin Cancer Res Dec. 1, 2004 7986-7993 10.

O'Loghlen, A., V. M. Gonzalez, M. Salinas and M. E. Martin. Suppression of human Mnk1 by small interfering RNA increases the eukaryotic initiation factor 4F activity in HEK293T cells FEBS Lett Dec. 3, 2004 31-35 578.

Esau, C., X. Kang, E. Peralta, E. Hanson, E. G. Marcusson, L. V. Ravichandran, Y. Sun, S. Koo, R. J. Perera, R. Jain, N. M. Dean, S. M. Freier, C. F. Bennett, B. Lollo and R. Griffey. MicroRNA-143 regulates adipocyte differentiation J Biol Chem Dec. 10, 2004 52361-52365 279.

Valoczi, A., C. Hornyik, N. Varga, J. Burgyan, S. Kauppinen and Z. Havelda. Sensitive and specific detection of microRNAs by northern blot analysis using LNA-modified oligonucleotide probes Nucleic Acids Res Dec. 14, 2004 e175 32.

Landthaler, M., A. Yalcin and T. Tuschl. The human DiGeorge syndrome critical region gene 8 and Its D. melanogaster homolog are required for miRNA biogenesis Curr Biol Dec. 14, 2004 2162-2167 14.

Bennasser, Y., S. Y. Le, M. L. Yeung and K. T. Jeang. HIV-1 encoded candidate micro-RNAs and their cellular targets Retrovirology Dec. 15, 2004 43 1.

Han, J., Y. Lee, K. H. Yeom, Y. K. Kim, H. Jin and V. N. Kim. The Drosha-DGCR8 complex in primary microRNA processing Genes Dev Dec. 15, 2004 3016-3027 18.

Omoto, S., M. Ito, Y. Tsutsumi, Y. Ichikawa, H. Okuyama, E. A. Brisibe, N. K. Saksena and Y. R. Fujii. HIV-1 nef suppression by virally encoded microRNA Retrovirology Dec. 15, 2004 44 1.

Jin, W. and G. J. Cote. Enhancer-dependent splicing of FGFR1 alpha-exon is repressed by RNA interference-mediated down-regulation of SRp55 Cancer Res Dec. 15, 2004 8901-8905 64.

Cullen, B. R. Transcription and processing of human microRNA precursors Mol Cell Dec. 22, 2004 861-865 16.

Sun, Y., S. Koo, N. White, E. Peralta, C. Esau, N. M. Dean and R. J. Perera. Development of a micro-array to detect human and mouse microRNAs and characterization of expression in human organs Nucleic Acids Res Dec. 22, 2004 e188 32.

Kittler, R., G. Putz, L. Pelletier, I. Poser, A. K. Heninger, D. Drechsel, S. Fischer, I. Konstantinova, B. Habermann, H. Grabner, M. L. Yaspo, H. Himmelbauer, B. Korn, K. Neugebauer, M. T. Pisabarro and F. Buchholz. An endoribonuclease-prepared siRNA screen in human cells identifies genes essential for cell division Nature Dec. 23, 2004 1036-1040 432.

Bignold, L. P. The cell-type-specificity of inherited predispositions to tumours: review and hypothesis Cancer Lett Dec. 28, 2004 127-146 216.

Rapozzi, V. and L. E. Xodo. Efficient silencing of bcr/abl oncogene by single- and double-stranded siRNAs targeted against b2a2 transcripts Biochemistry Dec. 28, 2004 16134-16141 43.

Kanatsu-Shinohara, M., K. Inoue, J. Lee, M. Yoshimoto, N. Ogonuki, H. Miki, S. Baba, T. Kato, Y. Kazuki, S. Toyokuni, M. Toyoshima, O. Niwa, M. Oshimura, T. Heike, T. Nakahata, F. Ishino, A. Ogura and T. Shinohara. Generation of pluripotent stem cells from neonatal mouse testis Cell Dec. 29, 2004 1001-1012 119.

Agrawal, S. and E. R. Kandimalla. Role of Toll-like receptors in antisense and siRNA [corrected] Nat Biotechnol Dec. 2004 1533-1537 22.

Bantounas, I., L. A. Phylactou and J. B. Uney. RNA interference and the use of small interfering RNA to study gene function in mammalian systems J Mol Endocrinol Dec. 2004 545-557 33.

Barad, O., E. Meiri, A. Avniel, R. Aharonov, A. Barzilai, I. Bentwich, U. Einav, S. Gilad, P. Hurban, Y. Karov, E. K. Lobenhofer, E. Sharon, Y. M. Shiboleth, M. Shtutman, Z. Bentwich and P. Einat. MicroRNA expression detected by oligonucleotide microarrays: system establishment and expression profiling in human tissues Genome Res Dec. 2004 2486-2494 14.

Komano, J., K. Miyauchi, Z. Matsuda and N. Yamamoto. Inhibiting the Arp2/3 complex limits infection of both intracellular mature vaccinia virus and primate lentiviruses Mol Biol Cell Dec. 2004 5197-5207 15.

Lu, S. and B. R. Cullen. Adenovirus VA1 noncoding RNA can inhibit small interfering RNA and MicroRNA biogenesis AJ Virol Dec. 2004 12868-12876 78.

Ostberg, Y., I. Bunikis, S. Bergstrom and J. Johansson. The etiological agent of Lyme disease, Borrelia burgdorferi, appears to contain only a few small RNA molecules J Bacteriol Dec. 2004 8472-8477 186.

Shi, H., N. Chamond, C. Tschudi and E. Ullu. Selection and characterization of RNA interference-deficient trypanosomes impaired in target mRNA degradation Eukaryot Cell Dec. 2004 1445-1453 3.

Tan, F. L. And J. Q. Yin. RNAi, a new therapeutic strategy against viral infection Cell Res Dec. 2004 460-466 14.

Vella, M. C., K. Reinert and F. J. Slack. Architecture of a validated microRNA:target interaction Chem Biol Dec. 2004 1619-1623 11.

Allen, E., Z. Xie, A. M. Gustafson, G. H. Sung, J. W. Spatafora and J. C. Carrington. Evolution of microRNA genes by inverted duplication of target gene sequences in Arabidopsis thaliana Nat Genet Dec. 2004 1282-1290 36.

Xu, P., M. Guo and B. A. Hay. MicroRNAs and the regulation of cell death Trends Genet Dec. 2004 617-624 20.

Cai, X., C. H. Hagedorn and B. R. Cullen. Human microRNAs are processed from capped, polyadenylated transcripts that can also function as mRNAs Rna Dec (Epub Nov. 3, 2004) 2004 1957-1966 10.

Chang, J., E. Nicolas, D. Marks, C. Sander, A. Lerro, M. Annick Buendia, C. Xu, W. S. Mason, T. Moloshok, R. Bort, K. S. Zaret and J. M. Taylor. miR-122, a Mammalian Liver-Specific microRNA, is Processed from her mRNA and May Downregulate the High Affinity Cationic Amino Acid Transporter CAT-1 2004 106 1.

Gershon, D. Microarrays go mainstream Nature Methods 2004 263 1.

Joseph, R., A. Krichevsky, K. S. Kosik and R. Manchanda. Validation of miRNA microarray data using Micromax ASAP miRNA chemical labeling kit by Northern blot analysis PerkinElmer Life and Analytical Sciences 2004 1 6938.

Lund, E., S. Guttinger, A. Calado, J. E. Dahlberg and U. Kutay. Nuclear export of microRNA precursors Science Jan. 2 (Epub Nov. 20, 2003) 2004 95-98 303.

Matzke, M., W. Aufsatz, T. Kanno, L. Daxinger, I. Papp, M. F. Mette and A. J. Matzke. Genetic analysis of RNA-mediated transcriptional gene silencing 2004 129 1677.

Paradigmgenetics, I. Market Exploration: MicroRNAs Final Report 2004 1.

Soreq, H. and S. Seidman. Antisense approach to isoform specific blockade of acetylcholinesterase 2004 1.

Wang, L. C., O. C. Yen and E. Zandi. TNFa-dependent drug resistance to purine and pyrimidine analogues in human colon tumor cells mediated through IKK J.Biol Chem. 2004.

Hardy, J. Toward Alzheimer therapies based on genetic knowledge Annu Rev Med 2004 15-25 55.

Shabalina, S. A. and N. A. Spiridonov. The mammalian transcriptome and the function of non-coding DNA sequences Genome Biol 2004 105 5.

Gustafson, A. M., E. Allen, S. Givan, D. Smith, J. C. Carrington and K. D. Kasschau. ASRP: the Arabidopsis Small RNA Project Database Nucleic Acids Res Jan. 1, 2005 D637-640 33.

Pang, K. C., S. Stephen, P. G. Engstrom, K. Tajul-Arifin, W. Chen, C. Wahlestedt, B. Lenhard, Y. Hayashizaki and J. S. Mattick. RNAdb—a comprehensive mammalian noncoding RNA database Nucleic Acids Res Jan. 1, 2005 D125-130 33.

Einav, Y., R. Agami and D. Canaani. shRNA-mediated RNA interference as a tool for genetic synthetic lethality screening in mouse embryo fibroblasts FEBS Lett Jan. 3, 2005 199-202 579.

Sugiyama, T., H. Cam, A. Verdel, D. Moazed and S. I. Grewal. RNA-dependent RNA polymerase is an essential component of a self-enforcing loop coupling heterochromatin assembly to siRNA production Proc Natl Acad Sci U S A Jan. 4, 2005 152-157 102.

Huppi, K., S. E. Martin and N. J. Caplen. Defining and assaying RNAi in mammalian cells Mol Cell Jan. 7, 2005 1-10 17.

Zeng, Y., R. Yi and B. R. Cullen. Recognition and cleavage of primary microRNA precursors by the nuclear processing enzyme Drosha Embo J Jan. 12, 2005 138-148 24.

Tops, B. B., H. Tabara, T. Sijen, F. Simmer, C. C. Mello, R. H. Plasterk and R. F. Ketting. RDE-2 interacts with MUT-7 to mediate RNA interference in Caenorhabditis elegans Nucleic Acids Res Jan. 13, 2005 347-355 33.

Elmen, J., H. Thonberg, K. Ljungberg, M. Frieden, M. Westergaard, Y. Xu, B. Wahren, Z. Liang, H. Orum, T. Koch and C. Wahlestedt. Locked nucleic acid (LNA) mediated improvements in siRNA stability and functionality Nucleic Acids Res Jan. 14, 2005 439-447 33.

Lewis, B. P., C. B. Burge and D. P. Bartel. Conserved seed pairing, often flanked by adenosines, indicates that thousands of human genes are microRNA targets Cell Jan. 14, 2005 15-20 120.

Berezikov, E., V. Guryev, J. Van De Belt, E. Wienholds, R. H. Plasterk and E. Cuppen. Phylogenetic shadowing and computational identification of human microRNA genes Cell Jan. 14, 2005 21-24 120.

Tanzer, A., C. T. Amemiya, C. B. Kim and P. F. Stadler. Evolution of microRNAs located within Hox gene clusters J Exp Zoolog B Mol Dev Evol Jan. 15, 2005 75-85 304.

Yun, M. S., S. E. Kim, S. H. Jeon, J. S. Lee and K. Y. Choi. Both ERK and Wnt/beta-catenin pathways are involved in Wnt3a-induced proliferation J Cell Sci Jan. 15, 2005 313-322 118.

Watanabe, T., A. Takeda, K. Mise, T. Okuno, T. Suzuki, N. Minami and H. Imai. Stage-specific expression of microRNAs during Xenopus development FEBS Lett Jan. 17, 2005 318-324 579.

Ying, S. Y. and S. L. Lin. Intronic microRNAs Biochem Biophys Res Commun Jan. 21, 2005 515- 520 326.

Tomari, Y. and P. D. Zamore. MicroRNA biogenesis: drosha can't cut it without a partner Curr Biol Jan. 26, 2005 R61-64 15.

Fan, Q. W. and W. A. Weiss. RNA interference against a glioma-derived allele of EGFR induces blockade at G2M Oncogene Jan. 27, 2005 829-837 24.

Liang, R. Q., W. Li, Y. Li, C. Y. Tan, J. X. Li, Y. X. Jin and K. C. Ruan. An oligonucleotide microarray for microRNA expression analysis based on labeling RNA with quantum dot and nanogold probe Nucleic Acids Res Jan. 31, 2005 e17 33.

Akaneya, Y., B. Jiang and T. Tsumoto. RNAi-induced gene silencing by local electroporation in targeting brain region J Neurophysiol Jan. 2005 594-602 93.

Adai, A., C. Johnson, S. Mlotshwa, S. Archer-Evans, V. Manocha, V. Vance and V. Sundaresan. Computational prediction of miRNAs in Arabidopsis thaliana Genome Res Jan. 2005 78-91 15.

Alibu, V. P., L. Storm, S. Haile, C. Clayton and D. Horn. A doubly inducible system for RNA interference and rapid RNAi plasmid construction in Trypanosoma brucei Mol Biochem Parasitol Jan. 2005 75-82 139.

Alsford, S., L. Glover and D. Horn. Multiplex analysis of RNA interference defects in Trypanosoma brucei Mol Biochem Parasitol Jan. 2005 129-132 139.

Bedell, J. A., M. A. Budiman, A. Nunberg, R. W. Citek, D. Robbins, J. Jones, E. Flick, T. Rholfing, J. Fries, K. Bradford, J. McMenamy, M. Smith, H. Holeman, B. A. Roe, G. Wiley, I. F. Korf, P. D. Rabinowicz, N. Lakey, W. R. McCombie, J. A. Jeddeloh and R. A. Martienssen. Sorghum genome sequencing by methylation filtration PLoS Biol Jan. 2005 e13 3.

Hansen, K. R., G. Burns, J. Mata, T. A. Volpe, R. A. Martienssen, J. Bahler and G. Thon. Global effects on gene expression in fission yeast by silencing and RNA interference machineries Mol Cell Biol Jan. 2005 590-601 25.

Soldan, S. S., M. L. Plassmeyer, M. K. Matukonis and F. Gonzalez-Scarano. La Crosse virus nonstructural protein NSs counteracts the effects of short interfering RNA J Virol Jan. 2005 234-244 79.

Taylor, J. A. and N. V. Naoumov. The potential of RNA interference as a tool in the management of viral hepatitis J Hepatol Jan. 2005 139-144 42.

Wu, C. J., H. W. Huang, C. Y. Liu, C. F. Hong and Y. L. Chan. Inhibition of SARS-CoV replication by siRNA Antiviral Res Jan. 2005 45-48 65.

Weber, M. J. New human and mouse microRNA genes found by homology search Febs J Jan. 2005 59-73 272.

Zhang, Y. Q. and K. Broadie. Fathoming fragile X in fruit flies Trends Genet Jan. 2005 37-45 21.

Gitlin, L., J. K. Stone and R. Andino. Poliovirus escape from RNA interference: short interfering RNA-target recognition and implications for therapeutic approaches J Virol Jan. 2005 1027-1035 79.

Kan, L. and J. A. Kessler. New tool for an old problem: can RNAi efficiently resolve the issue of genetic redundancy? Bioessays Jan. 2005 14-16 27.

Pfeffer, S., A. Sewer, M. Lagos-Quintana, R. Sheridan, C. Sander, F. A. Grasser, L. F. Van Dyk, C. K. Ho, S. Shuman, M. Chien, J. J. Russo, J. Ju, G. Randall, B. D. Lindenbach, C. M. Rice, V. Simon, D. D. Ho, M. Zavolan and T. Tuschl. Identification of microRNAs of the herpesvirus family Nat Methods Feb. 16, 2005 269-276 2.

Saito, Y. and S. Dzik. Gene knockdown: RNA-interference is coming of age Transfusion Jan. 2005 111-114 45.

Scherr, M., K. Battmer, B. Schultheis, A. Ganser and M. Eder. Stable RNA interference (RNAi) as an option for anti-bcr-abl therapy Gene Ther Jan. 2005 12-21 12.

Article Weber, W., L. Malphettes, M. Rinderknecht, R. G. Schoenmakers, M. Spielmann, B. Keller, P. Van De Wetering, C. C. Weber and M. Fussenegger. Quorum-sensing-based toolbox for regulatable transgene and siRNA expression in mammalian cells Biotechnol Prog Jan.-Feb. 2005 178-185 21.

Zhang, W., H. Yang, X. Kong, S. Mohapatra, H. San Juan-Vergara, G. Hellermann, S. Behera, R. Singam, R. F. Lockey and S. S. Mohapatra. Inhibition of respiratory syncytial virus infection with intranasal siRNA nanoparticles targeting the viral NS1 gene Nat Med Jan. 2005 56-62 11.

Bitko, V., A. Musiyenko, O. Shulyayeva and S. Barik. Inhibition of respiratory viruses by nasally administered siRNA Nat Med Jan; Epub Dec. 26, 2004 50-55 11.

Article Weber, W., L. Malphettes, M. Rinderknecht, R. G. Schoenmakers, M. Spielmann, B. Keller, P. Van De Wetering, C. C. Weber and M. Fussenegger. Quorumsensing-based toolbox for regulatable transgene and siRNA expression in mammalian cells Biotechnol Prog Jan.-Feb. 2005 178-185 21.

Dresios, J., A. Aschrafi, G. C. Owens, P. W. Vanderklish, G. M. Edelman and V. P. Mauro. Cold stress-induced protein Rbm3 binds 60S ribosomal subunits, alters microRNA levels, and enhances global protein synthesis Proc Natl Acad Sci U S A Feb. 8, 2005 1865-1870 102.

Yu, B., Z. Yang, J. Li, S. Minakhina, M. Yang, R. W. Padgett, R. Steward and X. Chen. Methylation as a crucial step in plant microRNA biogenesis Science Feb. 11, 2005 932-935 307.

Kanellopoulou, C., S. A. Muljo, A. L. Kung, S. Ganesan, R. Drapkin, T. Jenuwein, D. M. Livingston and K. Rajewsky. Dicer-deficient mouse embryonic stem cells are defective in differentiation and centromeric silencing Genes Dev Feb. 15, 2005 489-501 19.

Pfeffer, S., A. Sewer, M. Lagos-Quintana, R. Sheridan, C. Sander, F. A. Grasser, L. F. Van Dyk, C. K. Ho, S. Shuman, M. Chien, J. J. Russo, J. Ju, G. Randall, B. D. Lindenbach, C. M. Rice, V. Simon, D. D. Ho, M. Zavolan and T. Tuschl. Identification of microRNAs of the herpesvirus family Nat Methods Feb. 16, 2005 269-276 2.

Lim, L. P., N. C. Lau, P. Garrett-Engele, A. Grimson, J. M. Schelter, J. Castle, D. P. Bartel, P. S. Linsley and J. M. Johnson. Microarray analysis shows that some microRNAs downregulate large numbers of target mRNAs Nature Feb. 17, 2005 769-773 433.

Xiao, Z., J. Xue, T. J. Sowin, S. H. Rosenberg and H. Zhang. A novel mechanism of checkpoint abrogation conferred by Chk1 downregulation Oncogene Feb. 17, 2005 1403-1411 24.

Shah, S., S. Rangarajan and S. H. Friedman. Light-activated RNA interference Angew Chem Int Ed Engl Feb. 18, 2005 1328-1332 44.

Karube, Y., H. Tanaka, H. Osada, S. Tomida, Y. Tatematsu, K. Yanagisawa, Y. Yatabe, J. Takamizawa, S. Miyoshi, T. Mitsudomi and T. Takahashi. Reduced expression of Dicer associated with poor prognosis in lung cancer patients Cancer Sci Feb. 2005 111-115 96.

Teixeira, M. R. and S. Heim. Multiple numerical chromosome aberrations in cancer: what are their causes and what are their consequences? Semin Cancer Biol Feb. 2005 3-12 15.

Kidner, C. A. and R. A. Martienssen. The developmental role of microRNA in plants Curr Opin Plant Biol Feb. 2005 38-44 8.

Li, Y., W. Li and Y. X. Jin. Computational identification of novel family members of microRNA genes in Arabidopsis thaliana and Oryza sativa Acta Biochim Biophys Sin (Shanghai) Feb. 2005 75-87 37.

Robb, G. B., K. M. Brown, J. Khurana and T. M. Rana. Specific and potent RNAi in the nucleus of human cells Nat Struct Mol Biol Feb. 2005 133-137 12.

Tang, G. siRNA and miRNA: an insight into RISCs Trends Biochem Sci Feb. 2005 106-114 30.

Westhof, E. and W. Filipowicz. From RNAi to epigenomes: how RNA rules the world Chembiochem Feb. 2005 441-443 6.

Kim, D. H., M. A. Behlke, S. D. Rose, M. S. Chang, S. Choi and J. J. Rossi. Synthetic dsRNA Dicer substrates enhance RNAi potency and efficacy Nat Biotechnol Feb. 2005 222-226 23.

Leonard, J. N. and D. V. Schaffer. Computational design of antiviral RNA interference strategies that resist human immunodeficiency virus escape J Virol Feb. 2005 1645-1654 79.

Siolas, D., C. Lerner, J. Burchard, W. Ge, P. S. Linsley, P. J. Paddison, G. J. Hannon and M. A. Cleary. Synthetic shRNAs as potent RNAi triggers Nat Biotechnol Feb. 2005 227-231 23.

Yi, R., B. P. Doehle, Y. Qin, I. G. Macara and B. R. Cullen. Overexpression of exportin 5 enhances Rna interference mediated by short hairpin RNAs and microRNAs Rna Feb (Epub Dec. 21, 2004) 2005 220-226 11.

Tomari, Y. and P. D. Zamore. Perspective: machines for RNAi Genes Dev Mar. 1, 2005 517-529 19.

Cheng, A. M., M. W. Byrom, J. Shelton and L. P. Ford. Antisense inhibition of human miRNAs and indications for an involvement of miRNA in cell growth and apoptosis Nucleic Acids Res Mar. 1, 2005 1290-1297 33.

Onishi, K. and S. Ueda. Molecular evolution of a microRNA cluster in the PWS/AS region among mammals Gene Mar. 1, 2005.

Wei, J. H., Y. F. Chou, Y. H. Ou, Y. H. Yeh, S. W. Tyan, T. P. Sun, C. Y. Shen and S. Y. Shieh. TTK/hMps1 participates in the regulation of DNA damage checkpoint response by phosphorylating CHK2 on threonine 68 J Biol Chem Mar. 4 (Epub Dec. 23, 2004) 2005 7748-7757 280.

Eis, P. S., W. Tam, L. Sun, A. Chadburn, Z. Li, M. F. Gomez, E. Lund and J. E. Dahlberg. Accumulation of miR-155 and BIC RNA in human B cell lymphomas Proc Natl Acad Sci U S A Mar. 8, 2005 3627-3632 102.

Kang, W., O. Nielsen, C. Fenger, R. G. Leslie, U. Holmskov and K. B. Reid. Induction of DMBT1 expression by reduced ERK activity during gastric mucosa differentiation-like process and its association with human gastric cancer Carcinogenesis Mar. 10, 2005.

Kessler, P. S. and M. Parsons. Probing the role of compartmentation of glycolysis in procyclic form Trypanosoma brucei: RNA interference studies of PEX14, hexokinase, and phosphofructokinase J Biol Chem Mar. 11, 2005 9030-9036 280.

Jing, Q., S. Huang, S. Guth, T. Zarubin, A. Motoyama, J. Chen, F. Di Padova, S. C. Lin, H. Gram and J. Han. Involvement of microRNA in AU-rich element-mediated mRNA instability Cell Mar. 11, 2005 623-634 120.

Johnson, S. M., H. Grosshans, J. Shingara, M. Byrom, R. Jarvis, A. Cheng, E. Labourier, K. L. Reinert, D. Brown and F. J. Slack. RAS is regulated by the let-7 microRNA family Cell Mar. 11, 2005 635-647 120.

Yang, W. J., D. D. Yang, S. Na, G. E. Sandusky, Q. Zhang and G. Zhao. Dicer is required for embryonic angiogenesis during mouse development J Biol Chem Mar. 11 (Epub Dec. 21, 2004) 2005 9330-9335 280.

Robins, H., Y. Li and R. W. Padgett. Incorporating structure to predict microRNA targets Proc Natl Acad Sci U S A Mar. 15, 2005 4006-4009 102.

Giraldez, A. J., R. M. Cinalli, M. E. Glasner, A. J. Enright, M. J. Thomson, S. Baskerville, S. M. Hammond, D. P. Bartel and A. F. Schier. MicroRNAs Regulate Brain Morphogenesis in Zebrafish Science Mar. 17, 2005.

Xie, X., J. Lu, E. J. Kulbokas, T. R. Golub, V. Mootha, K. Lindblad-Toh, E. S. Lander and M. Kellis. Systematic discovery of regulatory motifs in human promoters and 3' UTRs by comparison of several mammals Nature Mar. 17, 2005 338-345 434.

Best, A., L. Handoko, E. Schluter and H. U. Goringer. In vitro synthesized siRNAs elicit RNA interference in African trypanosomes—an in vitro and in vivo analysis J Biol Chem Mar. 21, 2005.

Lolle, S. J., J. L. Victor, J. M. Young and R. E. Pruitt. Genome-wide non-mendelian inheritance of extra-genomic information in Arabidopsis Nature Mar. 24, 2005 505-509 434.

Cai, X., S. Lu, Z. Zhang, C. M. Gonzalez, B. Damania and B. R. Cullen. Kaposi's sarcoma-associated herpesvirus expresses an array of viral microRNAs in latently infected cells Proc Natl Acad Sci U S A Mar. 30, 2005.

Rivas, F. V., N. H. Tolia, J. J. Song, J. P. Aragon, J. Liu, G. J. Hannon and L. Joshua-Tor. Purified Argonaute2 and an siRNA form recombinant human RISC Nat Struct Mol Biol Mar. 30, 2005.

Ma, J. B., Y. R. Yuan, G. Meister, Y. Pei, T. Tuschl and D. J. Patel. Structural basis for 5'-end-specific recognition of guide RNA by the A. fulgidus Piwi protein Nature Mar. 31, 2005 666-670 434.

Omoto, S. and Y. R. Fujii. Regulation of human immunodeficiency virus 1 transcription by nef microRNA J Gen Virol Mar. 2005 751-755 86.

Grosshans, H., T. Johnson, K. L. Reinert, M. Gerstein and F. J. Slack. The Temporal Patterning MicroRNA let-7 Regulates Several Transcription Factors at the Larval to Adult Transition in C. elegans Dev Cell Mar. 2005 321-330 8.

Lu, P. Y., F. Y. Xie and M. C. Woodle. Modulation of angiogenesis with siRNA inhibitors for novel therapeutics Trends Mol Med Mar. 2005 104-113 11.

Smirnova, L., A. Grafe, A. Seiler, S. Schumacher, R. Nitsch and F. G. Wulczyn. Regulation of miRNA expression during neural cell specification Eur J Neurosci Mar. 2005 1469-1477 21.

Voinnet, O. Induction and suppression of RNA silencing: insights from viral infections Nat Rev Genet Mar. 2005 206-220 6.

Guarguaglini, G., P. I. Duncan, Y. D. Stierhof, T. Holmstrom, S. Duensing and E. A. Nigg. The forkhead-associated domain protein Cep170 interacts with Polo-like kinase 1 and serves as a marker for mature centrioles Mol Biol Cell Mar. 2005 1095-1107 16.

Holway, A. H., C. Hung and W. M. Michael. Systematic, RNA-interference-mediated identification of mus-101 modifier genes in Caenorhabditis elegans Genetics Mar. 2005 1451-1460 169.

Mollinari, C., J. P. Kleman, Y. Saoudi, S. A. Jablonski, J. Perard, T. J. Yen and R. L. Margolis. Ablation of PRC1 by small interfering RNA demonstrates that cytokinetic abscission requires a central spindle bundle in mammalian cells, whereas completion of furrowing does not Mol Biol Cell Mar. 2005 1043-1055 16.

Tanno, B., V. Cesi, R. Vitali, F. Sesti, M. L. Giuffrida, C. Mancini, B. Calabretta and G. Raschella. Silencing of endogenous IGFBP-5 by micro Rna interference affects proliferation, apoptosis and differentiation of neuroblastoma cells Cell Death Differ Mar. 2005 213-223 12.

Brennecke, J., A. Stark, R. B. Russell and S. M. Cohen. Principles of microRNA-target recognition PLoS Biol Mar. 2005 e85 3.

Baskerville, S. And D. P. Bartel. Microarray profiling of microRNAs reveals frequent coexpression with neighboring miRNAs and host genes Rna Mar. 2005 241-247 11.

Legendre, M., A. Lambert and D. Gautheret. Profile-based detection of microRNA precursors in animal genomes Bioinformatics Apr. 1, 2005 841-845 21.

Walters, D. K., E. P. Stoffregen, M. C. Heinrich, M. W. Deininger and B. J. Druker. RNAi-induced down-regulation of FLT3 expression in AML cell lines increases sensitivity to MLN518 Blood Apr. 1, 2005 2952-2954 105.

Krek, A., D. Grun, M. N. Poy, R. Wolf, L. Rosenberg, E. J. Epstein, P. Macmenamin, I. Da Piedade, K. C. Gunsalus, M. Stoffel and N. Rajewsky. Combinatorial microRNA target predictions Nat Genet Apr. 3, 2005.

Vermeulen, A., L. Behlen, A. Reynolds, A. Wolfson, W. S. Marshall, J. Karpilow and A. Khvorova. The contributions of dsRNA structure to Dicer specificity and efficiency Rna Apr. 5, 2005.

Bahramian, M. B. and H. Zarbl. GENE impedance: a natural process for control of gene expression and the origin of RNA interference J Theor Biol Apr. 7, 2005 301-314 233.

Mattick, J. S. and I. V. Makunin. Small regulatory RNAs in mammals Hum Mol Genet Apr. 15, 2005 R121-132 14 Suppl 1.

Brown, J. R. and P. Sanseau. A computational view of microRNAs and their targets Drug Discov Today Apr. 15, 2005 595-601 10.

Lai, E. C., B. Tam and G. M. Rubin. Pervasive regulation of Drosophila Notch target genes by GYbox-, Brd-box-, and K-box-class microRNAs Genes Dev Apr. 15, 2005.

Kim, V. N. MicroRNA biogenesis: coordinated cropping and dicing Nat Rev Mol Cell Biol Apr. 15, 2005.

Lecellier, C. H., P. Dunoyer, K. Arar, J. Lehmann-Che, S. Eyquem, C. Himber, A. Saib and O. Voinnet. A cellular microRNA mediates antiviral defense in human cells Science Apr. 22, 2005 557-560 308.

Couzin, J. Molecular biology. Human RNA slows down a primate retrovirus Science Apr. 22, 2005 480-481 308.

Lee, Y. S., H. K. Kim, S. Chung, K. S. Kim and A. Dutta. Depletion of human micro-RNA miR-125b reveals that it is critical for the proliferation of differentiated cells but not for the down-regulation of putative targets during differentiation J Biol Chem Apr. 29, 2005 16635-16641 280.

Teixeira, D., U. Sheth, M. A. Valencia-Sanchez, M. Brengues and R. Parker. Processing bodies require RNA for assembly and contain nontranslating mRNAs RNA Apr. 2005 371-382 11.

Orban, T. I. and E. Izaurralde. Decay of mRNAs targeted by Risc requires XRN1, the Ski complex, and the exosome Rna Apr. 2005 459-469 11.

O'Toole A, S., S. Miller and M. J. Serra. Stability of 3' double nucleotide overhangs that model the 3' ends of siRNA Rna Apr. 2005 512-516 11.

Neilson, J. R. and P. A. Sharp. Herpesviruses throw a curve ball: new insights into microRNA biogenesis and evolution Nat Methods Apr. 2005 252-254 2.

Pasquinelli, A. E., S. Hunter and J. Bracht. MicroRNAs: a developing story Curr Opin Genet Dev Apr. 2005 200-205 15.

Chen, C. Z. and H. F. Lodish. MicroRNAs as regulators of mammalian hematopoiesis Semin Immunol Apr. 2005 155-165 17.

Knott, J. G., M. Kurokawa, R. A. Fissore, R. M. Schultz and C. J. Williams. Transgenic RNA interference reveals role for mouse sperm phospholipase Czeta in triggering Ca2+ oscillations during fertilization Biol Reprod Apr. 2005 992-996 72.

Latchoumycandane, C., V. Anantharam, M. Kitazawa, Y. Yang, A. Kanthasamy and A. G. Kanthasamy. Protein kinase Cdelta is a key downstream mediator of manganese-induced apoptosis in dopaminergic neuronal cells J Pharmacal Exp Ther Apr. 2005 46-55 313.

Gregory, R. I. and R. Shiekhattar. MicroRNA biogenesis and cancer Cancer Res May 1, 2005 3509-3512 65.

Jaronczyk, K., J. B. Carmichael and T. C. Hobman. Exploring the functions of RNA interference pathway proteins: some functions are more RISCy than others? Biochem J May 1, 2005 561-571 387.

Cheng, L. C., M. Tavazoie and F. Doetsch. Stem Cells From Epigeneticsto microRNAs Neuron May 5, 2005 363-367 46.

Liao, H. and J. H. Wang. Biomembrane-Permeable and Ribonuclease-Resistant siRNA with Enhanced Activity Oligonucleotides May 5, 2005.

Altuvia, Y., P. Landgraf, G. Lithwick, N. Elefant, S. Pfeffer, A. Aravin, M. J. Brownstein, T. Tuschl and H. Margalit. Clustering and conservation patterns of human microRNAs Nucleic Acids Res May 12, 2005 2697-2706 33.

Schubert, S., A. Grunweller, V. A. Erdmann and J. Kurreck. Local RNA Target Structure Influences siRNA Efficacy: Systematic Analysis of Intentionally Designed Binding Regions J Mol Biol May 13, 2005 883-893 348.

Overhoff, M., M. Alken, R. K. Far, M. Lemaitre, B. Lebleu, G. Sczakiel and I. Robbins. Local RNA Target Structure Influences siRNA Efficacy: a Systematic Global Analysis J Mol Biol May 13, 2005 871-881 348.

Li, Z., Y. Xiong, Y. Peng, J. Pan, Y. Chen, X. Wu, S. Hussain, P. Tien and D. Guo. Specific inhibition of HIV-1 replication by short hairpin RNAs targeting human cyclin T1 without inducing apoptosis FEBS Lett May 21, 2005.

Sen, G. L. and H. M. Blau. Argonaute 2/Risc resides in sites of mammalian mRNA decay known as cytoplasmic bodies Nat Cell Biol May 22, 2005.

Hobert, O. MicroRNAs: All Gone and Then What? Curr Biol May 24, 2005 R387-389 15.

Brown, K. M., C. Y. Chu and T. M. Rana. Target accessibility dictates the potency of human RiSC Nat Struct Mol Biol May 2005 469-470 12.

Bennasser, Y., S. Y. Le, M. Benkirane and K. T. Jeang. Evidence that HIV-1 Encodes an siRNA and a Suppressor of RNA Silencing Immunity May 2005 607-619 22.

Kong, Y. and J. H. Han. MicroRNA: biological and computational perspective Genomics Proteomics Bioinformatics May 2005 62-72 3.

Yu, L., X. Yu, R. Shen and Y. He. HYL1 gene maintains venation and polarity of leaves Planta May 2005 231-242 221.

Gong, H., C. M. Liu, D. P. Liu and C. C. Liang. The role of small RNAs in human diseases: potential troublemaker and therapeutic tools Med Res Rev May 2005 361-381 25.

Lee, R. C., R. L. Feinbaum and V. Ambros. The C. elegans heterochronic gene lin-4 encodes small RNAs with antisense complementarity to lin-14 Cell Dec. 3, 1993 843-854 75.

Wightman, B., I. Ha and G. Ruvkun. Posttranscriptional regulation of the heterochronic gene lin-14 by lin-4 mediates temporal pattern formation in C. elegans Cell Dec. 3, 1993 855-862 75.

Gallinaro, H., L. Domenjoud and M. Jacob. Structural study of the 5' end of a synthetic premessenger RNA from adenovirus. Evidence for a long-range exon-intron interaction J Mol Biol Jul. 15, 1994 205-225 240.

Lu, C. and R. Bablanian. Characterization of small nontranslated polyadenylylated RNAs in vaccinia virus-infected cells Proc Natl Acad Sci U S A Mar. 5, 1996 2037-2042 93.

Crawford, E. D., E. P. Deantoni, R. Etzioni, V. C. Schaefer, R. M. Olson and C. A. Ross. Serum prostate-specific antigen and digital rectal examination for early detection of prostate cancer in a national community-based program. The Prostate Cancer Education Council Urology Jun. 1996 863-869 47.

Engdahl HM, Hjalt TA, Wagner EG. A two unit antisense RNA cassette test system for silencing of target genes. Nucleic Acids Res. Aug. 15, 1997 3218-27 25.

Smith, D. S., P. A. Humphrey and W. J. Catalona. The early detection of prostate carcinoma with prostate specific antigen: the Washington University experience Cancer Nov. 1, 1997 1852-1856 80.

Dsouza, M., N. Larsen and R. Overbeek. Searching for patterns in genomic data Trends Genet Dec. 1997 497-498 13.

Moss, E. G., R. C. Lee and V. Ambros. The cold shock domain protein Lin-28 controls developmental timing C. elegans and is regulated by the lin-4 RNA Cell 1997 637 88.

Fire, A., S. Xu, M. K. Montgomery, S. A. Kostas, S. E. Driver and C. C. Mello. Potent and specific genetic interference by double-stranded RNA in Caenorhabditis elegans Nature Feb. 19, 1998 806-811 391.

Waterhouse, P. M., M. W. Graham and M. B. Wang. Virus resistance and gene silencing in plants can be induced by simultaneous expression of sense and antisense RNA Proc Natl Acad Sci U S A Nov. 10, 1998 13959-13964 95.

Ngo, H., C. Tschudi, K. Gull and E. Ullu. Double-stranded RNA induces mRNA degradation in Trypanosoma brucei Proc Natl Acad Sci U S A Dec. 8, 1998 14687-14692 95.

Verma, S. and F. Eckstein. Modified oligonucleotides: synthesis and strategy for users Annu Rev Biochem *No date in Pubmed* 1998 99-134 67.

Wuchty, S., W. Fontana, I. L. Hofacker and P. Schuster. Complete suboptimal folding of RNA and the stability of secondary structures Biopolymers Feb. 199 145-165 49.

Mathews, D. H., J. Sabina, M. Zuker and D. H. Turner. Expanded sequence dependence of thermodynamic parameters improves prediction of RNA secondary structure J Mol Biol May 21, 1999 911-940 288.

Chang, P. L. Encapsulation for somatic gene therapy Ann N Y Acad Sci Jun. 18, 199 146-158 875.

Zhang, M. Q. Large-scale gene expression data analysis: a new challenge to computational biologists Genome Res Aug. 1999 681-688 9.

Grisaru, D., M. Sternfeld, A. Eldor, D. Glick and H. Soreq. Structural roles of acetylcholinesterase variants in biology and pathology Eur J Biochem Sep. 1999 672-686 264.

Fire, A. RNA-triggered gene silencing Trends Genet Sep. 1999 358-363 15.

Tabara, H., M. Sarkissian, W. G. Kelly, J. Fleenor, A. Grishok, L. Timmons, A. Fire and C. C. Mello. The rde-1 gene, RNA interference, and transposon silencing in C. elegans Cell Oct. 15, 1999 123-132 99.

Ryo, A., Y. Suzuki, K. Ichiyama, T. Wakatsuki, N. Kondoh, A. Hada, M. Yamamoto and N. Yamamoto. Serial analysis of gene expression in HIV-1-infected T cell lines FEBS Lett Nov. 26, 1999 182-186 462.

Olsen, P. H. and V. Ambros. The lin-4 regulatory RNA controls developmental timing in Caenorhabditis elegans by blocking LIN-14 protein synthesis after the initiation of translation Dev Biol Dec. 15, 1999 671-680 216.

Tuschl, T., P. D. Zamore, R. Lehmann, D. P. Bartel and P. A. Sharp. Targeted mRNA degradation by double-stranded RNA in vitro Genes Dev Dec. 15, 1999 3191-3197 13.

Reinhart, B. J., F. J. Slack, M. Basson, A. E. Pasquinelli, J. C. Bettinger, A. E. Rougvie, H. R. Horvitz and G. Ruvkun. The 21-nucleotide let-7 RNA regulates developmental timing in Caenorhabditis elegans Nature Feb. 24, 2000 901-906 403.

Pitt, J. N., J. A. Schisa and J. R. Priess. P granules in the germ cells of Caenorhabditis elegans adults are associated with clusters of nuclear pores and contain Rna Dev Biol Mar. 15, 2000 315-333 219.

Hammond, S. M., E. Bernstein, D. Beach and G. J. Hannon. An RNA-directed nuclease mediates post-transcriptional gene silencing in Drosophila cells Nature Mar. 16, 2000 293-296 404.

Slack, F. J., M. Basson, Z. Liu, V. Ambros, H. R. Horvitz and G. Ruvkun. The lin-41 RBCC gene acts in the C. elegans heterochronic pathway between the let-7 regulatory Rna and the Lin-29 transcription factor Mol Cell Apr. 2000 659-669 5.

Fortier, E. and J. M. Belote. Temperature-dependent gene silencing by an expressed inverted repeat in Drosophila Genesis Apr. 2000 240-244 26.

Mourrain, P., C. Beclin, T. Elmayan, F. Feuerbach, C. Godon, J. B. Morel, D. Jouette, A. M. Lacombe, S. Nikic, N. Picault, K. Remoue, M. Sanial, T. A. Vo and H. Vaucheret. Arabidopsis SGS2 and SGS3 genes are required for posttranscriptional gene silencing and natural virus resistance Cell May 26, 2000 533-542 101.

Sijen, T. and J. M. Kooter. Post-transcriptional gene-silencing: RNAs on the attack or on the defense? Bioessays Jun. 2000 520-531 22.

Brenner, S., M. Johnson, J. Bridgham, G. Golda, D. H. Lloyd, D. Johnson, S. Luo, S. McCurdy, M. Foy, M. Ewan, R. Roth, D. George, S. Eletr, G. Albrecht, E. Vermaas, S. R. Williams, K. Moon, T. Burcham, M. Pallas, R. B. Dubridge, J. Kirchner, K. Fearon, J. Mao and K. Corcoran. Gene expression analysis by massively parallel signature sequencing (MPSS) on microbead arrays Nat Biotechnol Jun. 2000 630-634 18.

Ryo, A., Y. Suzuki, M. Arai, N. Kondoh, T. Wakatsuki, A. Hada, M. Shuda, K. Tanaka, C. Sato, M. Yamamoto and N. Yamamoto. Identification and characterization of differentially expressed mRNAs in HIV type 1-infected human T cells AIDS Res Hum Retroviruses Jul. 1, 2000 995 1005 16.

Nilsson, M., G. Barbany, D. O. Antson, K. Gertow and U. Landegren. Enhanced detection and distinction of RNA by enzymatic probe ligation Nat Biotechnol Jul. 2000 791-793 18.

Kent, W. J. and A. M. Zahler. Conservation, regulation, synteny, and introns in a large-scale C. briggsae-C. elegans genomic alignment Genome Res Aug. 2000 1115-1125 10.

Kennerdell, J. R. and R. W. Carthew. Heritable gene silencing in Drosophila using double-stranded RNA Nat Biotechnol Aug. 2000 896-898 18.

Smith, N. A., S. P. Singh, M. B. Wang, P. A. Stoutjesdijk, A. G. Green and P. M. Waterhouse. Total silencing by intron-spliced hairpin RNAs Nature Sep. 21, 2000 319-320 407.

Voinnet, O., C. Lederer and D. C. Baulcombe. A viral movement protein prevents spread of the gene silencing signal in Nicotiana benthamiana Cell Sep. 29, 2000 157-167 103.

Mette MF, Aufsatz W, van der Winden J, Matzke MA, Matzke AJ. Transcriptional silencing and promoter methylation triggered by double-stranded RNA. Embo J. Oct. 2, 2000 5194-201 19.

Yang, D., H. Lu and J. W. Erickson. Evidence that processed small dsRNAs may mediate sequence-specific mRNA degradation during RNAi in Drosophila embryos Curr Biol Oct. 5, 2000 1191.

Anandalakshmi, R., R. Marathe, X. Ge, J. M. Herr, Jr., C. Mau, A. Mallory, G. Pruss, L. Bowman and V. B. Vance. A calmodulin-related protein that suppresses posttranscriptional gene silencing in plants Science Oct. 6, 2000 142-144 290.

Fagard, M., S. Boutet, J. B. Morel, C. Bellini and H. Vaucheret. AGO1, QDE-2, and RDE-1 are related proteins required for post-transcriptional gene silencing in plants, quelling in fungi, and RNA interference in animals Proc Natl Acad Sci U S A Oct. 10, 2000 11650-11654 97.

Pasquinelli, A. E., B. J. Reinhart, F. Slack, M. Q. Martindale, M. I. Kuroda, B. Maller, D. C. Hayward, E. E. Ball, B. Degnan, P. Muller, J. Spring, A. Srinivasan, M. Fishman, J. Finnerty, J. Corbo, M. Levine, P. Leahy, E. Davidson and G. Ruvkun. Conservation of the sequence and temporal expression of let-7 heterochronic regulatory RNA Nature Nov. 2, 2000 86-89 408.

Llave, C., K. D. Kasschau and J. C. Carrington. Virus-encoded suppressor of posttranscriptional gene silencing targets a maintenance step in the silencing pathway Proc Natl Acad Sci U S A Nov. 21, 2000 13401-13406 9.

Cogoni, C. and G. Macino. Post-transcriptional gene silencing across kingdoms Curr Opin Genet Dev Dec. 2000 638-643 10.

Elbashir, S. M., W. Lendeckel and T. Tuschl. RNA interference is mediated by 21- and 22-nucleotide RNAs Genes Dev Jan. 15, 2001 188-200 15.

Bernstein, E., A. A. Caudy, S. M. Hammond and G. J. Hannon. Role for a bidentate ribonuclease in the initiation step of RNA interference Nature Jan. 18, 2001 363-366 409.

Vaucheret, H. and M. Fagard. Transcriptional gene silencing in plants: targets, inducers and regulators Trends Genet Jan. 2001 29-35 17.

Thomas, C. L., L. Jones, D. C. Baulcombe and A. J. Maule. Size constraints for targeting post-transcriptional gene silencing and for RNA-directed methylation in Nicotiana benthamiana using a potato virus X vector Plant J Feb. 2001 417-425 25.

Galyam, N., D. Grisaru, M. Grifman, N. Melamed-Book, F. Eckstein, S. Seidman, A. Eldor and H. Soreq. Complex host cell responses to antisense suppression of ACHE gene expression Antisense Nucleic Acid Drug Dev Feb. 2001 51-57 11.

Sharp, P. A. RNA interference—2001 Genes Dev Mar. 1, 2001 485-490 15.

Mallory, A. C., L. Ely, T. H. Smith, R. Marathe, R. Anandalakshmi, M. Fagard, H. Vaucheret, G. Pruss, L. Bowman and V. B. Vance. HC-Pro suppression of transgene silencing eliminates the small RNAs but not transgene methylation or the mobile signal Plant Cell Mar. 2001 571-583 13.

Matzke, M. A., A. J. Matzke, G. J. Pruss and V. B. Vance. RNA-based silencing strategies in plants Curr Opin Genet Dev Apr. 2001 221-227 11.

Schisa, J. A., J. N. Pitt and J. R. Priess. Analysis of RNA associated with P granules in germ cells of C elegans adults Development Apr. 2001 1287-1298 128.

Di Serio, F., H. Schob, A. Iglesias, C. Tarina, E. Bouldoires and F. Meins, Jr. Sense- and antisense-mediated gene silencing in tobacco is inhibited by the same viral suppressors and is associated with accumulation of small RNAs Proc Natl Acad Sci U S A May 22, 2001 6506-6510 98.

Elbashir, S. M., J. Harborth, W. Lendeckel, A. Yalcin, K. Weber and T. Tuschl. Duplexes of 21-nucleotide RNAs mediate RNA interference in cultured mammalian cells Nature May 24, 2001 494-498 411.

Piccin, A., A. Salameh, C. Benna, F. Sandrelli, G. Mazzotta, M. Zordan, E. Rosato, C. P. Kyriacou and R. Costa. Efficient and heritable functional knock-out of an adult phenotype in Drosophila using a GAL4-driven hairpin RNA incorporating a heterologous spacer Nucleic Acids Res Jun. 15, 2001 E55-55 29.

Vance, V. and H. Vaucheret. RNA silencing in plants—defense and counterdefense Science Jun. 22, 2001 2277-2280 292.

Argaman, L., R. Hershberg, J. Vogel, G. Bejerano, E. G. Wagner, H. Margalit and S. Altuvia. Novel small RNA-encoding genes in the intergenic regions of *Escherichia coli* Curr Biol Jun. 26, 2001 941-950 11.

Grishok, A., A. E. Pasquinelli, D. Conte, N. Li, S. Parrish, I. Ha, D. L. Baillie, A. Fire, G. Ruvkun and C. C. Mello. Genes and mechanisms related to RNA interference regulate expression of the small temporal RNAs that control C. elegans developmental timing Cell Jul. 13, 2001 23-34 106.

Hutvagner, G., J. Mclachlan, A. E. Pasquinelli, E. Balint, T. Tuschl and P. D. Zamore. A cellular function for the RNA-interference enzyme Dicer in the maturation of the let-7 small temporal RNA Science Aug. 3, 2001 834-838 293.

Hammond, S. M., S. Boettcher, A. A. Caudy, R. Kobayashi and G. J. Hannon. Argonaute2, a link between genetic and biochemical analyses of RNAi Science Aug. 10, 2001 1146-1150 293.

Vaucheret, H., C. Beclin and M. Fagard. Post-transcriptional gene silencing in plants J Cell Sci Sep. 2001 3083-3091 114.

Wesley, S. V., C. A. Helliwell, N. A. Smith, M. B. Wang, D. T. Rouse, Q. Liu, P. S. Gooding, S. P. Singh, D. Abbott, P. A. Stoutjesdijk, S. P. Robinson, A. P. Gleave, A. G. Green and P. M. Waterhouse. Construct design for efficient, effective and high-throughput gene silencing in plants J Sep. 2001 581-590 27.

Mattick, J. S. and M. J. Gagen. The evolution of controlled multitasked gene networks: the role of introns and other noncoding RNAs in the development of complex organisms Mol Biol Evol Sep. 2001 1611-1630 18.

Carter, R. J., I. Dubchak and S. R. Holbrook. A computational approach to identify genes for functional RNAs in genomic sequences Nucleic Acids Res Oct. 1, 2001 3928-3938 29.

Moss, E. G. RNA interference: it's a small RNA world Curr Biol Oct. 2, 2001 R772-775 11.

Ketting, R. F., S. E. Fischer, E. Bernstein, T. Sijen, G. J. Hannon and R. H. Plasterk. Dicer functions in RNA interference and in synthesis of small RNA involved in developmental timing in C. elegans Genes Dev Oct. 15, 2001 2564-2659 15.

Ruvkun, G. Molecular biology. Glimpses of a tiny RNA world Science Oct. 26, 2001 797-799 294

Lee, R. C. and V. Ambros. An extensive class of small RNAs in Caenorhabditis elegans Science Oct. 26, 2001 862-864 294.

Lau, N. C., L. P. Lim, E. G. Weinstein and D. P. Bartel. An abundant class of tiny RNAs with portable regulatory roles in Caenorhabditis elegans Science Oct. 26, 2001 858-862 294.

Lagos-Quintana, M., R. Rauhut, W. Lendeckel and T. Tuschl. Identification of novel genes coding for small expressed RNAs Science Oct. 26, 2001 853-858 294.

Itaya, A., A. Folimonov, Y. Matsuda, R. S. Nelson and B. Ding. Potato spindle tuber viroid as inducer of RNA silencing in infected tomato Mol Plant Microbe Interact Nov. 2001 1332-1334 14.

Mattick, J. S. Non-coding RNAs: the architects of eukaryotic complexity EMBO Rep Nov. 2001 986-991 2.

Elbashir, S. M., J. Martinez, A. Patkaniowska, W. Lendeckel and T. Tuschl. Functional anatomy of siRNAs for mediating efficient RNAi in Drosophila melanogaster embryo lysate Embo J Dec. 3, 2001 6877-6888 20.

Ambros, V. microRNAs: tiny regulators with great potential Cell Dec. 28, 2001 823-826 107.

Blaszczyk, J., J. E. Tropea, M. Bubunenko, K. M. Routzahn, D. S. Waugh, D. L. Court and X. Ji. Crystallographic and modeling studies of RNase III suggest a mechanism for double-stranded RNA cleavage Structure Dec. 2001 1225-1236 9.

Crete, P., S. Leuenberger, V. A. Iglesias, V. Suarez, H. Schob, H. Holtorf, S. Van Eeden and F. Meins. Graft transmission of induced and spontaneous post-transcriptional silencing of chitinase genes Plant J Dec. 2001 493-501 28.

Smallridge, R. A small fortune Nat Rev Mol Cell Biol Dec.2001 867 2.

Eddy, S. R. Non-coding RNA genes and the modern RNA world Nat Rev Genet Dec. 2001 919-929 2.

Lu, C. M. miRNA bead detection Genaco Biomedical Products PHS 398 2001 1.

Matzke, M., A. J. Matzke and J. M. Kooter. RNA: guiding gene silencing 2001 1080 293.

Grosshans, H. and F. J. Slack. Micro-RNAs: small is plentiful J Cell Biol Jan. 7, 2002 17-21 156.

Meshorer, E., C. Erb, R. Gazit, L. Pavlovsky, D. Kaufer, A. Friedman, D. Glick, N. Benarie and H. Soreq. Alternative splicing and neuritic mRNA translocation under long-term neuronal hypersensitivity Science Jan. 18, 2002 508-512 295.

Paddison, P. J., A. A. Caudy and G. J. Hannon. Stable suppression of gene expression by RNAi in mammalian cells Proc Natl Acad Sci U S A Feb. 5, 2002 1443-1448 99.

Moss, E. G. MicroRNAs: hidden in the genome Curr Biol Feb. 19, 2002 R138-140 12.

Banerjee, D. and F. Slack. Control of developmental timing by small temporal RNAs: a paradigm for RNA-mediated regulation of gene expression Bioessays Feb. 2002 119-129 24.

Elbashir, S. M., J. Harborth, K. Weber and T. Tuschl. Analysis of gene function in somatic mammalian cells using small interfering RNAs Methods Feb. 2002 199-213 26.

Han, Y. and D. Grierson. Relationship between small antisense RNAs and aberrant RNAs associated with sense transgene mediated gene silencing in tomato Plant J Feb. 2002 509-519 29.

Nicholson, R. H. and A. W. Nicholson. Molecular characterization of a mouse cDNA encoding Dicer, a ribonuclease III ortholog involved in RNA interference Mamm Genome Feb. 2002 67-73 13.

Puerta-Fernandez, E., A. Barroso-Deljesus and A. Berzal-Herranz. Anchoring hairpin ribozymes to long target RNAs by loop-loop RNA interactions Antisense Nucleic Acid Drug Dev Feb. 2002 1-9 12.

Giordano, E., R. Rendina, I. Peluso and M. Furia. RNAi triggered by symmetrically transcribed transgenes in Drosophila melanogaster Genetics Feb. 2002 637-648 160.

Martens, H., J. Novotny, J. Oberstrass, T. L. Steck, P. Postlethwait and W. Nellen. RNAi in Dictyostelium: the role of RNA-directed RNA polymerases and double-stranded RNase Mol Biol Cell Feb. 2002 445-453 13.

Mourelatos, Z., J. Dostie, S. Paushkin, A. Sharma, B. Charroux, L. Abel, J. Rappsilber, M. Mann and G. Dreyfuss. miRNPs: a novel class of ribonucleoproteins containing numerous microRNAs Genes Dev Mar. 15, 2002 720-728 16.

Seggerson, K., L. Tang and E. G. Moss. Two genetic circuits repress the Caenorhabditis elegans heterochronic gene lin-28 after translation initiation Dev Biol Mar. 15, 2002 215-225 243.

Morel, J. B., C. Godon, P. Mourrain, C. Beclin, S. Boutet, F. Feuerbach, F. Proux and H. Vaucheret. Fertile hypomorphic Argonaute (ago1) mutants impaired in post-transcriptional gene silencing and virus resistance Plant Cell Mar. 2002 629-639 14.

Catalanotto, C., G. Azzalin, G. Macino and C. Cogoni. Involvement of small RNAs and role of the qde genes in the gene silencing pathway in Neurospora Genes Dev Apr. 1, 2002 790-795 16.

Boutla, A., K. Kalantidis, N. Tavernarakis, M. Tsagris and M. Tabler. Induction of RNA interference in Caenorhabditis elegans by RNAs derived from plants exhibiting post-transcriptional gene silencing Nucleic Acids Res Apr. 1, 2002 1688-1694 30.

Pasquinelli, A. E. and G. Ruvkun. Control of developmental timing by micrornas and their targets Annu Rev Cell Dev Biol Epub 2002 Apr. 2, 2002 495-513 18.

Paddison, P. J., A. A. Caudy, E. Bernstein, G. J. Hannon and D. S. Conklin. Short hairpin RNAs (shRNAs) induce sequence-specific silencing in mammalian cells Genes Dev Apr. 15, 2002 948-958 16.

Beclin, C., S. Boutet, P. Waterhouse and H. Vaucheret. A branched pathway for transgene-induced RNA silencing in plants Curr Biol Apr. 16, 2002 684-688 12.

Eddy, S. R. Computational genomics of noncoding RNA genes Cell Apr. 19, 2002 137-140 109.

Lagos-Quintana, M., R. Rauhut, A. Yalcin, J. Meyer, W. Lendeckel and T. Tuschl. Identification of tissue-specific microRNAs from mouse Curr Biol Apr. 30, 2002 735-739 12.

Kent, W. J. BLAT—the BLAST-like alignment tool Genome Res Apr. 2002 656-6654 12.

Hutvagner, G. and P. D. Zamore. RNAi: nature abhors a double-strand Curr Opin Genet Dev Apr. 2002 225-232 12.

Nilsson, M., J. Baner, M. Mendel-Hartvig, F. Dahl, D. O. Antson, M. Gullberg and U Landegren. Making ends meet in genetic analysis analysis using padlock probes Hum Mutat Apr. 2002 410-415 19.

Pasquinelli, A. E. MicroRNAs: deviants no longer Trends Genet Apr. 2002 171-173 18.

Lai, E. C. Micro RNAs are complementary to 3' UTR sequence motifs that mediate negative post-transcriptional regulation Nat Genet Apr. 2002 363-364 30.

Schwarz, D. S. and P. D. Zamore. Why do miRNAs live in the miRNP? Genes Dev May 1, 2002 1025-1031 16.

Brantl, S. Antisense-RNA regulation and RNA interference Biochim Biophys Acta May 3, 2002 15-25 1575.

Li, H., W. X. Li and S. W. Ding. Induction and suppression of RNA silencing by an animal virus Science May 17, 2002 1319-1321 296.

Zamore, P. D. Ancient pathways programmed by small RNAs Science May 17, 2002 1265-1269 296.

Chen, S., E. A. Lesnik, T. A. Hall, R. Sampath, R. H. Griffey, D. J. Ecker and L. B. Blyn. A bioinformatics based approach to discover small RNA genes in the Escherichia coli genome Biosystems Mar.-May 2002 157-177 65.

Lee, N. S., T. Dohjima, G. Bauer, H. Li, M. J. Li, A. Ehsani, P. Salvaterra and J. Rossi. Expression of small interfering RNAs targeted against HIV-1 rev transcripts in human cells Nat Biotechnol May 2002 500-505 20.

Draghici, S. Statistical intelligence: effective analysis of high-density microarray data Drug Discov Today Jun. 1, 2002 S55-63 7.

Silhavy, D., A. Molnar, A. Lucioli, G. Szittya, C. Hornyik, M. Tavazza and J. Burgyan. A viral protein suppresses RNA silencing and binds silencing-generated, 21- to 25-nucleotide double-stranded RNAs Embo J Jun. 17, 2002 3070-3080 21.

Ayash-Rashkovsky, M., Z. Weisman, J. Diveley, R. B. Moss, Z. Bentwich and G. Borkow. Generation of Th1 immune responses to inactivated, gp120-depleted HIV-1 in mice with a dominant Th2 biased immune profile via immunostimulatory [correction of imunostimulatory] oligonucleotides—relevance to AIDS vaccines in developing countries Vaccine Jun. 21, 2002 2684-2692 20.

Tabara, H., E. Yigit, H. Siomi and C. C. Mello. The dsRNA binding protein RDE-4 interacts with RDE-1, DCR-1, and a DExH-box helicase to direct RNAi in C. elegans Cell Jun. 28, 2002 861-871.

Bettencourt, R., O. Terenius and I. Faye. Hemolin gene silencing by ds-RNA injected into Cecropia pupae is lethal to next generation embryos Insect Mol Biol Jun. 2002 267-271 11.

Hooper, N. M. and A. J. Turner. The search for alpha-secretase and its potential as a therapeutic approach to Alzheimer s disease Curr Med Chem Jun. 2002 1107-1119 9.

Liu, Q., S. Singh and A. Green. High-oleic and high-stearic cottonseed oils: nutritionally improved cooking oils developed using gene silencing J Am Coll Nutr Jun. 2002 205S-211S 21.

Zeng, Y., E. J. Wagner and B. R. Cullen. Both natural and designed micro RNAs can inhibit the expression of cognate mRNAs when expressed in human cells Mol Cell Jun. 2002 1327-1333 9.

McManus, M. T., C. P. Petersen, B. B. Haines, J. Chen and P. A. Sharp. Gene silencing using micro-RNA designed hairpins Rna Jun. 2002 842-850 8.

Reinhart, B. J., E. G. Weinstein, M. W. Rhoades, B. Bartel and D. P. Bartel. MicroRNAs in plants Genes Dev Jul. 1, 2002 1616-1626 16.

McCaffrey, A. P., L. Meuse, T. T. Pham, D. S. Conklin, G. J. Hannon and M. A. Kay. RNA interference in adult mice Nature Jul. 4, 2002 38-39 418.

Hannon, G. J. RNA interference Nature Jul. 11, 2002 244-251 418.

Dennis, C. The brave new world of RNAna Nature Jul. 11, 2002 122-124 418.

Jacque, J. M., K. Triques and M. Stevenson. Modulation of HIV-1 replication by RNA interference Nature Jul. 25, 2002 435-438 418.

Cullen, B. R. RNA interference: antiviral defense and genetic tool Nat Immunol Jul. 2002 597-599 3.

Ma, C. and A. Mitra. Intrinsic direct repeats generate consistent post-transcriptional gene silencing in tobacco Plant J Jul. 2002 37-49 31.

Novina, C. D., M. F. Murray, D. M. Dykxhoorn, P. J. Beresford, J. Riess, S. K. Lee, R. G. Collman, J. Lieberman, P. Shankar and P. A. Sharp. siRNA-directed inhibition of HIV-1 infection Nat Med Jul. 2002 681-686 8.

Pomerantz, R, J. RNA interference meets HIV-1: will silence be golden? Nat Med Jul. 2002 659-660 8.

Zeng, Y. and B. R. Cullen. RNA interference in human cells is restricted to the cytoplasm RNA Jul. 2002 855-860 8.

Xiang, C. C., O. A. Kozhich, M. Chen, J. M. Inman, Q. N. Phan, Y. Chen and M. J. Brownstein. Amine-modified random primers to label probes for DNA microarrays Nat Biotechnol Jul. 2002 738-742 20.

Llave, C., K. D. Kasschau, M. A. Rector and J. C. Carrington. Endogenous and silencing-associated small RNAs in plants Plant Cell Jul. 2002 1605-1619 14.

Rhoades, M. W., B. J. Reinhart, L. P. Lim, C. B. Burge, B. Bartel and D. P. Bartel. Prediction of plant microRNA targets Cell Aug. 23, 2002 513-520 110.

Hipfner, D. R., K. Weigmann and S. M. Cohen. The bantam gene regulates Drosophila growth Aug. 2002 1527-1537 161.

Liu, Q., S. P. Singh and A. G. Green. High-stearic and High-oleic cottonseed oils produced by hairpin RNA-mediated post-transcriptional gene silencing Plant Physiol Aug. 2002 1732-1743 129.

Stoutjesdijk, P. A., S. P. Singh, Q. Liu, C. J. Hurlstone, P. A. Waterhouse and A. G. Green. hpRNA-mediated targeting of the Arabidopsis FAD2 gene gives highly efficient and stable silencing Plant Physiol Aug. 2002 1723-1731 129.

Suzuma, S., S. Asari, K. Bunai, K. Yoshino, Y. Ando, H. Kakeshita, M. Fujita, K. Nakamura and K. Yamane. Identification and characterization of novel small RNAs in the aspS-yrvM intergenic region of the Bacillus subtilis genome Microbiology Aug. 2002 2591-2598 148.

Milligan, L., T. Forne, E. Antoine, M. Weber, B. Hemonnot, L. Dandolo, C. Brunel and G. Cathala. Turnover of primary transcripts is a major step in the regulation of mouse H19 gene expression EMBO Rep Aug. 2002 774-779 3.

Hamilton, A., O. Voinnet, L. Chappell and D. Baulcombe. Two classes of short interfering RNA in RNA silencing Embo J Sep. 2, 2002 4671-4679 21.

Lee, Y., K. Jeon, J. T. Lee, S. Kim and V. N. Kim. MicroRNA maturation: stepwise processing and subcellular localization Embo J Sep. 2, 2002 4663-4670 21.

Klahre, U., P. Crete, S. A. Leuenberger, V. A. Iglesias and F. Meins, Jr. High molecular weight RNAs and small interfering RNAs induce systemic posttranscriptional gene silencing in plants Proc Natl Acad Sci U S A Sep. 3, 2002 11981-11986 99.

Park, W., J. Li, R. Song, J. Messing and X. Chen. Carpel Factory, a Dicer homolog, and HEN1, a novel protein, act in microRNA metabolism in Arabidopsis thaliana Curr Biol Sep. 3, 2002 1484-1495 12.

Jiang, M. And J. Milner. Selective silencing of viral gene expression in Hpv-positive human cervical carcinoma cells treated with siRNA, a primer of RNA interference Oncogene Sep. 5, 2002 6041-6048 21.

Martinez, J., A. Patkaniowska, H. Urlaub, R. Luhrmann and T. Tuschl. Single-stranded antisense siRNAs guide target RNA cleavage in RNAi Cell Sep. 6, 2002 563-574 110.

Allshire, R. Molecular biology. RNAi and heterochromatin—a hushed-up affair Science Sep. 13, 2002 1818-1819 297.

Reinhart, B. J. and D. P. Bartel. Small RNAs correspond to centromere heterochromatic repeats Science Sep. 13, 2002 1831 297.

Volpe, T. A., C. Kidner, I. M. Hall, G. Teng, S. I. Grewal and R. A. Martienssen. Regulation of heterochromatic silencing and histone H3 lysine-9 methylation by RNAi Science Sep. 13, 2002 1833-1837 297.

Baulcombe, D. DNA events. An RNA microcosm Science Sep. 20, 2002 2002-2003 297.

Llave, C., Z. Xie, K. D. Kasschau and J. C. Carrington. Cleavage of Scarecrow-like mRNA targets directed by a class of Arabidopsis miRNA Science Sep. 20, 2002 2053-2056 297.

Mochizuki, K., N. A. Fine, T. Fujisawa and M. A. Gorovsky. Analysis of a piwi-related gene implicates small RNAs in genome rearrangement in tetrahymena Cell Sep. 20, 2002 689-699 110.

Hutvagner, G. and P. D. Zamore. A microRNA in a multiple-turnover RNAi enzyme complex Science Sep. 20, 2002 2056-2060 297.

Coburn, G. A. and B. R. Cullen. Potent and specific inhibition of human immunodeficiency virus type 1 replication by RNA interference J Virol Sep. 2002 9225-9231 76.

Caudy, A. A., M. Myers, G. J. Hannon and S. M. Hammond. Fragile X-related protein and VIG associate with the RNA interference machinery Genes Dev Oct. 1, 2002 2491-2496 16.

Ishizuka, A., M. C. Siomi and H. Siomi. A Drosophila fragile X protein interacts with components of RNAi and ribosomal proteins Genes Dev Oct. 1, 2002 2497-2508 16.

Voinnet, O. RNA silencing: small RNAs as ubiquitous regulators of gene expression Curr Opin Plant Biol Oct. 2002 444-451 5.

Golden, T. A., S. E. Schauer, J. D. Lang, S. Pien, A. R. Mushegian, U. Grossniklaus, D. W. Meinke and A. Ray. Short INTEGUMENTS1/SUSPENSOR1/Carpel Factory, a Dicer homolog, is a maternal effect gene required for embryo development in Arabidopsis Plant Physiol Oct. 2002 808-822 130.

Merkle, I., M. J. Van Ooij, F. J. Van Kuppeveld, D. H. Glaudemans, J. M. Galama, A. Henke, R. Zell and W. J. Melchers. Biological significance of a human enterovirus B-specific RNA element in the 3' nontranslated region J Virol Oct. 2002 9900-9909 76.

Froeyen, M. and P. Herdewijn. RNA as a target for drug design, the example of Tat-TAR interaction Curr Top Med Chem Oct. 2002 1123-1145 2.

Carmell, M. A., Z. Xuan, M. Q. Zhang and G. J. Hannon. The Argonaute family: tentacles that reach into RNAi, developmental control, stem cell maintenance, and tumorigenesis Genes Dev Nov. 1, 2002 2733-2742 16.

Provost, P., D. Dishart, J. Doucet, D. Frendewey, B. Samuelsson and O. Radmark. Ribonuclease activity and RNA binding of recombinant human Dicer Embo J Nov. 1, 2002 5864-5874.

Zhang, H., F. A. Kolb, V. Brondani, E. Billy and W. Filipowicz. Human Dicer preferentially cleaves dsRNAs at their termini without a requirement for Atp Embo J Nov. 1, 2002 5875-5885 21.

Mallory, A. C., B. J. Reinhart, D. Bartel, V. B. Vance and L. H. Bowman. A viral suppressor of RNA silencing differentially regulates the accumulation of short interfering RNAs and micro-RNAs in tobacco Proc Natl Acad Sci U S A Nov. 12, 2002 15228-15233 99.

Gottesman, S. Stealth regulation: biological circuits with small RNA switches Genes Dev Nov. 15, 2002 2829-2842 16.

Calin, G. A., C. D. Dumitru, M. Shimizu, R. Bichi, S. Zupo, E. Noch, H. Aldler, S. Rattan, M. Keating, K. Rai, L. Rassenti, T. Kipps, M. Negrini, F. Bullrich and C. M. Croce. Frequent deletions and downregulation of micro- RNA genes miR15 and miR16 at 13q14 in chronic lymphocytic leukemia Proc Natl Acad Sci U S A Nov. 26, 2002 15524-15529 99.

Gaudilliere, B., Y. Shi and A. Bonni. RNA interference reveals a requirement for myocyte enhancer factor 2A in activity-dependent neuronal survival J Biol Chem Nov. 29, 2002 46442-46446.

Jones, L. Revealing micro-RNAs in plants Trends Plant Sci Nov. 2002 473-475 7.

Schauer, S. E., S. E. Jacobsen, D. W. Meinke and a. Ray. Dicer-LIKE1: blind men and elephants in Arabidopsis development Trends Plant Sci Nov. 2002 487-491 7.

Okazaki, Y., M. Furuno, T. Kasukawa, J. Adachi, H. Bono, S. Kondo, et al. Analysis of the mouse transcriptome based on functional annotation of 60,770 full-length cDNAs Nature Dec. 5, 2002.

Dennis, C. Small RNAs: the genome's guiding hand? Nature Dec. 19-26, 2002 732 420.

Uchida, N., S. Hoshino, H. Imataka, N. Sonenberg and T. Katada. A novel role of the mammalian GSPT/eRF3 associating with poly(A)-binding protein in Cap/Poly(A)-dependent translation J Biol Chem Dec. 27, 2002 50286-50292 277.

Huttenhofer, A., J. Brosius and J. P. Bachellerie. RNomics: identification and function of small, non-messenger RNAs Curr Opin Chem Biol Dec. 2002 835-843 6.

Wood, N. T. Unravelling the molecular basis of viral suppression of PTGS Trends Plant Sci 2002 384 7.

Cohen, O., C. Erb, D. Ginzberg, Y. Pollak, S. Seidman, S. Shoham, R. Yirmiya and H. Soreq. Neuronal overexpression of "readthrough" acetylcholinesterase is associated with antisense-suppressible behavioral impairments Mol Psychiatry *No date in pubmed* 2002 874-885 7.

Mlotshwa, S., O. Voinnet, M. F. Mette, M. Matzke, H. Vaucheret, S. W. Ding, G. Pruss and V. B. Vance. RNA silencing and the mobile silencing signal Plant Cell *No date in pubmed* 2002 S289-301 14 Suppl.

Tang, G., B. J. Reinhart, D. P. Bartel and P. D. Zamore. A biochemical framework for RNA silencing in plants Genes Dev Jan. 1, 2003 49-63 17.

Kawasaki, H. and K. Taira. Short hairpin type of dsRNAs that are controlled by tRNA(Val) promoter significantly induce RNAi-mediated gene silencing in the cytoplasm of human cells Nucleic Acids Res Jan. 15, 2003 700-707 31.

Ashrafi, K., F. Y. Chang, J. L. Watts, A. G. Fraser, R. S. Kamath, J. Ahringer and G. Ruvkun. Genome-wide RNAi analysis of Caenorhabditis elegans fat regulatory genes Nature Jan. 16, 2003 268-272 421.

Kamath, R. S., A. G. Fraser, Y. Dong, G. Poulin, R. Durbin, M. Gotta, A. Kanapin, N. Le Bot, S. Moreno, M. Sohrmann, D. P. Welchman, P. Zipperlen and J. Ahringer. Systematic functional analysis of the Caenorhabditis elegans genome using RNAi Nature Jan. 16, 2003 231-237 421.

Tuschl, T. Functional genomics: RNA sets the standard Nature Jan. 16, 2003 220-221 421.

Iyer, L. M., E. V. Koonin and L. Aravind. Evolutionary connection between the catalytic subunits of DNA-dependent RNA polymerases and eukaryotic RNA-dependent RNA polymerases and the origin of RNA polymerases BMC Struct Biol Jan. 28, 2003 1 3.

Shi, Y. Mammalian RNAi for the masses Trends Genet Jan. 2003 9-12 19.

Cerutti, H. RNA interference: traveling in the cell and gaining functions? Trends Genet Jan. 2003 39-46 19.

Zeng, Y. and B. R. Cullen. Sequence requirements for micro RNA processing and function in human cells RNA Jan. 2003 112-123 9.

Kawasaki, H., E. Suyama, M. Iyo and K. Taira. siRNAs generated by recombinant human Dicer induce specific and significant but target site-independent gene silencing in human cells Nucleic Acids Res Feb. 1, 2003 981-987 31.

Reiner, A., D. Yekutieli and Y. Benjamin I. Identifying differentially expressed genes using false discovery rate controlling procedures Bioinformatics Feb. 12, 2003 368-375 19.

Doench, J. G., C. P. Petersen and P. A. Sharp. siRNAs can function as miRNAs Genes Dev Feb. 15, 2003 438-442 17.

Gupta, V., A. Cherkassky, P. Chatis, R. Joseph, A. L. Johnson, J. Broadbent, T. Erickson and J. Dimeo. Directly labeled mRNA produces highly precise and unbiased differential gene expression data Nucleic Acids Res Feb. 15, 2003 e13 31.

Boffelli, D., J. Mcauliffe, D. Ovcharenko, K. D. Lewis, I. Ovcharenko, L. Pachter and E. M. Rubin. Phylogenetic shadowing of primate sequences to find functional regions of the human genome Science Feb. 28, 2003 1391-1394 299.

Kasschau, K. D., Z. Xie, E. Allen, C. Llave, E. J. Chapman, K. A. Krizan and J. C. Carrington. P1/HC-Pro, a viral suppressor of RNA silencing, interferes with Arabidopsis development and miRNA unction Dev Cell Feb. 2003 205-217 4.

Carmell, M. A., L. Zhang, D. S. Conklin, G. J. Hannon and T. A. Rosenquist. Germline transmission of RNAi in mice Nat Struct Biol Feb. 2003 91-92 10.

Dostie, J., Z. Mourelatos, M. Yang, A. Sharma and G. Dreyfuss. Numerous microRNPs in neuronal cells containing novel microRNAs RNA Feb. 2003 180-186 9.

Lagos-Quintana, M., R. Rauhut, J. Meyer, A. Borkhardt and T. Tuschl. New microRNAs from mouse and human Rna Feb. 2003 175-179 9.

Wilson, J. A., S. Jayasena, A. Khvorova, S. Sabatinos, I. G. Rodrigue-Gervais, S. Arya, F. Sarangi, M. Harris-Brandts, S. Beaulieu and C. D. Richardson. RNA interference blocks gene expression and RNA synthesis from hepatitis C replicons propagated in human liver cells Proc Natl Acad Sci U S Aa Mar. 4, 2003 2783-2788 100.

Lim, L. P., M. E. Glasner, S. Yekta, C. B. Burge and D. P. Bartel. Vertebrate microRNA genes Science Mar. 7, 2003 1540 299.

Maniataki, E., A. E. Martinez De Alba, R. Sagesser, M. Tabler and M. Tsagris. Viroid RNA systemic spread may depend on the interaction of a 71-nucleotide bulged hairpin with the host protein VirP1 Rna Mar. 2003 346-354 9.

Ambros, V., B. Bartel, D. P. Bartel, C. B. Burge, J. C. Carrington, X. Chen, G. Dreyfuss, S. R. Eddy, S. Griffiths-Jones, M. Marshall, M. Matzke, G. Ruvkun and T. Tuschl. A uniform system for microRNA annotation Rna Mar. 2003 277-279 9.

Findley, S. D., M. Tamanaha, N. J. Clegg and H. Ruohola-Baker. Maelstrom, a Drosophila spindle-class gene, encodes a protein that colocalizes with Vasa and RDE1/AGO1 homolog, Aubergine, in nuage Development Mar. 2003 859-871 130.

Hershberg, R., S. Altuvia and H. Margalit. A survey of small RNA-encoding genes in Escherichia coli Nucleic Acids Res Apr. 1, 2003 1813-1820 31.

Zhou, A., S. Scoggin, R. B. Gaynor and N. S. Williams. Identification of Nf-kappa B-regulated genes induced by TNFalpha utilizing expression profiling and RNA interference Oncogene Apr. 3, 2003 2054-2064 22.

Brennecke, J., D. R. Hipfner, a. Stark, R. B. Russell and S. M. Cohen. bantam encodes a developmentally regulated microRNA that controls cell proliferation and regulates the proapoptotic gene hid in Drosophila Cell Apr. 4, 2003 25-36 113.

Lim, L. P., N. C. Lau, E. G. Weinstein, A. Abdelhakim, S. Yekta, M. W. Rhoades, C. B. Burge and D. P. Bartel. The microRNAs of Caenorhabditis elegans Genes Dev Apr. 15, 2003 991-1008 17.

Xu, P., S. Y. Vernooy, M. Guo and B. A. Hay. The Drosophila microRNA Mir-14 suppresses cell death and is required for normal fat metabolism Curr Biol Apr. 29, 2003 790-795 13.

Xie, Z., K. D. Kasschau and J. C. Carrington. Negative feedback regulation of Dicer-Like1 in Arabidopsis by microRNA-guided mRNA degradation Curr Biol Apr. 29, 2003 784-789 13.

Masse, E., N. Majdalani and S. Gottesman. Regulatory roles for small RNAs in bacteria Curr. Opin Microbiol Apr. 2003 120-124 6.

Carmichael, G. G. Antisense starts making more sense Nat Bioctechnol Apr. 2003 371-372 21.

Yelin, R., D. Dahary, R. Sorek, E. Y. Levanon, O. Goldstein, A. Shoshan, A. Diber, S. Biton, Y. Tamir, R. Khosravi, S. Nemzer, E. Pinner, S. Walach, J. Bernstein, K. Savitsky and G. Rotman. Widespread occurrence of antisense transcription in the human genome.

Boutet, S., F. Vazquez, J. Liu, C. Beclin, M. Fagard, A. Gratias, J. B. Morel, P. Crete, X. Chen and H. Vaucheret. Arabidopsis HEN1: a genetic link between endogenous miRNA controlling development and siRNA controlling transgene silencing and virus resistance Curr Biol May13, 2003 843-848 13.

Ambros, V., R. C. Lee, A. Lavanway, P. T. Williams and D. Jewell. MicroRNAs and other tiny endogenous RNAs in C. elegans Curr Biol May 13, 2003 807-818 13.

Liang, X. S., J. Q. Lian, Y. X. Zhou, Q. H. Nie and C. Q. Hao. A small yeast RNA inhibits HCV IRES mediated translation and inhibits replication of poliovirus in vivo World J Gastroenterol May 2003 1008-1013 9.

Grad, Y., J. Aach, G. D. Hayes, B. J. Reinhart, G. M. Church, G. Ruvkun and J. Kim. Computational and experimental identification of C. elegans microRNAs Mol Cell May 2003 1253-1263 11.

Abrahante, J. E., A. L. Daul, M. Li, M. L. Volk, J. M. Tennessen, E. A. Miller and A. E. Rougvie. The Caenorhabditis elegans hunchback-like gene lin-57/hbl-1 controls developmental time and is regulated by microRNAs Dev Cell May 2003 625-637 4.

Lin, S. Y., S. M. Johnson, M. Abraham, M. C. Vella, A. Pasquinelli, C. Gamberi, E. Gottlieb and F. J. Slack. The C elegans hunchback homolog, hbl-1, controls temporal patterning and is a probable microRNA target Dev Cell May 2003 639-650 4.

Zamvil, S. S. and L. Steinman. Diverse targets for intervention during inflammatory and neurodegenerative phases of multiple sclerosis Neuron Jun. 5, 2003 685-688 38.

Ambros, V. MicroRNA pathways in flies and worms: growth, death, fat, stress, and timing Cell Jun. 13, 2003 673-676 113.

Moss, E. G. and L. Tang. Conservation of the heterochronic regulator Lin-28, its developmental expression and microRNA complementary sites Dev Biol Jun. 15, 2003 432-442 258.

Smalheiser, N. R. EST analyses predict the existence of a population of chimeric microRNA precursor-mRNA transcripts expressed in normal human and mouse tissues Genome Biol Epub 2003 Jun. 18, 2003 403 4.

Kawasaki, H. And K. Taira. Hes1 is a target of microRNA-23 during retinoic-acid-induced neuronal differentiation of NT2 cells Nature Jun. 19, 2003 838-842 423.

Lai, E. C., P. Tomancak, R. W. Williams and G. M. Rubin. Computational identification of Drosophila microRNA genes Genome Biol Epub 2003 Jun. 30, 2003 R42 4.

No author listed. Whither RNAi? Nat Cell Biol Jun. 2003 489-490 5.

Bartel, B. and D. P. Bartel. MicroRNAs: at the root of plant development? Plant Physiol Jun. 2003 709-717 132.

Dykxhoorn, D. M., C. D. Novina and P. A. Sharp. Killing the messenger: short RNAs that silence gene expression Nat Rev Mol Cell Biol Jun. 2003 457-467 4.

Saunders, L. R. and G. N. Barber. The dsRNA binding protein family: critical roles, diverse cellular functions FASEB J Jun. 2003 961-983 17.

Steinman, L. and S. Zamvil. Transcriptional analysis of targets in multiple sclerosis Nat Rev Immunol Jun. 2003 483-492 3.

Qi, Y. and B. Ding. Inhibition of cell growth and shoot development by a specific nucleotide sequence in a noncoding viroid RNA Plant Cell Jun. 2003 1360-1374 15.

Jackson, A. L., S. R. Bartz, J. Schelter, S. V. Kobayashi, J. Burchard, M. Mao, B. Li, G. Cavet and P. S. Linsley. Expression profiling reveals off-target gene regulation by RNAi Nat Biotechnol Jun. 2003 635-637 21.

Bashirullah, A., A. E. Pasquinelli, A. A. Kiger, N. Perrimon, G. Ruvkun and C. S. Thummel. Coordinate regulation of small temporal RNAs at the onset of Drosophila metamorphosis Dev Biol Jul. 1, 2003 1-8 259.

Sempere, L. F., N. S. Sokol, E. B. Dubrovsky, E. M. Berger and V. Ambros. Temporal regulation of microRNA expression in Drosophila melanogaster mediated by hormonal signals and broad-Complex gene activity Dev Biol Jul. 1, 2003 9-18 259.

Heetebrij, R. J., E. G. Talman, M. A. V Velzen, R. P. Van Gijlswijk, S. S. Snoeijers, M. Schalk, J. Wiegant, F. V D Rijke, R. M. Kerkhoven, A. K. Raap, H. J. Tanke, J. Reedijk and H. J. Houthoff. Platinum(II)-based coordination compounds as nucleic acid labeling reagents: synthesis, reactivity, and applications in hybridization assays Chembiochem Jul. 7, 2003 573-583 4.

Borodina, T. A., H. Lehrach and A. V. Soldatov. Ligation-based synthesis of oligonucleotides with block structure Anal Biochem Jul. 15, 2003 309-313 318.

Johnson, S. M., S. Y. Lin and F. J. Slack. The time of appearance of the C. elegans let-7 microRNA is transcriptionally controlled utilizing a temporal regulatory element in its promoter Dev Biol Jul. 15, 2003 364-379 259.

Carrington, J. C. and V. Ambros. Role of microRNAs in plant and animal development Science Jul. 18, 2003 336-338 301.

Smale, S. T. The establishment and maintenance of lymphocyte identity through gene silencing Nat Immunol Jul. 2003 607-615 4.

Bridge, A. J., S. Pebernard, A. Ducraux, A. L. Nicoulaz and R. Iggo. Induction of an interferon response by RNAi vectors in mammalian cells Nat Genet Jul. 2003 263-264 34.

Seitz, H., N. Youngson, S. P. Lin, S. Dalbert, M. Paulsen, J. P. Bachellerie, A. C. Ferguson-Smith and J. Cavaille. Imprinted microRNA genes transcribed antisense to a reciprocally imprinted retrotransposon-like gene Nat Genet Jul. 2003 261-262 34.

Zeng, Y., R. Yi and B. R. Cullen. MicroRNAs and small interfering RNAs can inhibit mRNA expression by similar mechanisms Proc Nat; Acad Sci U S A Aug. 19, 2003 9779-9784 100.

Schramke, V. and R. Allshire. Hairpin RNAs and retrotransposon LTRs effect RNAi and chromatin-based gene silencing Science Aug. 22, 2003 1069-1074 301.

Wiznerowicz, M. and D. Trono. Conditional suppression of cellular genes: lentivirus vector-mediated drug-inducible RNA interference J Virol Aug. 2003 8957-8961 77.

Lau, N. C. and D. P. Bartel. Censors of the genome Sci Am Aug. 2003 34-41 289.

Houbaviy, H. B., M. F. Murray and P. A. Sharp. Embryonic stem cell-specific MicroRNAs Dev Cell Aug. 2003 351-358 5.

Aravin, A. A., M. Lagos-Quintana, A. Yalcin, M. Zavolan, D. Marks, B. Snyder, T. Gaasterland, J. Meyer and T. Tuschl. The small RNA profile during Drosophila melanogaster development Dev Cell Aug. 2003 337-350 5.

McManus, M. T. MicroRNAs and cancer Semin Cancer Biol Aug. 2003 253-258 13.

Baner, J., A. Isaksson, E. Waldenstrom, J. Jarvius, U. Landegren and M. Nilsson. Parallel gene analysis with allele-specific padlock probes and tag microarrays Nucleic Acids Res Sep. 1, 2003 e103 31.

Boutla, A., C. Delidakis and M. Tabler. Developmental defects by antisense-mediated inactivation of micro-RNAs 2 and 13 in Drosophila and the identification of putative target genes Nucleic Acids Res Sep. 1, 2003 4973-4980 31.

Palatnik, J. F., E. Allen, X. Wu, C. Schommer, R. Schwab, J. C. Carrington and D. Weigel. Control of leaf morphogenesis by microRNAs Nature Sep. 18, 2003 257-263 425.

Klein, R. J. and S. R. Eddy. Rsearch: finding homologs of single structured RNA sequences BMC Bioinformatics Sep. 22, 2003 44 4.

Caudy, A. A., R. F. Ketting, S. M. Hammond, A. M. Denli, A. M. Bathoorn, B. B. Tops, J. M. Silva, M. M. Myers, G. J. Hannon and R.

H. Plasterk. A micrococcal nuclease homologue in RNAi effector complexes Nature Sep. 25, 2003 411-414 425.

Lee, Y., C. Ahn, J. Han, H. Choi, J. Kim, J. Yim, J. Lee, P. Provost, O. Radmark, S. Kim and V. N. Kim. The nuclear RNase III Drosha initiates microRNA processing Nature Sep. 25, 2003 415-419 425.

Sledz, C. A., M. Holko, M. J. De Veer, R. H. Silverman and B. R. Williams. Activation of the interferon system by short-interfering RNAs Nat Cell Biol Sep. 2003 834-839 5.

Bergmann, A. and M. E. Lane. HIDden targets of microRNAs for growth control Trends Biochem Sci Sep. 2003 461-463 28.

Khvorova, A., A. Reynolds and S. D. Jayasena. Functional siRNAs and miRNAs exhibit strand bias Cell Oct. 17, 2003 209-216 115.

Schwarz, D. S., G. Hutvagner, T. Du, Z. Xu, N. Aronin and P. D. Zamore. Asymmetry in the assembly of the RNAi enzyme complex Cell Oct. 17, 2003 199-208 115.

Abbott, A. L. Heterochronic genes Curr Biol Oct. 28, 2003 R824-825 13.

Hake, S. MicroRNAs: a role in plant development Curr Biol Oct. 28, 2003 R851-852 13.

Carthew, R. W. Making and breaking with nucleases and small RNAs Nat Struct Biol Oct. 2003 776-777 10.

Krichevsky, A. M., K. S. King, C. P. Donahue, K. Khrapko and K. S. Kosik. A microRNA array reveals extensive regulation of microRNAs during brain development Rna Oct. 2003 1274-1281 9.

Mattick, J. S. Challenging the dogma: the hidden layer of non-protein-coding RNAs in complex organisms Bioessays Oct. 2003 930-939 25.

Nelson, P., M. Kiriakidou, A. Sharma, E. Maniataki and Z. Mourelatos. The microRNA world: small is mighty Trends Biochem Sci Oct. 2003 534-540 28.

Michael, M. Z., O. C. Sm, N. G. Van Holst Pellekaan, G. P. Young and R. J. James. Reduced accumulation of specific microRNAs in colorectal neoplasia Mol Cancer Res Oct. 2003 882- 891 1.

Allinson, T. M., E. T. Parkin, A. J. Turner and N. M. Hooper. ADAMs family members as amyloid precursor protein alpha-secretases J Neurosci Res Nov. 1, 2003 342-352 74.

Kawasaki, H. and K. Taira. Retraction: Hes1 is a target of microRNA-23 during retinoic-acid-induced neuronal differentiation of NT2 cells Nature Nov. 6, 2003 100 426.

Saxena, S., Z. O. Jonsson and A. Dutta. Small RNAs with imperfect match to endogenous mRNA repress translation. Implications for off-target activity of small inhibitory RNA in mammalian cells J Biol Chem Nov. 7, 2003 44312-44319 278.

Basyuk, E., F. Suavet, A. Doglio, R. Bordonne and E. Bertrand. Human let-7 stem-loop precursors harbor features of RNase III cleavage products Nucleic Acids Res Nov. 15, 2003 6593-6597 31.

Stevenson, M. Dissecting HIV-1 through RNA interference Nat Rev Immunol Nov. 2003 851-858 3.

Wienholds, E., M. J. Koudijs, F. J. Van Eeden, E. Cuppen and R. H. Plasterk. The microRNA-producing enzyme Dicer1 is essential for zebrafish development Nat Genet Nov. 2003 217-218 35.

Gibbs, W. W. The unseen genome: gems among the junk Sci Am Nov. 2003 26-33 289.

Chang, J., P. Provost and J. M. Taylor. Resistance of human hepatitis delta virus RNAs to dicer activity J Virol Nov. 2003 11910-11917 77.

Wang, D., A. Urisman, Y. T. Liu, M. Springer, T. G. Ksiazek, D. D. Erdman, E. R. Mardis, M. Hickenbotham, V. Magrini, J. Eldred, J. P. Latreille, R. K. Wilson, D. Ganem and J. L. Derisi. Viral discovery and sequence recovery using DNA microarrays PLoS Biol Nov. 2003 E2 1.

Aukerman, M. J. and H. Sakai. Regulation of flowering time and floral organ identity by a MicroRNA and its APETALA2-like target genes Plant Cell Nov. 2003 2730-2741 15.

Finnegan, E. J. and M. A. Matzke. The small RNA world J Cell Sci Dec. 1, 2003 4689-4693 116.

Enright, A. J., B. John, U. Gaul, T. Tuschl, C. Sander and D. S. Marks. MicroRNA targets in *Drosophila* Genome Biol Epub Dec. 12, 2003 R1 5.

Rosok, O. and M. Sioud. Systematic identification of sense-antisense transcripts in mammalian cells Nat Biotechnol Jan (Epub Dec. 14, 2003) 2004 104-108 22.

Yi, R., Y. Qin, I. G. Macara and B. R. Cullen. Exportin-5 mediates the nuclear export of premicroRNAs and short hairpin RNAs Genes Dev Dec. 15, 2003 3011-3016 17.

Cao, X., W. Aufsatz, D. Zilberman, M. F. Mette, M. S. Huang, M. Matzke and S. E. Jacobsen. Role of the DRM and CMT3 methyltransferases in RNA-directed DNA methylation Curr Biol Dec. 16, 2003 2212-2217 13.

Ye, K., L. Malinina and D. J. Patel. Recognition of small interfering RNA by a viral suppressor of RNA silencing Nature Dec. 18, 2003 874-878 426.

Johnston, R. J. and O. Hobert. A microRNA controlling left/right neuronal asymmetry in *Caenorhabditis elegans* Nature Dec. 18, 2003 845-849 426.

Xayaphoummine, A., T. Bucher, F. Thalmann and H. Isambert. Prediction and statistics of pseudoknots in RNA structures using exactly clustered stochastic simulations Proc Natl Acad Sci U S A Dec. 23, 2003 15310-15315 100.

Lewis, B. P., I. H. Shih, M. W. Jones-Rhoades, D. P. Bartel and C. B. Burge. Prediction of mammalian microRNA targets Cell Dec. 26, 2003 787-798 115.

Robinson, W. H., P. J. Utz and L. Steinman. Genomic and proteomic analysis of multiple sclerosis. Opinion Curr Opin Immunol Dec. 2003 660-667 15.

Gibbs, W. W. The unseen genome: beyond DNA Sci Am Dec. 2003 106-113 289.

Stark, A., J. Brennecke, R. B. Russell and S. M. Cohen. Identification of *Drosophila* MicroRNA targets PLoS Biol Dec. 2003 E60 1.

Konforti, B. The news and you Nat Struct Biol 2003 147 10.

Stein, T. D. and J. A. Johnson. Genetic programming by the proteolytic fragments of the amyloid precursor protein: somewhere between confusion and clarity Rev Neurosci *no. date in pubmed* 2003 317-341 14.

Szymanski, M., M. Z. Barciszewska, M. Zywicki and J. Barciszewski. Noncoding RNA transcripts J Appl Genet *No. Datein Pubmed* 2003 1-19 44.

Griffiths-Jones, S. The microRNA Registry Nucleic Acids Res Jan. 1, 2004 D109-111 32.

Chen, C. Z., L. Li, H. F. Lodish and D. P. Bartel. MicroRNAs modulate hematopoietic lineage differentiation Science Jan. 2, 2004 83-86 303.

Kim, J., A. Krichevsky, Y. Grad, G. D. Hayes, K. S. Kosik, G. M. Church and G. Ruvkun. Identification of many microRNAs that copurify with polyribosomes in mammalian neurons Proc Natl Acad Sci U S A Jan. 6, 2004 360-365 101.

Ohno, M., E. A. Sametsky, L. H. Younkin, H. Oakley, S. G. Younkin, M. Citron, R. Vassar and J. F. Disterhoft. BACE1 deficiency rescues memory deficits and cholinergic dysfunction in a mouse model of Alzheimer's disease Neuron Jan. 8, 2004 27-33 41.

Vella, M. C., E. Y. Choi, S. Y. Lin, K. Reinert and F. J. Slack. The C. elegans microRNA let-7 binds to imperfect let-7 complementary sites from the lin-41 3'UTR Genes Dev Jan. 15, 2004 132-137.

Kao, S. C., A. M. Krichevsky, K. S. Kosik and L. H. Tsai. BACE1 suppression by RNA interference in primary cortical neurons J Biol Chem Jan. 16, 2004 1942-1949 279.

Hofacker, I. L., B. Priwitzer and P. F. Stadler. Prediction of locally stable RNA secondary structures for genome-wide surveys Bioinformatics Jan. 22, 2004 186-190 20.

Ruvkun, G., B. Wightman and I. Ha. The 20 years it took to recognize the importance of tiny RNAs Cell Jan. 23, 2004 S93-96, 92 p. following S96 116.

Bartel, D. P. MicroRNAs: genomics, biogenesis, mechanism, and function Cell Jan. 23, 2004 281-297 116.

Han, M. H., S. Goud, L. Song and N. Fedoroff. The Arabidopsis double-stranded RNA-binding protein HYL1 plays a role in microRNA-mediated gene regulation Proc Natl Acad Sci U S A Jan. 27, 2004 1093-1098 101.

Hartig, J. S., I. Grune, S. H. Najafi-Shoushtari and M. Famulok. Sequence-specific detection of MicroRNAs by signal-amplifying ribozymes J Am Chem Soc Jan. 28, 2004 722-723 126.

Nishitsuji, H., T. Ikeda, H. Miyoshi, T. Ohashi, M. Kannagi and T. Masuda. Expression of small hairpin RNA by lentivirus-based vector confers efficient and stable gene-suppression of HIV-1 on human cells including primary non-dividing cells Microbes Infect Jan. 2004 76-85 6.

Ota, T., Y. Suzuki, T. Nishikawa, T. Otsuki, T. Sugiyama, R. Irie, A., et al. Complete sequencing and characterization of 21,243 full-length human cDNAs Nat Genet Jan. 2004 40-45 36.

Colciaghi, F., E. Marcello, B. Borroni, M. Zimmermann, C. Caltagirone, F. Cattabeni, A. Padovani and M. Di Luca. Platelet App, Adam 10 and BACE alterations in the early stages of Alzheimer disease Neurology Feb. 10, 2004 498-501 62.

Boden, D., O. Pusch, R. Silbermann, F. Lee, L. Tucker and B. Ramratnam. Enhanced gene silencing of HIV-1 specific siRNA using microRNA designed hairpins Nucleic Acids Res Feb. 13, 2004 1154-1158 32.

Sempere, L. F., S. Freemantle, I. Pitha-Rowe, E. Moss, E. Dmitrovsky and V. Ambros. Expression profiling of mammalian microRNAs uncovers a subset of brain-expressed microRNAs with possible roles in murine and human neuronal differentiation Genome Biol Epub 2004 Feb. 16, 2004 R13 5.

Scacheri, P. C., O. Rozenblatt-Rosen, N. J. Caplen, T. G. Wolfsberg, L. Umayam, J. C. Lee, C. M. Hughes, K. S. Shanmugam, A. Bhattacharjee, M. Meyerson and F. S. Collins. Short interfering RNAs can induce unexpected and divergent changes in the levels of untargeted proteins in mammalian cells Proc Natl Acad Sci U S A Feb. 17, 2004 1892-1897 101.

Xie, Z., L. K. Johansen, A. M. Gustafson, K. D. Kasschau, A. D. Lellis, D. Zilberman, S. E. Jacobsen and J. C. Carrington. Genetic and functional diversification of small RNA pathways in plants PLoS Biol May (Epub Feb. 18, 2004) 2004 E104 2.

Cawley, S., S. Bekiranov, H. H. Ng, P. Kapranov, E. A. Sekinger, D. Kampa, A. Piccolboni, V. Sementchenko, J. Cheng, A. J. Williams, R. Wheeler, B. Wong, J. Drenkow, M. Yamanaka, S. Patel, S. Brubaker, H. Tammana, G. Helt, K. Struhl and T. R. Gingeras. Unbiased mapping of transcription factor binding sites along human chromosomes 21 and 22 points to widespread regulation of noncoding RNAs Cell Feb 20, 2004 499-509 116.

Dandekar, D. H., K. N. Ganesh and D. Mitra. HIV-1 Tat directly binds to NFkappaB enhancer sequence: role in viral and cellular gene expression Nucleic Acids Res Feb 23, 2004 1270-1278 32.

Hutvagner, G., M. J. Simard, C. C. Mello and P. D. Zamore. Sequence-specific inhibition of small RNA function PLoS Biol Apr. (Epub Feb. 24, 2004) 2004 E98 2.

Schmittgen, T. D., J. Jiang, Q. Liu and L. Yang. A high-throughput method to monitor the expression of microRNA precursors Nucleic Acids Res Feb. 25, 2004 e43 32.

Stremlau, M., C. M. Owens, M. J. Perron, M. Kiessling, P. Autissier and J. Sodroski. The cytoplasmic body component TRIM5alpha restricts HIV-1 infection in Old World monkeys Nature Feb. 26, 2004 848-853 427.

Bohnsack, M. T., K. Czaplinski and D. Gorlich. Exportin 5 is a RanGTP-dependent dsRNA-binding protein that mediates nuclear export of pre-miRNAs Rna Feb. 2004 185-191 10.

Demidov, V. V. and M. D. Frank-Kamenetskii. Two sides of the coin: affinity and specificity of nucleic acid interactions Trends Biochem Sci Feb. 2004 62-71 29.

Maquat, L. E. Nonsense-mediated mRNA decay: splicing, translation and mRNP dynamics Nat Rev Mol Cell Biol Feb. 2004 89-99 5.

Nijholt, I., N. Farchi, M. Kye, E. H. Sklan, S. Shoham, B. Verbeure, D. Owen, B. Hochner, J. Spiess, H. Soreq and T. Blank. Stress-induced alternative splicing of acetylcholinesterase results in enhanced fear memory and long-term potentiation Mol Psychiatry Feb. 2004 174-183 9.

Sengupta, P. Taking sides in the nervous system with miRNA Nat Neurosci Feb. 2004 100-102 7.

Zerhouni, B., J. A. Nelson and K. Saha. Isolation of CD4-independent primary human immunodeficiency virus type 1 isolates that are syncytium inducing and acutely cytopathic for CD8+ lymphocytes J Virol Feb. 2004 1243-1255 78.

Jin, P., D. C. Zarnescu, S. Ceman, M. Nakamoto, J. Mowrey, T. A. Jongens, D. L. Nelson, K. Moses and S. T. Warren. Biochemical and genetic interaction between the fragile X mental retardation protein and the microRNA pathway Nat Neurosci Feb. 2004 113-117 7.

Lai, E. C., C. Wiel and G. M. Rubin. Complementary miRNA pairs suggest a regulatory role for miRNA:miRNA duplexes Rna Feb. 2004 171-175 10.

Metzler, M., M. Wilda, K. Busch, S. Viehmann and A. Borkhardt. High expression of precursor microRNA-155/BIC RNA in children with Burkitt lymphoma Genes Chromosomes Cancer Feb. 2004 167-169 39.

Doench, J. G. and P. A. Sharp. Specificity of microRNA target selection in translational repression Genes Dev Mar. 1, 2004 504-511 18.

Liang, X. S., J. Q. Lian, Y. X. Zhou and M. B. Wan. Inhibitor RNA blocks the protein translation mediated by hepatitis C virus internal ribosome entry site in vivo World J Gastroenterol Mar. 1, 2004 664-667 10.

Calin, G. A., C. Sevignani, C. D. Dumitru, T. Hyslop, E. Noch, S. Yendamuri, M. Shimizu, S. Rattan, F. Bullrich, M. Negrini and C. M. Croce. Human microRNA genes are frequently located at fragile sites and genomic regions involved in cancers Proc Natl Acad Sci U S A Mar. 2, 2004 2999-3004 101.

Juarez, M. T., J. S. Kui, J. Thomas, B. A. Heller and M. C. Timmermans. microRNA-mediated repression of rolled leaf1 specifies maize leaf polarity Nature Mar. 4, 2004 84-88 428.

Kidner, C. A. And R. A. Martienssen. Spatially restricted microRNA directs leaf polarity through Argonaute1 Nature Mar. 4, 2004 81-84 428.

Zamore, P. D. Plant RNAi: How a viral silencing suppressor inactivates siRNA Curr Biol Mar. 9, 2004 R198-200 14.

Wang, J. F., H. Zhou, Y. Q. Chen, Q. J. Luo and L. H. Qu. Identification of 20 microRNAs from Oryza sativa Nucleic Acids Res Mar. 12, 2004 1688-1695 32.

Jack, T. Molecular and genetic mechanisms of floral control Plant Cell Epub 2004 Mar. 12, 2004 2004 S1-17 16 Suppl.

Roth, M. E., L. Feng, K. J. McConnell, P. J. Schaffer, C. E. Guerra, J. P. Affourtit, K. R. Piper, L. Guccione, J. Hariharan, M. J. Ford, S. W. Powell, H. Krishnaswamy, J. Lane, L. Guccione, G. Intrieri, J. S. Merkel, C. Perbost, A. Valerio, B. Zolla, C. D. Graham, J. Hnath, C. Michaelson, R. Wang, B. Ying, C. Halling, C. E. Parman, D. Raha, B. Orr, B. Jedrzkiewicz, J. Liao, A. Tevelev, M. J. Mattessich, D. M. Kranz, M. Lacey, J. C. Kaufman, J. Kim, D. R. Latimer and P. M. Lizardi. Expression profiling using a hexamer-based universal microarray Nat Biotechnol Apr. (Epub Mar. 14, 2004) 2004 418-426 22.

Rajewsky, N. and N. D. Socci. Computational identification of microRNA targets Dev Biol Mar. 15, 2004 529-535 267.

Winkler, W. C., A. Nahvi, A. Roth, J. A. Collins and R. R. Breaker. Control of gene expression by a natural metabolite-responsive ribozyme Nature Mar. 18, 2004 281-286 428.

Kuwabara, T., J. Hsieh, K. Nakashima, K. Taira and F. H. Gage. A small modulatory dsRNA specifies the fate of adult neural stem cells Cell Mar. 19, 2004 779-793 116.

Chen, X. A microRNA as a translational repressor of APETALA2 in *Arabidopsis* flower development Science Mar. 26, 2004 2022-2025 303.

Carmell, M. A. and G. J. Hannon. RNase III enzymes and the initiation of gene silencing Nat Struct Mol Biol Mar. 2004 214-218 11.

Davidson, B. L. and H. L. Paulson. Molecular medicine for the brain: silencing of disease genes with RNA interference Lancet Neurol Mar. 2004 145-149 3.

Kawasaki, H., R. Wadhwa and K. Taira. World of small RNAs: from ribozymes to siRNA and miRNA Differentiation Mar. 2004 58-64 72.

Meister, G., M. Landthaler, Y. Dorsett and T. Tuschl. Sequence-specific inhibition of microRNA- and siRNA-induced RNA silencing Rna Mar. 2004 544-550 10.

Nelson, P. T., A. G. Hatzigeorgiou and Z. Mourelatos. miRNP:mRNA association in polyribosomes in a human neuronal cell line Rna Mar. 2004 387-394 10.

Floyd, S. K. and J. L. Bowman. Gene regulation: ancient microRNA target sequences in plants Nature Apr. 1, 2004 485-486 428.

Dorsett, Y. and T. Tuschl. siRNAs: applications in functional genomics and potential as therapeutics Nat Rev Drug Discov Apr. 2004 318-329 3.

Mallory, A. C. and H. Vaucheret. MicroRNAs: something important between the genes Curr Opin Plant Biol Apr. 2004 120-125 7.

Ogita, S., H. Uefuji, M. Morimoto and H. Sano. Application of RNAi to confirm theobromine as the major intermediate for caffeine biosynthesis in coffee plants with potential for construction of decaffeinated varieties Plant Mol Biol Apr. 2004 931-941 54.

Storz, G., J. A. Opdyke and A. Zhang. Controlling mRNA stability and translation with small, noncoding RNAs Curr Opin Microbiol Apr. 2004 140-144 7.

Kim, V. N. MicroRNA precursors in motion: exportin-5 mediates their nuclear export Trends Cell Biol Apr. 2004 156-159 14.

Jabri, E. RISCy business Nat Struct Mol Biol Apr. 2004 300 11.

Nakahara, K. and R. W. Carthew. Expanding roles for miRNAs and siRNAs in cell regulation Curr Opin Cell Biol Apr. 2004 127-133 16.

Ambinder, R.F. et al. "Epstein-Barr virus genome B95-8." XP002500226. Retrieved from EBI Database accession No. ADN12161. Database EMBL Jun. 17, 2004.

"Human herpesvirus 4 complete wild type genome." XP002500227. Retrieved from EBI Database accession No. AJ507799. Abstract. Database EMBL Oct. 9, 2002.

European Search Report for European Pat. App. No. 05774516.8, mailed by European Patent Office on Nov. 27, 2008.

\* cited by examiner

FIG. 2A

5'UTR SEQUENCE (5' TO 3') OF HIV-1 (U5-R)

GGTCTCTCTGGTTAGACCAGATCTGAGCCTGGGAGCTCTCTGGCTAACT
AGGGAACCCACTGCTTAAGCCTCAATAAAGCTTGCCTTGAGTGCTTCAAGTA
GTGTGTGCCCGTCTGTTGTGTGACTCTGGTAACTAGAGATCCCTCAGACCCTT
TTAGTCAGTGTGGAAAATCTCTAGCAGTGGCGCCCGAACAGGGACCTGAAAG
CGAAAGGGAAACCAGAGGAGCTCTCTCGACGCAGGACTCGGCTTGCTGAA
GCGCGCACG<u>GCAAGAGGCGAGGGGCG</u>GCGACTGGTGAGTACGCCAAAAA
TTTTGACTAGCGGAGGCTAGAAGGAGAGAG

FIG. 2B

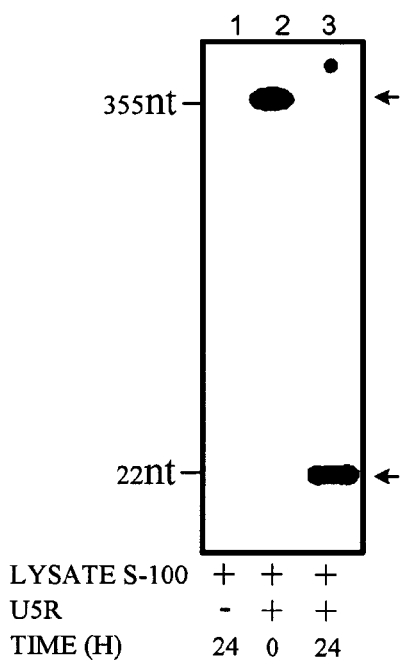

FIG. 2C

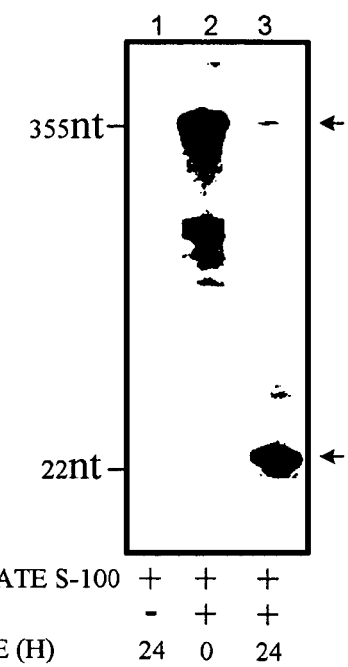

Fig 2E

TRANSCRIPT SEQUENCE (5' TO 3'):

TGGGAAGCCCTCAAATATTGGTGG
AATCTCCTACAGTATTGGAGTCAG
GAACTAAAGAATAGTGCTGTTAGC
TTGCTCAATGCCACAGCCATAGCA
GTAGCTGAGGGGACAGATAGGGTT
ATAGAAGTAGTACAAGGAGCTTGT
AGAGCTATTCGCCACATACCTAGA
AGAATAAGACAGGGCTTGGAAAGG
ATTTTGCT

GAM RNA:
TGAGGGGACAGATAGGGTTATAGA

200nt —
22nt —

| | 1 | 2 |
|---|---|---|
| LYSATE S-100 | + | + |
| TRANSCRIPT | + | + |
| TIME (H) | 0 | 24 |

Fig 2D

TRANSCRIPT SEQUENCE (5' TO 3'):

ACAGGGCTGCTATTAACAAGAGAT
GGTGGTAATAGCAACAATGAGTCC
GAGATCTTCAGACCTGGAGGAGGA
GATATGAGGGACAATTGGAGAAGT
GAATTATATAAATATAAAGTAGTA
AAAATTGAACCATTAGGAGTAGCA
CCCACCAAGGCAAAGAGAA

GAM RNA:
TGAGTCCGAGATCTTCAGACCTGG

163nt —
22nt —

| | 1 | 2 |
|---|---|---|
| LYSATE S-100 | + | + |
| TRANSCRIPT | + | + |
| TIME (H) | 0 | 24 |

VIRAL AND VIRAL ASSOCIATED MIRNAS AND USES THEREOF

CROSS REFERENCE TO RELATED APPLICATIONS

The present application is a continuation of International Application No. PCT/IB2005/002352, filed May 26, 2005, which is a continuation-in-part of U.S. patent application Ser. No. 10/709,739, filed May 26, 2004 and which claims the benefit of U.S. Provisional Application No. 60/522,459, filed Oct. 4, 2004, U.S. Provisional Application No. 60/665,094, filed Mar. 25, 2005, U.S. Provisional Application No. 60/522,450, filed Oct. 3, 2004, and U.S. Provisional Application No. 60/522,451, filed Oct. 3, 2004, each of which is incorporated herein by reference.

FIELD OF THE INVENTION

The invention relates in general to viral microRNA molecules and to a group of human microRNA molecules associated with viral infections, as well as various nucleic acid molecules relating thereto or derived therefrom.

BACKGROUND OF THE INVENTION

MicroRNAs (miRNAs) are short RNA oligonucleotides of approximately 22 nucleotides that are involved in gene regulation. MicroRNAs regulate gene expression by targeting miRNAs for cleavage or translational repression. Although miRNAs are present in a wide range of species including *C. elegans, Drosophila* and humans, they have only recently been identified. More importantly, the role of miRNAs in the development and progression of disease has only recently become appreciated.

As a result of their small size, miRNAs have been difficult to identify using standard methodologies. A limited number of miRNAs have been identified by extracting large quantities of RNA. MiRNAs have also been identified that contribute to the presentation of visibly discernable phenotypes. Expression array data shows that miRNAs are expressed in different developmental stages or in different tissues. The restriction of miRNAs to certain tissues or at limited developmental stages indicates that the miRNAs identified to date are likely only a small fraction of the total miRNAs.

Computational approaches have recently been developed to identify the remainder of miRNAs in the genome. Tools such as MiRscan and MiRseeker have identified miRNAs that were later experimentally confirmed. Based on these computational tools, it has been estimated that the human genome contains 200-255 miRNA genes. These estimates are based on an assumption, however, that the miRNAs remaining to be identified will have the same properties as those miRNAs already identified. Based on the fundamental importance of miRNAs in mammalian biology and disease, the art needs to identify unknown miRNAs. The present invention satisfies this need and provides a significant number of miRNAs and uses therefore. To date, no viral miRNAs have been detected.

SUMMARY OF THE INVENTION

The present invention is related to an isolated nucleic acid comprising a sequence of a pri-miRNA, pre-miRNA, miRNA, miRNA*, anti-miRNA, or a miRNA binding site, or a variant thereof. The nucleic acid may comprise SEQS: 4097721-4204913; the sequence of a precursor referred to in Table 1, 11-12 or 21-23; SEQS: 1-1142416 or 4204914-4204915; the sequence of a miRNA referred to in Table 1, 13-14 or 21-23; SEQS: 1142417-4097720; the sequence of a target gene binding site referred to in Tables 4, 10 or 15-16; a complement thereof; or a sequence comprising at least 12 contiguous nucleotides at least 70% identical thereto. The isolated nucleic acid may be from 5-250 nucleotides in length.

The present invention is also related to a probe comprising the nucleic acid. The probe may comprise at least 8-22 contiguous nucleotides complementary to SEQS: 1-1142416 or 4204914-4204915, a miRNA referred to in Table 1, 13-14 or 21-23, or a variant thereof. The probe may also comprise at least 8-22 contiguous nucleotides complementary to a human miRNA differentially expressed in viral infection, or variant thereof.

The present invention is also related to a plurality of the probes. The plurality of probes may comprise at least ten of the probes. The plurality of probes may also comprise at least 100 of the probes. The present invention is also related to a composition comprising a probe or plurality of probes. The present invention is also related to a biochip comprising a solid substrate, said substrate comprising a plurality of the probes. Each of the probes may be attached to the substrate at a spatially defined address. The biochip may comprise probes that are complementary to a viral miRNA. The biochip may also comprise probes that are complementary to a human miRNA characterized by expression during viral infection.

The present invention is also related to a method of detecting differential expression of a disease-associated miRNA. A biological sample may be provided and the level of a nucleic acid measured that is at least 70% identical to SEQS: 1-1142416 or 4204914-4204915; the sequence of a miRNA referred to in Table 1, 13-14 and 21-23; or a variant thereof. A difference in the level of the nucleic acid compared to a control is indicative of differential expression.

The present invention is also related to a method of identifying a compound that modulates a pathological condition. A cell may be provided that is capable of expressing a nucleic acid at least 70% identical to SEQS: 1-1142416; the sequence of a miRNA referred to in Table 1, 13-14 and 21-23; or a variant thereof. The cell may be contacted with a candidate modulator and then measuring the level of expression of the nucleic acid. A difference in the level of the nucleic acid compared to a control identifies the compound as a modulator of a pathological condition associated with the nucleic acid.

The present invention is also related to a method of inhibiting expression of a target gene in a cell. Into the cell, a nucleic acid may be introduced in an amount sufficient to inhibit expression of the target gene. The target gene may comprise a binding site substantially identical to a binding site referred to in Tables 4, 10 or 15-16, or a variant thereof. The nucleic acid may comprise a portion of SEQS: 1-1142416 or 4204914-4204915; the sequence of a miRNA referred to in Table 1, 13-14 or 21-23; or a variant thereof. Expression of the target gene may be inhibited in vitro or in vivo.

The present invention is also related to a method of increasing expression of a target gene in a cell. Into the cell, a nucleic acid may be introduced in an amount sufficient to increase expression of the target gene. The target gene may comprise a binding site substantially identical to a binding site referred to in Tables 4, 10 or 15-16, or a variant thereof. A portion of the nucleic acid may be substantially complementary to SEQS: 1-1142416 or 4204914-4204915; the sequence of a miRNA referred to in Table 1, 13-14 or 21-23; or a variant thereof. Expression of the target gene may be inhibited in vitro or in vivo. Expression of the target gene may be increased in vitro or in vivo.

The present invention is also related to a method of treating a patient with a disorder set forth on Table 6 comprising administering to a patient in need thereof a nucleic acid comprising a sequence of SEQS: 1-760616; a sequence set forth on Table 10; a sequence set forth on Table 17; or a variant thereof.

The present invention is also related to a method of treating a patient with a viral infection or a condition associated with a viral infection comprising administering to a patient in need thereof a nucleic acid, wherein a portion of the nucleic acid is substantially complementary to SEQ ID NOS: 1-1142416 or 4204914-4204915; the sequence of a miRNA referred to in Table 1, 13-14, or 21-23; or a variant thereof.

BRIEF DESCRIPTION OF SEQUENCE LISTING AND TABLES

Reference is made to the appendix submitted herewith. The appendix contains the following: Patent45 U.S. Ser. No. 11/511,035 Sequence Listing January 2008 Amended 01.tx t (20,000 KB); Patent45 U.S. Ser. No. 11/511,035 Sequence Listing January 2008 Amended 02.tx t (20,001 KB), Patent45 U.S. Ser. No. 11/511,035 Sequence Listing January 2008 Amended 03.tx t (20,001 KB); Patent45 U.S. Ser. No. 11/511, 035 Sequence Listing January 2008 Amended 04.tx t (20,000 KB); Patent45 U.S. Ser. No. 11/511,035 Sequence Listing January 2008 Amended 05.tx t (20,001 KB); and Patent45 U.S. Ser. No. 11/511,035 Sequence Listing January 2008 Amended 06.tx t (16,700 KB), which were all created on Jan. 8, 2008 and are altogether a sequence listing in accordance with 37 C.F.R. §§1.821-1.825, the contents of which are incorporated by reference herein.

Reference is made to the tables submitted in electronic form herewith. The tables consist of the following: "Table1.txt" (4 KB), "Table2.txt" (2 KB), "Table3.txt" (1 KB), "Table4.txt" (244 KB), "Table5.txt" (1 KB), "Table6.txt" (1 KB), "Table7.txt" (5 KB), "Table8.txt" (190 KB), "Table9.txt" (1 KB), "Table10.txt" (2 KB), which were all created on Sep. 19, 2008, the contents of all of which are incorporated by reference herein.

otide different from the miRNA presented in FIG. 2B. FIGS. 2B and 2C depict Northern blot analysis of miRNA oligonucleotides that are present in U5R, hybridized with predicted mature miRNA probes. The upper arrow indicates the molecular size of the entire 355 nt U5R transcript. The predicted molecular sizes of the two GAM RNAs are 22 nt and 17 nt, respectively. The lower arrow indicates the 22 nt molecular marker. Lanes: 1—Hela lysate; 2—U5R transcript in HeLa Lysate without incubation; and 3—U5R transcript incubated for 24 hours with Hela lysate. FIGS. 2D and 2E present partial transcripts of HIV1 RNA (SEQ ID NOS: 547374 and 547375) reacted with predicted mature HIV1 miRNA probes (SEQ ID NOS: 547376 and 547377). In each figure, the experimental transcript sequence is shown, and the predicted mature miRNA is underlined. Northern blot analyses of miRNA precursors are presented. It is demonstrated that one miRNA precursor transcript is 163 nt and the other miRNA precursor transcript is 200 nt. The predicted molecular sizes of mature miRNA are both 24 nt. The 22 nt molecular marker is indicated. Lanes: 1—Transcript in HeLa Lysate without incubation and 2—Transcript incubated for 24 hours with HeLa lysate. arrow indicates the 22 nt molecular marker. Lanes: 1—Hela lysate; 2—U5R transcript in HeLa Lysate without incubation; and 3—U5R transcript incubated for 24 hours with Hela lysate. FIGS. 2D and 2E present partial transcripts of HIV1 RNA (SEQ ID NOS: 547374 and 547375) reacted with predicted mature HIV1 miRNA probes (SEQ ID NOS: 547376 and 547377). In each figure, the experimental transcript sequence is shown, and the predicted mature miRNA is underlined. Northern blot analyses of miRNA precursors are presented. It is demonstrated that one miRNA precursor transcript is 163 nt and the other miRNA precursor transcript is 200 nt. The predicted molecular sizes of mature miRNA are both 24 nt. The 22 nt molecular marker is indicated. Lanes: 1—Transcript in HeLa Lysate without incubation and 2—Transcript incubated for 24 hours with HeLa lysate.

FIG. 3 shows the results of a Northern Blot. The expression profile of GAM506333 and GAM506336 in EBV-infected (B95/8 EBV) and non-infected (PBMC) cells are presented. The expression of these miRNAs was demonstrated on a miRNA microarray hybridized with RNA from B-95/8 cell

LENGTHY TABLES

The patent contains a lengthy table section. A copy of the table is available in electronic form from the USPTO web site (http://seqdata.uspto.gov/?pageRequest=docDetail&DocID=US07795419B2). An electronic copy of the table will also be available from the USPTO upon request and payment of the fee set forth in 37 CFR 1.19(b)(3).

BRIEF DESCRIPTION OF THE DRAWINGS

FIG. 2A shows the 5'UTR of HIV1 (U5R)(SEQ ID NO: 547373) containing two predicted miRNAs in bold. The mature miRNAs are underlined, one closer to the 5' end (FIG. 2B) and the second closer to the 3' end (FIG. 2C). The 5'-most miRNA matches the known HIV1 RNA structure named TAR to which the TAT protein binds (Nature 1987. 330:489-93). A similar miRNA (GAM NAME 506033) was also lit on the chip. This miRNA probe was designed based on the sequence of T-tropic HIV-1 (LAV-1), Subtype B, which is one nuclelines infected with EBV. Probes against these validated miRNA predictions were hybridized with total RNA on a Northern blot. Northern blots confirmed high expression of these two miRNAs in the infected cells on the microarray.

DETAILED DESCRIPTION

Figure 1:
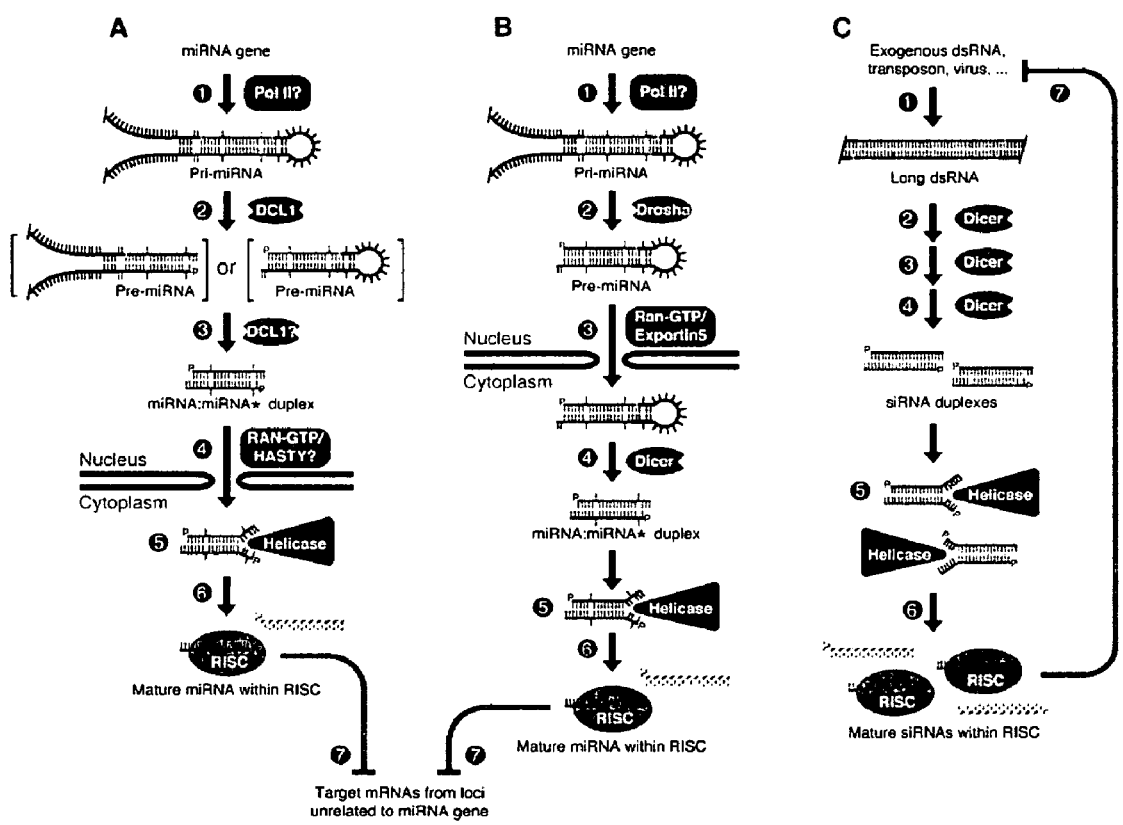
FIG. 1 demonstrates a model of maturation for miRNAs.

The present invention provides nucleotide sequences of viral and viral-associated miRNAs, precursors thereto, targets thereof and related sequences. Such nucleic acids are useful for diagnostic purposes, and also for modifying target gene expression. Other aspects of the invention will become apparent to the skilled artisan by the following description of the invention.

1. Definitions

Before the present compounds, products and compositions and methods are disclosed and described, it is to be understood that the terminology used herein is for the purpose of describing particular embodiments only and is not intended to be limiting. It must be noted that, as used in the specification and the appended claims, the singular forms "a," "an" and "the" include plural referents unless the context clearly dictates otherwise. It must further be noted that the terms "and" and "or" may encompass both conjunctive and disjunctive meaning unless the context clearly dictates otherwise.

"Animal" as used herein may mean fish, amphibians, reptiles, birds, and mammals, such as mice, rats, rabbits, goats, cats, dogs, cows, apes and humans.

"Attached" or "immobilized" as used herein to refer to a probe and a solid support may mean that the binding between the probe and the solid support is sufficient to be stable under conditions of binding, washing, analysis, and removal. The binding may be covalent or non-covalent. Covalent bonds may be formed directly between the probe and the solid support or may be formed by a cross linker or by inclusion of a specific reactive group on either the solid support or the probe or both molecules. Non-covalent binding may be one or more of electrostatic, hydrophilic, and hydrophobic interactions. Included in non-covalent binding is the covalent attachment of a molecule, such as streptavidin, to the support and the non-covalent binding of a biotinylated probe to the streptavidin. Immobilization may also involve a combination of covalent and non-covalent interactions.

"Biological sample" as used herein may mean a sample of biological tissue or fluid that comprises nucleic acids. Such samples include, but are not limited to, tissue isolated from animals. Biological samples may also include sections of tissues such as biopsy and autopsy samples, frozen sections taken for histologic purposes, blood, plasma, serum, sputum, stool, tears, mucus, hair, and skin. Biological samples also include explants and primary and/or transformed cell cultures derived from patient tissues. A biological sample may be provided by removing a sample of cells from an animal, but can also be accomplished by using previously isolated cells (e.g., isolated by another person, at another time, and/or for another purpose), or by performing the methods of the invention in vivo. Archival tissues, such as those having treatment or outcome history, may also be used.

"Complement" or "complementary" as used herein may mean Watson-Crick or Hoogsteen base pairing between nucleotides or nucleotide analogs of nucleic acid molecules.

"Differential expression" may mean qualitative or quantitative differences in the temporal and/or cellular gene expression patterns within and among cells and tissue. Thus, a differentially expressed gene can qualitatively have its expression altered, including an activation or inactivation, in, e.g., normal versus disease tissue. Genes may be turned on or turned off in a particular state, relative to another state thus permitting comparison of two or more states. A qualitatively regulated gene will exhibit an expression pattern within a state or cell type which may be detectable by standard techniques. Some genes will be expressed in one state or cell type, but not in both. Alternatively, the difference in expression may be quantitative, e.g., in that expression is modulated, either up-regulated, resulting in an increased amount of transcript, or down-regulated, resulting in a decreased amount of transcript. The degree to which expression differs need only be large enough to quantify via standard characterization techniques such as expression arrays, quantitative reverse transcriptase PCR, northern analysis, and RNase protection.

"Gene" used herein may be a genomic gene comprising transcriptional and/or translational regulatory sequences and/or a coding region and/or non-translated sequences (e.g., introns, 5'- and 3'-untranslated sequences). The coding region of a gene may be a nucleotide sequence coding for an amino acid sequence or a functional RNA, such as tRNA, rRNA, catalytic RNA, siRNA, miRNA and antisense RNA. A gene may also be an miRNA or cDNA corresponding to the coding regions (e.g., exons and miRNA) optionally comprising 5'- or 3'-untranslated sequences linked thereto. A gene may also be an amplified nucleic acid molecule produced in vitro comprising all or a part of the coding region and/or 5'- or 3'-untranslated sequences linked thereto.

"Host cell" used herein may be a naturally occurring cell or a transformed cell that contains a vector and supports the replication of the vector. Host cells may be cultured cells, explants, cells in vivo, and the like. Host cells may be prokaryotic cells such as E. coli, or eukaryotic cells such as yeast, insect, amphibian, or mammalian cells, such as CHO, HeLa.

"Identical" or "identity" as used herein in the context of two or more nucleic acids or polypeptide sequences, may mean that the sequences have a specified percentage of nucleotides or amino acids that are the same over a specified region. The percentage may be calculated by comparing optimally aligning the two sequences, comparing the two sequences over the specified region, determining the number of positions at which the identical residue occurs in both sequences to yield the number of matched positions, dividing the number of matched positions by the total number of positions in the specified region, and multiplying the result by 100 to yield the percentage of sequence identity. In cases where the two sequences are of different lengths or the alignment produces staggered end and the specified region of comparison includes only a single sequence, the residues of single sequence are included in the denominator but not the numerator of the calculation. When comparing DNA and RNA, thymine (T) and uracil (U) are considered equivalent. Identity may be performed manually or by using computer sequence algorithm such as BLAST or BLAST 2.0.

"Inhibit" as used herein may mean prevent, suppress, repress, reduce or eliminate.

"Label" as used herein may mean a composition detectable by spectroscopic, photochemical, biochemical, immunochemical, chemical, or other physical means. For example, useful labels include $^{32}P$, fluorescent dyes, electron-dense reagents, enzymes (e.g., as commonly used in an ELISA), biotin, digoxigenin, or haptens and other entities which can be made detectable. A label may be incorporated into nucleic acids and proteins at any position.

"Nucleic acid" or "oligonucleotide" or "polynucleotide" used herein may mean at least two nucleotides covalently linked together. As will be appreciated by those in the art, the depiction of a single strand also defines the sequence of the complementary strand. Thus, a nucleic acid also encompasses the complementary strand of a depicted single strand. As will also be appreciated by those in the art, many variants of a nucleic acid may be used for the same purpose as a given nucleic acid. Thus, a nucleic acid also encompasses substantially identical nucleic acids and complements thereof. As will also be appreciated by those in the art, a single strand provides a probe for a probe that may hybridize to the target sequence under stringent hybridization conditions. Thus, a nucleic acid also encompasses a probe that hybridizes under stringent hybridization conditions.

Nucleic acids may be single stranded or double stranded, or may contain portions of both double stranded and single stranded sequence. The nucleic acid may be DNA, both genomic and cDNA, RNA, or a hybrid, where the nucleic acid may contain combinations of deoxyribo- and ribo-nucleotides, and combinations of bases including uracil, adenine, thymine, cytosine, guanine, inosine, xanthine hypoxanthine, isocytosine and isoguanine. Nucleic acids may be obtained by chemical synthesis methods or by recombinant methods.

A nucleic acid will generally contain phosphodiester bonds, although nucleic acid analogs may be included that may have at least one different linkage, e.g., phosphoramidate, phosphorothioate, phosphorodithioate, or O-methylphosphoroamidite linkages and peptide nucleic acid backbones and linkages. Other analog nucleic acids include those with positive backbones; non-ionic backbones, and non-ribose backbones, including those described in U.S. Pat. Nos. 5,235,033 and 5,034,506, which are incorporated by reference. Nucleic acids containing one or more non-naturally occurring or modified nucleotides are also included within one definition of nucleic acids. The modified nucleotide analog may be located for example at the 5'-end and/or the 3'-end of the nucleic acid molecule. Representative examples of nucleotide analogs may be selected from sugar- or backbone-modified ribonucleotides. It should be noted, however, that also nucleobase-modified ribonucleotides, i.e. ribonucleotides, containing a non-naturally occurring nucleobase instead of a naturally occurring nucleobase such as uridines or cytidines modified at the 5-position, e.g. 5-(2-amino)propyl uridine, 5-bromo uridine; adenosines and guanosines modified at the 8-position, e.g. 8-bromo guanosine; deaza nucleotides, e.g. 7-deaza-adenosine; O- and N-alkylated nucleotides, e.g. N6-methyl adenosine are suitable. The 2'-OH-group may be replaced by a group selected from H, OR, R, halo, SH, SR, $NH_2$, NHR, $NR_2$ or CN, wherein R is $C_1$-$C_6$ alkyl, alkenyl or alkynyl and halo is F, Cl, Br or I. Modifications of the ribose-phosphate backbone may be done for a variety of reasons, e.g., to increase the stability and half-life of such molecules in physiological environments or as probes on a biochip. Mixtures of naturally occurring nucleic acids and analogs may be made; alternatively, mixtures of different nucleic acid analogs, and mixtures of naturally occurring nucleic acids and analogs may be made.

"Operably linked" used herein may mean that expression of a gene is under the control of a promoter with which it is spatially connected. A promoter may be positioned 5' (upstream) or 3' (downstream) of the gene under its control. The distance between the promoter and the gene may be approximately the same as the distance between that promoter and the gene it controls in the gene from which the promoter is derived. As is known in the art, variation in this distance can be accommodated without loss of promoter function.

"Probe" as used herein may mean an oligonucleotide capable of binding to a target nucleic acid of complementary sequence through one or more types of chemical bonds, usually through complementary base pairing, usually through hydrogen bond formation. Probes may bind target sequences lacking complete complementarity with the probe sequence depending upon the stringency of the hybridization conditions. There may be any number of base pair mismatches which will interfere with hybridization between the target sequence and the single stranded nucleic acids of the present invention. However, if the number of mutations is so great that no hybridization can occur under even the least stringent of hybridization conditions, the sequence is not a complementary target sequence. A probe may be single stranded or partially single and partially double stranded. The strandedness of the probe is dictated by the structure, composition, and properties of the target sequence. Probes may be directly labeled or indirectly labeled such as with biotin to which a streptavidin complex may later bind.

"Promoter" as used herein may mean a synthetic or naturally-derived molecule which is capable of conferring, activating or enhancing expression of a nucleic acid in a cell. A promoter may comprise one or more specific regulatory elements to further enhance expression and/or to alter the spatial expression and/or temporal expression of same. A promoter may also comprise distal enhancer or repressor elements, which can be located as much as several thousand base pairs from the start site of transcription. A promoter may be derived from sources including viral, bacterial, fungal, plants, insects, and animals. A promoter may regulate the expression of a gene component constitutively, or differentially with respect to cell, the tissue or organ in which expression occurs or, with respect to the developmental stage at which expression occurs, or in response to external stimuli such as physiological stresses, pathogens, metal ions, or inducing agents. Representative examples of promoters include the bacteriophage T7 promoter, bacteriophage T3 promoter, SP6 promoter, lac operator-promoter, tac promoter, SV40 late promoter, SV40 early promoter, RSV-LTR promoter, CMV IE promoter, SV40 early promoter or SV40 late promoter and the CMV IE promoter.

"Selectable marker" used herein may mean any gene which confers a phenotype on a cell in which it is expressed to facilitate the identification and/or selection of cells which are transfected or transformed with a genetic construct. Representative examples of selectable markers include the ampicillin-resistance gene ($Amp^r$), tetracycline-resistance gene ($Tc^r$), bacterial kanamycin-resistance gene ($Kan^r$), zeocin resistance gene, the AURI-C gene which confers resistance to the antibiotic aureobasidin A, phosphinothricin-resistance gene, neomycin phosphotransferase gene (nptII), hygromycin-resistance gene, beta-glucuronidase (GUS) gene, chloramphenicol acetyltransferase (CAT) gene, green fluorescent protein-encoding gene and luciferase gene.

"Stringent hybridization conditions" used herein may mean conditions under which a first nucleic acid sequence (e.g., probe) will hybridize to a second nucleic acid sequence (e.g., target), such as in a complex mixture of nucleic acids, but to no other sequences. Stringent conditions are sequence-dependent and will be different in different circumstances. Generally, stringent conditions are selected to be about 5-10° C. lower than the thermal melting point ($T_m$) for the specific sequence at a defined ionic strength pH. The $T_m$ may be the temperature (under defined ionic strength, pH, and nucleic concentration) at which 50% of the probes complementary to the target hybridize to the target sequence at equilibrium (as the target sequences are present in excess, at $T_m$, 50% of the probes are occupied at equilibrium). Stringent conditions may be those in which the salt concentration is less than about 1.0 M sodium ion, typically about 0.01-1.0 M sodium ion concentration (or other salts) at pH 7.0 to 8.3 and the temperature is at least about 30° C. for short probes (e.g., about 10-50 nucleotides) and at least about 60° C. for long probes (e.g., greater than about 50 nucleotides). Stringent conditions may also be achieved with the addition of destabilizing agents such as formamide. For selective or specific hybridization, a positive signal may be at least 2 to 10 times background hybridization. Exemplary stringent hybridization conditions include the following: 50% formamide, 5×SSC, and 1% SDS, incubating at 42° C., or, 5×SSC, 1% SDS, incubating at 65° C., with wash in 0.2×SSC, and 0.1% SDS at 65° C.

"Substantially complementary" used herein may mean that a first sequence is at least 60%, 65%, 70%, 75%, 80%, 85%, 90%, 95%, 97%, 98% or 99% identical to the complement of a second sequence over a region of 8, 9, 10, 11, 12, 13, 14, 15, 16, 17, 18, 19, 20, 21, 22, 23, 24, 25, 30, 35, 40, 45, 50 or more nucleotides, or that the two sequences hybridize under stringent hybridization conditions.

"Substantially identical" used herein may mean that a first and second sequence are at least 60%, 65%, 70%, 75%, 80%, 85%, 90%, 95%, 97%, 98% or 99% identical over a region of 8, 9, 10, 11, 12, 13, 14, 15, 16, 17, 18, 19, 20, 21, 22, 23, 24, 25, 30, 35, 40, 45, 50 or more nucleotides or amino acids, or with respect to nucleic acids, if the first sequence is substantially complementary to the complement of the second sequence.

"Target" as used herein may mean a polynucleotide that may be bound by one or more probes under stringent hybridization conditions.

"Terminator" used herein may mean a sequence at the end of a transcriptional unit which signals termination of transcription. A terminator may be a 3'-non-translated DNA sequence containing a polyadenylation signal, which may facilitate the addition of polyadenylate sequences to the 3'-end of a primary transcript. A terminator may be derived from sources including viral, bacterial, fungal, plants, insects, and animals. Representative examples of terminators include the SV40 polyadenylation signal, HSV TK polyadenylation signal, CYC1 terminator, ADH terminator, SPA terminator, nopaline synthase (NOS) gene terminator of *Agrobacterium tumefaciens*, the terminator of the Cauliflower mosaic virus (CaMV) 35S gene, the zein gene terminator from *Zea mays*, the Rubisco small subunit gene (SSU) gene terminator sequences, subclover stunt virus (SCSV) gene sequence terminators, rho-independent *E. coli* terminators, and the lacZ alpha terminator.

"Treat" or "treating" used herein when referring to protection of an animal from a condition, means preventing, suppressing, repressing, or eliminating the condition. Preventing the condition involves administering a composition of the present invention to an animal prior to onset of the condition. Suppressing the condition involves administering a composition of the present invention to an animal after induction of the condition but before its clinical appearance. Repressing the condition involves administering a composition of the present invention to an animal after clinical appearance of the condition such that the condition is reduced or prevented from worsening. Elimination of the condition involves administering a composition of the present invention to an animal after clinical appearance of the condition such that the animal no longer suffers from the condition.

"Vector" used herein may mean a nucleic acid sequence containing an origin of replication. A vector may be a plasmid, bacteriophage, bacterial artificial chromosome or yeast artificial chromosome. A vector may be a DNA or RNA vector. A vector may be either a self-replicating extrachromosomal vector or a vector which integrates into a host genome.

2. MicroRNA

While not being bound by theory, the current model for the maturation of mammalian miRNAs is shown in FIG. 1. A gene coding for a miRNA may be transcribed leading to production of an miRNA precursor known as the pri-miRNA. The pri-miRNA may be part of a polycistronic RNA comprising multiple pri-miRNAs. The pri-miRNA may form a hairpin with a stem and loop. As indicated on FIG. 1, the stem may comprise mismatched bases.

The hairpin structure of the pri-miRNA may be recognized by Drosha, which is an RNase III endonuclease. Drosha may recognize terminal loops in the pri-miRNA and cleave approximately two helical turns into the stem to produce a 60-70 nt precursor known as the pre-miRNA. Drosha may cleave the pri-miRNA with a staggered cut typical of RNase III endonucleases yielding a pre-miRNA stem loop with a 5' phosphate and ~2 nucleotide 3' overhang. Approximately one helical turn of stem (~10 nucleotides) extending beyond the Drosha cleavage site may be essential for efficient processing. The pre-miRNA may then be actively transported from the nucleus to the cytoplasm by Ran-GTP and the export receptor Ex-portin-5.

The pre-miRNA may be recognized by Dicer, which is also an RNase III endonuclease. Dicer may recognize the double-stranded stem of the pre-miRNA. Dicer may also recognize the 5' phosphate and 3' overhang at the base of the stem loop. Dicer may cleave off the terminal loop two helical turns away from the base of the stem loop leaving an additional 5' phosphate and ~2 nucleotide 3' overhang. The resulting siRNA-like duplex, which may comprise mismatches, comprises the mature miRNA and a similar-sized fragment known as the miRNA*. The miRNA and miRNA* may be derived from opposing arms of the pri-miRNA and pre-miRNA. miRNA* sequences may be found in libraries of cloned miRNAs but typically at lower frequency than the miRNAs.

Although initially present as a double-stranded species with miRNA*, the miRNA may eventually become incorporated as single-stranded RNAs into a ribonucleoprotein complex known as the RNA-induced silencing complex (RISC). Various proteins can form the RISC, which can lead to variability in specificity for miRNA/miRNA* duplexes, binding site of the target gene, activity of miRNA (repress or activate), which strand of the miRNA/miRNA* duplex is loaded in to the RISC.

When the miRNA strand of the miRNA:miRNA* duplex is loaded into the RISC, the miRNA* may be removed and degraded. The strand of the miRNA:miRNA* duplex that is loaded into the RISC may be the strand whose 5' end is less tightly paired. In cases where both ends of the miRNA:miRNA* have roughly equivalent 5' pairing, both miRNA and miRNA* may have gene silencing activity.

The RISC may identify target nucleic acids based on high levels of complementarity between the miRNA and the miRNA, especially by nucleotides 2-8 of the miRNA. Only one case has been reported in animals where the interaction between the miRNA and its target was along the entire length of the miRNA. This was shown for mir-196 and Hox B8 and it was further shown that mir-196 mediates the cleavage of the Hox B8 miRNA (Yekta et al 2004, Science 304-594). Otherwise, such interactions are known only in plants (Bartel & Bartel 2003, Plant Physiol 132-709).

A number of studies have looked at the base-pairing requirement between miRNA and its miRNA target for achieving efficient inhibition of translation (reviewed by Bartel 2004, Cell 116-281). In mammalian cells, the first 8 nucleotides of the miRNA may be important (Doench & Sharp 2004 GenesDev 2004-504). However, other parts of the microRNA may also participate in miRNA binding. Moreover, sufficient base pairing at the 3' can compensate for insufficient pairing at the 5' (Brennecke at al, 2005 PLoS 3-e85). Computation studies, analyzing miRNA binding on whole genomes have suggested a specific role for bases 2-7 at the 5' of the miRNA in target binding but the role of the first nucleotide, found usually to be "A" was also recognized (Lewis et at 2005 Cell 120-15). Similarly, nucleotides 1-7 or 2-8 were used to identify and validate targets by Krek et al (2005, Nat Genet 37-495).

The target sites in the miRNA may be in the 5' UTR, the 3' UTR or in the coding region. Interestingly, multiple miRNAs may regulate the same miRNA target by recognizing the same or multiple sites. The presence of multiple miRNA complementarity sites in most genetically identified targets may indicate that the cooperative action of multiple RISCs provides the most efficient translational inhibition.

MiRNAs may direct the RISC to downregulate gene expression by either of two mechanisms: miRNA cleavage or translational repression. The miRNA may specify cleavage of the miRNA if the miRNA has a certain degree of complementarity to the miRNA. When a miRNA guides cleavage, the cut may be between the nucleotides pairing to residues 10 and 11 of the miRNA. Alternatively, the miRNA may repress translation if the miRNA does not have the requisite degree of complementarity to the miRNA. Translational repression may be more prevalent in animals since animals may have a lower degree of complementarity.

It should be notes that there may be variability in the 5' and 3' ends of any pair of miRNA and miRNA*. This variability may be due to variability in the enzymatic processing of Drosha and Dicer with respect to the site of cleavage. Variability at the 5' and 3' ends of miRNA and miRNA* may also be due to mismatches in the stem structures of the pri-miRNA and pre-miRNA. The mismatches of the stem strands may lead to a population of different hairpin structures. Variability in the stem structures may also lead to variability in the products of cleavage by Drosha and Dicer.

3. Nucleic Acid

The present invention relates to an isolated nucleic acid comprising a nucleotide sequence referred to in SEQS: 1-4204915, the sequences referred to in Tables 1, 4, 10-14 and 21-23, and variants thereof. The variant may be a complement of the referenced nucleotide sequence. The variant may also be a nucleotide sequence that is substantially identical to the referenced nucleotide sequence or the complement thereof. The variant may also be a nucleotide sequence which hybridizes under stringent conditions to the referenced nucleotide sequence, complements thereof, or nucleotide sequences substantially identical thereto.

The nucleic acid may have a length of from 10 to 100 nucleotides. The nucleic acid may have a length of at least 10, 11, 12, 13, 14, 15, 16, 17, 18, 19, 20, 21, 22, 23, 24, 25, 26, 27, 28, 29, 30, 35, 40, 45, 50, 60, 70, 80 or 90 nucleotides. The nucleic acid may be synthesized or expressed in a cell (in vitro or in vivo) using a synthetic gene described below. The nucleic acid may be synthesized as a single strand molecule and hybridized to a substantially complementary nucleic acid to form a duplex, which is considered a nucleic acid of the invention. The nucleic acid may be introduced to a cell, tissue or organ in a single- or double-stranded form or capable of being expressed by a synthetic gene using methods well known to those skilled in the art, including as described in U.S. Pat. No. 6,506,559 which is incorporated by reference.

a. Pri-miRNA

The nucleic acid of the invention may comprise a sequence of a pri-miRNA or a variant thereof. The pri-miRNA sequence may comprise from 45-250, 55-200, 70-150 or 80-100 nucleotides. The sequence of the pri-miRNA may comprise a pre-miRNA, miRNA and miRNA* as set forth below. The pri-miRNA may also comprise a miRNA or miRNA* and the complement thereof, and variants thereof.

The pri-miRNA may comprise at least 19% adenosine nucleotides, at least 16% cytosine nucleotides, at least 23% thymine nucleotides and at least 19% guanine nucleotides.

The pri-miRNA may form a hairpin structure. The hairpin may comprise a first and second nucleic acid sequence that are substantially complementary. The first and second nucleic acid sequence may be from 37-50 nucleotides. The first and second nucleic acid sequence may be separated by a third sequence of from 8-12 nucleotides. The hairpin structure may have a free energy less than −25 Kcal/mole as calculated by the Vienna algorithm with default parameters, as described in Hofacker et al., Monatshefte f. Chemie 125: 167-188 (1994), the contents of which are incorporated herein. The hairpin may comprise a terminal loop of 4-20, 8-12 or 10 nucleotides.

The sequence of the pri-miRNA may comprise SEQS: 4097721-4204913, a precursor referred to in Table 1, the sequence of a sequence referred to in Tables 11-12 and 21-23, or a variant thereof.

b. Pre-miRNA

The nucleic acid of the invention may also comprise a sequence of a pre-miRNA or a variant thereof. The pre-miRNA sequence may comprise from 45-90, 60-80 or 60-70 nucleotides. The sequence of the pre-miRNA may comprise a miRNA and a miRNA* as set forth below. The pre-miRNA may also comprise a miRNA or miRNA* and the complement thereof, and variants thereof. The sequence of the pre-miRNA may also be that of a pri-miRNA excluding from 0-160 nucleotides from the 5' and 3' ends of the pri-miRNA.

The sequence of the pre-miRNA may comprise SEQS: 4097721-4204913, a precursor referred to in Table 1, the sequence of a sequence referred to in Tables 11-12 and 21-23, or a variant thereof.

c. MiRNA

The nucleic acid of the invention may also comprise a sequence of a miRNA, miRNA* or a variant thereof. The miRNA sequence may comprise from 13-33, 18-24 or 21-23 nucleotides. The sequence of the miRNA may be the first 13-33 nucleotides of the pre-miRNA. The sequence of the miRNA may be the last 13-33 nucleotides of the pre-miRNA.

The sequence of the miRNA may comprise SEQS: 1-1142416 or 4204914-4204915, a miRNA referred to in Table 1, the sequence of a sequence referred to in Tables 11-12 and 21-23, or a variant thereof.

d. Anti-miRNA

The nucleic acid of the invention may also comprise a sequence of an anti-miRNA that is capable of blocking the activity of a miRNA or miRNA*. The anti-miRNA may comprise a total of 5-100 or 10-60 nucleotides. The anti-miRNA may also comprise a total of at least 5, 6, 7, 8, 9, 10, 11, 12, 13, 14, 15, 16, 17, 18, 19, 20, 21, 22, 23, 24, 25 or 26 nucleotides. The sequence of the anti-miRNA may comprise (a) at least 5 nucleotides that are substantially identical to the 5' of a miRNA and at least 5-12 nucleotide that are substantially complementary to the flanking regions of the target site from the 5' end of said miRNA, or (b) at least 5-12 nucleotides that are substantially identical to the 3' of a miRNA and at least 5 nucleotide that are substantially complementary to the flanking region of the target site from the 3' end of said miRNA.

The sequence of the anti-miRNA may comprise the complement of SEQS: 1-1142416 or 4204914-4204915, a sequence of a miRNA referred to in Tables 1, 13-14 or 21-23, or a variant thereof.

e. Binding Site of Target

The nucleic acid of the invention may also comprise a sequence of a target miRNA binding site, or a variant thereof. The target site sequence may comprise a total of 5-100 or 10-60 nucleotides. The target site sequence may comprise at least 5 nucleotides of SEQS: 1142417-4097720, the sequence of a target gene binding site referred to in Tables 4, 10 or 15-16, or a variant thereof.

4. Synthetic Gene

The present invention also relates to a synthetic gene comprising a nucleic acid of the invention operably linked to a transcriptional and/or translational regulatory sequences. The synthetic gene may be capable of modifying the expression of a target gene with a binding site for the nucleic acid of the invention. Expression of the target gene may be modified in a cell, tissue or organ. The synthetic gene may be synthesized or derived from naturally-occurring genes by standard recombinant techniques. The synthetic gene may also comprise terminators at the 3'-end of the transcriptional unit of the synthetic gene sequence. The synthetic gene may also comprise a selectable marker.

5. Vector

The present invention also relates to a vector comprising a synthetic gene of the invention. The vector may be an expression vector. An expression vector may comprise additional elements. For example, the expression vector may have two replication systems allowing it to be maintained in two organisms, e.g., in mammalian or insect cells for expression and in a prokaryotic host for cloning and amplification. For integrating expression vectors, the expression vector may contain at least one sequence homologous to the host cell genome, and preferably two homologous sequences which flank the expression construct. The integrating vector may be directed to a specific locus in the host cell by selecting the appropriate homologous sequence for inclusion in the vector. The vector may also comprise a selectable marker gene to allow the selection of transformed host cells.

6. Host Cell

The present invention also relates to a host cell comprising a vector of the invention. The cell may be a bacterial, fungal, plant, insect or animal cell.

7. Probes

The present invention also relates to a probe comprising a nucleic acid of the invention. Probes may be used for screening and diagnostic methods, as outlined below. The probe may be attached or immobilized to a solid substrate, such as a biochip.

The probe may have a length of from 8 to 500, 10 to 100 or 20 to 60 nucleotides. The probe may also have a length of at least 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90, 100, 120, 140, 160, 180, 200, 220, 240, 260, 280 or 300 nucleotides. The probe may further comprise a linker sequence of from 10-60 nucleotides.

8. Biochip

The present invention also relates to a biochip. The biochip may comprise a solid substrate comprising an attached probe or plurality of probes of the invention. The probes may be capable of hybridizing to a target sequence under stringent hybridization conditions. The probes may be attached at spatially defined address on the substrate. More than one probe per target sequence may be used, with either overlapping probes or probes to different sections of a particular target sequence. The probes may be capable of hybridizing to target sequences associated with a single disorder.

The probes may be attached to the biochip in a wide variety of ways, as will be appreciated by those in the art. The probes may either be synthesized first, with subsequent attachment to the biochip, or may be directly synthesized on the biochip.

The solid substrate may be a material that may be modified to contain discrete individual sites appropriate for the attachment or association of the probes and is amenable to at least one detection method. Representative examples of substrates include glass and modified or functionalized glass, plastics (including acrylics, polystyrene and copolymers of styrene and other materials, polypropylene, polyethylene, polybutylene, polyurethanes, TeflonJ, etc.), polysaccharides, nylon or nitrocellulose, resins, silica or silica-based materials including silicon and modified silicon, carbon, metals, inorganic glasses and plastics. The substrates may allow optical detection without appreciably fluorescing.

The substrate may be planar, although other configurations of substrates may be used as well. For example, probes may be placed on the inside surface of a tube, for flow-through sample analysis to minimize sample volume. Similarly, the substrate may be flexible, such as a flexible foam, including closed cell foams made of particular plastics.

The biochip and the probe may be derivatized with chemical functional groups for subsequent attachment of the two. For example, the biochip may be derivatized with a chemical functional group including, but not limited to, amino groups, carboxyl groups, oxo groups or thiol groups. Using these functional groups, the probes may be attached using functional groups on the probes either directly or indirectly using a linker. The probes may be attached to the solid support by either the 5' terminus, 3' terminus, or via an internal nucleotide.

The probe may also be attached to the solid support non-covalently. For example, biotinylated oligonucleotides can be made, which may bind to surfaces covalently coated with streptavidin, resulting in attachment. Alternatively, probes may be synthesized on the surface using techniques such as photopolymerization and photolithography.

9. MiRNA Expression Analysis

The present invention also relates to a method of identifying miRNAs that are associated with disease or a pathological condition, such as viral infection, comprising contacting a biological sample with a probe or biochip of the invention and detecting the amount of hybridization. PCR may be used to amplify nucleic acids in the sample, which may provide higher sensitivity.

The ability to identify miRNAs that are overexpressed or underexpressed in pathological cells compared to a control can provide high-resolution, high-sensitivity datasets which may be used in the areas of diagnostics, therapeutics, drug development, pharmacogenetics, biosensor development, and other related areas. An expression profile generated by the current methods may be a "fingerprint" of the state of the sample with respect to a number of miRNAs. While two states may have any particular miRNA similarly expressed, the evaluation of a number of miRNAs simultaneously allows the generation of a gene expression profile that is characteristic of the state of the cell. That is, normal tissue may be distinguished from diseased tissue. By comparing expression profiles of tissue in known different disease states, information regarding which miRNAs are associated in each of these states may be obtained. Then, diagnosis may be performed or confirmed to determine whether a tissue sample has the expression profile of normal or disease tissue. This may provide for molecular diagnosis of related conditions.

10. Determining Expression Levels

The present invention also relates to a method of determining the expression level of a disease-associated miRNA comprising contacting a biological sample with a probe or biochip of the invention and measuring the amount of hybridization.

The expression level of a disease-associated miRNA is information in a number of ways. For example, a differential expression of a disease-associated miRNA compared to a control may be used as a diagnostic that a patient suffers from the disease. Expression levels of a disease-associated miRNA may also be used to monitor the treatment and disease state of a patient. Furthermore, expression levels of a disease-associated miRNA may allow the screening of drug candidates for altering a particular expression profile or suppressing an expression profile associated with disease.

A target nucleic acid may be detected by contacting a sample comprising the target nucleic acid with a biochip comprising an attached probe sufficiently complementary to the target nucleic acid and detecting hybridization to the probe above control levels.

The target nucleic acid may also be detected by immobilizing the nucleic acid to be examined on a solid support such as nylon membranes and hybridizing a labeled probe with the sample. Similarly, the target nucleic may also be detected by immobilizing the labeled probe to the solid support and hybridizing a sample comprising a labeled target nucleic acid. Following washing to remove the non-specific hybridization, the label may be detected.

The target nucleic acid may also be detected in situ by contacting permeabilized cells or tissue samples with a labeled probe to allow hybridization with the target nucleic acid. Following washing to remove the non-specifically bound probe, the label may be detected.

These assays can be direct hybridization assays or can comprise sandwich assays, which include the use of multiple probes, as generally outlined in U.S. Pat. Nos. 5,681,702; 5,597,909; 5,545,730; 5,594,117; 5,591,584; 5,571,670; 5,580,731; 5,571,670; 5,591,584; 5,624,802; 5,635,352; 5,594,118; 5,359,100; 5,124,246; and 5,681,697, each of which is hereby incorporated by reference.

A variety of hybridization conditions may be used, including high, moderate and low stringency conditions as outlined above. The assays may be performed under stringency conditions which allow hybridization of the probe only to the target. Stringency can be controlled by altering a step parameter that is a thermodynamic variable, including, but not limited to, temperature, formamide concentration, salt concentration, chaotropic salt concentration pH, or organic solvent concentration.

Hybridization reactions may be accomplished in a variety of ways. Components of the reaction may be added simultaneously, or sequentially, in different orders. In addition, the reaction may include a variety of other reagents. These include salts, buffers, neutral proteins, e.g., albumin, detergents, etc. which may be used to facilitate optimal hybridization and detection, and/or reduce non-specific or background interactions. Reagents that otherwise improve the efficiency of the assay, such as protease inhibitors, nuclease inhibitors and anti-microbial agents may also be used as appropriate, depending on the sample preparation methods and purity of the target.

a. Diagnostic

The present invention also relates to a method of diagnosis comprising detecting a differential expression level of a disease- or infection-associated miRNA in a biological sample. The miRNA may be a viral miRNA, which may be expressed in the infected subject. The miRNA may also be from the subject, the expression level of which is modified due to a viral infection. The sample may be derived from a patient. Diagnosis of a disease state in a patient allows for prognosis and selection of therapeutic strategy. Further, the developmental stage of cells may be classified by determining temporarily expressed miRNA-molecules.

In situ hybridization of labeled probes to tissue arrays may be performed. When comparing the fingerprints between an individual and a standard, the skilled artisan can make a diagnosis, a prognosis, or a prediction based on the findings. It is further understood that the genes which indicate the diagnosis may differ from those which indicate the prognosis and molecular profiling of the condition of the cells may lead to distinctions between responsive or refractory conditions or may be predictive of outcomes.

b. Drug Screening

The present invention also relates to a method of screening therapeutics comprising contacting a pathological cell capable of expressing a disease related miRNA with a candidate therapeutic and evaluating the effect of a drug candidate on the expression profile of the disease associated miRNA. Having identified the differentially expressed miRNAs, a variety of assays may be executed. Test compounds may be screened for the ability to modulate gene expression of the disease associated miRNA. Modulation includes both an increase and a decrease in gene expression.

The test compound or drug candidate may be any molecule, e.g., protein, oligopeptide, small organic molecule, polysaccharide, polynucleotide, etc., to be tested for the capacity to directly or indirectly alter the disease phenotype or the expression of the disease associated miRNA. Drug candidates encompass numerous chemical classes, such as small organic molecules having a molecular weight of more than 100 and less than about 500, 1,000, 1,500, 2,000 or 2,500 daltons. Candidate compounds may comprise functional groups necessary for structural interaction with proteins, particularly hydrogen bonding, and typically include at least an amine, carbonyl, hydroxyl or carboxyl group, preferably at least two of the functional chemical groups. The candidate agents may comprise cyclical carbon or heterocyclic structures and/or aromatic or polyaromatic structures substituted with one or more of the above functional groups. Candidate agents are also found among biomolecules including peptides, saccharides, fatty acids, steroids, purines, pyrimidines, derivatives, structural analogs or combinations thereof.

Combinatorial libraries of potential modulators may be screened for the ability to bind to the disease associated miRNA or to modulate the activity thereof. The combinatorial library may be a collection of diverse chemical compounds generated by either chemical synthesis or biological synthesis by combining a number of chemical building blocks such as reagents. Preparation and screening of combinatorial chemical libraries is well known to those of skill in the art. Such combinatorial chemical libraries include, but are not limited to, peptide libraries encoded peptides, benzodiazepines, diversomers such as hydantoins, benzodiazepines and dipeptide, vinylogous polypeptides, analogous organic syntheses of small compound libraries, oligocarbamates, and/or peptidyl phosphonates, nucleic acid libraries, peptide nucleic acid libraries, antibody libraries, carbohydrate libraries, and small organic molecule libraries.

11. Gene Silencing

The present invention also relates to a method of using the nucleic acids of the invention to reduce expression of a target gene in a cell, tissue or organ. Expression of the target gene may be reduced by expressing a nucleic acid of the invention that comprises a sequence substantially complementary to one or more binding sites of the target miRNA. The nucleic acid may be a miRNA or a variant thereof. The nucleic acid may also be pri-miRNA, pre-miRNA, or a variant thereof, which may be processed to yield a miRNA. The expressed miRNA may hybridize to a substantially complementary binding site on the target miRNA, which may lead to activation of RISC-mediated gene silencing. An example for a study employing over-expression of miRNA is Yekta et al 2004, Science 304-594, which is incorporated herein by reference. One of ordinary skill in the art will recognize that the nucleic acids of the present invention may be used to inhibit expression of target genes using antisense methods well known in the art, as well as RNAi methods described in U.S. Pat. Nos. 6,506,559 and 6,573,099, which are incorporated by reference.

The target gene may be a viral gene, which may be reduced by expressing a viral or human miRNA. The target gene may also be a human gene that is expressed upon viral infection, which may be reduced by expressing a viral or human miRNA. The target of gene silencing may be a protein that causes the silencing of a second protein. By repressing expression of the target gene, expression of the second protein may be increased. Examples for efficient suppression of miRNA expression are the studies by Esau et al 2004 JBC 275-52361; and Cheng et al 2005 Nucleic Acids Res. 33-1290, which is incorporated herein by reference.

12. Gene Enhancement

The present invention also relates to a method of using the nucleic acids of the invention to increase expression of a target gene in a cell, tissue or organ. Expression of the target gene may be increased by expressing a nucleic acid of the invention that comprises a sequence substantially complementary to a pri-miRNA, pre-miRNA, miRNA or a variant thereof. The nucleic acid may be an anti-miRNA. The anti-miRNA may hybridize with a pri-miRNA, pre-miRNA or miRNA, thereby reducing its gene repression activity. Expression of the target gene may also be increased by expressing a nucleic acid of the invention that is substantially complementary to a portion of the binding site in the target gene, such that binding of the nucleic acid to the binding site may prevent miRNA binding.

The target gene may be a viral gene, expression of which may reduce infectivity of the virus. The target gene may also be a human gene, expression of which may reduce infectivity of the virus or increase resistance or immunity to the viral infection.

13. Therapeutic

The present invention also relates to a method of using the nucleic acids of the invention as modulators or targets of disease or disorders, such as those associated with viral infection. In general, the claimed nucleic acid molecules may be used as a modulator of the expression of genes which are at least partially complementary to said nucleic acid. Further, miRNA molecules may act as target for therapeutic screening procedures, e.g. inhibition or activation of miRNA molecules might modulate a cellular differentiation process, e.g. apoptosis.

Furthermore, existing miRNA molecules may be used as starting materials for the manufacture of sequence-modified miRNA molecules, in order to modify the target-specificity thereof, e.g. an oncogene, a multidrug-resistance gene or another therapeutic target gene. Further, miRNA molecules can be modified, in order that they are processed and then generated as double-stranded siRNAs which are again directed against therapeutically relevant targets. Furthermore, miRNA molecules may be used for tissue reprogramming procedures, e.g. a differentiated cell line might be transformed by expression of miRNA molecules into a different cell type or a stem cell.

14. Compositions

The present invention also relates to a pharmaceutical composition comprising the nucleic acids of the invention and optionally a pharmaceutically acceptable carrier. The compositions may be used for diagnostic or therapeutic applications. The administration of the pharmaceutical composition may be carried out by known methods, wherein a nucleic acid is introduced into a desired target cell in vitro or in vivo. Commonly used gene transfer techniques include calcium phosphate, DEAE-dextran, electroporation, microinjection, viral methods and cationic liposomes.

15. Kits

The present invention also relates to kits comprising a nucleic acid of the invention together with any or all of the following: assay reagents, buffers, probes and/or primers, and sterile saline or another pharmaceutically acceptable emulsion and suspension base. In addition, the kits may include instructional materials containing directions (e.g., protocols) for the practice of the methods of this invention.

EXAMPLE 1

Prediction of miRNAs

We surveyed a number of viral genomes for potential miRNA coding genes using three computational approaches similar to those described in U.S. patent application Ser. Nos. 60/522,459, 10/709,577 and 10/709,572, the contents of which are incorporated herein by reference, for predicting miRNAs. The predicted hairpins and potential miRNAs were scored by thermodynamic stability, as well as structural and contextual features. The algorithm was calibrated by using miRNAs in the Sanger Database which had been validated.

1. First and Second Screen

Tables 11 and 12 show the sequence ("PRECURSOR SEQUENCE"), sequence identifier ("PRECUR SEQ-ID") and organism of origin ("GAM ORGANISM") for each predicted hairpin from the first computational screen, together with the predicted miRNAs ("GAM NAME"). Tables 13 and 14 show the sequence ("GAM RNA SEQUENCE") and sequence identifier ("GAM SEQ-ID") for each miRNA ("GAM NAME"), along with the organism of origin ("GAM ORGANISM") and Dicer cut location ("GAM POS").

2. Third Screen

Table 1 lists the SEQ ID NO for each predicted hairpin ("HID") of the third computational screen of a particular viral genome ("V"; See also Table 10). Table 1 also lists the genomic location for each hairpin ("Hairpin Location"). The format for the genomic location is a concatenation of <strand><start position>. The genetic location is based on the NCBI-Entrez Nucleotides database. The Entrez Nucleotides database is a collection of sequences from several sources, including GenBank, RefSeq, and PDB. Table 10 shows the accession number and the build (version) are presented for each of the genomes used in this screen.

Table 1 also lists the SEQ ID NO ("MID") for each predicted miRNA and miRNA*. Table 1 also lists the prediction score grade for each hairpin ("P") on a scale of 0-1 (1 the hairpin is the most reliable), as described in Hofacker et al., Monatshefte f. Chemie 125: 167-188, 1994. Table 1 also lists the p-value ("Pval") calculated out of background hairpins for the values of each P scores. All the p-values are significantlower than 0.05. As shown in Table 1, there are few instances where the Pval is 0.0. In each of these cases, the value is less than 0.0001. The p-values were calculated by comparing the palgrade of the tested hairpin to the palgrade of other sequences without pre-selection of hairpins.

Table 1 also lists whether the miRNAs were validated by expression analysis ("E") (Y=Yes, N=No), as detailed in Table 2. Table 1 also lists whether the miRNAs were validated by sequencing ("S") (Y=Yes, N=No), as detailed in Table 3. If there was a difference in sequences between the predicted and sequenced miRNAs, the sequenced sequence is presented. It should be noted that failure to sequence or detect expression of a miRNA does not necessarily mean that a miRNA does not exist. Such undetected miRNAs may be expressed in tissues other than those tested. In addition, such undetected miRNAs may be expressed in the test tissues, but at a difference stage or under different condition than those of the experimental cells.

Table 1 also listed whether the miRNAs were shown to be differentially expressed ("D") (Y=Yes, N=No) in at least one disease, as detailed in Table 2). Table 1 also whether the miRNAs were present ("F") (Y=Yes, N=No) in Sanger DB Release 6.0 (April 2005) as being detected in humans or mice predicted in humans. As discussed above, the miRNAs listed in the Sanger database are a component of the prediction algorithm and a control for the output.

Table 1 also lists a genetic location cluster ("LC") for those hairpins that are within 1,000 nucleotides of each other of a particular virus. Each miRNA that has the same LC share the same genetic cluster. Those hairpins that overlap are not clustered. Table 1 also lists a seed cluster ("SC") to group miRNAs by their seed of 2-7 by an exact match, regardless of the source virus. Each miRNA that has the same SC have the same seed. For a discussion of seed lengths of 6 nucleotides, see Lewis et al., Cell, 120; 15-20 (2005).

EXAMPLE 2

Prediction of Target Genes

The predicted miRNAs from the three computational screens of Example 1 were then used to predict human and viral target genes and their binding sites using two computational approaches similar to those described in U.S. patent application Ser. Nos. 60/522,459, 10/709,577 and 10/709,572, the contents of which are incorporated herein by reference, for predicting miRNAs.

1. First and Second Screen

Tables 15 and 16 list the predicted target genes ("TARGET") and binding site sequence ("TARGET BINDING SITE SEQUENCE") and binding site sequence identifier ("TARGET BINDING SITE SEQ-ID") from the first computational screen, as well as the organism of origin for the target ("TARGET ORGANISM").

2. Third Screen a. Human Target Genes

Table 4 lists the predicted human target gene for each miRNA (MID) from a particular virus (V) and its hairpin (HID) from the third computational screen. The names of the target genes were taken from NCBI Reference Sequence release 9 (Pruitt et al., Nucleic Acids Res, 33(1):D501-D504, 2005; Pruitt et al., Trends Genet., 16(1):44-47, 2000; and Tatusova et al., Bioinformatics, 15(7-8):536-43, 1999). Target genes were identified by having a perfect complementary match of a 7 nucleotide miRNA seed (positions 2-8) and an A on the UTR (total=8 nucleotides). For a discussion on identifying target genes, see Lewis et al., Cell, 120: 15-20, (2005). For a discussion of the seed being sufficient for binding of a miRNA to a UTR, see Lim Lau et al., (Nature 2005) and Brenneck et al, (PLoS Biol 2005).

The binding site screen only considered the first 4000 nucleotides per UTR and considered the longest transcript when there were several transcripts per gene. The filtering reduced the total number of transcripts from 23626 to 14239. Table 4 lists the SEQ ID NO for the predicted binding sites for each target gene. The sequence of the binding site includes the 20 nucleotides 5' and 3' of the binding site as they are located on the spliced miRNA. In cases that the binding site is comprised from 2 exons, 20 nucleotides are included from both 5' and 3' ends of both exons.

Table 5 shows the relationship between the miRNAs ("MID")/hairpins ("HID") of a particular virus ("V") and diseases by their human target genes. The name of the diseases are taken from OMIM. For a discussion of the rationale for connecting the host gene the hairpin is located upon to disease, see Baskerville and Bartel, RNA, 11: 241-247 (2005) and Rodriguez et al., Genome Res., 14: 1902-1910 (2004). Table 5 shows the number of miRNA target genes ("N") that are related to the disease. Table 5 also shows the total number of genes that are related to the disease ("T"), which is taken from the genes that were predicted to have binding sites for miRNAs. Table 5 also shows the percentage of N out of T and the p-value of hypergeometric analysis ("Pval"). In cases that the pval is listed as 0.0, it means that the value is less than 0.0001. For a reference of hypergeometric analysis, see Schaum's Outline of Elements of Statistics II: Inferential Statistics. Table 7 shows the disease codes for Tables 5 and 6.

b. Viral Target Genes

Similar to the date described above in Table 4 for human target genes, Table 10 lists the predicted viral target gene for each miRNA (MID) from the same particular virus (V) and its hairpin (HID) from the third computational screen. The prediction of viral binding sites used complete genes not UTRs as in the Table 4 in the method described above for human target genes Table 10. Candidate target genes were included in the screen if they were known to have a role in the virus life cycle. Those miRNAs that have binding sites on a viral gene that takes part in the virus life cycle they may affect the diseases that may be related to the virus Human Herpes virus 1 and 2 are related to any of several inflammatory diseases caused by a herpesvirus and marked in one case by groups of watery blisters on the skin or mucous membranes (as of the mouth and lips) above the waist and in the other by such blisters on the genitals. Human herpesvirus 4 (Epstein-Barr virus) causes infectious mononucleosis and is associated with Burkitt's lymphoma and nasopharyngeal carcinoma. HIV strains are related to Acquired Immune Deficiency Syndrome (AIDS). Hepatitis B and C viruses cause inflammation of the liver.

EXAMPLE 3

Validation of miRNAs

To confirm the hairpins and miRNAs predicted in Example 1, we detected expression in various tissues using the high-throughput microarrays similar to those described in U.S. patent application Ser. Nos. 60/522,459, 10/709,577 and 10/709,572, the contents of which are incorporated herein by reference. For each predicted precursor miRNA, mature miRNAs derived from both stems of the hairpin were tested.

1. Expression Analysis—Set 1 and Set 2

Tables 17-19 list the results of microarray expression analysis to detch miRNA sequence ("GAM RNA SEQUENCE").

2. Expression Analysis—Set 3

Table 2 shows the hairpins ("HID") of the third prediction set that were validated by detecting expression of related miRNAs ("MID") from a particular virus ("V"), as well as a code for the tissue ("Tissue") that expression was detected. In cases where there is more than one score from the same miRNA in the same tissue, only the one with the higher score is presented.

The tissue and diseases codes are listed in Table 6 and Table 7, respectively. Table 8 shows the relationship between gene and disease. This enables the connection of all miRNAs to disease. Table 4 assign at least one target gene to each miRNA. Table 5 presents the outcome of statistical analysis of table 4 and OMIM to depict significant relations of miRNAs and disease. Table 8 is basically a condensed version of OMIM. It lists for each gene all the numeric codes of the diseases that are related to it.

All the tissues disclosed give an indication of a viral disease. The fact that significant expression of the virus was measured implies that in this tissue it may be involve in a viral disease(s). E.g. when a mir from HIV was expressed in T cell line it may have an effect on AIDS. Of course cell lines represent only subset of the features of a tissue as it function in an organ however we can deduce from the expression as it is measured in the cell line.

Table 2 also shows the chip expression score grade (range of 500-65000)("S"). A threshold of 500 was used to eliminate non-significant signals and the score was normalized by Mir-Chip probe signals from different experiments. Variations in the intensities of fluorescence material between experiments may be due to variability in RNA preparation or labeling efficiency. We normalized based on the assumption that the total amount of miRNAs in each sample is relatively constant. First we subtracted the background signal from the raw signal of each probe, where the background signal is defined as 400. Next, we divided each miRNA probe signal by the average signal of all miRNAs, multiplied the result by 10000 and added back the background signal of 400. Thus, by definition, the sum of all miRNA probe signals in each experiment is 10400.

Table 2 also shows a statistical analysis of the normalized signal ("Spval") calculated on the normalized score. For each miRNA, we used a relevant control group out of the full predicted miRNA list. Each miRNA has an internal control of probes with mismatches. The relevant control group contained probes with similar C and G percentage (abs diff <5%) in order to have similar Tm. The probe signal P value is the ratio over the relevant control group probes with the same or higher signals. The results are p-value $\leq 0.05$ and score is above 500. In those cases that the SPVal is listed as 0.0, the value is less than 0.0001.

3. Sequencing—Set 3

To further validate the hairpins ("HID") of the second prediction, a number of miRNAs were validated by sequencing methods similar to those described in U.S. patent application Ser. Nos. 60/522,459, 10/709,577 and 10/709,572, the contents of which are incorporated herein by reference. Table 3 shows the hairpins ("HID") that were validated by sequencing a miRNA (MID") from a virus ("V") in the indicated tissue ("Tissue").

4. Northern Analysis

Figure 3:
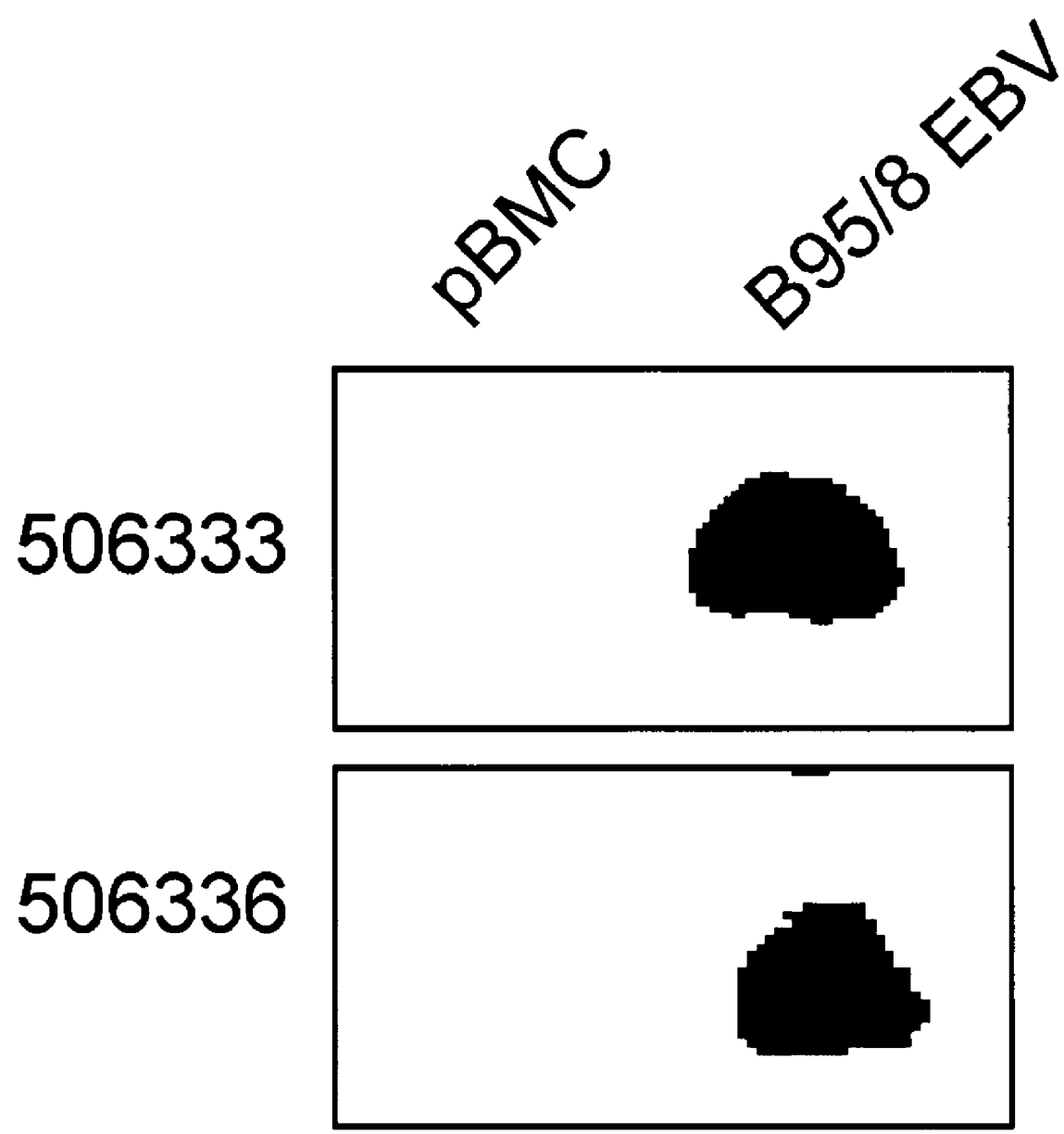

A group of miRNA were validated by Northern analysis, as shown in FIGS. 2 and 3.

EXAMPLE 4

Differential Expression of miRNAs

1. Viral miRNAs

Table 20 provides validated viral miRNAs that were demonstrated to be differentially expressed in diseased compared to healthy human tissue or human-derived cell lines. All miRNA sequences were validated using a miRNA microarray as described hereinabove. For Alzheimer Disease, GAM RNA expression was studied in a mixture of tissue from diseased and healthy human amygdala, cingulate cortex, caudate nucleus, globus pallidus, posterior parietal cortex, and superior parietal cortex, all brain regions that were shown to be affected mildly, moderately, or severely by Alzheimer pathology. For Parkinson Disease, GAM RNA expression was studied in substantia nigra tissue from diseased and healthy human tissue. MT2 cell lines were infected with a T-tropic clinical isolation of Clade A Human Immunodeficiency Virus (HIV), while healthy controls were not infected. cMagi cell lines were infected with a M-tropic Clade B HIV, while healthy controls were not infected. Human fibroblast cells (TC) were infected with HSV1 or HSV2 or were not infected and served as controls. GAM RNA SEQUENCE: the sequence (5' to 3') of the mature, "diced" GAM RNA. CHIP SEQUENCE is the sequence of the oligonucleotide including the predicted GAM RNA that was placed on the microarray (not including the non-genomic sequence used as a separator from the microarray surface). DISEASE: the disease in which the GAM RNA was differentially expressed—BAL refers to M-tropic HIV1 Subtype B, lab strain, and BLAI refers to T-tropic HIV-1 (LAV-1), Subtype B; SIGNAL (HEALTHY): the signal on the microarray for the GAM RNA in samples comprised of human tissue or human-derived cell lines that are not afflicted with the specified disease; SIGNAL (DISEASE): the signal on the microarray for the GAM RNA in samples comprised of human tissue or human-derived cell lines that are afflicted with the specified disease.

2. Human miRNAs

Table 21 lists expression data of miRNAs by the following: HID: hairpin SEQ; MID: miRNA SEQ; Tissue: tested tissue; S: chip expression score grade (range=100-65000); Dis. Diff. Exp.: disease related differential expression and the tissue it was tested in; R: ratio of disease related expression (range=0.01-99.99); and abbreviations: Brain Mix A—a mixture of brain tissue that are affected in Alzheimer; Brain Mix B—a mixture of all brain tissues; and Brain SN—Substantia Nigra. Tables 22 and 23 provide the details regarding the differentially expressed miRNAs by the following: HID: hairpin SEQ; Hairpin_Loc: hairpin genomic hocation, concatenating <chr_id><strand>space<start position> (e.g., 19+135460000 means chr19+strand, start position 135460000); C: conservation in evolution (Yes/No and "-" when data is not available; Yes-conservation level above threshold of 0.7); T: genomic type, InterGenic (G), Intron (I), Exon (E); MID: miRNA SEQ; Target Gene, Disease: target gene (HUGO database) and related disease (OMIM database); P: prediction score grade, on range 0-9; E: chip expression information—Yes/No (Y/N); S: validation by eequencing—Yes/No (Y/N); HID: hairpin SEQ. Table 24 provides the sequence for the sequences referred to in Tables 21-23.

EXAMPLE 4

Analysis of EBV miRNAs

1. Validation of Expression

Figure 4:
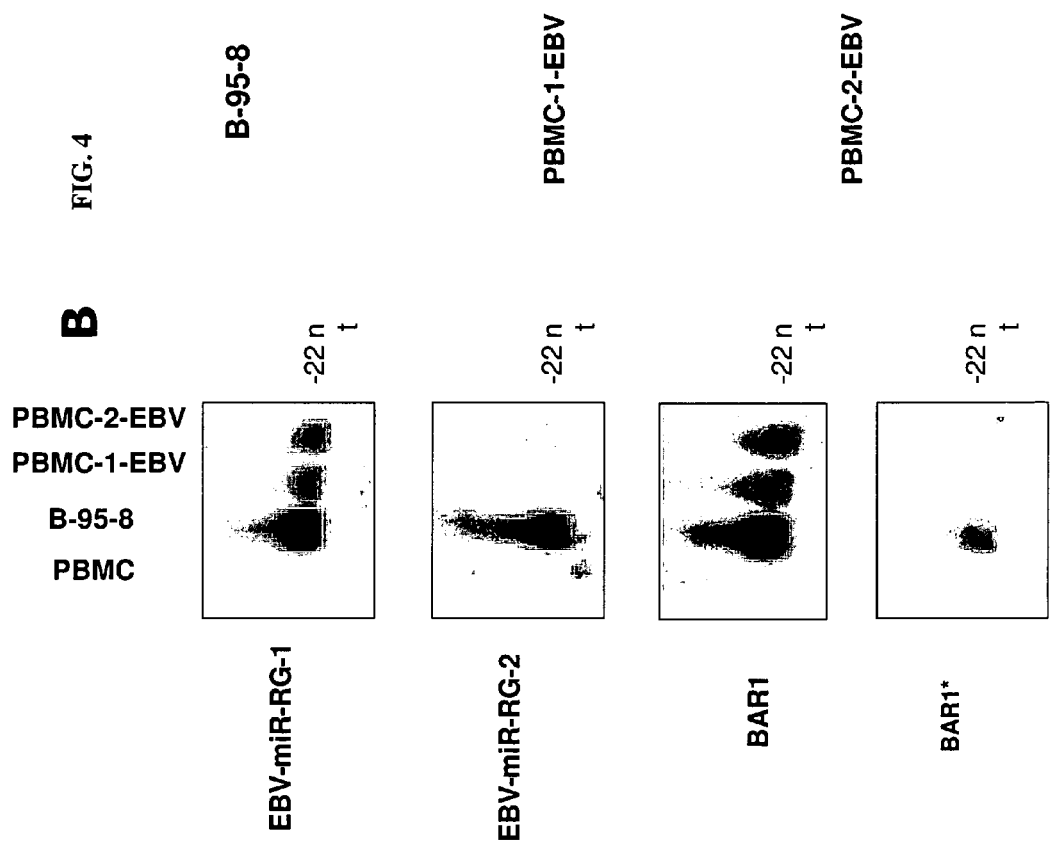
FIG. 4 shows validation of miRNAs expressed by EBV.

FIG. 4 shows the validation of expression of miRNAs predicted in EBV (Epstein's Barr Virus) miRNAs; expression validation. Three cell line were tested. Two were freshly infected normal B-cells (PBMC-1/2-EBV), and one EBV-transformed cell line (B-95-8). The 3 cell lines exhibit the same extent of EBV infection (FIG. 4A). However, in contrast to the freshly infected B cells, EBV-miR-RG-1 and -2 are highly expressed in the B-95-8 cell-line (FIG. 4B).

2. Knockout of Expression

Figure 5:
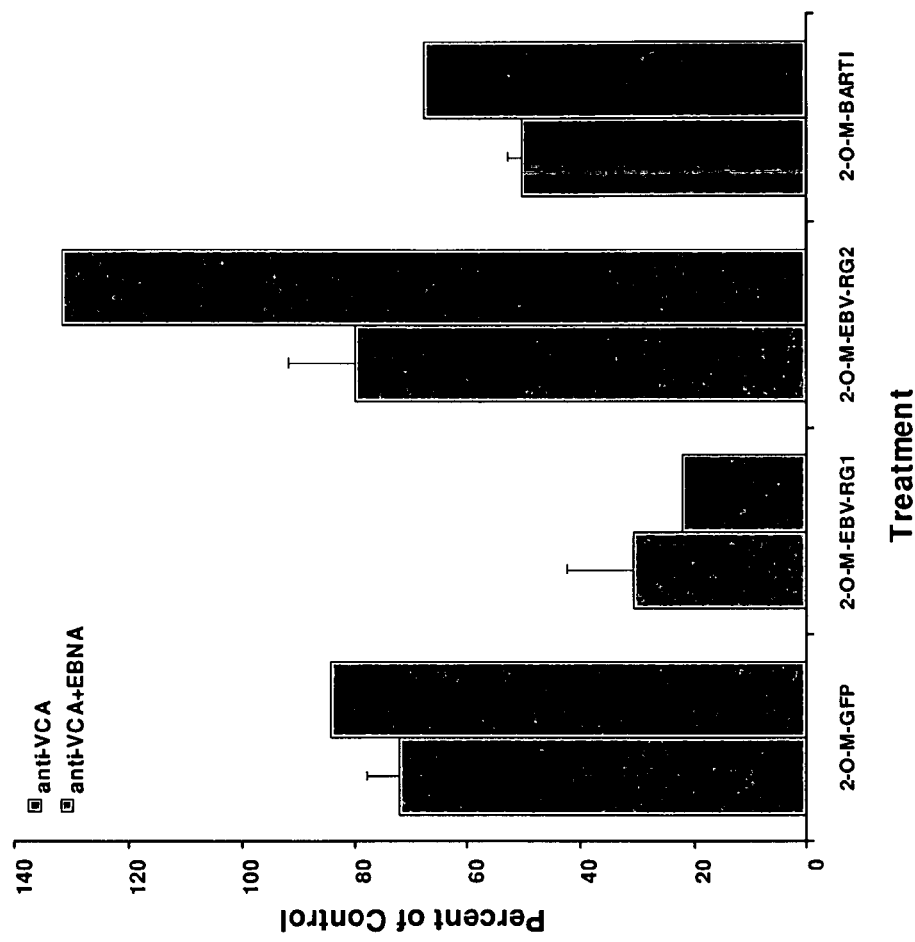
FIG. 5 shows the knockout of EBV miRNAs.

FIG. 5 shows the knockout of EBV miRNAs. Addition of 2-O-Methyl against EBV-miR-RG-1 to B-95-8 cell line resulted is dramatic reduction of cells expressing EBV antigens. Addition of 2-O-Methyl against EBV-miR-RG-2 to B-95-8, had a moderate effect, slightly increasing EBV expression.

SEQUENCE LISTING (547377 sequences)

SEQ ID NO: 1 - RNA, 69 nt, Human Herpes Virus 1
ccccuuucuccccccucuuccgaggccagcaggggggcaggacuuugugaggcgggggggggagagggg

SEQ ID NO: 2 - RNA, 69 nt, Human Herpes Virus 1; identical to SEQ ID NO: 1

SEQ ID NO: 3 - RNA, 67 nt, Human Herpes Virus 1
uaugggcccugcuccggcggggccucacgaccgcauccacccuccgcuggggcccccaggguccgug

SEQ ID NO: 4 - RNA, 64 nt, Human Herpes Virus 1
guccgggcccgucgugucuuucgguggaccuugggccgucgggcacguacacggguggccgggc

SEQ ID NO: 5 - RNA, 67 nt, Human Herpes Virus 1
ggccgccgccgccgcggaccugcuguuugacaaccagagccugcgcccccugcuggcggcggcggcc

SEQ ID NO: 6 - RNA, 67 nt, Human Herpes Virus 1; identical to SEQ ID NO: 5

SEQ ID NO: 7 - RNA, 68 nt, Human Herpes Virus 1
cggcggccgugugggcgcccgagcugggcgacgccgcgcagcaguacgcccugaucacgcggcugcug

SEQ ID NO: 8 - RNA, 95 nt, Human Herpes Virus 1
cguggcgagguuauccagcacagccgcggucgucccgauaaugggguccugggggcgcagcggcagguugugguggaugcacaucuugcaccacg

SEQ ID NO: 9 - RNA, 68 nt, Human Herpes Virus 1
gggccucgacgcggcgacgggugucgaagagcgccugcaggcgcgcgcccugucgcgucaggaggccc

SEQ ID NO: 10 - RNA, 56 nt, Human Herpes Virus 1
cucgcuuccccccgggagauccguguccugcacagccuggguggggacuaugugag

SEQ ID NO: 11 - RNA, 61 nt, Human Herpes Virus 1
ggccgccugccgcgggauccuggaggcgcuggccgagggcuucgacggcgaccuggcggcc

SEQ ID NO: 12 - RNA, 61 nt, Human Herpes Virus 1; identical to SEQ ID NO: 11

SEQ ID NO: 13 - RNA, 85 nt, Human Herpes Virus 1
gcgcgggguggccggugccgcgcgggucguuaacaagguguugggggaggacgacgagaccaaggccgggucggccgccucgcgc

SEQ ID NO: 14 - RNA, 68 nt, Human Herpes Virus 1
cuccgugcuggccgcgggguuggggucgugggucgucacggcccgaagaugcguggcuaggcgcgggg

SEQ ID NO: 15 - RNA, 55 nt, Human Herpes Virus 1
ggguuuggaucucugaccugagauuggcggcacugagguagagaugcccgaaccc

SEQ ID NO: 16 - RNA, 55 nt, Human Herpes Virus 1; identical to SEQ ID NO: 15

SEQ ID NO: 17 - RNA, 93 nt, Human Herpes Virus 1
ggggcgcguggggaggggccccgacgugcgggugggugggcucggccaaauccgcgccgcgcugugggaggggcuguuccaccaccgcguucc

SEQ ID NO: 18 - RNA, 55 nt, Human Herpes Virus 1
ccccgagccacgccagaaccuuggcaaaggucgacgggguggcguggcuucgggg

SEQ ID NO: 19 - RNA, 90 nt, Human Herpes Virus 1
cgcguccagucuugcuaggcccguccggccguggggguccgccagcccgcuccccccgaggucggccagggccgccaggagcugggcgcg

SEQ ID NO: 20 - RNA, 85 nt, Human Herpes Virus 1
agaccggggcucccugggagaccgggguugucguggaucccuggggucacgcgguacccuggggucucugggagcucgcgguacu

SEQ ID NO: 21 - RNA, 55 nt, Human Herpes Virus 1
ggggggugcucugauagucucgcgugcccaaggcccgugaucgggguacuucgcc

SEQ ID NO: 22 - RNA, 69 nt, Human Herpes Virus 1
ggccagguccugucgggucacgaaugcgacguagugcgcguacgccguguccuucacggggcucugguc

SEQ ID NO: 23 - RNA, 56 nt, Human Herpes Virus 1
gccauggcggccggccgcuucggcuggggccuggcgcacgcggcggccgccguggc

SEQ ID NO: 24 - RNA, 76 nt, Human Herpes Virus 1
cagguccugggcguacgaagggauguacgggugcugaaagcuguuggcgacguacgugucgucguccauggacuug

SEQ ID NO: 25 - RNA, 80 nt, Human Herpes Virus 1
cgcccuaagcggcugucccccgcgcggguccguuagcgagacggaccacgcgguggcgcuguucaagauaaucuggggcg

SEQ ID NO: 26 - RNA, 56 nt, Human Herpes Virus 1
gugccgcacgcggugggggccgaaccggacacaggcaaccccgacgugcguugcac

SEQ ID NO: 27 - RNA, 63 nt, Human Herpes Virus 1
gggaaaggaaagaggaaacaggccgcggacacccgggggaguuuguguucccuuuucuuucuu

SEQ ID NO: 28 - RNA, 60 nt, Human Herpes Virus 1
gggcccagcgcgaucuacgggagcugcggugccgggaucccgaggcgucgcugccggccc

SEQ ID NO: 29 - RNA, 61 nt, Human Herpes Virus 1
caucucccgggcaaacgugcgcgccaggucgcagaucgucgguauggagccugggguggug

SEQ ID NO: 30 - RNA, 56 nt, Human Herpes Virus 1
uguggcucggggcggggguguccgggggcucggaaacugccuccaccgggcccacg

SEQ ID NO: 31 - RNA, 59 nt, Human Herpes Virus 1
uaucugggucaccguuagcgcguaucgcgagucgcgggucgcucgcguggcauuagaug

SEQ ID NO: 32 - RNA, 61 nt, Human Herpes Virus 1
gacguaccuggccaccggggcccugcucgcccgcuucaaucccgacgccguccggugcguu

SEQ ID NO: 33 - RNA, 84 nt, Human Herpes Virus 1
uccuccuccccgcuucacccuggguggcggcuguuguuccugucgcgacacacggcgccgcucugcgguauucgggggggaggg

SEQ ID NO: 34 - RNA, 58 nt, Human Herpes Virus 1
gccccccgggccuccggagaggcguccggagacgggccgcucggcggcccgggcgggc

SEQ ID NO: 35 - RNA, 94 nt, Human Herpes Virus 1
cuccgucuccgcgccccacccgagggccccccgcucgucgcggucugggcucggggugggcggcggcccgucgguggggcccggggagccgggg

SEQ ID NO: 36 - RNA, 57 nt, Human Herpes Virus 1
gcggcggcggccgccagcgcgucggcggcguccggugcgcuggccgccgccgccagc

SEQ ID NO: 37 - RNA, 57 nt, Human Herpes Virus 1; identical to SEQ ID NO: 36

SEQ ID NO: 38 - RNA, 68 nt, Human Herpes Virus 1
ucuguugcgaccuggagagcuggcgucaguuggcgggucuguuccagcccuucauguucgucaacgga

SEQ ID NO: 39 - RNA, 71 nt, Human Herpes Virus 1
ggcccgcggagccggcccggcgaacucggucuaacguuacacccgaggcggccugggucuuccgcggagcu

SEQ ID NO: 40 - RNA, 71 nt, Human Herpes Virus 1; identical to SEQ ID NO: 39

SEQ ID NO: 41 - RNA, 55 nt, Human Herpes Virus 1
acggggugcucccggcggccccgggggacgucccccgggacgcgaguacccacgu

SEQ ID NO: 42 - RNA, 55 nt, Human Herpes Virus 1
uccuugucugugccggagguggggcgggggccccgcccggggggcggaacgagga

SEQ ID NO: 43 - RNA, 55 nt, Human Herpes Virus 1
uuggugccgguggggcguaccgcguaaauacaucggugcagcggacuggcaccga

SEQ ID NO: 44 - RNA, 72 nt, Human Herpes Virus 1
cccucggggggguucgggcaucucuaccucagugccgccaaucucaggucagagauccaaacccuccggggg

SEQ ID NO: 45 - RNA, 57 nt, Human Herpes Virus 1
ggucucuuuuguguggugcguuccgguauggggggggcugccgccagguugggggcc

SEQ ID NO: 46 - RNA, 96 nt, Human Herpes Virus 1
ggaggcgcgcauccacccgcccccgcgccucgcccguggcggacgagccagcgggcgauggggugggguucaugggguaccugcgugcgguguucc

SEQ ID NO: 47 - RNA, 67 nt, Human Herpes Virus 1
gcccggcggcguggggcagguaccgccgcagcucguuggcguccagccgcaccugcgccugcugggu

SEQ ID NO: 48 - RNA, 65 nt, Human Herpes Virus 1
cugcccccgaagccacgccaccccgucgaccuuugccaagguucuggcguggcucggggucgcgg

SEQ ID NO: 49 - RNA, 80 nt, Human Herpes Virus 1
gggggaugguaaggcgucgcggcguccuggaucgacgguaugugccaguuuggugggauuugcggcgccaccguccccac

SEQ ID NO: 50 - RNA, 80 nt, Human Herpes Virus 1
cccggcggcgcgcucaaccaccgcuccccccacgucgucucggaaauggaguccacgguaggcccagcauguccgccggg

SEQ ID NO: 51 - RNA, 71 nt, Human Herpes Virus 1
ggguccggcgcguccucggcgggagaguacacgauaaacgggaucguguaccacugccacugucgguaucc

SEQ ID NO: 52 - RNA, 83 nt, Human Herpes Virus 1
cgcccgccggccaaugggggggcggcaaggcgggcggcccuugggccgcccgccgucccguuggucccggcguccggcgggcg

SEQ ID NO: 53 - RNA, 55 nt, Human Herpes Virus 1
cuggucccccgcggguggcccgcguuugcgcccgccagucccggggaggacacgg

SEQ ID NO: 54 - RNA, 60 nt, Human Herpes Virus 1
gcccguccccgccccguacgucguccacgguucucuaacgaugcgggggguggcacgggu

SEQ ID NO: 55 - RNA, 56 nt, Human Herpes Virus 1
gggggcgcagggcccacgggccggcgaagaacgugugugcggggcauugugucucc

SEQ ID NO: 56 - RNA, 56 nt, Human Herpes Virus 1
cguccucgccgacccgggcuucguccccuacguucuggcccugguggucggggacg

SEQ ID NO: 57 - RNA, 67 nt, Human Herpes Virus 1
cccgcgagccguaccgggccaaugggucgcggcggucgcaccacacgggcccgggggguuuaguggg

SEQ ID NO: 58 - RNA, 64 nt, Human Herpes Virus 1
cucgucgagcguaccgacgggcggcacaccuaucacgugacuggccgucaggagcucggcgcag

SEQ ID NO: 59 - RNA, 90 nt, Human Herpes Virus 1
ccgucuccgcgccccacccgagggccccccgcucgucgcggucugggcucggggugggcggcggcccgucgguggggcccggggagccgg

SEQ ID NO: 60 - RNA, 64 nt, Human Herpes Virus 1
gcgcgugguccccggggacguggcgcuggaccaggccugcuuccggaucucgggcgccgcgcgc

SEQ ID NO: 61 - RNA, 69 nt, Human Herpes Virus 1
cgggcgucaccaugcagcgccggacgcgcggcgcgagcucccugcggcuggcgcggugccugacgccug

SEQ ID NO: 62 - RNA, 88 nt, Human Herpes Virus 1
cggggaccccgcggacgaaaaccccccgggggcucuucccgggcccccgggcggcccccgguaucgggucuuuguccuagggucccug

SEQ ID NO: 63 - RNA, 58 nt, Human Herpes Virus 1
ccauagccacgggccccguggguuagggacggggucccccauggggaaugguuuaugg

SEQ ID NO: 64 - RNA, 63 nt, Human Herpes Virus 1
ucgauggcgcugcccgggcgggagaggcgggggccuugcaugccuguccgaugccgucgucga

SEQ ID NO: 65 - RNA, 64 nt, Human Herpes Virus 1
caccgucaggugggccaggcgcuuguugguguacgcgcgcgggugucugcucaguucggcggug

SEQ ID NO: 66 - RNA, 55 nt, Human Herpes Virus 1
ccaugggcgguggaggaguuccggggcgcgcgggagcucauccaacgccgcaugg

SEQ ID NO: 67 - RNA, 66 nt, Human Herpes Virus 1
gccagcggggcccacgcggucaauguguuugacuugcacgaacucgcugacgguggcccgcuuggc

SEQ ID NO: 68 - RNA, 66 nt, Human Herpes Virus 1
cuccccugcggcguugcgacauacaaaauacaccagggcguggaaguacucgcgagcgcggggggg

SEQ ID NO: 69 - RNA, 70 nt, Human Herpes Virus 1
cccccggcgugccggcgucggggcggggucgugcauaauggaauuccguucggggugggcccgccggggg

SEQ ID NO: 70 - RNA, 57 nt, Human Herpes Virus 1
ucgucgucagcaccgucauccacaccuuaucguuuuuguguauuggugcgauggcga

SEQ ID NO: 71 - RNA, 90 nt, Human Herpes Virus 1
gcgcgaggaagggguccucgucgguggcgcuggcggcgaggacguccucgccgcccgccacaaacgggagcuccucgguggccucgcugc

SEQ ID NO: 72 - RNA, 84 nt, Human Herpes Virus 1
gggacccuaggacaaagacccgauaccgggggccgcccgggggcccgggaagagcccccgggggguuuucguccgcgggguccc

SEQ ID NO: 73 - RNA, 90 nt, Human Herpes Virus 1
ucgccuccaucagcuggccccaggccucgcccagccgcucggucugccggccuggcggggcgcgcuggugggccaggugaggcaggucgg

SEQ ID NO: 74 - RNA, 65 nt, Human Herpes Virus 1
cgaggcgcaccccgaucgcacgcuguucgcgcacgucgcgcugugcgcgaucgggcggcgccucg

SEQ ID NO: 75 - RNA, 83 nt, Human Herpes Virus 1
cggucucgacgccgccaucgcgcccuuucgccaccugucgccggcgucucgcgagggggcgcggcgacuggccgccgaggccg

SEQ ID NO: 76 - RNA, 80 nt, Human Herpes Virus 1
cccggcggacaugcugggccuaccguggacuccauuuccgagacgacguggggggagcggugguugagcgcgccgccggg

SEQ ID NO: 77 - RNA, 55 nt, Human Herpes Virus 1
ccgcgggcaggaggcauccggcugccgccgaggccacgccgggccaggcucgcgg

SEQ ID NO: 78 - RNA, 75 nt, Human Herpes Virus 1
aacgggcgcgcggggcucguaucucauuaccgccgaaccgggaagucggggcccgggccccgcccccugcccguu

SEQ ID NO: 79 - RNA, 73 nt, Human Herpes Virus 1
gccgcgcucggcggaccacuccggcggcccccccgaggccccgccgccggccagguccucgcccggcagcggc

SEQ ID NO: 80 - RNA, 56 nt, Human Herpes Virus 1
cgguuccgcgguaccccgagucgauaagacccaguauuacguggugcccggggcug

SEQ ID NO: 81 - RNA, 75 nt, Human Herpes Virus 1
caccacagcucccuuagcguggggccgggcggggcggaauccugggccccgggcaccagggaacucgagucggug

SEQ ID NO: 82 - RNA, 77 nt, Human Herpes Virus 1
aacgcgggcguauuggucccaauggggucucggugggguaucgacagagugccagcccugggaccgaaccccgcguu

SEQ ID NO: 83 - RNA, 67 nt, Human Herpes Virus 1
gggggcugcagcuggaccaggggccgcagcugcucgacggcaccccuggagaucacguacagcuccc

SEQ ID NO: 84 - RNA, 79 nt, Human Herpes Virus 1
cccgccggccaaugggggggcggcaaggcgggcggcccuugggccgcccgccgucccguuggucccggcguccggcggg

SEQ ID NO: 85 - RNA, 67 nt, Human Herpes Virus 1
gugcgcguccccgcacgcccgggcguacuuuaaggucacggucgccagggccgugugcagcgcguac

SEQ ID NO: 86 - RNA, 61 nt, Human Herpes Virus 1
gggggguucgggcaucucuaccucagugccgccaaucucaggucagagauccaaacccucc

SEQ ID NO: 87 - RNA, 76 nt, Human Herpes Virus 1
ggcgcccgcgcaggccccgggccggacaaaaccgccccggaaacgggacgccgcguccgggggaccuccggguguu

SEQ ID NO: 88 - RNA, 63 nt, Human Herpes Virus 1
ggcccggcggucgauaaucuuggucauguaauuguguguggguugcucgauggggugcgggcc

SEQ ID NO: 89 - RNA, 61 nt, Human Herpes Virus 1
gugcgggugguuguuauccaugauaaacugagaguuauugguggccaagacgagcccgcgc

SEQ ID NO: 90 - RNA, 84 nt, Human Herpes Virus 1
ggccgcguggccgucgagugccuggccgccugccgcgggauccuggaggcgcuggccgagggcuucgacggcgaccuggcggcc

SEQ ID NO: 91 - RNA, 92 nt, Human Herpes Virus 1
cguguagcgcggccuaccuuccccgcccggucgaguucgcccugcguguguuggccugggcccgggacuuugggcugggcuaucuccccacg

SEQ ID NO: 92 - RNA, 59 nt, Human Herpes Virus 1
gagguuuugagcagcugggcaaagucccgcacaaagugcaccagcuggcgaaaggcuuc

SEQ ID NO: 93 - RNA, 81 nt, Human Herpes Virus 1
cagcagcacgugcagcaucuggucggccgugccgcgcucaaacgccccgaggacggccuggacguugcgagcgagcuguug

SEQ ID NO: 94 - RNA, 65 nt, Human Herpes Virus 1
uucgcgcagcacauccuccacggaggcguagguguuauugggauggaggucgguguggcagcgga

SEQ ID NO: 95 - RNA, 78 nt, Human Herpes Virus 1
gucucauacgggucggugaugucgggcgucgggggagagggaguucccucugcgcuugcgauucuagccucguggggc

SEQ ID NO: 96 - RNA, 93 nt, Human Herpes Virus 1
gacccgcaugucgucgucaucuucuucggccgccucugcggcgggggucuugggggcggagggaggcgguggugggaucgcggaggguggguc

SEQ ID NO: 97 - RNA, 75 nt, Human Herpes Virus 1
ggggucgcugucauagugcaaaaggggggaugcgcccgggcgggaagcuccuaagggcacuaugacaccggccuu

SEQ ID NO: 98 - RNA, 73 nt, Human Herpes Virus 1
acgggcgcgcggggcucguaucucauuaccgccgaaccgggaagucggggcccgggccccgcccccugcccgu

SEQ ID NO: 99 - RNA, 66 nt, Human Herpes Virus 1
agccccacgcagggucugcgagcaauaccugcccggggaaagcuacgccuaccucugccugggguu

SEQ ID NO: 100 - RNA, 78 nt, Human Herpes Virus 1
gugccgccucccccgagucuucggaaugucuuggcggccgucaagaacuguuaucccgaggcacggaugagcggccac

SEQ ID NO: 101 - RNA, 56 nt, Human Herpes Virus 1
gggguuacgcggguaguaggcggcggccgugcacgucgccuugaacggcugacccu

SEQ ID NO: 102 - RNA, 71 nt, Human Herpes Virus 1
gaguccccgcugucauacagggccaaaaacccagccacguaaaugggcacggcccugucgggcaggggcuc

SEQ ID NO: 103 - RNA, 66 nt, Human Herpes Virus 1
gccccgucucgaacaguuccguguccgugcuguccgccucggaggcggagucgucgucaugguggu

SEQ ID NO: 104 - RNA, 66 nt, Human Herpes Virus 1; identical to SEQ ID NO: 103

SEQ ID NO: 105 - RNA, 66 nt, Human Herpes Virus 1
ggggcuggcggcuccgcgccuguccuuucuccccgcgggacacacgcgcagacugucgacggcccc

SEQ ID NO: 106 - RNA, 55 nt, Human Herpes Virus 1
uggggucggggguggggucggaacuggggccgguugcaccaccaggaccaccgag

SEQ ID NO: 107 - RNA, 67 nt, Human Herpes Virus 1
guucgcggacccaggcccgggggauuguccggaugugcgggcagcccggacggcguggguugcggac

SEQ ID NO: 108 - RNA, 62 nt, Human Herpes Virus 1
cgccggugagcuuguagccgaucccccggggcagaggggagugggugacgacguagcuggcg

SEQ ID NO: 109 - RNA, 92 nt, Human Herpes Virus 1
cgggggcgccgguccaauugcccgcccaggcggccguguccggcccgcacagccgguuggccagggccgccagcaggcaggacagcccgccg

SEQ ID NO: 110 - RNA, 85 nt, Human Herpes Virus 1
ggccgaggcggucaucgggccgugccuggggcccgaggcccgugcccgggcccuggcccgcggagccggcccggcgaacucgguc

SEQ ID NO: 111 - RNA, 85 nt, Human Herpes Virus 1; identical to SEQ ID NO: 110

SEQ ID NO: 112 - RNA, 86 nt, Human Herpes Virus 1
acucagcguaacggccagccccuggcgagacagauccacggaguccggaaccgcggucgucuggcccagggggccgaggcuguagu

SEQ ID NO: 113 - RNA, 62 nt, Human Herpes Virus 1
acagcccugucgccgguauggggcaugaucagacgagccgcgcgccgcgcguugggcccugu

SEQ ID NO: 114 - RNA, 78 nt, Human Herpes Virus 1
gacggacuucugcucucggaggaagccgucaagcgcgucgccgacgcccuaagcggcugucccccgcgcggguccguu

SEQ ID NO: 115 - RNA, 59 nt, Human Herpes Virus 1
guauggagccgguuguguuuggagccaaggccauccuggcccgcacgacggcccagugc

SEQ ID NO: 116 - RNA, 88 nt, Human Herpes Virus 1
gcccggacguacggugggcgggagccaugguguuuuucgugccgucgggcccggaacccgcggcuccugcggacuugacggccgcggc

SEQ ID NO: 117 - RNA, 95 nt, Human Herpes Virus 1
uguguuagccgcgucugcgggccugucguguagauucgaaaccacggacgggugauugugucgcagggcggcccgcguauaaaggcgagagcgcg

SEQ ID NO: 118 - RNA, 71 nt, Human Herpes Virus 1
guugcgauugguucugggggcacgccggcggggguccgacaaaccaucggcagccccgggaccaccgcgac

SEQ ID NO: 119 - RNA, 79 nt, Human Herpes Virus 1
ggggugccgcuguggccucaccugaccaaccuuuacacgggggcccggaacgggaggccacagcgccgucuuucucccc

SEQ ID NO: 120 - RNA, 78 nt, Human Herpes Virus 1
gaguggcuucuggagcgcucgcaggcccacccggacacccuuuuugcccccgccaccccgacgcacccagaaccgcuu

SEQ ID NO: 121 - RNA, 70 nt, Human Herpes Virus 1
ccgccgccgccagcacggugccgcugcggcccguggccgaggcccagcgaaucccgggcggcgccggcgg

SEQ ID NO: 122 - RNA, 57 nt, Human Herpes Virus 1
cccaugcggcguuggaugagcucccgcgcgccccggaacuccuccaccgcccauggg

SEQ ID NO: 123 - RNA, 62 nt, Human Herpes Virus 1
gaggcccauagcucggcgagcgugucgucgaaugccaggcggcugcuucgcuggauggccuu

SEQ ID NO: 124 - RNA, 57 nt, Human Herpes Virus 1
ccccgccgcuugaucauuaucaccccguugcggggguccggagaucaugcgcgggug

SEQ ID NO: 125 - RNA, 95 nt, Human Herpes Virus 1
gcgggucgcugcagggucgcucgguauucgaggccacacgcgucaccuuaauaugcgaaguggaccugggaccgcgccgccccgacugcaucugc

SEQ ID NO: 126 - RNA, 55 nt, Human Herpes Virus 1
ggccggcagcgccccguggguggccggggccaaccgcgucagggcgcccucggcc

SEQ ID NO: 127 - RNA, 96 nt, Human Herpes Virus 1
gucgggcacggcgccagugcucgcacuucgcccuaauaauauauauauauugggacgaagugcgaacgcuucgcguucucacuucuuuuacccggc

SEQ ID NO: 128 - RNA, 84 nt, Human Herpes Virus 1
ggccgccaggucgccgucgaagcccucggccagcgccuccaggaucccgcggcaggcggccaggcacucgacggccacgcggcc

SEQ ID NO: 129 - RNA, 76 nt, Human Herpes Virus 1
acggacccgcgcgggggacagccgcuuagggcgucggcgacgcgcuugacggcuuccuccgagagcagaaguccgu

SEQ ID NO: 130 - RNA, 56 nt, Human Herpes Virus 1
cgcggcgcccggcgucgucgucggcgucggcguggcgggcggcgucggggucgucg

SEQ ID NO: 131 - RNA, 56 nt, Human Herpes Virus 1; identical to SEQ ID NO: 130

SEQ ID NO: 132 - RNA, 70 nt, Human Herpes Virus 1
ccgccggcgccgcccgggauucgcugggccucggccacgggccgcagcggcaccgugcuggcggcggcgg

SEQ ID NO: 133 - RNA, 59 nt, Human Herpes Virus 1
gcgguugucgucugauuauuugguggugggggaaagaacuagccaggagacgggaccgc

SEQ ID NO: 134 - RNA, 59 nt, Human Herpes Virus 1
caggguggcguggcccgcggcgacggucgcguugucgccggcggggcgcggcggcuuug

SEQ ID NO: 135 - RNA, 88 nt, Human Herpes Virus 1
aacagcgcaccagcucgugcucccagaggcgcgacaggcgcuccagguccugggcguacgaagggauguacgggugcugaaagcuguu

SEQ ID NO: 136 - RNA, 65 nt, Human Herpes Virus 1
gcaggggagucugcaccgccgcauuacggauaagcgccgcgaucgccggggguguggggcccugc

SEQ ID NO: 137 - RNA, 68 nt, Human Herpes Virus 1
gcuguugucggguggcucccgccggauccaaaugagucuucggaccucgcgggggccgcuuaagcggu

SEQ ID NO: 138 - RNA, 95 nt, Human Herpes Virus 1
ggucucugggagcucgcgguacucuggguucccuagguucucgggguggucgcggaacccggggcucccggggaacacgcgguguccuggggauu

SEQ ID NO: 139 - RNA, 57 nt, Human Herpes Virus 1
gaguuagacaggcaagcacuacucgccucugcacgcacaugcuugccugucaaacuc

SEQ ID NO: 140 - RNA, 57 nt, Human Herpes Virus 1; identical to SEQ ID NO: 139

SEQ ID NO: 141 - RNA, 75 nt, Human Herpes Virus 1
gccccagucgcacucgucccuggcucaggccgcgaaccaagaacagagucugugccgggcgcgugcgacgguggc

SEQ ID NO: 142 - RNA, 75 nt, Human Herpes Virus 1; identical to SEQ ID NO: 141

SEQ ID NO: 143 - RNA, 87 nt, Human Herpes Virus 1
uggugaacggcaacuugccccuggcgcuauguccggcggcguuccgggacgcccggggccuggagcugggggugggacgccacgcca

SEQ ID NO: 144 - RNA, 80 nt, Human Herpes Virus 1
ccaggaauuugccggcgagcaccuggccaugcuguguggguuuuccccggcgcugcuggccaagaugcuguuuuaccugg

SEQ ID NO: 145 - RNA, 66 nt, Human Herpes Virus 1
gggguacgaagccauacgcgcuucuacaaggcgcuggccgaagaggugcgggaguuucacgccacc

SEQ ID NO: 146 - RNA, 55 nt, Human Herpes Virus 1
gguggacaucaugucccaguuuaggaaacugcugaugggagacgagggggccgcc

SEQ ID NO: 147 - RNA, 55 nt, Human Herpes Virus 1
ggccgagggcgcccugacgcgguuggccccggccacccacggggcgcugccggcc

SEQ ID NO: 148 - RNA, 67 nt, Human Herpes Virus 1
cggcaaguccguggguggcgcgacgguguccuccgggaucaucucgucguccucgacggggguguug

SEQ ID NO: 149 - RNA, 90 nt, Human Herpes Virus 1
gccuuagucgccacccgcuggguucggggggcccggggggcgguggugggugugcguccggccccuccggacccagcggguggcggaggc

SEQ ID NO: 150 - RNA, 88 nt, Human Herpes Virus 1
ccgagaugggcagguagcgcgugaggccgcccgcggggacggccccggaagucuccgcguggcgcgucuuccgggcacacuuccucgg

SEQ ID NO: 151 - RNA, 88 nt, Human Herpes Virus 1; identical to SEQ ID NO: 150

SEQ ID NO: 152 - RNA, 56 nt, Human Herpes Virus 1
gcccgccgcgcgcaggucccguccaucaaggaccggaucccguacgugaucguggc

SEQ ID NO: 153 - RNA, 65 nt, Human Herpes Virus 1
ccccccgcgcucgcgaguacuuccacgcccugguguauuuuguaugucgcaacgccgcaggggag

SEQ ID NO: 154 - RNA, 62 nt, Human Herpes Virus 1
ccccccgcgcauggugccccgcaggaucuuguccagggccuguucgguaucgucguuggggg

SEQ ID NO: 155 - RNA, 70 nt, Human Herpes Virus 1
cgacgccagcgcuccguguucguagcggcccccgccggccgcgaacugcgucuuggggagcuugucgucg

SEQ ID NO: 156 - RNA, 78 nt, Human Herpes Virus 1
ucccgcugcgcauccccccgucagccugccucuccccccaggccuaccagcagggggugacgguggacagcaucggga

SEQ ID NO: 157 - RNA, 55 nt, Human Herpes Virus 1
ggccgcgcccagggccgucaccgcgucgaccaggacgcggugcgcccgcacggcc

SEQ ID NO: 158 - RNA, 55 nt, Human Herpes Virus 1
guccgcauccucuucguccucgucguccgacgaggacgaggacgacgacggcaac

SEQ ID NO: 159 - RNA, 55 nt, Human Herpes Virus 1
guggccccaaucucaucccggcugcgucgucguauaccggggggagaugcgccac

SEQ ID NO: 160 - RNA, 59 nt, Human Herpes Virus 1
cccugcgucgccccgugucugugggccaagauggcccaguguacccuggcgguccaggg

SEQ ID NO: 161 - RNA, 62 nt, Human Herpes Virus 1
ccccaggcagagguaggcguagcuuuccccgggcagguauugcucgcagacccugcgugggg

SEQ ID NO: 162 - RNA, 74 nt, Human Herpes Virus 1
gcggcgcugucggccauggccgcuaggaaggccaggggggaggccgggucgcuggcggccgcgcccagggccgu

SEQ ID NO: 163 - RNA, 82 nt, Human Herpes Virus 1
uguaggguuguuuccggacgucuucggaggccccgcggacaaucuggggggccuccgacggugcguuuaggagcacgcugcg

SEQ ID NO: 164 - RNA, 92 nt, Human Herpes Virus 1
gcugugaguuguguuguugggcaggugugguggaugacgugacgugugacgugcggagugcgccgugcucuguugguuucaccuguggcagc

SEQ ID NO: 165 - RNA, 92 nt, Human Herpes Virus 1; identical to SEQ ID NO: 164

SEQ ID NO: 166 - RNA, 69 nt, Human Herpes Virus 1
caggugguuaaugucgggacacugggagguguagaaguaccucucggggucggggcacuuuggaaucug

SEQ ID NO: 167 - RNA, 92 nt, Human Herpes Virus 1
ggguggugggcgaggggggagggggcauuagggagaaaaaacaagagccuccguuggguuuucuuugugccuguacucaaaaggucauaccc

SEQ ID NO: 168 - RNA, 94 nt, Human Herpes Virus 1
gcgcguacgccaaggccacaggccagacgggcgcgggcgcggcggccgcgcccgcgccccugcucguggaucuucgcgcccuagacgcccgcgc

SEQ ID NO: 169 - RNA, 67 nt, Human Herpes Virus 1
gucauucccgcccggucucgucguuggucuacgcugucccccacccacgcgagccgggcgucauggc

SEQ ID NO: 170 - RNA, 59 nt, Human Herpes Virus 1
cgccguuccguuuuccggaauacguacggacgucaguguugggggagacgguuucggug

SEQ ID NO: 171 - RNA, 63 nt, Human Herpes Virus 1
ucguuuuuguguauuggugcgauggcgacacaccuguguggcgguugguccagacgcgggcga

SEQ ID NO: 172 - RNA, 59 nt, Human Herpes Virus 1
gccgacgaggggcgcggugggccgacccucgaacccgggcaccacgugucccucgcggu

SEQ ID NO: 173 - RNA, 94 nt, Human Herpes Virus 1
ggugagcggccuguuugacggcauccccgccccacgccagccacuugacgcccacaacccgcgcacggaugugguuaucacgggccgccgcgcc

SEQ ID NO: 174 - RNA, 59 nt, Human Herpes Virus 1
ggggaggguuggagaccgggguuggggaaugaaucccuccccuucaccgacaacccccc

SEQ ID NO: 175 - RNA, 79 nt, Human Herpes Virus 1
ugacaguuucgacgcccuucugaccgcgcgucuggaaucugggcagacgcugagccccucgggggggcgcgaggcguca

SEQ ID NO: 176 - RNA, 96 nt, Human Herpes Virus 1
guucagcgggcagugcaggacgucacccgccgccacccgguccgagcgcggaccgggcgugcggccuguggcguugcaucggggcuacgccagggc

SEQ ID NO: 177 - RNA, 74 nt, Human Herpes Virus 1
acgcacgcguagcgcagggggguguacgugcccaccucgggggccgugaaucccccgucaaacgcggccagugu

SEQ ID NO: 178 - RNA, 74 nt, Human Herpes Virus 1
ucggacccgcccgugggccaggcgcugcccccaggcguucaaaaacagcugcugcaugucugcggcggggccgg

SEQ ID NO: 179 - RNA, 77 nt, Human Herpes Virus 1
acccagcuguuucccggccuggccgcccugugucuugacgcccaggcggggcggccggucgggucgacgcggcgggu

SEQ ID NO: 180 - RNA, 59 nt, Human Herpes Virus 1
uagcauaucacauaccccguuccgcuuccgcggggacccgggcggggguggauacgcug

SEQ ID NO: 181 - RNA, 67 nt, Human Herpes Virus 1
ggccaguugagccgcgccauccucacgcaguacuggaaguaccugcagacgguggugcccagcggcc

SEQ ID NO: 182 - RNA, 62 nt, Human Herpes Virus 1
guugacgaacaugaagggcuggaacagacccgccaacugacgccagcucuccaggucgcaac

SEQ ID NO: 183 - RNA, 58 nt, Human Herpes Virus 1
ggccacgaucacguacgggauccgguccuugauggacgggaccugcgcgcggcgggcc

SEQ ID NO: 184 - RNA, 74 nt, Human Herpes Virus 1
ggucaauaaaugcguguuuucauccaacccguguguuuuguguuugugggauggaggggcgggugugauagacc

SEQ ID NO: 185 - RNA, 56 nt, Human Herpes Virus 1
gugcaacgcacgucgggguugccuguguccgguucggcccccaccgcgugcggcac

SEQ ID NO: 186 - RNA, 59 nt, Human Herpes Virus 1
gggcaaucagcgguucgccccgcgguaccugacccugggggggcacacggugagggccc

SEQ ID NO: 187 - RNA, 59 nt, Human Herpes Virus 1; identical to SEQ ID NO: 186

SEQ ID NO: 188 - RNA, 74 nt, Human Herpes Virus 1
gaggaauaggcgggcgggcgaggaaagggcgggccggggagggggcguaaccugaucgcgccccccguugucuc

SEQ ID NO: 189 - RNA, 74 nt, Human Herpes Virus 1; identical to SEQ ID NO: 188

SEQ ID NO: 190 - RNA, 89 nt, Human Herpes Virus 1
acguacgccgccuuugcagagcucggcaugaugcccgaggauaguccccgcugccugcaccgcaccgagcgcuuuggggcggucagcgu

SEQ ID NO: 191 - RNA, 80 nt, Human Herpes Virus 1
cgccauggcgcccggcgcgccggacuucugcgaggaggaggcccacucgcacgccgccugcgcgcgcuggggccugggcg

SEQ ID NO: 192 - RNA, 55 nt, Human Herpes Virus 1
cgcgaucgcguccgcgcaugugcgccuggcggugcagcugccggacgcuggcgcg

SEQ ID NO: 193 - RNA, 73 nt, Human Herpes Virus 1
cgccaucaacgccggcagcgccgccgucgcaacggcagacccugcgucgacgguggaugcggccgugcgggcg

SEQ ID NO: 194 - RNA, 90 nt, Human Herpes Virus 1
gccuccgccacccgcuggguccggaggggccggacgcacacccaccaccgccccccgggccccccgaacccagcggguggcgacuaaggc

SEQ ID NO: 195 - RNA, 55 nt, Human Herpes Virus 1
agugcucgcacuucgcccuaauaauauauauauauugggacgaagugcgaacgcu

SEQ ID NO: 196 - RNA, 60 nt, Human Herpes Virus 1
ggcgcggggaggggggcgcgggcguccgagccgggggcguccgcgccgcucuucuucguc

SEQ ID NO: 197 - RNA, 63 nt, Human Herpes Virus 1
gggaccgcagcgcgcagucggggauugugucccguaaaguucgcuggcgcgugcgccccuccc

SEQ ID NO: 198 - RNA, 67 nt, Human Herpes Virus 1
uacccgaagaucggcugcuauccccgggacauggaucgcggggcgguggugggguuucuucucggug

SEQ ID NO: 199 - RNA, 58 nt, Human Herpes Virus 1
ccgccgcccaccccgagcccagaccgcgacgagcggggggcccucggguggggcgcgg

SEQ ID NO: 200 - RNA, 95 nt, Human Herpes Virus 1
gcggcgggcuguccugccugcuggcggcccuggccaaccggcugugcgggccggacacggccgccugggcgggcaauuggaccggcgcccccgac

SEQ ID NO: 201 - RNA, 58 nt, Human Herpes Virus 1
gcgccgggaccaggagcuguguuguguguacgugaucaagagccagcuccccccgcgc

SEQ ID NO: 202 - RNA, 65 nt, Human Herpes Virus 1
agcgcgccacggccuccgcguucucgggcgugaguuccagggggacgggguaggccgugcccguu

SEQ ID NO: 203 - RNA, 79 nt, Human Herpes Virus 1
cacccagucccaggccacggugaacuugggggucgugagcagguuccggguggucggcgccguggcccgggccuuggug

SEQ ID NO: 204 - RNA, 75 nt, Human Herpes Virus 1
ggcccccacgagucccgcggcgcgcgccagguacgccccgacggcguuggcgcgggccgcggccguguccuggcc

SEQ ID NO: 205 - RNA, 55 nt, Human Herpes Virus 1
cgcgccagcguccggcagcugcaccgccaggcgcacaugcgcggacgcgaucgcg

SEQ ID NO: 206 - RNA, 66 nt, Human Herpes Virus 1
ugguccagcugcucgagucccugccugucuucgaccagcacacgcgggacaucgcgcagcgcgccg

SEQ ID NO: 207 - RNA, 84 nt, Human Herpes Virus 1
ggcccgguggcugucguugcggagcaucccgcgccuuggccgugauggcacgcggggugguuccgucacgccccacauacggcu

SEQ ID NO: 208 - RNA, 78 nt, Human Herpes Virus 1
gacgcgcggcuggcgugggcgcgccuggcggccauucgcgacaccccccagugcgcguccgccgcuucgcugaccguu

SEQ ID NO: 209 - RNA, 83 nt, Human Herpes Virus 1
gggccggcagcgacgccucgggaucccggcaccgcagcucccguagaucgcgcugggcccugagggcgucgaaauguacgccc

SEQ ID NO: 210 - RNA, 75 nt, Human Herpes Virus 1
gccccgacggcguuggcgcgggccgcggccguguccuggcccucgaacagcggccacgcggagaugucggugggc

SEQ ID NO: 211 - RNA, 56 nt, Human Herpes Virus 1
acaccugugaaggcugggugugugaacuuugacuauucgcgcacccgccgcugugu

SEQ ID NO: 212 - RNA, 55 nt, Human Herpes Virus 1
cgccguggucggggugcgccgccgcuucggcggacacgaccgcuucggccaggcg

SEQ ID NO: 213 - RNA, 56 nt, Human Herpes Virus 1
uggcggcguuggcgucggcguggaugaccgugucgaugucggcgaagcgcaggucg

SEQ ID NO: 214 - RNA, 62 nt, Human Herpes Virus 1
cugggucgucgggccgagggacguacaggccguggcgcuguguguaccggccuacgagccgg

SEQ ID NO: 215 - RNA, 57 nt, Human Herpes Virus 1
ggguggaugcggucgugaggccccgccggagcagggcccauagcuggcagucggccu

SEQ ID NO: 216 - RNA, 79 nt, Human Herpes Virus 1
cggggcacggccacggagggcugcguggccguggugagguccacgagccaggccucgacggccucccggcgguggcccg

SEQ ID NO: 217 - RNA, 67 nt, Human Herpes Virus 1
cgacgagccggucgccccgcggcccgcguacaccauguguagcagauccacggggagguuggugucg

SEQ ID NO: 218 - RNA, 91 nt, Human Herpes Virus 1
gucggaaccaagggucgucccuuugaggugagucgggucguggggcgaguugccagcggcccgauaaugguggggggugucuucgggcgac

SEQ ID NO: 219 - RNA, 58 nt, Human Herpes Virus 1
ccgcgccccacccgagggccccccgcucgucgcggucugggcucggggugggcggcgg

SEQ ID NO: 220 - RNA, 69 nt, Human Herpes Virus 1
ggccgccggggcgcccgaggccucgaaccggcgucgcgccuccuccgccucgggcgccccccagaggcc

SEQ ID NO: 221 - RNA, 55 nt, Human Herpes Virus 1
ucugguucgaggauaugacccccgccgagcuggagguugucuucccgacuacgga

SEQ ID NO: 222 - RNA, 67 nt, Human Herpes Virus 1
uguguuggccgacuggcccggcgcguccguauacacacguuuaaagggccauuugggccgccccgca

SEQ ID NO: 223 - RNA, 60 nt, Human Herpes Virus 1
gggcugacggccgugggcgacaagauggcgagccacaucucgcgcgcgcuguuucugccc

SEQ ID NO: 224 - RNA, 76 nt, Human Herpes Virus 1
cgcguaucggcgucccggcgcggcgagcgucugacggucugucucuggcggucccgcgucgggucguggauccgug

SEQ ID NO: 225 - RNA, 69 nt, Human Herpes Virus 1
ggccucuggggggcgcccgaggcggaggaggcgcgacgccgguucgaggccucgggcgccccggcggcc

SEQ ID NO: 226 - RNA, 73 nt, Human Herpes Virus 1
gcauuugccgcgcuggccugggacgacugggcccgcauaacgcgggacgcucgccuggccgaagcggucgugu

SEQ ID NO: 227 - RNA, 55 nt, Human Herpes Virus 1
caaaucggcggcgcgggccgugucaacguccacgugugcugcgcugcuggcguug

SEQ ID NO: 228 - RNA, 70 nt, Human Herpes Virus 1
ggcacauaugaucgcgggcaccccaccgcacuccacgauggaacgcgggggggaucgcgacaucgugguc

SEQ ID NO: 229 - RNA, 67 nt, Human Herpes Virus 1
gggagcuguacgugaucuccaggggugccgucgagcagcugcggccccugguccagcugcagccccc

SEQ ID NO: 230 - RNA, 62 nt, Human Herpes Virus 1
augacgcccguggcguaguggucauagauccgccgaaauauggcgcugcugcggguggccau

SEQ ID NO: 231 - RNA, 79 nt, Human Herpes Virus 1
agaacacgcgguccccugugguguuuuugguuauuuuuauuaaaucucgucgacaaacagggggaaaggggcguggucu

SEQ ID NO: 232 - RNA, 86 nt, Human Herpes Virus 1
acuacagccucggcccccugggccagacgaccgcgguuccggacuccguggaucugucucgccaggggcuggccguuacgcugagu

SEQ ID NO: 233 - RNA, 69 nt, Human Herpes Virus 1
cggaggccggggcccuugucaacgccagcagcgcagcacacguggacguugacacggcccgcgccgccg

SEQ ID NO: 234 - RNA, 64 nt, Human Herpes Virus 1
gcgaagcguucgcacuucgucccaauauauauauauuauuagggcgaagugcgagcacuggcgc

SEQ ID NO: 235 - RNA, 78 nt, Human Herpes Virus 1
gacacgcucgcgccagaggggcgagguccguuucguccaguacgacgagucggauuaugcccucuacgggggcucguc

SEQ ID NO: 236 - RNA, 80 nt, Human Herpes Virus 1
cccacacggccgccggggcgcccgaggccucgaaccggcgucgcgccuccuccgccucgggcgccccccagaggcccggg

SEQ ID NO: 237 - RNA, 57 nt, Human Herpes Virus 1
cgaagacucggcggacgcugguuggccgggccccgccgcgcuggcggccgccgauug

SEQ ID NO: 238 - RNA, 57 nt, Human Herpes Virus 1; identical to SEQ ID NO: 237

SEQ ID NO: 239 - RNA, 59 nt, Human Herpes Virus 1
ccgauaccgggggccgcccgggggcccgggaagagcccccgggggguuuucguccgcgg

SEQ ID NO: 240 - RNA, 55 nt, Human Herpes Virus 1
ggccgugguguugcggagcgccacgacgacgggcgcgcccaggagcacugccgcc

SEQ ID NO: 241 - RNA, 83 nt, Human Herpes Virus 1
cggccucggcggccagucgccgcgcccccucgcgagacgccggcgacagguggcgaaagggcgcgauggcggcgucgagaccg

SEQ ID NO: 242 - RNA, 92 nt, Human Herpes Virus 1
cggcgggcuguccugccugcuggcggcccuggccaaccggcugugcgggccggacacggccgccugggcgggcaauuggaccggcgcccccg

SEQ ID NO: 243 - RNA, 80 nt, Human Herpes Virus 1
uaccagggggccaggguccuugaccccacuuccggguuucacgugaaccccguggugguguucgacuuugccagccugua

SEQ ID NO: 244 - RNA, 95 nt, Human Herpes Virus 1
gugcgcguccgcauguuccgccccccgucucugacccuccagccccacgcggugauggagggucagccguucaaggcgacgugcacggccgccgc

SEQ ID NO: 245 - RNA, 95 nt, Human Herpes Virus 1
gcgcaggugcuggggcuccggcgucgccugcacaggaaggaccccggggacggggcccgguuggcggcgacgcuucggggccucuucuucuccgu

SEQ ID NO: 246 - RNA, 59 nt, Human Herpes Virus 1
gggcacacuuccucggcccccgcggcccagaagcagcgcgggggccgagggagguuucc

SEQ ID NO: 247 - RNA, 59 nt, Human Herpes Virus 1; identical to SEQ ID NO: 246

SEQ ID NO: 248 - RNA, 64 nt, Human Herpes Virus 1
cgucgccccgcccccgacgucaggcccgccccccacauacuugacgcuggagggcgguguugcg

SEQ ID NO: 249 - RNA, 89 nt, Human Herpes Virus 1
ggacaccggcgcuacuucaccuucggugggggcuacguguacuucgaggaguacgcguacucccaccagcugagccgcgccgacaucac

SEQ ID NO: 250 - RNA, 55 nt, Human Herpes Virus 1
ccgcccgugcgccgucgacgggaaggcccgcgagcccgacgacggcgcgcgucgg

SEQ ID NO: 251 - RNA, 68 nt, Human Herpes Virus 1
gguccccgcgaagacccccccggagccgggcgcgugcugcgccuugggcccgggggccugguggcacc

SEQ ID NO: 252 - RNA, 93 nt, Human Herpes Virus 1
uaaccccccacgccaaugacccacguacuccaagaaggcaugugucccaccccgccuguguuuuugugccuggcucucuaugcuugggucuua

SEQ ID NO: 253 - RNA, 93 nt, Human Herpes Virus 1; identical to SEQ ID NO: 252

SEQ ID NO: 254 - RNA, 64 nt, Human Herpes Virus 1
gcgcggugggcuuugguacaaauaccugauacgucuugaagguguagaugagggcacgcaacgc

SEQ ID NO: 255 - RNA, 80 nt, Human Herpes Virus 1
gcacgucggggccccuccccacgcgcccccaacccacggcgcccugcgguuaggggcggugaugggggccgcccugcugc

SEQ ID NO: 256 - RNA, 95 nt, Human Herpes Virus 1
ugggggccaggcuuccgggccccaacgagcccuccgccccaacaagguccacagggccgggggucggguuugggaccgaggggcucuggucgucg

SEQ ID NO: 257 - RNA, 87 nt, Human Herpes Virus 1
ggugcgguaucugcagggcggcgggucguggcgggaggauuggggacagcuuucgggggcggccgugccgccccagggugccgagcc

SEQ ID NO: 258 - RNA, 96 nt, Human Herpes Virus 1
ucugggccucggccgcccgccuggcgcgccgcggcucgugggcccgcgagcgggccgaccgggcucgguuccggcgccggguggcggaggccgagg

SEQ ID NO: 259 - RNA, 96 nt, Human Herpes Virus 1; identical to SEQ ID NO: 258

SEQ ID NO: 260 - RNA, 72 nt, Human Herpes Virus 1
gccgccgucugccugcagaucgaggagacggccagcucggugaaguucgcggucugcgggggcgaugggggu

SEQ ID NO: 261 - RNA, 62 nt, Human Herpes Virus 1
gguguacgagcaacccggggagguucucggccaagagcgccgucuccggaagcccgugggcc

SEQ ID NO: 262 - RNA, 56 nt, Human Herpes Virus 1
cucgcgcagccacgcgcgcaggcggggcgcgucggcgugcggcggcggcggggaag

SEQ ID NO: 263 - RNA, 84 nt, Human Herpes Virus 1
ccggccgcguggccgucgagugccuggccgccugccgcgggauccuggaggcgcuggccgagggcuucgacggcgaccuggcgg

SEQ ID NO: 264 - RNA, 88 nt, Human Herpes Virus 1
gagggccgaauccucggggucuuccggggcgaguucuggcugcguggcguugggggucucggacagcuccgggggcagcagggugcuc

SEQ ID NO: 265 - RNA, 73 nt, Human Herpes Virus 1
gcggcuuugcgguaccagggguaaggguuagaacgucguucaggauguccucgcccccgggcccguggggcgc

SEQ ID NO: 266 - RNA, 70 nt, Human Herpes Virus 1
acgggcgggcggucgggcgauugauauauuuuucaauaaaaggcauuagucccgaagaccgccggugugu

SEQ ID NO: 267 - RNA, 63 nt, Human Herpes Virus 1
caugacgcccggcucgcgugggugggggacagcguagaccaacgacgagaccgggcgggaaug

SEQ ID NO: 268 - RNA, 67 nt, Human Herpes Virus 1
cgcgcuccugaccgcggguuccgaguugggcguggagguuaccugggacugugcgguugggacggcg

SEQ ID NO: 269 - RNA, 67 nt, Human Herpes Virus 1; identical to SEQ ID NO: 268

SEQ ID NO: 270 - RNA, 97 nt, Human Herpes Virus 1
ggcgcaacggucggggggcgggcggaaaggcgagagcgaaugcuaaacuaaacgcuaacccagcucccgccguugcguucacgccaaccgccgggcc

SEQ ID NO: 271 - RNA, 87 nt, Human Herpes Virus 1
acggcgggggcgggggcccggugcggcccgggggggaaaauagggcggaucccccccagucguacaggggauuuuccgccucaaugu

SEQ ID NO: 272 - RNA, 56 nt, Human Herpes Virus 1
cggggauccggguggccgggggcggggacuagguccccggcgugcgcggcaaaccg

SEQ ID NO: 273 - RNA, 55 nt, Human Herpes Virus 1
gcgucuggccccgcuggaucagaucccgcaacaggauggccguggggcuggucgc

SEQ ID NO: 274 - RNA, 71 nt, Human Herpes Virus 1
accugccagaugacguggcaucgcgacuccgugacguucucgcgacgcaaugccaccgggcuggcccuggu

SEQ ID NO: 275 - RNA, 55 nt, Human Herpes Virus 1
acguggguacucgcgucccgggggacgucccccggggccgccgggagcaccccgu

SEQ ID NO: 276 - RNA, 70 nt, Human Herpes Virus 1
cguucggcgcggcgccgggcgcgccgagcggcucgcugggcggcuuggcgugagcggccccgcuccgacg

SEQ ID NO: 277 - RNA, 74 nt, Human Herpes Virus 1
gugucgguguuguugucugggucaccauacacagagagacaggcucgggugucccggaccgucgcaccaaccac

SEQ ID NO: 278 - RNA, 85 nt, Human Herpes Virus 1
ucguccgcguaucggcgucccggcgcggcgagcgucugacggucugucucuggcggucccgcgucgggucguggauccgugucgg

SEQ ID NO: 279 - RNA, 77 nt, Human Herpes Virus 1
uuguccugaugggccgccacggccccgucgaucgugggggccucgaacccggggugguggcgcgccagucguucuag

SEQ ID NO: 280 - RNA, 77 nt, Human Herpes Virus 1
gguucgguucggcccgaguggaccacguuaaaggggaaaccaucuccuucucguuuccggacgggucgcgcaguacc

SEQ ID NO: 281 - RNA, 59 nt, Human Herpes Virus 1
gguuguccaggaugaaccgggugguggcgucgaccccacccucguacuucuugauggcc

SEQ ID NO: 282 - RNA, 56 nt, Human Herpes Virus 1
guaucggcggcucauggccacggcggccgccgcgugcgccaggccccagccgaagc

SEQ ID NO: 283 - RNA, 65 nt, Human Herpes Virus 1
ccagcggccggccggcgcuuagggggaggaugucgccgacgccccuuggccgccccggcugcagg

SEQ ID NO: 284 - RNA, 65 nt, Human Herpes Virus 1; identical to SEQ ID NO: 283

SEQ ID NO: 285 - RNA, 90 nt, Human Herpes Virus 1
gcagcgaggccaccgaggagcucccguuuguggcgggcggcgaggacguccucgccgccagcgccaccgacgaggaccccuuccucgcgc

SEQ ID NO: 286 - RNA, 91 nt, Human Herpes Virus 1
gcacgcgcuucggcccggacacgccggugcccauguccccgcgcgaguaccgccgggccgugcugccggcgcuggacggccgggcggcggc

SEQ ID NO: 287 - RNA, 91 nt, Human Herpes Virus 1; identical to SEQ ID NO: 286

SEQ ID NO: 288 - RNA, 92 nt, Human Herpes Virus 1
ggaggcggguaugguggaccgcggacucggucggcaccuauggcgccugacgcgccgcgggcccccggccgccgcggacgccguggcgcccc

SEQ ID NO: 289 - RNA, 61 nt, Human Herpes Virus 1
ggagguccugacgaacaucaccgccccacccgggggacuccugguguacgacagcgccccc

SEQ ID NO: 290 - RNA, 78 nt, Human Herpes Virus 1
ggaccguauacguggacaggcucuggagcauccgcacgacugcggugauauuaccggagaccuucugcgggacgagcc

SEQ ID NO: 291 - RNA, 95 nt, Human Herpes Virus 1
gcagacagcagcagggcggcccccaucaccgccccuaaccgcagggcgccguggguugggggcgcguggggaggggccccgacgugcgggugggu

SEQ ID NO: 292 - RNA, 64 nt, Human Herpes Virus 1
ggauagcuuccggagucuccauacgcacggucaccccacgcacaugugagacuucgggggcgcu

SEQ ID NO: 293 - RNA, 90 nt, Human Herpes Virus 1
gaaugucuggccgaguacugcaccucgcugcgaaccagcccgggugugcuaauauccgggcugcgcgugcgggcgcaggacagaaucauc

SEQ ID NO: 294 - RNA, 55 nt, Human Herpes Virus 1
agcguucgcacuucgucccaauauauauauauuauuagggcgaagugcgagcacu

SEQ ID NO: 295 - RNA, 67 nt, Human Herpes Virus 1
ggccgcggcgggcccaccgauccaccaguagcgcgcgcugccuccgaucgucagcccgccgacgacc

SEQ ID NO: 296 - RNA, 70 nt, Human Herpes Virus 1
cgcggccuuuguuccugcgcccggcgcgucgcccuaccccgacgacggcgggcugucgccagaggccacg

SEQ ID NO: 297 - RNA, 55 nt, Human Herpes Virus 1
cccgguggcauugcgucgcgagaacgucacggagucgcgaugccacgucaucugg

SEQ ID NO: 298 - RNA, 65 nt, Human Herpes Virus 1
uccuccauccggucucccggggcaucggcugccaugcgcgcacccacagagacuuugguggacga

SEQ ID NO: 299 - RNA, 63 nt, Human Herpes Virus 1
cgcggcguccggguggcggucgagggaaauagcagccaggacucggccgucgccaucgccacg

SEQ ID NO: 300 - RNA, 58 nt, Human Herpes Virus 1
cccgucagcgccgcguucucgcgcgccaacaggggcgcguaggcgcggcgcaggcugg

SEQ ID NO: 301 - RNA, 58 nt, Human Herpes Virus 1; identical to SEQ ID NO: 300

SEQ ID NO: 302 - RNA, 67 nt, Human Herpes Virus 1
gccgcaccgucccccgacgaccucuugcagacgguccgugaugcaaggacggcggggggccugcagc

SEQ ID NO: 303 - RNA, 55 nt, Human Herpes Virus 1
cgcaacggcgggagcuggguuagcguuuaguuuagcauucgcucucgccuuuccg

SEQ ID NO: 304 - RNA, 56 nt, Human Herpes Virus 1
gccccccccuccaaccggggccgggauacgcgaagauccuugguuggagggggcgc

SEQ ID NO: 305 - RNA, 56 nt, Human Herpes Virus 1
aucgggcggcgccucggcacuaucgucaccuacgacaccggucucgacgccgccau

SEQ ID NO: 306 - RNA, 56 nt, Human Herpes Virus 1
cggcggcccgugauaaccacauccgugcgcggguugugggcgucaaguggcuggcg

SEQ ID NO: 307 - RNA, 72 nt, Human Herpes Virus 1
gggugguagaguuugacaggcaagcaugugcgugcagaggcgaguagugcuugccugucuaacucgcuaguc

SEQ ID NO: 308 - RNA, 72 nt, Human Herpes Virus 1; identical to SEQ ID NO: 307

SEQ ID NO: 309 - RNA, 93 nt, Human Herpes Virus 1
ugggcaccggcguguccgggccgaagcgcgugcgcacgcgguagcgcacguugccgccgcggcacaggcgcagcggcggcgcgucgggguaca

SEQ ID NO: 310 - RNA, 93 nt, Human Herpes Virus 1; identical to SEQ ID NO: 309

SEQ ID NO: 311 - RNA, 79 nt, Human Herpes Virus 1
ccgcccccggggcgggugcuguacggcggccugggcgacagccgcccgggccucuggggggcgcccgaggcggaggagg

SEQ ID NO: 312 - RNA, 77 nt, Human Herpes Virus 1
ucggcugcgucgucguacucguccccgucaucgucgucggcucgaaaggcggggguccggggcggcgaggccgcggg

SEQ ID NO: 313 - RNA, 58 nt, Human Herpes Virus 1
gcgcccccgaagucucacaugugcguggggugaccgugcguauggagacuccggaagc

SEQ ID NO: 314 - RNA, 67 nt, Human Herpes Virus 1
cgggccgccgcccaccccgagcccagaccgcgacgagcggggggcccucggguggggcgcggagacg

SEQ ID NO: 315 - RNA, 68 nt, Human Herpes Virus 1
ugucgccgcgcccgccggcccagccgccgcggagacgucgucacggccgguggcggccaucggcguca

SEQ ID NO: 316 - RNA, 57 nt, Human Herpes Virus 1
gcuggcggcggcggccagcgcaccggacgccgccgacgcgcuggcggccgccgccgc

SEQ ID NO: 317 - RNA, 57 nt, Human Herpes Virus 1; identical to SEQ ID NO: 316

SEQ ID NO: 318 - RNA, 69 nt, Human Herpes Virus 1
ugucucgccaggggcuggccguuacgcugaguauggauugguuacugaugaacgagcuccugcggguca

SEQ ID NO: 319 - RNA, 93 nt, Human Herpes Virus 1
ccucaucaucaucguccaggcgaccgcgcaccgacuggcuacgggccgcaucgggcccggggcgcugccgggacgcucggcgaugggaugugg

SEQ ID NO: 320 - RNA, 92 nt, Human Herpes Virus 1
guuaccgaacucgugcucgacgcaccguuuguuguuaauaaaaauggcccagcuauacgagaggcgggcguacucgcgcagcgugcgguugc

SEQ ID NO: 321 - RNA, 71 nt, Human Herpes Virus 1
gguagauguacguaaugaauucacggucggacacgcgcaggcaacugcgaucguggguuaugaacuucucc

SEQ ID NO: 322 - RNA, 55 nt, Human Herpes Virus 1
gcucggucugccggccuggcggggcgcgcuggugggccaggugaggcaggucggc

SEQ ID NO: 323 - RNA, 93 nt, Human Herpes Virus 1
guucaggcugucgguggcccagacgccguacccggugagggucgcguugaugauauacugggcguggugauggacgaucgacagaaccuccac

SEQ ID NO: 324 - RNA, 85 nt, Human Herpes Virus 1
cuucuuccucgugcccgggacccacguggcggccaacccacagguggaccgcgagggacacguggugcccggguucgagggucgg

SEQ ID NO: 325 - RNA, 56 nt, Human Herpes Virus 1
gcuggcggcgagauugaugcccaucgcuacggggguauacagacggagccguuggu

SEQ ID NO: 326 - RNA, 74 nt, Human Herpes Virus 1
ggugaccacgaugucgcgaucccccccgcguuccaucguggagugcgguggggugcccgcgaucauaugugccc

SEQ ID NO: 327 - RNA, 90 nt, Human Herpes Virus 1
gaugauucuguccugcgcccgcacgcgcagcccggauauuagcacacccgggcugguucgcagcgaggugcaguacucggccagacauuc

SEQ ID NO: 328 - RNA, 65 nt, Human Herpes Virus 1
gacccugacggagguccugggucgguacaacguacagccggaugcgggggggaccgucgaggggu

SEQ ID NO: 329 - RNA, 97 nt, Human Herpes Virus 1
gagugccggcgagacuuucguccucgcccucgucauugucauccucgucguaaucggcuggggucggggguggggucggaacuggggccgguugcac

SEQ ID NO: 330 - RNA, 85 nt, Human Herpes Virus 1
gaccgaguucgccgggccggcuccgcgggccagggcccgggcacgggccucgggccccaggcacggcccgaugaccgccucggcc

SEQ ID NO: 331 - RNA, 85 nt, Human Herpes Virus 1; identical to SEQ ID NO: 330

SEQ ID NO: 332 - RNA, 70 nt, Human Herpes Virus 1
gauggcccccgagucggacccggaggccccacgggcgauggccuccgaagggacggcuccggggaucagc

SEQ ID NO: 333 - RNA, 75 nt, Human Herpes Virus 1
gaacgggggauggaaggacgggaaguggaaguccugauacccauccuacaccccccugccuuccacccuccggcc

SEQ ID NO: 334 - RNA, 75 nt, Human Herpes Virus 1; identical to SEQ ID NO: 333

SEQ ID NO: 335 - RNA, 64 nt, Human Herpes Virus 1
uacgccauggcggccggccgcuucggcuggggccuggcgcacgcggcggccgccguggccauga

SEQ ID NO: 336 - RNA, 58 nt, Human Herpes Virus 1
gacgcguucugcggcgcaggccucggucagggccguggccagcgccgaggacagcagc

SEQ ID NO: 337 - RNA, 55 nt, Human Herpes Virus 1
uacaggggccauguugggccgccacgcgcggcugguccacacccaguggcuccgg

SEQ ID NO: 338 - RNA, 64 nt, Human Herpes Virus 1
gagggugggucggcggaggggggauccgugggugggguacccuucagggccaccgcccauacau

SEQ ID NO: 339 - RNA, 57 nt, Human Herpes Virus 1
ucgaauccgaugcugucucggauucgaccucagacuccaaggcuguaucggauucua

SEQ ID NO: 340 - RNA, 58 nt, Human Herpes Virus 1
ucggcggaccacuccggcggcccccccgaggccccgccgccggccagguccucgcccg

SEQ ID NO: 341 - RNA, 89 nt, Human Herpes Virus 1
gccguccccccagcgugcaggcugcggccgcgugguccgcgcagggcggggcgggccuggaggccggggcccgcgcgcugauggacgcc

SEQ ID NO: 342 - RNA, 56 nt, Human Herpes Virus 1
gcagauguacauguccgugggggcggcugacaaguccgcggaugugcucgucuccc

SEQ ID NO: 343 - RNA, 56 nt, Human Herpes Virus 1
acggagcuggcccgcgccguuguguuuuuaaacaccaccugcgggaucagccaccu

SEQ ID NO: 344 - RNA, 78 nt, Human Herpes Virus 1
cguguaaugccaagcucuguucgcgcuccagaaucucggccaccaggugcuggagccgagccucuagcugcaggcggg

SEQ ID NO: 345 - RNA, 75 nt, Human Herpes Virus 1
ggccggaggguggaaggcagggggguguaggauggguaucaggacuuccacuucccguccuuccaucccccguuc

SEQ ID NO: 346 - RNA, 75 nt, Human Herpes Virus 1; identical to SEQ ID NO: 345

SEQ ID NO: 347 - RNA, 56 nt, Human Herpes Virus 1
cgcauguuggugguggacgcgguguuggcgcccgcgucgggcgccgccgagcagag

SEQ ID NO: 348 - RNA, 56 nt, Human Herpes Virus 1
cgggcaugaaaacgaccuccacacggaccaccggaugggggugugcguucgaugcg

SEQ ID NO: 349 - RNA, 73 nt, Human Herpes Virus 1
gggcgcucgugggggaguuugagacggccgagcgccgcuuuaguuccggucaacccagccuucuccgcgagac

SEQ ID NO: 350 - RNA, 92 nt, Human Herpes Virus 1
aucccuggggucacgcgguacccuggggucucugggagcucgcgguacucuggguucccuagguucucgggguggucgcggaacccggggcu

SEQ ID NO: 351 - RNA, 95 nt, Human Herpes Virus 1
gucgggggcgccgguccaauugcccgcccaggcggccguguccggcccgcacagccgguuggccagggccgccagcaggcaggacagcccgccgc

SEQ ID NO: 352 - RNA, 57 nt, Human Herpes Virus 1
guccccggggaccacgcgcggguucuggagccaccccauggccuccgcguccggggu

SEQ ID NO: 353 - RNA, 89 nt, Human Herpes Virus 1
gugaugucggcgcggcucagcuggugggaguacgcguacuccucgaaguacacguagcccccaccgaaggugaaguagcgccggugucc

SEQ ID NO: 354 - RNA, 56 nt, Human Herpes Virus 1
uuccgacgcgcgccgucgucgggcucgcgggccuucccgucgacggcgcacgggcg

SEQ ID NO: 355 - RNA, 59 nt, Human Herpes Virus 1
guacggggcggcccgugcggguugcuuaaaugcgugguggcgaccacgggcugucauuc

SEQ ID NO: 356 - RNA, 57 nt, Human Herpes Virus 1
uuggagccagcccgcccucacagggcgggccgccucgggggcgggacuggccaaucg

SEQ ID NO: 357 - RNA, 57 nt, Human Herpes Virus 1; identical to SEQ ID NO: 356

SEQ ID NO: 358 - RNA, 71 nt, Human Herpes Virus 2
ggcgcgcucucgaccgcgguucccgagucguacgcagggaccauuugggagucugcgguugggagcgcgcc

SEQ ID NO: 359 - RNA, 72 nt, Human Herpes Virus 2
uccgucaggcccgccgccgcguggcccccgacaaacaccuggggccacagcggcaggaccgggccugacgga

SEQ ID NO: 360 - RNA, 70 nt, Human Herpes Virus 2
gggacccuggguucucugggagaucguggaacucgcgguucccugggcucucggggaacccggggcuccc

SEQ ID NO: 361 - RNA, 70 nt, Human Herpes Virus 2
ggagaggccguggagcuugccagcgagacgcucaugaaacgcgaguugacgagcuucgcgguacuacucc

SEQ ID NO: 362 - RNA, 72 nt, Human Herpes Virus 2
guccugccugcuggcggcccugggcaaccggcucugcgggcccgccacggccgccugggcgggcaacuggac

SEQ ID NO: 363 - RNA, 55 nt, Human Herpes Virus 2
gccccggcgggcgcguucccgcugcucggccgagggcgcgcccgccaggaacggc

SEQ ID NO: 364 - RNA, 59 nt, Human Herpes Virus 2
gggcggccgccgaggugcgggggccccuccggccggggcgcaccucggcggccaagccc

SEQ ID NO: 365 - RNA, 68 nt, Human Herpes Virus 2
ggucucguacaucgugaccuaccucgggggcgaccuccccgaggagugcauggccguguaucgggacc

SEQ ID NO: 366 - RNA, 71 nt, Human Herpes Virus 2
gcggucgggguggggggagagugucguggguguguuuucgugucccccaccaccacucccaccccgaccgc

SEQ ID NO: 367 - RNA, 59 nt, Human Herpes Virus 2
gagggcggccucggccggcggagccccggagcuccgaaggucugcgcgaggccgcucuc

SEQ ID NO: 368 - RNA, 55 nt, Human Herpes Virus 2
gcgucggggaggaggcggggaccucggcggcgacgggggccuucuucuugggcgc

SEQ ID NO: 369 - RNA, 71 nt, Human Herpes Virus 2
gcggucggggugggagugguggugggggacacgaaaacacacccacgacacucuccccccaccccgaccgc

SEQ ID NO: 370 - RNA, 92 nt, Human Herpes Virus 2
gcgcgucggggcgggagaguucacucggcacgcaugcacguguaaccgccaguccgugcuugccuagcgaacucacccgucccggcuggcgu

SEQ ID NO: 371 - RNA, 69 nt, Human Herpes Virus 2
gccggcgucccggucgccgccgcaccaggggcacaccggcugcgcggcggagaccgggacggcagcggc

SEQ ID NO: 372 - RNA, 76 nt, Human Herpes Virus 2
gcuccgucaggcccgguccugccgcuguggccccagguguuugucgggggccacgcggcggcgggccugacggagc

SEQ ID NO: 373 - RNA, 61 nt, Human Herpes Virus 2
cccguggucucgggagcagggcgcgcccgcgccggccggcgacgcccccgcgggccacggg

SEQ ID NO: 374 - RNA, 70 nt, Human Herpes Virus 2
ggccgugcgggcgcauggcgcccuggcggacgcggugucggcccugggcgcggccgcccgcgacccggcc

SEQ ID NO: 375 - RNA, 71 nt, Human Herpes Virus 2
ggucggccugcggccccgcggacacccgcagcgggucacggcgcgggugcugcugccgcgcggcuacgacu

SEQ ID NO: 376 - RNA, 63 nt, Human Herpes Virus 2
cgccucggggcggugcugggggcggcccuguugcuggccgcccucgggcuguccgcgugggcg

SEQ ID NO: 377 - RNA, 63 nt, Human Herpes Virus 2
cgcccgcggcccgcgccggcgccgucggggcguaccuggcgcgcgccgcgggccucgugggcg

SEQ ID NO: 378 - RNA, 67 nt, Human Herpes Virus 2
cgucgguucgucgggcgcgggaacguacaggccguggcgcuggauguaccgaccgacgagccgcacg

SEQ ID NO: 379 - RNA, 56 nt, Human Herpes Virus 2
agcguucgcacuucguccuaauaguauauauauuauuagggcaaagugcgagcgcu

SEQ ID NO: 380 - RNA, 76 nt, Human Herpes Virus 2
cgcugcggcccgucuacguggcgcuggggcgcgacgccgugcgcggcggcccggcggagcugcgcgggccgcggcg

SEQ ID NO: 381 - RNA, 61 nt, Human Herpes Virus 2
gggggcuugcacccgcggcugauggcccgaagugccucccgguccauggugucgagcucuu

SEQ ID NO: 382 - RNA, 57 nt, Human Herpes Virus 2
gggccuggcgauccugggccugugggucugcgccaccggccuggucguccgcggccc

SEQ ID NO: 383 - RNA, 64 nt, Human Herpes Virus 2
guggucggcguggggaccggcuguguggugggugggggaggcacguuggacuacgaccgaccac

SEQ ID NO: 384 - RNA, 80 nt, Human Herpes Virus 2
gggcggucggcguuccgguugucauccuggagggcgugguguggcgcgcggcgggguggcgggccugcgcgugaucgucu

SEQ ID NO: 385 - RNA, 67 nt, Human Herpes Virus 2
cucgucggcggccccgcggagguuguacaaaaagcucgugcuggccuucccgguguuggucgacgag

SEQ ID NO: 386 - RNA, 83 nt, Human Herpes Virus 2
gggacccgcaccgcggggcuuggagcgaccgaggccccccccgggccuacgagggcacaagccccggagguugcgucgguccc

SEQ ID NO: 387 - RNA, 68 nt, Human Herpes Virus 2
ggaggauggaagggcagaagauggggagucccgauccuccuccugcauccccucgccuuccauucucc

SEQ ID NO: 388 - RNA, 66 nt, Human Herpes Virus 2
acgcgggcgaccgcggcgccccagaagaagaaggccucgagggccaggcccggguaccgcccgcgu

SEQ ID NO: 389 - RNA, 72 nt, Human Herpes Virus 2
uagggcgacggugcgcugguuuucggggauaaagcgggguagcaucccgaugcugucgaccgucacgcccug

SEQ ID NO: 390 - RNA, 58 nt, Human Herpes Virus 2
cguguguggcgauggccacggccgaguccuggcugcuguugcccucgaccgccacgcg

SEQ ID NO: 391 - RNA, 82 nt, Human Herpes Virus 2
gucggggcgggagaguucacucggcacgcaugcacguguaaccgccaguccgugcuugccuagcgaacucacccgucccggc

SEQ ID NO: 392 - RNA, 70 nt, Human Herpes Virus 2
cgcggcgcugcagcggugcgagggucgaguggucuuucugccgaccauccgccgccagcuggcgcucgcg

SEQ ID NO: 393 - RNA, 66 nt, Human Herpes Virus 2
auguggccgccacggcgguccggcucgcggcgcgcgaugccgcccuggcccgcgagguggccgcgu

SEQ ID NO: 394 - RNA, 56 nt, Human Herpes Virus 2
cguccucgccgacccgggguucgucccuuacgugcuggcccugguggucggggacg

SEQ ID NO: 395 - RNA, 90 nt, Human Herpes Virus 2
gcccgcccgcgacgagggucucauuagcaucgcgggcggaagcggaagccgcccgcgccgggcgcuaaugagaugccgcgcgggcggagc

SEQ ID NO: 396 - RNA, 59 nt, Human Herpes Virus 2
ggucccagcgccacugcgucgccuucaacgagaacgacgugcuggucgcgcugguggcc

SEQ ID NO: 397 - RNA, 71 nt, Human Herpes Virus 2
cggcgggcgcuccgcggccguccuccaggcggaacgucacgcccuccuccgcgcccgcgcggugccugccg

SEQ ID NO: 398 - RNA, 73 nt, Human Herpes Virus 2
agccccccccgcgcauggcgggccuacgggggcgcgucgcucccgccgcccgcuagucugggggcgaggugcu

SEQ ID NO: 399 - RNA, 69 nt, Human Herpes Virus 2
ggccucggggcccgcggcccgaagcaggcucacgaaccggcccccguccccgggcugcgccucgggguc

SEQ ID NO: 400 - RNA, 92 nt, Human Herpes Virus 2
gccagccgggggggcccccgggccgcgggcgaggacguccucaacgacgugcucacccucgugccggggaccgccaagccgcgaucgcuggu

SEQ ID NO: 401 - RNA, 74 nt, Human Herpes Virus 2
cguugguggugucggacagcuccggcggcagcagggugcugguguacgggggcuuggggccgugccacccggcg

SEQ ID NO: 402 - RNA, 59 nt, Human Herpes Virus 2
ggcagggcguuucguuggucuaggaggguaaccacacuuacaacaacaacgcccauguc

SEQ ID NO: 403 - RNA, 62 nt, Human Herpes Virus 2
guugccggugauggcccggaggguggccugguuagugguggccuggggguuuaccagguagc

SEQ ID NO: 404 - RNA, 96 nt, Human Herpes Virus 2
gccagccgggacgggugaguucgcuaggcaagcacggacuggcgguuacacgugcaugcgugccgagugaacucucccgccccgacgcgcuccggc

SEQ ID NO: 405 - RNA, 88 nt, Human Herpes Virus 2
cccgcccgcgacgagggucucauuagcaucgcgggcggaagcggaagccgcccgcgccgggcgcuaaugagaugccgcgcgggcggag

SEQ ID NO: 406 - RNA, 64 nt, Human Herpes Virus 2
gagcgcccccaggcggccggcgugccgcgccagggggccggggccgucgccgcgggcggcgcuu

SEQ ID NO: 407 - RNA, 70 nt, Human Herpes Virus 2
gccagguccucgcccggcagcggcgaguagaggaucaccacgcgcacguccuccgggucgggcaccuggc

SEQ ID NO: 408 - RNA, 70 nt, Human Herpes Virus 2; identical to SEQ ID NO: 407

SEQ ID NO: 409 - RNA, 92 nt, Human Herpes Virus 2
guuccuggcgcgcuggcggcgccucucggccggcuaucaggccgcacgcgcggccacgggccccgagcggguggccgaguucguucaggaac

SEQ ID NO: 410 - RNA, 97 nt, Human Herpes Virus 2
ggcagggcgccagugcucgcacuuugcccuaauaauauauauacuauuaggacgaagugcgaacgcuucgcguucucacuucuuuuacccugcggcc

SEQ ID NO: 411 - RNA, 67 nt, Human Herpes Virus 2
cggcccuguaccgguaccugcgcgccagcguucggcagcuacaccgccaggcacacaugcggggccg

SEQ ID NO: 412 - RNA, 62 nt, Human Herpes Virus 2
gcugcagcagcgcgaggagccguugcugggccccggcggagggcggcuccccuagcugcagc

SEQ ID NO: 413 - RNA, 56 nt, Human Herpes Virus 2
cgucccggucgccgccgcaccaggggcacaccggcugcgcggcggagaccgggacg

SEQ ID NO: 414 - RNA, 80 nt, Human Herpes Virus 2
ggcgaauggcggacagcauggccaggucaagccgcucgcccgggcguuggcgucuggccaggcggucggcguguucggcc

SEQ ID NO: 415 - RNA, 68 nt, Human Herpes Virus 2
ggugggcgggguccaggcaaggcagggccugggccacagaccacugcuuggccucgagcccguccauc

SEQ ID NO: 416 - RNA, 55 nt, Human Herpes Virus 2
gccggcccgggcgccagcccgcggcuguacucggucgucgggccgcugggucggc

SEQ ID NO: 417 - RNA, 55 nt, Human Herpes Virus 2
gcgggcgagggcgucuaaggccucgcgcaucucgcgggccuccgccucgacccgc

SEQ ID NO: 418 - RNA, 55 nt, Human Herpes Virus 2
gucgccgccgguccaggcggucccaggaugacuacggggcgguggugguggcggc

SEQ ID NO: 419 - RNA, 70 nt, Human Herpes Virus 2
gcgcgccuccucgcggaguaugaccgucggugccagaccgaagaggugcugccgccgcgggaggaugugu

SEQ ID NO: 420 - RNA, 66 nt, Human Herpes Virus 2
ccucggccgguggcgacgacggcgacggggacugguuccccgacgccgguggucccggcgacgagg

SEQ ID NO: 421 - RNA, 59 nt, Human Herpes Virus 2
ggcggggggaaggcgccggaggccccgcacgccgcgccugccgccgccugccccccgcc

SEQ ID NO: 422 - RNA, 56 nt, Human Herpes Virus 2
ucgggccugaucgcguucugggcaugggcgccccagagcauaaagaccaggcccgg

SEQ ID NO: 423 - RNA, 71 nt, Human Herpes Virus 2
gcgcgcgcgcgccucccccgcggcgucgcgacagaccagauacagcagggcguggaggcagucgcgcgugc

SEQ ID NO: 424 - RNA, 59 nt, Human Herpes Virus 2
ggcggggggcaggcggcggcaggcgcggcgugcggggccuccggcgccuuccccccgcc

SEQ ID NO: 425 - RNA, 55 nt, Human Herpes Virus 2
cgccgcccucuuggcccccacccccuggggggcgaggggcgagcgcggggcggcg

SEQ ID NO: 426 - RNA, 58 nt, Human Herpes Virus 2
ggugggcuuccggcggccgccggagaccacgggauccgggggucggcgaagcgccgcc

SEQ ID NO: 427 - RNA, 86 nt, Human Herpes Virus 2
ccuggcccucaagcaggggccacguggugaugucggggggcggcucgucaaagaccgccaucgacacgauggacuccagggccagg

SEQ ID NO: 428 - RNA, 59 nt, Human Herpes Virus 2
gagggggagcgcgacgggucccuguggcaggacccuccggagagacccgacucucccuc

SEQ ID NO: 429 - RNA, 83 nt, Human Herpes Virus 2
gccggcgucgaggcggcgcuggaccgcgucgagaaccgcgccgaguucgacguggucgagcugcgccgccugcaggcgcuggc

SEQ ID NO: 430 - RNA, 64 nt, Human Herpes Virus 2
gcgacgugggugauguccggggcccguaaaaacagguucgagaggggcgucguugucauguugc

SEQ ID NO: 431 - RNA, 66 nt, Human Herpes Virus 2
gcggacggcgucgucucgccgcggcagcuggcccugcuggccucgaugguggacgaggccguucgc

SEQ ID NO: 432 - RNA, 66 nt, Human Herpes Virus 2; identical to SEQ ID NO: 431

SEQ ID NO: 433 - RNA, 56 nt, Human Herpes Virus 2
gggcggugggucguggguguugagagcacacaggcgggacaccucgaucaccgucc

SEQ ID NO: 434 - RNA, 66 nt, Human Herpes Virus 2
cugggcguggacggccgcgguggucucaggcucuucgagggcguaguggcaguagaacacguccag

SEQ ID NO: 435 - RNA, 67 nt, Human Herpes Virus 2
gccgcuggagccuugcgcccaaaccuugcccaaccccgggcccccccguccggcgcgauccgguggc

SEQ ID NO: 436 - RNA, 59 nt, Human Herpes Virus 2
uccggcggcguugaucguggggaugacgcccguggcguaguggucguaaagccgccgga

SEQ ID NO: 437 - RNA, 95 nt, Human Herpes Virus 2
gcguggcgcgucuuccuggcacacuuccucggcccccgcggcgcagcagcgcgggggccgagggagguuucucgucucuccccagcgccggacgc

SEQ ID NO: 438 - RNA, 59 nt, Human Herpes Virus 2
guggccagcugccggggcagcgugugcugccugagaaacgcccccaggcgcugcgucgc

SEQ ID NO: 439 - RNA, 76 nt, Human Herpes Virus 2
gacggcggacccgcggaggaggaggaggcggcggcggcggcgcgcggguccuccgccgccgcgggcccgggccguc

SEQ ID NO: 440 - RNA, 58 nt, Human Herpes Virus 2
ucgccuuuacauaccccgcggcgcuaucggccagcaccgcgaggaaggacaggggcga

SEQ ID NO: 441 - RNA, 88 nt, Human Herpes Virus 2
ccucggggagcucgggcaggcucgcguuccgaggccggccgagcagauaggucuuugggauguaaagcagcugcccggggucccgagg

SEQ ID NO: 442 - RNA, 64 nt, Human Herpes Virus 2
gggaggggagaggagaagggcgcgccggugcgcggagcagccuuccuucuccggagucccucuc

SEQ ID NO: 443 - RNA, 68 nt, Human Herpes Virus 2
ggcgacgcccagcgaaccggacuccgucguguguuccugcgccgacaagaucgggcugcgcgugugcc

SEQ ID NO: 444 - RNA, 58 nt, Human Herpes Virus 2
gcccgcggcggcggaggacccgcgcgccgccgccgccgccuccuccuccuccgcgggu

SEQ ID NO: 445 - RNA, 55 nt, Human Herpes Virus 2
agcgggagcuccgggucggucaccgcaguucuggccgccucucgguccucccguu

SEQ ID NO: 446 - RNA, 66 nt, Human Herpes Virus 2
gacucgagguccggcuccuggaggcaaaacuggccccgggauaucguggaguuggaguucaggguc

SEQ ID NO: 447 - RNA, 93 nt, Human Herpes Virus 2
ccgcguccgcugguuucucugcguugcgucugaccacgagcacaaacgugcucugccacacgugggcggcgaaccgguagccggggcacgcgg

SEQ ID NO: 448 - RNA, 73 nt, Human Herpes Virus 2
cgccaggugcccgacccggaggacgugcgcguggugauccucuacucgccgcugccgggcgaggaccuggccg

SEQ ID NO: 449 - RNA, 56 nt, Human Herpes Virus 2
cggccgcggugauguugccggagaucuuuugcgggacgagccgggucacgcggcug

SEQ ID NO: 450 - RNA, 68 nt, Human Herpes Virus 2
uccuccgcggggguauaaaaggugcucgccgggaaggccggggccguguuugucuccggcgggacgga

SEQ ID NO: 451 - RNA, 59 nt, Human Herpes Virus 2
gggcgggggggaaggccgccaggucuucgagcaggaaggcggggucugccgucccgcuc

SEQ ID NO: 452 - RNA, 75 nt, Human Herpes Virus 2
gcugaugcgcucgaccgccgcgcgcucggauauggaucgcagaaccgcccgaacggcggggucgauggugucggc

SEQ ID NO: 453 - RNA, 65 nt, Human Herpes Virus 2
gcggccugggcgucgcugagggccagcuggagccgguucacgacggucagcacguacauggccgu

SEQ ID NO: 454 - RNA, 80 nt, Human Herpes Virus 2
gggggcggggacgcuugacggggccgacccccggcccgcuuaagcggucgggggacccccgugggccgugcgccgccccc

SEQ ID NO: 455 - RNA, 59 nt, Human Herpes Virus 2
gcggccgagggccccggcgcgguagcggggggcgaggcggugaggggggaaucggccgu

SEQ ID NO: 456 - RNA, 56 nt, Human Herpes Virus 2
gugccggggugcgaaugcggcccgaccgucacacggggcugccuuauacccggcgc

SEQ ID NO: 457 - RNA, 60 nt, Human Herpes Virus 2
ggcgcgcauggaggggguccgcggcggagaaggcgagcgggccgcuucuucuugcgcgcc

SEQ ID NO: 458 - RNA, 60 nt, Human Herpes Virus 2; identical to SEQ ID NO: 457

SEQ ID NO: 459 - RNA, 67 nt, Human Herpes Virus 2
gcgggucgucggcgacguggcccgggccuucguggugaggucgcgcgcguagaagccgucgaccugc

SEQ ID NO: 460 - RNA, 65 nt, Human Herpes Virus 2
gcggggggucuggggcucugaccugagugcagguuacgaaggucagguggcccgagcccccccgc

SEQ ID NO: 461 - RNA, 65 nt, Human Herpes Virus 2; identical to SEQ ID NO: 460

SEQ ID NO: 462 - RNA, 62 nt, Human Herpes Virus 2
gcugcagcuaggggagccgcccuccgccggggcccagcaacggcuccucgcgcugcugcagc

SEQ ID NO: 463 - RNA, 56 nt, Human Herpes Virus 2
caucggcaccgccaucccaccccgagcuguugggugggcgggugggggggcuggug

SEQ ID NO: 464 - RNA, 86 nt, Human Herpes Virus 2
augcgcgacugcgugcugcgccaggaaaaucucaucgaggcccuggcguccgcggaugagacgcuggcguggugcaagaugugcau

SEQ ID NO: 465 - RNA, 55 nt, Human Herpes Virus 2
cgcgccgaugaucaggcccggguugcugggggcggcgggggcguggugcggcgcg

SEQ ID NO: 466 - RNA, 60 nt, Human Herpes Virus 2
cuggcggcccggggggugcugcaggagcucgccgagcgcgccgacccccugguccgccag

SEQ ID NO: 467 - RNA, 55 nt, Human Herpes Virus 2
uggaucuccgcgcagacaucgccauacguccggugugugcaccgcgaagaaucca

SEQ ID NO: 468 - RNA, 61 nt, Human Herpes Virus 2
gcgcgcccgccggaagcgaccguggucgcggacgcggcggcggcgcccgagcccggcgcgc

SEQ ID NO: 469 - RNA, 95 nt, Human Herpes Virus 2
ucgugcucuccucgggguagccggccacccgccggagggcguccagcgccgagccguugucggcgggcgucggggcccccaggacaaagacgcga

SEQ ID NO: 470 - RNA, 56 nt, Human Herpes Virus 2
gguggucccggagaucgcccccggugaggagugcccgagcgaucccgugaccgacc

SEQ ID NO: 471 - RNA, 55 nt, Human Herpes Virus 2
gucgacgcggcccagcugcugcaucgucggcgaguacaguuggcccaacgucgac

SEQ ID NO: 472 - RNA, 85 nt, Human Herpes Virus 2
cgcgcgccccggucgcgcaugacccaggcucagaccgacacccaagcacagagucugggccgggcaggcgcgaccgacgcgcgcg

SEQ ID NO: 473 - RNA, 83 nt, Human Herpes Virus 2
ggucgcgccucgggaccaggcggucggcuuccccccgggaaccgcacggggggaagguggcccgcauccaacccccgucgacc

SEQ ID NO: 474 - RNA, 56 nt, Human Herpes Virus 2
uggaaggcgaggggaugcaggaggaggaucgggacuccccaucuucugcccuucca

SEQ ID NO: 475 - RNA, 56 nt, Human Herpes Virus 2; identical to SEQ ID NO: 474

SEQ ID NO: 476 - RNA, 85 nt, Human Herpes Virus 2
cgcgcgcgucggucgcgccugcccggcccagacucugugcuugggugucggucugagccugggucaugcgcgaccggggcgcgcg

SEQ ID NO: 477 - RNA, 70 nt, Human Herpes Virus 2
gccaggugcccgacccggaggacgugcgcguggugauccucuacucgccgcugccgggcgaggaccuggc

SEQ ID NO: 478 - RNA, 60 nt, Human Herpes Virus 2
guuugcugggaacucgcccgccguuggggauacgggggcgggggguguggucgggcggac

SEQ ID NO: 479 - RNA, 55 nt, Human Herpes Virus 2
gcguucuggggcuuccguugcgcgacacgcgcccggggcggguaggccagagcgu

SEQ ID NO: 480 - RNA, 64 nt, Human Herpes Virus 2
gcgcauggagcugcguacgcgucgaagcgccgaaugggcgcggugccgggugucgcgcaugcgc

SEQ ID NO: 481 - RNA, 61 nt, Human Herpes Virus 2
cccuggaggaggccgaggcggagugggacgaggucuggggucgcuuuggccgcguccgggg

SEQ ID NO: 482 - RNA, 74 nt, Human Herpes Virus 2
agggggagguagggaggggagaggagaagggcgcgccggugcgcggagcagccuuccuucuccggagucccucu

SEQ ID NO: 483 - RNA, 56 nt, Human Herpes Virus 2
ggcccgcgucaucccgcgggcuccgccccgaggcgggcccggacggggggcgggcc

SEQ ID NO: 484 - RNA, 56 nt, Human Herpes Virus 2; identical to SEQ ID NO: 483

SEQ ID NO: 485 - RNA, 68 nt, Human Herpes Virus 2
ccgggcuuccggcagcccggccuccccgaggcccgcgagggcggccaggagcugggccuggagcccgg

SEQ ID NO: 486 - RNA, 58 nt, Human Herpes Virus 2
ggcgugcugggaggggcggcgucgggccccgcccacgguccgccacgccccgcgcguc

SEQ ID NO: 487 - RNA, 69 nt, Human Herpes Virus 2
gccgcuuuugcgucgucuccgcggucgagucucccccgccccgauacgccccggaggacgccgagcggc

SEQ ID NO: 488 - RNA, 87 nt, Human Herpes Virus 2
guggugaagguggucgagauggcgucggaggagaagcggaaggagccgccguacucggcgcggagcaucucguccaccuccugccac

SEQ ID NO: 489 - RNA, 56 nt, Human Herpes Virus 2
aucgccacccgcacgauggcguccaccagaaaacccaucgcgcgggaggggcuggu

SEQ ID NO: 490 - RNA, 64 nt, Human Herpes Virus 2
ucgcacagcgcgucccccgucgucucgugcuuuaggucgcagggccggggcgcguaguccgcga

SEQ ID NO: 491 - RNA, 61 nt, Human Herpes Virus 2
accgucaugaccugggggccuggggggacuacagccuggggccccugggucagccgacggu

SEQ ID NO: 492 - RNA, 55 nt, Human Herpes Virus 2
ccggugaccuacggcgagauggucuugaacggggccaaccucgucacggcgcugg

SEQ ID NO: 493 - RNA, 92 nt, Human Herpes Virus 2
gcgcugaaacagcgcccugcggguccgcugcagcuguuguuguaugcggcggcaugcgcggaucaaaaccgccagggcgcuacgaccggugc

SEQ ID NO: 494 - RNA, 77 nt, Human Herpes Virus 2
ccagguacacgcacgccccgguggggcgcgugcucuguuuguugugcgccgccaccagggagucgaggaccuucagg

SEQ ID NO: 495 - RNA, 56 nt, Human Herpes Virus 2
aguaccagaccgaaaacaaggacggaucggcccgcuccguuuuucgguggggugcu

SEQ ID NO: 496 - RNA, 63 nt, Human Herpes Virus 2
ggcgccagggccacgacgcucgagacccccgcgaugggcagguagcgcgugaggccgggcgcc

SEQ ID NO: 497 - RNA, 63 nt, Human Herpes Virus 2; identical to SEQ ID NO: 496

SEQ ID NO: 498 - RNA, 55 nt, Human Herpes Virus 2
cggcgcagcucgaccacgucgaacucggcgcgguucucgacgcgguccagcgccg

SEQ ID NO: 499 - RNA, 88 nt, Human Herpes Virus 2
cgcgguauggcugcccccgcgcacgcgcgacugccuccacgcccugcuguaucuggucugucgcgacgccgcgggggaggcgcgcgcg

SEQ ID NO: 500 - RNA, 76 nt, Human Herpes Virus 2
ccgccgaugaccagcaccgccaggguacugccggccagcgcgccgaugaucaggcccggguugcugggggcggcgg

SEQ ID NO: 501 - RNA, 69 nt, Human Herpes Virus 2
ccgggccgugcuggagcgccuggugccggacgcgugcgacgccugccccgcgcuccggcagcugcucgg

SEQ ID NO: 502 - RNA, 88 nt, Human Herpes Virus 2
gcugcccgccucggagguggagucgcggugaaggucgucgucagagauucccaccucggucuccuccuccgagucgcugcuggcgagc

SEQ ID NO: 503 - RNA, 88 nt, Human Herpes Virus 2; identical to SEQ ID NO: 502

SEQ ID NO: 504 - RNA, 64 nt, Human Herpes Virus 2
gccccccggcggcggucaagguuuuuguuuuuguucggggacccgggugacuucgucugggggc

SEQ ID NO: 505 - RNA, 63 nt, Human Herpes Virus 2
ggcgcccggccucacgcgcuaccugcccaucgcgggggucucgagcgucguggcccuggcgcc

SEQ ID NO: 506 - RNA, 63 nt, Human Herpes Virus 2; identical to SEQ ID NO: 505

SEQ ID NO: 507 - RNA, 92 nt, Human Herpes Virus 2
gcccgucgggacugaacgucucaugggcggccgccaccagggcgcacagggccgcgccgcccaugaucacgcacaacccccaaaacacgggu

SEQ ID NO: 508 - RNA, 55 nt, Human Herpes Virus 2
gaccgacgcaaccuccggggcuugugcccucguaggcccggggggggccucgguc

SEQ ID NO: 509 - RNA, 61 nt, Human Herpes Virus 2
gggcggcagcagcgccgggucgcgcaucaggugauucagcucggccugagccugcccgccc

SEQ ID NO: 510 - RNA, 76 nt, Human Herpes Virus 2
gacggcccgggcccgcggcggcggaggacccgcgcgccgccgccgccgccuccuccuccuccgcggguccgccguc

SEQ ID NO: 511 - RNA, 69 nt, Human Herpes Virus 2
augggccccgaggacgccguucgcacgcggcggauccugugucgcgccgccgagcaggcccucgcccgu

SEQ ID NO: 512 - RNA, 64 nt, Human Herpes Virus 2
gcgcguggcgcccggggacguggcgcuggaccaggccugcuuccggaucucgggcgcggcgcgc

SEQ ID NO: 513 - RNA, 64 nt, Human Herpes Virus 2; identical to SEQ ID NO: 512

SEQ ID NO: 514 - RNA, 55 nt, Human Herpes Virus 2
gcgcgcguagaagccgucgaccugcuugaagcggucggcggcguagcuggugugc

SEQ ID NO: 515 - RNA, 58 nt, Human Herpes Virus 2
gguuccgggacguggcggccuuggaggucccgaccggccugccgcuccgggaguuucc

SEQ ID NO: 516 - RNA, 83 nt, Human Herpes Virus 2
gcacgggcggcucugugaggcggucggccugucgggcggcguccucagccagacgcuggcgcgcaucaugggcccggccgugc

SEQ ID NO: 517 - RNA, 60 nt, Human Herpes Virus 2
cgccgggagcgccgccgucgcgacggcaagucccgcggcgacgguggacgcggccgugcg

SEQ ID NO: 518 - RNA, 59 nt, Human Herpes Virus 2
ccgucggcugacccaggggccccaggcuguaguccccccaggcccccaggucaugacgg

SEQ ID NO: 519 - RNA, 59 nt, Human Herpes Virus 2
ggggccgcggacgaccaggccgguggcgcagacccacaggcccaggaucgccaggcccu

SEQ ID NO: 520 - RNA, 82 nt, Human Herpes Virus 2
cugggggccgcuaucuggugggcgguuggcgcgcgccuaugaaagggggcgagccaccgucccgcccgccagugcaucccag

SEQ ID NO: 521 - RNA, 75 nt, Human Herpes Virus 2
auccgugcguccgcccucccccgcgggcugaugacguggcgguuagucagugggaaggcagggggaaagaugggu

SEQ ID NO: 522 - RNA, 87 nt, Human Herpes Virus 2
acagcgggcggcggacgucaacgcccguaagcuuguauccgaucccgcggggcaagggggugugggugacgacguagcuggcguugu

SEQ ID NO: 523 - RNA, 57 nt, Human Herpes Virus 2
ugcgggucgaggcggaggcccgcgagaugcgcgaggccuuagacgcccucgcccgcg

SEQ ID NO: 524 - RNA, 57 nt, Human Herpes Virus 2
cggggguguuggugccgcgggggaccccggguccucccuccgcgcccggcccucccg

SEQ ID NO: 525 - RNA, 80 nt, Human Herpes Virus 2
gcgccgucucgcgcaggaggcugggcuggccggcgcugaagcggcgcucggccgucucaaacucccccacgagcgugcgc

SEQ ID NO: 526 - RNA, 56 nt, Human Herpes Virus 2
gaucgcugaccuggcgcaccucgcaggccaugcgcagcagcgccugguugcugauc

SEQ ID NO: 527 - RNA, 64 nt, Human Herpes Virus 2
gucuccucuuccugcuccuccuccuuucucccagccagggugaggaggggcgggcguggcgggc

SEQ ID NO: 528 - RNA, 74 nt, Human Herpes Virus 2
ccgccaugagcgcguaggucagcgcguucucccccgccgcgcucucgcgggcgugcugcaccacgggcuggcgg

SEQ ID NO: 529 - RNA, 63 nt, Human Herpes Virus 2
ggugggugcuucggggacuugacggucgccacucuccugcgagcccucacgucuucgcccacc

SEQ ID NO: 530 - RNA, 89 nt, Human Herpes Virus 2
gcuugauuugcgcgcuggucgugggggcgcugguggccgcgguggcgucggcggccccggcggccccggcggccccccgcgccucgggc

SEQ ID NO: 531 - RNA, 83 nt, Human Herpes Virus 2
ggagaauggaaggcgaggggaugcaggaggaggaucgggacuccccaucuucugcccuuccauccuccguuuuuccgcuuucc

SEQ ID NO: 532 - RNA, 67 nt, Human Herpes Virus 2
ucgccaucgggacagucccgcgcgaagccgcucccggaagcuggaucggcggcgggacccggggcgg

SEQ ID NO: 533 - RNA, 56 nt, Human Herpes Virus 2
gggcgacgggcacgcacguggagacggccaugacgucuccgagcaugcgcgcgcuc

SEQ ID NO: 534 - RNA, 95 nt, Human Herpes Virus 2
agggaaaggcagaacgaaaaggaaccgaugcgcccgcgucucuguauccgauccgauccgggugcgucggugccccgcucgccgccggcgucucu

SEQ ID NO: 535 - RNA, 86 nt, Human Herpes Virus 2
gggaaaacucuggcagcgcaggggcggggcgaucucguccgugcacacggcacacacgucgccccccccucccgcuuccgcuuccu

SEQ ID NO: 536 - RNA, 60 nt, Human Herpes Virus 2
ggcguacccgggauccuccgccagcucggacaccagcagcuugcggggcuuggacgcgcc

SEQ ID NO: 537 - RNA, 94 nt, Human Herpes Virus 2
gcgcaacaaagccagguacucuccgcuccacaacgaggacgaggccggagacgaagacgagcucuaagggaggggaggggagcugggcuugugu

SEQ ID NO: 538 - RNA, 56 nt, Human Herpes Virus 2
uggcgagccggggggagcguccgcggguccgugugggugcgucuuuggguccguug

SEQ ID NO: 539 - RNA, 65 nt, Human Herpes Virus 2
uccgcagagacgaggcgcgucgugucaccgggcccggaggcgcggccguuugugucgcaggcgga

SEQ ID NO: 540 - RNA, 61 nt, Human Herpes Virus 2
guccgagcuggcggaggaucccggguacgccaucgcccggggcguuccgcucaacacggac

SEQ ID NO: 541 - RNA, 67 nt, Human Herpes Virus 2
uggggauggcgugucuacucgagguccugcgucgccugggucgcgaguuggcgaggugcugccccca

SEQ ID NO: 542 - RNA, 71 nt, Human Herpes Virus 2
ggcggcggcggggggcaggcggcggcaggcgcggcgugcggggccuccggcgccuuccccccgcccucgcu

SEQ ID NO: 543 - RNA, 76 nt, Human Herpes Virus 2
gcggacgcggacgggguuucgccaccgccccccaggccagccgggggucccaagaacaccccagccgccccuccgc

SEQ ID NO: 544 - RNA, 56 nt, Human Herpes Virus 2; identical to SEQ ID NO: 152

SEQ ID NO: 545 - RNA, 59 nt, Human Herpes Virus 2
cgcccccgaccgcccuggccgcccagaugcgccagcacggccagggcguacgcggugug

SEQ ID NO: 546 - RNA, 75 nt, Human Herpes Virus 2
cgccucgacccgcaucucuucgccccgggcaaacugggccagcgccuggauccgauggagaagcggcuccgggug

SEQ ID NO: 547 - RNA, 64 nt, Human Herpes Virus 2
cggcgcagggccgcguggcuggcgucucggcucaucucgccgcccccgcgcgcgcccgacgucg

SEQ ID NO: 548 - RNA, 77 nt, Human Herpes Virus 2
ggcgccagggggcgccggucgggucgcggcgggcugggagguuccgcgggucgcccccgcaccgccgcccccgcgcc

SEQ ID NO: 549 - RNA, 89 nt, Human Herpes Virus 2
ggaagcaugaccccccaggccguguuggcguucguggcccucaugcccccgaccgcgcccggcacgaaccugguccuggguguccuucc

SEQ ID NO: 550 - RNA, 78 nt, Human Herpes Virus 2
ccggcccaccgugccacccgaacccgggccgcgcggcggggcgacgguccggguucggggugggcggcgguccgucgg

SEQ ID NO: 551 - RNA, 56 nt, Human Herpes Virus 2
cgggccccggccuccaggcccgcgccgcccugcggggcccaggcggccgccgccug

SEQ ID NO: 552 - RNA, 70 nt, Human Herpes Virus 2
cccccccccaucugcggacuggcagccgggacgacgaccaugggccccggucuguggguggugauggggg

SEQ ID NO: 553 - RNA, 61 nt, Human Herpes Virus 2
ggccccggggugccuccgcuugguucccggcgguuccgggaacgcgggcgguacccgggcc

SEQ ID NO: 554 - RNA, 70 nt, Human Herpes Virus 2
gcggcgcgcggggccgacaggcgcuuuugaaaaaauaacagggauaggcgucggggucuacgcgggccgc

SEQ ID NO: 555 - RNA, 68 nt, Human Herpes Virus 2
ggucggccucgagacgcgcaucucguggaccgaaauucuggcccaacagaucgcgggcgaggacgacu

SEQ ID NO: 556 - RNA, 60 nt, Human Herpes Virus 2
uguucgucccccuaaccacacacccgguaucgcgugugugugguuucccgggaagacaca

SEQ ID NO: 557 - RNA, 63 nt, Human Herpes Virus 2
gccguggagugccuggccgccugccgcgggauccuggaggcgcuggcggagggcuucgacggc

SEQ ID NO: 558 - RNA, 63 nt, Human Herpes Virus 2; identical to SEQ ID NO: 557

SEQ ID NO: 559 - RNA, 55 nt, Human Herpes Virus 2
gcccagaucgccgcgcuggugggggccaucgccgccgaccgccaggcgggugggc

SEQ ID NO: 560 - RNA, 55 nt, Human Herpes Virus 2
ggggugaagcguguuuaccacauucagccgagccuggaggacccguuccagcccc

SEQ ID NO: 561 - RNA, 55 nt, Human Herpes Virus 2
gucucgagcacccgucgggggggccacagcgccacccacgacgggcgcaggggac

SEQ ID NO: 562 - RNA, 90 nt, Human Herpes Virus 2
ccagcgaucgcggcuuggcgguccccggcacgagggugagcacgucguugaggacguccucgcccgcggcccgggggcccccccggcugg

SEQ ID NO: 563 - RNA, 64 nt, Human Herpes Virus 2
gccucggccagucgcucggucugccggccgggcggagcccgauggcgggccaggugggggaggu

SEQ ID NO: 564 - RNA, 65 nt, Human Herpes Virus 2
cucggggggguacggcgaggugcaguugauucgcgaacacaagcucgccgugaagaccauccggg

SEQ ID NO: 565 - RNA, 69 nt, Human Herpes Virus 2
cucgggggccacgccaagcccgaggcggcgcgcguguaccggcuguuucgggaggcgguggauaucgag

SEQ ID NO: 566 - RNA, 90 nt, Human Herpes Virus 2
cccguguuuuggggguugugcgugaucaugggcggcgcggcccugugcgcccugguggcggccgcccaugagacguucagucccgacggg

SEQ ID NO: 567 - RNA, 74 nt, Human Herpes Virus 2
cgcgcucgcugucgcucuugcgccccaacagcaccuugacggacgcgguguugcgcagacggcagaugugcgcg

SEQ ID NO: 568 - RNA, 67 nt, Human Herpes Virus 2
cugggucgggagcaggacagccgacccgucuagcggccgggucggcuguccagcgucgucgcccuag

SEQ ID NO: 569 - RNA, 80 nt, Human Herpes Virus 2
cggguucggagacgcugucucgauccucuucgaucugggccgcaggggcgacugacgacgaugacagcgacuccgacucg

SEQ ID NO: 570 - RNA, 61 nt, Human Herpes Virus 2
guccguguugagcggaacgccccgggcgauggcguacccgggauccuccgccagcucggac

SEQ ID NO: 571 - RNA, 56 nt, Human Herpes Virus 2
ggacgugggugggcgcggggagcgcggggacgaccgggcccgagccuucuccgucc

SEQ ID NO: 572 - RNA, 74 nt, Human Herpes Virus 2
ggcgcuacuucaucuucggcgggggcuacguguacuucgaggaguacgcguacucucaccagcugagucgcgcc

SEQ ID NO: 573 - RNA, 61 nt, Human Herpes Virus 2
gcguguggaccauggcgcgcaggcauucggaaaaccgguccagccgcgccccggcccgcgu

SEQ ID NO: 574 - RNA, 86 nt, Human Herpes Virus 2
ggucuucuucguagucguccucgcccgcgaucuguugggccagaauuucgguccacgagaugcgcgucucgaggccgaccggggcc

SEQ ID NO: 575 - RNA, 61 nt, Human Herpes Virus 2
ggggcuuggccgccgaggugcgccccggccggaggggcccccgcaccucggcggccgcccc

SEQ ID NO: 576 - RNA, 80 nt, Human Herpes Virus 2
gcgcacgcucgugggggaguuugagacggccgagcgccgcuucagcgccggccagcccagccuccugcgcgagacggcgc

SEQ ID NO: 577 - RNA, 72 nt, Human Herpes Virus 2
cggaaagucaacguuucgguucgggggagggggcgucauguccucggccccgugaaucguguugguuauccg

SEQ ID NO: 578 - RNA, 64 nt, Human Herpes Virus 2
ggccaggagcugggccuggagcccggagaaacaaaaccgcgccguccagaccggcccgacggcc

SEQ ID NO: 579 - RNA, 55 nt, Human Herpes Virus 2
gugcaggugggccgacgugccggggaagaugacguacagcauguggcccccguac

SEQ ID NO: 580 - RNA, 61 nt, Human Herpes Virus 2
ggcgaagcugcugcggucgcgcccccggguccugggggcgcgacccgcggccggugccgcc

SEQ ID NO: 581 - RNA, 72 nt, Human Herpes Virus 2
auugaacccaaggcagagguacgcguagcucucucccggaagguauugcucgcagacccuguguggggcagu

SEQ ID NO: 582 - RNA, 86 nt, Human Herpes Virus 2
cggaaaaacggaggauggaagggcagaagauggggagucccgauccuccuccugcauccccucgccuuccauucuccggcccuccg

SEQ ID NO: 583 - RNA, 74 nt, Human Herpes Virus 2
gcugacguggcaccgcgacuccgugucguucucucggcgcaacgccagcggcacggcaucggugcugccgcggc

SEQ ID NO: 584 - RNA, 98 nt, Human Herpes Virus 2
cggaaccccucgggggacuuccaggcgcccccccggacgcggccaaagcgaccccagaccucgucccacuccgccucggccuccuccagggaccuccg

SEQ ID NO: 585 - RNA, 55 nt, Human Herpes Virus 2
ggccaggucgguccaccccgcgggcagggaggcccgcagggucgccagcacggcc

SEQ ID NO: 586 - RNA, 72 nt, Human Herpes Virus 2
guccaguugcccgcccaggcggccguggcgggcccgcagagccgguugcccagggccgccagcaggcaggac

SEQ ID NO: 587 - RNA, 56 nt, Human Herpes Virus 2
ccggauguagucguagugcgggucgcuggcgagcccgucuacgaucaggcucucgg

SEQ ID NO: 588 - RNA, 56 nt, Human Herpes Virus 2
agcgcucgcacuuugcccuaauaauauauauacuauuaggacgaagugcgaacgcu

SEQ ID NO: 589 - RNA, 56 nt, Human Herpes Virus 2; identical to SEQ ID NO: 588

SEQ ID NO: 590 - RNA, 56 nt, Human Herpes Virus 2
agugcucgcacuuugcccuaauaauauauauacuauuaggacgaagugcgaacgcu

SEQ ID NO: 591 - RNA, 66 nt, Human Herpes Virus 2
gcugccgucccggucuccgccgcgcagccggugugccccuggugcggcggcgaccgggacgccggc

SEQ ID NO: 592 - RNA, 66 nt, Human Herpes Virus 2; identical to SEQ ID NO: 591

SEQ ID NO: 593 - RNA, 61 nt, Human Herpes Virus 2
cagccgcccccuggucagcuuucgguacgaagaccagggcccgcugaucgaggggcagcug

SEQ ID NO: 594 - RNA, 60 nt, Human Herpes Virus 2
ccgcccccgccccgucaucgcccccggaggccagggucccgaugagggcccggguugcgg

SEQ ID NO: 595 - RNA, 97 nt, Human Herpes Virus 2
ccgccccgacgcccgcgcguccgcguccguggcggcggcccguuggucgcgccgccgccgcuccgcccgcgcggcaucucauuagcgcccggcgcgg

SEQ ID NO: 596 - RNA, 97 nt, Human Herpes Virus 2; identical to SEQ ID NO: 595

SEQ ID NO: 597 - RNA, 55 nt, Human Herpes Virus 2
cguccaccccggaagguuggccggguuggugauguaacuuuccgggacgacaaag

SEQ ID NO: 598 - RNA, 76 nt, Human Herpes Virus 2
cggcccaccgugccacccgaacccgggccgcgcggcggggcgacgguccggguucggggugggcggcgguccgucg

SEQ ID NO: 599 - RNA, 94 nt, Human Herpes Virus 2
ucgaccccccggcggccgucgggccggucuggacggcgcgguuuuguuucuccgggcuccaggcccagcuccuggccgcccucgcgggccucgg

SEQ ID NO: 600 - RNA, 85 nt, Human Herpes Virus 2
caaccccgcccuccgcuacacgacccuggagauccccggggcccgcagcuucgggggcucggggggguacggcgaggugcaguug

SEQ ID NO: 601 - RNA, 68 nt, Human Herpes Virus 2
ccggcgggugagcgcgcgcaugcucggagacgucauggccgucuccacgugcgugcccgucgccccgg

SEQ ID NO: 602 - RNA, 58 nt, Human Herpes Virus 2
gggacgcggccgucugguucgaggacaugacccccgccgaacuagagguuauauuccc

SEQ ID NO: 603 - RNA, 84 nt, Human Herpes Virus 2
cuggcugacgugucuggggcugguucccauauugcgcaagacgcgcgagggggaggcgacgcagcgccugggggcguuucucag

SEQ ID NO: 604 - RNA, 67 nt, Human Herpes Virus 2
cgccgccgucucccgggggauguugaacacgggcaacauccagaagucccgggggaacucgggggug

SEQ ID NO: 605 - RNA, 56 nt, Human Herpes Virus 2
gucugggggccuuucucuguguggccaaaaguugcgcaucucgagggccccgggac

SEQ ID NO: 606 - RNA, 61 nt, Human Herpes Virus 2
gcucgcgaaccacauccacccaugauuugggcgucagggcgugggugugaauuucgggggu

SEQ ID NO: 607 - RNA, 71 nt, Human Herpes Virus 2
ccgggugcucgccguggucaacgacccucgggggccguuuuuuguggggcugaucgcgugcgugcagcugg

SEQ ID NO: 608 - RNA, 57 nt, Human Herpes Virus 2
gcgggccacggggaguagggggagcuaacacucggcuugcugcccgaaggaagccgc

SEQ ID NO: 609 - RNA, 55 nt, Human Herpes Virus 2
gggggaggcgugcuggaauuccagauugacgguggaggccagccacgccaacccc

SEQ ID NO: 610 - RNA, 65 nt, Human Herpes Virus 2
uugggaugcccgccgcccugaccacggccaacuuucacacucugguggggcacggguacaaccag

SEQ ID NO: 611 - RNA, 65 nt, Human Herpes Virus 2
gguggaucgacccccgcgccgccgcggcccugacggcggcggugguggcgggccucgggacaacc

SEQ ID NO: 612 - RNA, 57 nt, Human Herpes Virus 2
cgccgccugggccccgccgaucgccgguucguggcgcucagcgggagucuggaggcg

SEQ ID NO: 613 - RNA, 80 nt, Human Herpes Virus 2
ccggggagcagcgggcugcgcggccgacucgguguuccugaacguguccguguuggacccggcggcccgccugcggcugg

SEQ ID NO: 614 - RNA, 63 nt, Human Herpes Virus 2
gcguguaauacguggccggccggccggcgcagggcucgggaccccggucggccgcgucgacgu

SEQ ID NO: 615 - RNA, 56 nt, Human Herpes Virus 2
ccgcguacgcccuggccgugcuggcgcaucugggcggccagggcggucgggggcgg

SEQ ID NO: 616 - RNA, 55 nt, Human Herpes Virus 2
ggcgugggcgcgccuggccgccauucgcgacagcccccagugcgcguccuccgcc

SEQ ID NO: 617 - RNA, 64 nt, Human Herpes Virus 2
cgcuuuccgcgccgucccggcccacgacgaccucgugcaggugggccgugaugcgcgggcggcg

SEQ ID NO: 618 - RNA, 94 nt, Human Herpes Virus 2
gcugugcguucgcggggcgcgucccuucagccacuuuaagcgcagcauguaccgggccggccgcuuucacugggagcgcuuuucgaacgccagc

SEQ ID NO: 619 - RNA, 71 nt, Human Herpes Virus 2
ggcgucgccucggggcuccgccagggcgcccugguccaccaggccgucagcgggggagcccugggcgcguc

SEQ ID NO: 620 - RNA, 94 nt, Human Herpes Virus 2
ucgguggucgugggggcgcgccugcacccgcacuccgcccaccccgcguuugcggacguggagcaggaggcgcuguuucgcgcccugccccugg

SEQ ID NO: 621 - RNA, 57 nt, Human Herpes Virus 2
cgccuccagacucccgcugagcgccacgaaccggcgaucggcggggcccaggcggcg

SEQ ID NO: 622 - RNA, 73 nt, Human Herpes Virus 2
gcccucagcgcguccccgaccaccagggccagcacguaagggacgaaccccgggucggcgaggacguuggggu

SEQ ID NO: 623 - RNA, 75 nt, Human Herpes Virus 2
ugggugcucggggacagaggacgccggccgguccucgggccuacgucuggguguuuucuuucuuuuugccuccca

SEQ ID NO: 624 - RNA, 84 nt, Human Herpes Virus 2
gccguccucgggggcgcauagcgccgcgucgccgccccgcguccgcaucgccggcgcccgcgcgcgcugugcggccauggcggc

SEQ ID NO: 625 - RNA, 78 nt, Human Herpes Virus 2
cugcucguugaucuucgcgcccucgacgcccgcgcccgggccucuucuucccccgagggccacgaggucgacccgcag

SEQ ID NO: 626 - RNA, 84 nt, Human Herpes Virus 2
cugaucaucggcgcgcuggccggcaguacccuggcggugcuggucaucggcgguauugcguuuuggguacgccgccgcgcucag

SEQ ID NO: 627 - RNA, 78 nt, Human Herpes Virus 2
gcccuuuagcggggaggcgucguagaugagauacugcguaaagugggucucucgcgcgugggccuccccaucgcgggc

SEQ ID NO: 628 - RNA, 64 nt, Human Herpes Virus 2
ucgacgcccuccuggccgcacgccuggagucuggccagacgcucggcccggcgggggggcgcga

SEQ ID NO: 629 - RNA, 72 nt, Human Herpes Virus 2
gguagggaggggagaggagaagggcgcgccggugcgcggagcagccuuccuucuccggagucccucucgauc

SEQ ID NO: 630 - RNA, 60 nt, Human Herpes Virus 2
uacacccccgcgcaccucgaccguggcguucgccuucgcauaagaggucgcgggggcgua

SEQ ID NO: 631 - RNA, 66 nt, Human Herpes Virus 2
cggacccgcggaggaggaggaggcggcggcggcggcgcgcggguccuccgccgccgcgggcccggg

SEQ ID NO: 632 - RNA, 79 nt, Human Herpes Virus 2
gggauaggcgucggggucuacgcgggccgcgggaaacaacagcugaaccgccgccagcgccccgcgccuaaagugaccc

SEQ ID NO: 633 - RNA, 95 nt, Human Herpes Virus 2
ucgauucccggccgggggucccggguagccgcccggcgccgggcggaaggcgucccccgcccggcgguccggcccgggcccccggcggagcgcgg

SEQ ID NO: 634 - RNA, 76 nt, Human Herpes Virus 2
gggacgggugaguucgcuaggcaagcacggacuggcgguuacacgugcaugcgugccgagugaacucucccgcccc

SEQ ID NO: 635 - RNA, 57 nt, Human Herpes Virus 2
cggagggcuucuggccgcgucgcuugcgccuguggggcggugcggaccaugcccccg

SEQ ID NO: 636 - RNA, 55 nt, Human Herpes Virus 2
acgaugcagcagcugggccgcgucgacgcguugaugcugcgccugcugcgcacgu

SEQ ID NO: 637 - RNA, 55 nt, Human Herpes Virus 2
accagcagcccgauggggguguguuguaucaccacgccuccgcggggcaggcggu

SEQ ID NO: 638 - RNA, 79 nt, Human Herpes Virus 2
guuacggaccccuuucucccccccuuccgaacaaaaagcagcgggcggggggccggggugagggagggacacgggggac

SEQ ID NO: 639 - RNA, 55 nt, Human Herpes Virus 2
gggaacguggcggaccugcugcgggccgcggcccccgcguggagccgccgcaccc

SEQ ID NO: 640 - RNA, 82 nt, Human Herpes Virus 2
gucaccucggcggggggacgggacgugggccccgccucggggagcucgggcaggcucgcguuccgaggccggccgagcagau

SEQ ID NO: 641 - RNA, 80 nt, Human Herpes Virus 2
gugagcguccucgggcgcaugugucugccgagcgccgcuuuggccgcgcuguggaccugcauguuucccgacgacuacac

SEQ ID NO: 642 - RNA, 91 nt, Human Herpes Virus 2
cggauacccccccgcaguccgggcagggcggcggcgacgacgggcccgcgagcccgucgucgccguccgugcucgagacgcugggggcccg

SEQ ID NO: 643 - RNA, 80 nt, Human Herpes Virus 2
ggacagggggggagacgaggggucggaauccaaaggacgcagaccaccuuugguuacggaccccuuucucccccccuucc

SEQ ID NO: 644 - RNA, 80 nt, Human Herpes Virus 2; identical to SEQ ID NO: 643

SEQ ID NO: 645 - RNA, 80 nt, Human Herpes Virus 2
guacgugugcuuucgggccucguccgaagccccgcgcacgaucuggggggccuccgauggggcauguaggagcacgcugc

SEQ ID NO: 646 - RNA, 61 nt, Human Herpes Virus 2
gcgcgggcggcacgcgcgagagcaacccacgggucccguucgcgccaccgccagcccuugc

SEQ ID NO: 647 - RNA, 56 nt, Human Herpes Virus 2
ccgcgcaggaaacgcccccgggguuguaaaucuggccgcgggggcgccuguaucgg

SEQ ID NO: 648 - RNA, 61 nt, Human Herpes Virus 2
cggccccggggcgcggccuuccgcgacggucgagauucucgcgggccgcgugucgggcccg

SEQ ID NO: 649 - RNA, 56 nt, Human Herpes Virus 2
ggucggucacgggaucgcucgggcacuccucaccgggggcgaucuccgggaccacc

SEQ ID NO: 650 - RNA, 96 nt, Human Herpes Virus 2
cgucggggguucgcgccccggucagcgccgcguucucgcgcgccagcaggggcgcguaggcgcggcgcaggcuggucagcaggaagcccuucugcg

SEQ ID NO: 651 - RNA, 88 nt, Human Herpes Virus 2
gcucgccagcagcgacucggaggaggagaccgaggugggaaucucugacgacgaccuucaccgcgacuccaccuccgaggcgggcagc

SEQ ID NO: 652 - RNA, 80 nt, Human Herpes Virus 2
ggccgaacacgccgaccgccuggccagacgccaacgcccgggcgagcggcuugaccuggccaugcuguccgccauucgcc

SEQ ID NO: 653 - RNA, 77 nt, Human Herpes Virus 2
ugccgacaccaucgaccccgccguucgggcgguucugcgauccauauccgagcgcgcggcggucgagcgcaucagcg

SEQ ID NO: 654 - RNA, 95 nt, Human Herpes Virus 2
guccagcgucgucgcccuagaggcuguccgccgggcgugauguuuuccgcaucuacgacccccgaacagccccuggggcugucgggcgaugcgac

SEQ ID NO: 655 - RNA, 71 nt, Human Herpes Virus 2
gcucagguacucguccuccagcagcgccagccaguccucgaucugcagcugcugggugcgggggcccaggc

SEQ ID NO: 656 - RNA, 95 nt, Human Herpes Virus 2
gggcaugggaccggguggaggcgcgccuccggcguacggcaugcccgcgcacggacaugguggccggaggcccgauuuuuuacacacgcccuccc

SEQ ID NO: 657 - RNA, 76 nt, Human Herpes Virus 2
gggcauaaagaggggaugucaggggcccgccgccgcaucaguccgcgcggggcgcgccucugacccaccccccccc

SEQ ID NO: 658 - RNA, 86 nt, Human Herpes Virus 2
cgccccucguacccgggcaccacguggcccucgcgguccagcugcggguuggccgccacgugcgugccgggcacgagaaagaagcg

SEQ ID NO: 659 - RNA, 89 nt, Human Herpes Virus 2
ggcccugggucacuuuaggcgcggggcgcuggcggcgguucagcuguuguuucccgcggcccgcguagaccccgacgccuaucccuguu

SEQ ID NO: 660 - RNA, 92 nt, Human Herpes Virus 2
ggcccuucgacgccucccuccugacgggggagcuguucccgggacacccgguuuaccagcgcccccucgccgacgaggcaggucccucugcc

SEQ ID NO: 661 - RNA, 70 nt, Human Herpes Virus 2
ccgcgcuuacggcaacaaagggccuccgauagccuccgaggugcggagccucuuugggccguggguacgg

SEQ ID NO: 662 - RNA, 83 nt, Human Herpes Virus 2
gagcgcgccuggucgagcgucuuggccacggucgccgggacggcgaccaccuucagcauggucuugagguuggccaggcccuc

SEQ ID NO: 663 - RNA, 74 nt, Human Herpes Virus 2
caccguaucagcaccccaccgaaaaacggagcgggccgauccguccuuguuuucggucugguacucccuuugug

SEQ ID NO: 664 - RNA, 65 nt, Human Herpes Virus 2
ggccugcgaggugcugcccgccgugcagugcgccgugcgcuggccggcggcgcgggaccugcgcc

SEQ ID NO: 665 - RNA, 65 nt, Human Herpes Virus 2; identical to SEQ ID NO: 664

SEQ ID NO: 666 - RNA, 84 nt, Human Herpes Virus 2
gcggccggcgcgcucucgaccgcgguucccgagucguacgcagggaccauuugggagucugcgguugggagcgcgccggggcgc

SEQ ID NO: 667 - RNA, 55 nt, Human Herpes Virus 2
ggcggggcggcggucgccagcagcguguuuguggcgaccgucaagagccugggcc

SEQ ID NO: 668 - RNA, 91 nt, Human Herpes Virus 2
gacggagcggcggcccggcgggaggaggagacccggagagacagagacuaaaacccggcaagagagagaccgcgggccgccgucucgaguc

SEQ ID NO: 669 - RNA, 64 nt, Human Herpes Virus 2
gucggcggggcgccgggggucgcggcgacaggcuggccaugggguccggguacgccccgcggac

SEQ ID NO: 670 - RNA, 64 nt, Human Herpes Virus 2; identical to SEQ ID NO: 669

SEQ ID NO: 671 - RNA, 60 nt, Human Herpes Virus 2
gcgguccagugacacucgcgcagcacguccucgacggacgcguagguguuauuggggugc

SEQ ID NO: 672 - RNA, 90 nt, Human Herpes Virus 2
gccgcucgcgggcgcgggcgucccuguguccccgggggcgggggucgggucucggggggaggacgggggugucguuguccguggaggggu

SEQ ID NO: 673 - RNA, 67 nt, Human Herpes Virus 2
cgggggggcggggagcuugggagugugugguggucugcggcacagccugcuaguccccguccugccg

SEQ ID NO: 674 - RNA, 74 nt, Human Herpes Virus 2
gcuggucgcgucccucgcggggcugcgguccgucgucaccgagacgacggcgcaccucgggguaugcgacgagc

SEQ ID NO: 675 - RNA, 61 nt, Human Herpes Virus 2
acgggggggauuuagagggcgcggggcgugaggcgggacccccgcgccgugucccccgugu

SEQ ID NO: 676 - RNA, 85 nt, Human Herpes Virus 2
ccgggggcggacggccccuacgucaccuuugauacucuguuuaugguaucuucgaucgacgaacuggggcgccgccagcucacgg

SEQ ID NO: 677 - RNA, 65 nt, Human Herpes Virus 2
uccgcccccgccggggcgcgcggcuauugggggaaucguaaaugccgccccuuugggggagugga

SEQ ID NO: 678 - RNA, 98 nt, Human Herpes Virus 2
cgggggucgagugggggcgagcccgggggagcggcgggggugcguugucgcgccggguccguuguaucuugucccggcagcucccgccgaccgcgccg

SEQ ID NO: 679 - RNA, 57 nt, Human Herpes Virus 2
ugggaguaguggggggcguggugucggccgucucgggcguguccuccuuuaugucca

SEQ ID NO: 680 - RNA, 95 nt, Human Herpes Virus 2
gccgaggaacgucaccaggugcgguugcagggggcagucgggaaaguggcugucgaggacguaucccugcaccaagaucuguuugaaguucgggu

SEQ ID NO: 681 - RNA, 65 nt, Human Herpes Virus 2
agcgagggccugcguaacccacgggggccgcgggaguggcucccugcggguugcgggggagaguu

SEQ ID NO: 682 - RNA, 71 nt, Human Herpes Virus 2
ggcgcgcccaccgguccuucgcgggggccggggcucuucuggucauggcccuuggacgggugggccuagcc

SEQ ID NO: 683 - RNA, 62 nt, Human Herpes Virus 2
gcugcaggcgguugucgaggcgguccgcguacacguugccguucgcgaggagccgccgaagc

SEQ ID NO: 684 - RNA, 91 nt, Human Herpes Virus 2
gcggccagggcggucgggggcggcggcggcggcucgucccucucagcgacgacauccccgcccgcuucgccgacuccgacgcccacuacgc

SEQ ID NO: 685 - RNA, 55 nt, Human Herpes Virus 2
gcgugggugugaauuucggggguuccgggcccaacggccgagguuuauauccugc

SEQ ID NO: 686 - RNA, 80 nt, Human Herpes Virus 2
gguuugggggggggugggucagaggcgcgccccgcgcggacugaugcggcggcgggccccugacauccccucuuuaugcc

SEQ ID NO: 687 - RNA, 86 nt, Human Herpes Virus 2
gggugggcgugucguugggcggcccccggccuuugcuuccucgcggaagucgggccuguucggggcgugucuguccguugcccccc

SEQ ID NO: 688 - RNA, 55 nt, Human Herpes Virus 2
cgguccgaugaccgccucggccgccgccacgcggcgccggaaccggucgcggucg

SEQ ID NO: 689 - RNA, 81 nt, Human Herpes Virus 2
cucugccgcggggccaacgugcgguaccgcgugcgcacgcgcuucggccccgacacgcuggugcccauguccccgcgcgag

SEQ ID NO: 690 - RNA, 69 nt, Human Herpes Virus 2
gggucgcucgcuguucgaggccacgcgcgucaccuuaauaugcgaaguggaccucgggccgcgccgccc

SEQ ID NO: 691 - RNA, 95 nt, Human Herpes Virus 2
ccaugagcuuguaauacaccgucaggugggccaggcgcuuguugguguacgcgcgcgggugucugcucaguucggcggugaggacaaaguccugg

SEQ ID NO: 692 - RNA, 59 nt, Human Herpes Virus 2
cuguugguggugguggaggggcgguacagcagaaaccgcucccccgccgacuuuguuag

SEQ ID NO: 693 - RNA, 56 nt, Human Herpes Virus 2
gccuuugcggucuggcggucgcggcgacccggcgccgcgaccgccgggucugcggu

SEQ ID NO: 694 - RNA, 65 nt, Human Herpes Virus 2
gcagcgcgcggaggccaccgagcgggucauggcgggccugcgggaggcgcuggccgcgcgcgagc

SEQ ID NO: 695 - RNA, 88 nt, Human Herpes Virus 2
ggaggaagcggaagcgggaggggggggcgacgugugugccgugugcacggacgagaucgccccgccccugcgcugccagaguuuuccc

SEQ ID NO: 696 - RNA, 84 nt, Human Herpes Virus 2
ccagcccgacgcaccgcgugcgccgccgucggcgccuuaggaccgacugcuggcggcccaugcgcacgaggaagucguuggcgg

SEQ ID NO: 697 - RNA, 56 nt, Human Herpes Virus 2
cgagcacggacggcgacgacgggcucgcgggcccgucgucgccgccgcccugcccg

SEQ ID NO: 698 - RNA, 70 nt, Human Herpes Virus 2
ccacgccccggucuggcuccaggugacgacguggguguagacgcccucuggcgccagggagggggcgagg

SEQ ID NO: 699 - RNA, 96 nt, Human Herpes Virus 2
gaaggcggagagggggcuggggcucgcgucgccggucuggaggucgcgaaaguagcacgcguagcggccgccguccccaccacccuccgccgccuc

SEQ ID NO: 700 - RNA, 60 nt, Human Herpes Virus 2
gcacgcgccugcguucggucaggcugcucgugcgagcgggccuaccgacggccgcgcggc

SEQ ID NO: 701 - RNA, 77 nt, Human Herpes Virus 2
ggaggcgcuggcggagggcuucgacggcgaccuggcggccgugccggggcuggccggagcccggcccgccgcgcccc

SEQ ID NO: 702 - RNA, 78 nt, Human Herpes Virus 2
ggaggcgcuggcggagggcuucgacggcgaccuggcggccgugccggggcuggccggagcccggcccgccgcgccccc

SEQ ID NO: 703 - RNA, 79 nt, Human Herpes Virus 2
gcaggaaggcggggucugccgucccgcucacgggcgcccggggcgccgaggacgcggggcgaagguccacguguuccgc

SEQ ID NO: 704 - RNA, 63 nt, Human Herpes Virus 2
gcagguguuucugccccucgaccauucgcaguucagucgcuaucgauggggcggacccaccgc

SEQ ID NO: 705 - RNA, 74 nt, Human Herpes Virus 2
cgagcgagggcggggggaaggcgccggaggccccgcacgccgcgccugccgccgccugccccccgccgccgccg

SEQ ID NO: 706 - RNA, 69 nt, Human Herpes Virus 2
caaaaccgcgccguccagaccggcccgacggccgccggggggucgaguaguuggauggugguggccgug

SEQ ID NO: 707 - RNA, 69 nt, Human Herpes Virus 2
ggagggggcggccgccgaggugcgggggccccuccggccggggcgcaccucggcggccaagccccggcc

SEQ ID NO: 708 - RNA, 74 nt, Human Herpes Virus 2
ggagaacuguccccggagccacgccacgcccucgcuguucgucaaggugucggcgugguugggggucguggccc

SEQ ID NO: 709 - RNA, 61 nt, Human Herpes Virus 2
accaaccuccccguggaucugcuacacaugguguacgcgggccgcggggccgcggguucgu

SEQ ID NO: 710 - RNA, 56 nt, Human Herpes Virus 2
agcguucgcacuucguccuaauaguauauauauuauuagggcaaagugcgagcacu

SEQ ID NO: 711 - RNA, 56 nt, Human Herpes Virus 2; identical to SEQ ID NO: 710

SEQ ID NO: 712 - RNA, 74 nt, Human Herpes Virus 2
gccgcggggccaacgugcgguaccgcgugcgcacgcgcuucggccccgacacgcuggugcccauguccccgcgc

SEQ ID NO: 713 - RNA, 68 nt, Human Herpes Virus 2
ggcagcgcaggggcggggcgaucucguccgugcacacggcacacacgucgccccccccucccgcuucc

SEQ ID NO: 714 - RNA, 70 nt, Human Herpes Virus 2
gccacgcccgccccuccuuacccuggcugcggggagacucccaucggggcgagggggcucgcgcguucgc

SEQ ID NO: 715 - RNA, 70 nt, Human Herpes Virus 2; identical to SEQ ID NO: 714

SEQ ID NO: 716 - RNA, 57 nt, Human Herpes Virus 2
uccgcguccggcccccagguccgcaccgcgucguagaccccggcggccucgcgcuga

SEQ ID NO: 717 - RNA, 96 nt, Human Herpes Virus 2
ggcgacgguccggguucggggugggcggcgguccgucggcuggauccggagauccggggccgccggucgucuccgccgcggcccggagacgucccc

SEQ ID NO: 718 - RNA, 91 nt, Human Herpes Virus 2
ggccgcgucgcuugcgccuguggggcggugcggaccaugcccccgagggguucgaccccaccgucaccgucuuccacguguacgacauccu

SEQ ID NO: 719 - RNA, 79 nt, Human Herpes Virus 2
gccggggccggauugggcguggggccgccggcgucgucggacgccagcuccuccaggccguggauccaggcccacaugc

SEQ ID NO: 720 - RNA, 74 nt, Human Herpes Virus 2
gccuggaggacccguuccagccccccagcaucccgaucacuguguacuacgcagugcuggaacgugccugccgc

SEQ ID NO: 721 - RNA, 72 nt, Human Herpes Virus 2
gccugguccacguacugcagggccucgagcucggccaugacgcgcucgguggccgcgcgguacgucuccugc

SEQ ID NO: 722 - RNA, 68 nt, Human Herpes Virus 2
cgggcgucgggaugcggggucaggcgcuggacgaacagcauggacuccgcugcguccucgaacgcgcg

SEQ ID NO: 723 - RNA, 93 nt, Human Herpes Virus 2
cgguugcaugccucgggucuccucuuccugcuccuccuccuuucucccagccagggugaggaggggcgggcguggcgggcaggugugcgggcg

SEQ ID NO: 724 - RNA, 65 nt, Human Herpes Virus 2
gggggggcggggagcuugggagugugugguggucugcggcacagccugcuaguccccguccugcc

SEQ ID NO: 725 - RNA, 71 nt, Human Herpes Virus 2
gugacccagcucaagggacugucgcacaaccccggcgccuccgcgcuguugcggucccgggccuggguaac

SEQ ID NO: 726 - RNA, 91 nt, Human Herpes Virus 2
guggcucgccagcagcgacucggaggaggagaccgaggugggaaucucugacgacgaccuucaccgcgacuccaccuccgaggcgggcagc

SEQ ID NO: 727 - RNA, 61 nt, Human Herpes Virus 2
ucgggggggcgguuugggugccccgccugcggugugucgggugggcccgaggccccccggg

SEQ ID NO: 728 - RNA, 76 nt, Human Herpes Virus 2
guggcuccggggacaguucuccagguacaucagcaggcagacgagcucgaagucccggagguccguggggcgaaac

SEQ ID NO: 729 - RNA, 77 nt, Human Herpes Virus 2
gcgggccaggugggggaggucgguggggugccgcagggccaaaaggagcgccccggccggcuccgcguuugguuggc

SEQ ID NO: 730 - RNA, 62 nt, Human Herpes Virus 2
ggggaucagcaaccaggcgcugcugcgcauggccugcgaggugcgccaggucagcgaucgcc

SEQ ID NO: 731 - RNA, 95 nt, Human Herpes Virus 2
gcgccagaaaccggucggcgauguccggggcggugauaugccgagucacgauggagcgcgcuaaaucuucgucgcggagguccugauagaugggc

SEQ ID NO: 732 - RNA, 58 nt, Human Herpes Virus 2
gcgcacggacggcgaccugcggcgcgggaacgcucgcggcgggggauguguccauggc

SEQ ID NO: 733 - RNA, 81 nt, Human Herpes Virus 2
ccgacggaccgccgcccaccccgaacccggaccgucgccccgccgcgcggcccggguucggguggcacggugggccggagg

SEQ ID NO: 734 - RNA, 69 nt, Human Herpes Virus 2
cggaccccuuucucccccccuuccgaacaaaaagcagcgggcggggggccggggugagggagggacacg

SEQ ID NO: 735 - RNA, 60 nt, Human Herpes Virus 2
ccuccgccaccucgaccagacugcgguccccggcgauggccuguuugaggauggcggcgg

SEQ ID NO: 736 - RNA, 90 nt, Human Herpes Virus 2
gcuccgcccgcgcggcaucucauuagcgcccggcgcgggcggcuuccgcuuccgcccgcgaugcuaaugagacccucgucgcgggcgggc

SEQ ID NO: 737 - RNA, 79 nt, Human Herpes Virus 2
gcuucgcgggcgggguccccuccagggcugcugcccacacaucaucgggggggcgguuugggugccccgccugcggugu

SEQ ID NO: 738 - RNA, 58 nt, Human Herpes Virus 2
ccuugcggggggggauggcggaucgggucccgaggaccccgcugccccccccgcacgg

SEQ ID NO: 739 - RNA, 64 nt, Human Herpes Virus 2
ggugggucuggugugugcagguggcgacguucaucgucucggccaucugcgucguggggcuccu

SEQ ID NO: 740 - RNA, 77 nt, Human Herpes Virus 2
gguccugguacacggcgagguuggaccgccgcgcgaggagcugcagcagggggcacggcccgcagguguacgggucc

SEQ ID NO: 741 - RNA, 83 nt, Human Herpes Virus 2
gcuggcuggagaccgagcucguguucgugggggacgaggaggacgucuccaagcucuccgagggcgagcucggcuucuaccgc

SEQ ID NO: 742 - RNA, 69 nt, Human Herpes Virus 2
ccugcgguccccugcgcccgucguggguggcgcuguggcccccccgacgggugcucgagacggucgugg

SEQ ID NO: 743 - RNA, 75 nt, Human Herpes Virus 2
gcuccugcgggggggcucgggccaccugaccuucguaaccugcacucaggucagagccccagaccccccgcgggc

SEQ ID NO: 744 - RNA, 92 nt, Human Herpes Virus 2
cguagggguucagggccugggccaggaucauuagcugggccucguguucgcgaagccuuuccgucagcccgaaguccagguccaccuccuug

SEQ ID NO: 745 - RNA, 59 nt, Human Herpes Virus 2
cguucaccaccacgccccccaccgcgccuuggcuguuugggggguggcggcgguggucg

SEQ ID NO: 746 - RNA, 86 nt, Human Herpes Virus 2
gaagacgaggccgacgaugacgccccggaugacguggccuacccggaggacuacgcggaggggcguuuucuguccaugguuucggc

SEQ ID NO: 747 - RNA, 93 nt, Human Herpes Virus 2
gacccgcgcgcgucggucgcgccugcccggcccagacucugugcuugggugucggucugagccugggucaugcgcgaccggggcgcgcggugc

SEQ ID NO: 748 - RNA, 58 nt, Human Herpes Virus 2
aacauggcggcguuggcgucggcgcggaugaccgugucgaugucggcaaagcgcaggu

SEQ ID NO: 749 - RNA, 65 nt, Human Herpes Virus 2
gagaaggccgugguguugcggagcgccaccacgacgggcgcgccgaggagcaccgcggccagaac

SEQ ID NO: 750 - RNA, 57 nt, Human Herpes Virus 2
uaggcgccgucgagcucgugggccacgggcucguccgcgagcuguucggcggcgggg

SEQ ID NO: 751 - RNA, 93 nt, Human Herpes Virus 2
gcgacgguccggguucggggugggcggcgguccgucggcuggauccggagauccggggccgccggucgucuccgccgcggcccggagacgucc

SEQ ID NO: 752 - RNA, 95 nt, Human Herpes Virus 2
gcgcaccgcgcgccccggucgcgcaugacccaggcucagaccgacacccaagcacagagucugggccgggcaggcgcgaccgacgcgcgcggguc

SEQ ID NO: 753 - RNA, 67 nt, Human Herpes Virus 2
ccacccguggucucgggagcagggcgcgcccgcgccggccggcgacgcccccgcgggccacggggag

SEQ ID NO: 754 - RNA, 56 nt, Human Herpes Virus 2
cgugcggggggggcagcgggguccucgggacccgauccgccauccccccccgcaag

SEQ ID NO: 755 - RNA, 84 nt, Human Herpes Virus 2
gggcgggccggggcuuggccgccgaggugcgccccggccggaggggcccccgcaccucggcggccgcccccuccggcgccgcgc

SEQ ID NO: 756 - RNA, 56 nt, Human Herpes Virus 2
cggggggcggggucgccucgggccgcuugggcggcuuuuugguuuuccgcuuccgg

SEQ ID NO: 757 - RNA, 68 nt, Human Herpes Virus 2
ggguucacgcgggugcuggugucucggggaacgucgcccggggccgccgguagcaccccguggcgcac

SEQ ID NO: 758 - RNA, 59 nt, Human Herpes Virus 2
ggggccggauaccgcgggggcgugaauaaucgcgcagaagucccgcggcauugccauuc

SEQ ID NO: 759 - RNA, 58 nt, Human Herpes Virus 2
uggagccgguucacgacggucagcacguacauggccgugaccgucggggccgauucga

SEQ ID NO: 760 - RNA, 97 nt, Human Herpes Virus 2
ugggugacugggaccgacgcaaccuccggggcuugugcccucguaggcccggggggggccucggucgcuccaagccccgcggugcgggucccuccgg

SEQ ID NO: 761 - RNA, 73 nt, Human Herpes Virus 2
cgaugccgugccgcuggcguugcgccgagagaacgacacggagucgcggugccacgucagcuggcaggugaag

SEQ ID NO: 762 - RNA, 79 nt, Human Herpes Virus 2
cgacggaccgccgcccaccccgaacccggaccgucgccccgccgcgcggcccggguucggguggcacggugggccggag

SEQ ID NO: 763 - RNA, 56 nt, Human Herpes Virus 2
cgaaggcggcgggcgcgccgccggggggcggggcggcgcagcgcgcggccagcgag

SEQ ID NO: 764 - RNA, 56 nt, Human Herpes Virus 2
ggaaucucgggucgccccaugcacguaaaacacgggcgcugcguggggugggucgc

SEQ ID NO: 765 - RNA, 57 nt, Human Herpes Virus 2
ggcauccugacggugguguggaccccggacaccaucuacaucaccgcaacgaucuac

SEQ ID NO: 766 - RNA, 56 nt, Human Herpes Virus 2
cguuacguaucgaaguuacgaagcggacaaacccgccggggcuucguggguaguag

SEQ ID NO: 767 - RNA, 88 nt, Human Herpes Virus 2
cuccgcccgcgcggcaucucauuagcgcccggcgcgggcggcuuccgcuuccgcccgcgaugcuaaugagacccucgucgcgggcggg

SEQ ID NO: 768 - RNA, 75 nt, Human Herpes Virus 2
cuccugcgggggggcucgggccaccugaccuucguaaccugcacucaggucagagccccagaccccccgcgggcg

SEQ ID NO: 769 - RNA, 97 nt, Human Herpes Virus 2
gucgucggggguucgcgccccggucagcgccgcguucucgcgcgccagcaggggcgcguaggcgcggcgcaggcuggucagcaggaagcccuucugc

SEQ ID NO: 770 - RNA, 58 nt, Human Herpes Virus 2
uucaccaccacgccccccaccgcgccuuggcuguuugggggguggcggcgguggucgg

SEQ ID NO: 771 - RNA, 56 nt, Human Herpes Virus 2
guuuccacggcacucucggcccacgccaucggggcugucgggaguggcuugguuuu

SEQ ID NO: 772 - RNA, 55 nt, Human immunodeficiency virus type 1
cagaacauccaggggcaaaugguacaucaggccauaucaccuagaacuuuaaaug

SEQ ID NO: 773 - RNA, 96 nt, Human immunodeficiency virus type 1 (SE8131)
gcuucucgccuguacugggucucucuuguuagaccagaucgagccugggagcucucuggcuagcgagggaacccacugcuuaagccucaauaaagc

SEQ ID NO: 774 - RNA, 79 nt, Human immunodeficiency virus type 1 (HIV1084i)
gcuuguacugggucucucuagguagaccagaucugagcccgggagcucucuggcuaucuagggaacccacugcuuaagc

SEQ ID NO: 775 - RNA, 61 nt, Human immunodeficiency virus type 1 (HIV1084i)
gggaacccacugcuuaagccucaauaaagcuugccuugagugcucuaaguagugugugccc

SEQ ID NO: 776 - RNA, 61 nt, Human immunodeficiency virus type 1 (HIV1084i); identical to SEQ ID NO: 775

SEQ ID NO: 777 - RNA, 69 nt, Human immunodeficiency virus type 1 (HIV1084i)
guacugggucucucuagguagaccagaucugagcccgggagcucucuggcuaucuagggaacccacugc

SEQ ID NO: 778 - RNA, 72 nt, Human immunodeficiency virus type 1 (HIV1084i)
ggaugugggggaugcauauuuuucaguuccuuuagaugaaaacuucaggaaauauacugcauucaccauacc

SEQ ID NO: 779 - RNA, 55 nt, Human immunodeficiency virus type 1 (HIV1084i)
cuacacaccgggaccaggggucagauauccacugaccuuuggauggugcuucaag

SEQ ID NO: 780 - RNA, 55 nt, Human immunodeficiency virus type 1 (HIV1084i)
cuacacaccgggaccaggggacagauauccacugaccuuuggauggugcuucaag

SEQ ID NO: 781 - RNA, 77 nt, Human immunodeficiency virus type 1 (BLAI)
uuacccuauagugcagaacauccaggggcaaaugguacaucaggccauaucaccuagaacuuuaaaugcauggguaa

SEQ ID NO: 782 - RNA, 77 nt, Human immunodeficiency virus type 1 (BLAI); identical to SEQ ID NO: 781

SEQ ID NO: 783 - RNA, 55 nt, Human immunodeficiency virus type 1 (BLAI)
uuuuagggaagaucuggccuuccuacaagggaaggccagggaauuuucuucagag

SEQ ID NO: 784 - RNA, 97 nt, Human immunodeficiency virus type 1 (BLAI)
ggagcucucuggcuaacuagggaacccacugcuuaagccucaauaaagcuugccuugagugcuucaaguagugugugcccgucuguugugugacucu

SEQ ID NO: 785 - RNA, 86 nt, Human immunodeficiency virus type 1 (BLAI)
gcuuuuugccuguacugggucucucugguuagaccagauuugagccugggagcucucuggcuaacuagggaacccacugcuuaagc

SEQ ID NO: 786 - RNA, 69 nt, Human immunodeficiency virus type 1 (BLAI)
guacugggucucucugguuagaccagauuugagccugggagcucucuggcuaacuagggaacccacugc

SEQ ID NO: 787 - RNA, 71 nt, Human immunodeficiency virus type 1 (BLAI)
ggauuuggcuccauggcuuagggcaacauaucuaugaaacuuauggggauacuugggcaggaguggaagcc

SEQ ID NO: 788 - RNA, 55 nt, Human immunodeficiency virus type 1 (BLAI); identical to SEQ ID NO: 772

SEQ ID NO: 789 - RNA, 56 nt, Human immunodeficiency virus type 1 (BLAI)
gucucucugguuagaccagauuugagccugggagcucucuggcuaacuagggaacc

SEQ ID NO: 790 - RNA, 71 nt, Human immunodeficiency virus type 1 (BAL)
uauggcuucauggcuuagggcaacauaucuaugaaacuuauggggauacuugggcaggaguggaagccaua

SEQ ID NO: 791 - RNA, 129 nt, Human immunodeficiency virus type 1 (BAL)
uacuguaauucaacacaacuguuuaauaguacuuggaauguuacugaagagucaaauaacacuguagaaaauaacacaaucacacucccaugcagaauaaaacaaauuauaaacauguggcaggaagua

SEQ ID NO: 792 - RNA, 55 nt, Human immunodeficiency virus type 1 (BAL)
gaacuacacaccagggccagggaccagauuuccacugaccuuuggauggugcuuc

SEQ ID NO: 793 - RNA, 55 nt, Human immunodeficiency virus type 1 (BAL)
uacugaagagucaaauaacacuguagaaaauaacacaaucacacucccaugcaga

SEQ ID NO: 794 - RNA, 65 nt, Human Herpes Virus 4 (Epstein Barr virus)
cuucucccggcguuaucaugguagaauaacagagauuaugagccugaaugaugcucggguagagg

SEQ ID NO: 795 - RNA, 71 nt, Human Herpes Virus 4 (Epstein Barr virus)
gccucugggguccaggagucugcugcggcuaugcagcccauaccuauagauccugggccccccggaggggc

SEQ ID NO: 796 - RNA, 60 nt, Human Herpes Virus 4 (Epstein Barr virus)
uggggguguggcuuugaugacauacugucgugauuguuguuagaccggcacauaccuuca

SEQ ID NO: 797 - RNA, 84 nt, Human Herpes Virus 4 (Epstein Barr virus)
ccgcaucccgccuccgacgccucagaacggcggcgggggugcucccgcgggccgcggauggggcugggggcgauggacugcugg

SEQ ID NO: 798 - RNA, 67 nt, Human Herpes Virus 4 (Epstein Barr virus)
gccaagauuuccuggcuccgugacaagguggcggccgccgucacccugccggagaagauucuugugu

SEQ ID NO: 799 - RNA, 65 nt, Human Herpes Virus 4 (Epstein Barr virus)
acuaacccuaauucaauagcauauguuacccaacgggaagcauaugcuaucgaauuaggguuagu

SEQ ID NO: 800 - RNA, 64 nt, Human Herpes Virus 4 (Epstein Barr virus)
acccccuguuccagauucugaccggcugcaagcgcugccuuaaaggccuggaagcugggugggu

SEQ ID NO: 801 - RNA, 88 nt, Human Herpes Virus 4 (Epstein Barr virus)
cugccugaccgucaccccccgcaggaccaccggccgcaugcaagugcggucgggucccaagcaggggaugauggcauccaagaggcgg

SEQ ID NO: 802 - RNA, 77 nt, Human Herpes Virus 4 (Epstein Barr virus)
cucggucccuguccccagcggggccagcgcggaggaguacucugaccuggcccucuuuguggacgggggcucccggg

SEQ ID NO: 803 - RNA, 67 nt, Human Herpes Virus 4 (Epstein Barr virus)
gccgguggguccgcugggccgcugccccgcuccgggugggggguggccccgcugggcaccgcugcgc

SEQ ID NO: 804 - RNA, 67 nt, Human Herpes Virus 4 (Epstein Barr virus); identical to SEQ ID NO: 803

SEQ ID NO: 805 - RNA, 65 nt, Human Herpes Virus 4 (Epstein Barr virus)
cuggcggguggagauagggaccagaggacuaauguucucuaacugugucccacuccaccugccgg

SEQ ID NO: 806 - RNA, 67 nt, Human Herpes Virus 4 (Epstein Barr virus)
gccuccaucagcucucuuuuccccgggcugguuuugcuggcccuggagcugaaguugauggaugggc

SEQ ID NO: 807 - RNA, 65 nt, Human Herpes Virus 4 (Epstein Barr virus)
ccgguggguccgcugggccgcugccccgcuccgggugggggguggccccgcugggcaccgcugcg

SEQ ID NO: 808 - RNA, 79 nt, Human Herpes Virus 4 (Epstein Barr virus)
ggcucuuaguugcugggccaccagaucucgcuuagaacuacucaucuucauaagucaccauguccgcaacuauggagcc

SEQ ID NO: 809 - RNA, 55 nt, Human Herpes Virus 4 (Epstein Barr virus)
caucucaggagucucuaugucaaagguggucugauaguauuggcuccuggcggug

SEQ ID NO: 810 - RNA, 72 nt, Human Herpes Virus 4 (Epstein Barr virus)
cggggucuauagauggaggauaccaaucaucggggaagagaaugggagccucugggcuauuaugggacuccg

SEQ ID NO: 811 - RNA, 80 nt, Human Herpes Virus 4 (Epstein Barr virus)
cucuccgggcccagcuccagcagcucuucccgugaggcagggagggggcgcugcuggugugaggagccccccuggaguag

SEQ ID NO: 812 - RNA, 69 nt, Human Herpes Virus 4 (Epstein Barr virus)
ccugugggcccccugguggagaauauaaagagcaccuaucugaauaaaaucaccacggugguccacggg

SEQ ID NO: 813 - RNA, 64 nt, Human Herpes Virus 4 (Epstein Barr virus)
gcucacggaccgcucauucccugcauaccucgaggaggucauguaugugaugguucaguagagu

SEQ ID NO: 814 - RNA, 57 nt, Human Herpes Virus 4 (Epstein Barr virus)
cugacggccccuccgugccccuacgccgaaaguucaugggcacaggcggccgugcag

SEQ ID NO: 815 - RNA, 56 nt, Human Herpes Virus 4 (Epstein Barr virus)
ggugucaccggugaugcgccugacguugugccggcugguguugggcuggugacauc

SEQ ID NO: 816 - RNA, 97 nt, Human Herpes Virus 4 (Epstein Barr virus)
cccagaggagugucccggggccaccucuuugguucuguacauauuuuguuauuguacauaaccauggaguuggcuguggugcacuccaucugguaag

SEQ ID NO: 817 - RNA, 87 nt, Human Herpes Virus 4 (Epstein Barr virus)
ccgaggccagccugggcggggcgguugccugggggauaguuggaggaggaggcagguuagccuggccugggucauuaguggcuucgg

SEQ ID NO: 818 - RNA, 68 nt, Human Herpes Virus 4 (Epstein Barr virus)
uucccucaguguuugccagcuuauuuccccaguuuucacguacuggggccuguggacaccugagggag

SEQ ID NO: 819 - RNA, 56 nt, Human Herpes Virus 4 (Epstein Barr virus)
ccccgggugggauccauggcuggauuuccaggaaaggaggccggcccgcccggcgg

SEQ ID NO: 820 - RNA, 55 nt, Human Herpes Virus 4 (Epstein Barr virus)
cccgccuccagcaccgggacucguacgccgagcucgaguacgacugugagguggg

SEQ ID NO: 821 - RNA, 60 nt, Human Herpes Virus 4 (Epstein Barr virus)
gcgauguacccccggggaucgccagugguuguauguucagagcuccguggguaacauugu

SEQ ID NO: 822 - RNA, 64 nt, Human Herpes Virus 4 (Epstein Barr virus)
ggacuggucagcggggacggguuucagucagcagauaacaccccggccuccuccgaccggcucc

SEQ ID NO: 823 - RNA, 55 nt, Human Herpes Virus 4 (Epstein Barr virus)
uucuccagauucagacucuuuagcacuacgugcuugagguacaaaugcuggagag

SEQ ID NO: 824 - RNA, 63 nt, Human Herpes Virus 4 (Epstein Barr virus)
ccaugcuaguacugcagugggccucucuggcugugcugacccuucugcugcugcuggucaugg

SEQ ID NO: 825 - RNA, 62 nt, Human Herpes Virus 4 (Epstein Barr virus)
gccuauggaggggcucuuggcauucucaaucaucgagagcagggcgcacaucuccauaaggu

SEQ ID NO: 826 - RNA, 61 nt, Human Herpes Virus 4 (Epstein Barr virus)
uuaacagggggucucgcggggugccaauugucgccugccuucccccgcuuccccuuguuaa

SEQ ID NO: 827 - RNA, 79 nt, Human Herpes Virus 4 (Epstein Barr virus)
ugggcuggguauucacuagugaaggcaacuaacacaguuagacgugcuaguugugcccacugguguuuauccgguccca

SEQ ID NO: 828 - RNA, 83 nt, Human Herpes Virus 4 (Epstein Barr virus)
guacgccuggauugccggcugggggcuggggucccgggacgcccccucccugcucccacccgguucccucccccagggcgugc

SEQ ID NO: 829 - RNA, 61 nt, Human Herpes Virus 4 (Epstein Barr virus)
gccguguccaaccauuugauuagaaggguagcauccucgggaagugugggugggcugcggu

SEQ ID NO: 830 - RNA, 61 nt, Human Herpes Virus 4 (Epstein Barr virus)
ggggucucagaacccaggaccagacuuugaagucucagguauagguccuggcugagauucu

SEQ ID NO: 831 - RNA, 67 nt, Human Herpes Virus 4 (Epstein Barr virus)
ggauaagaaacacgcuggcuuuuugcuuaaaaaugugcagcuucuccagcgucauuucuuccaaucc

SEQ ID NO: 832 - RNA, 87 nt, Human Herpes Virus 4 (Epstein Barr virus)
aacgcgcgcccaaggcuugggucuccacggugaaauaucucuaaaaauacugaguuaaaauccagauccacauguucgguguguguu

SEQ ID NO: 833 - RNA, 60 nt, Human Herpes Virus 4 (Epstein Barr virus)
gaaugugccggguggauaugccgccugucgguugagaggggcuauugacuggcgcgcuuc

SEQ ID NO: 834 - RNA, 86 nt, Human Herpes Virus 4 (Epstein Barr virus)
uuuugugacugacgagggcaccucuagcuucgugaccaacacaaccgugggcauagagcucccggacgccuucaagugcaucgaag

SEQ ID NO: 835 - RNA, 69 nt, Human Herpes Virus 4 (Epstein Barr virus)
gccuugcguggugcuguccugcugaagggcguuucuuagguucucggucagacggccgcgcugcgaggc

SEQ ID NO: 836 - RNA, 64 nt, Human Herpes Virus 4 (Epstein Barr virus)
aagagggggcucugugggcugggagggccagaggccucagauucagcaguagugcuccccuuuu

SEQ ID NO: 837 - RNA, 62 nt, Human Herpes Virus 4 (Epstein Barr virus)
gacucggccuuaaggcgguggagcaggcgcccggccaggacaucagccucggggucugaguu

SEQ ID NO: 838 - RNA, 62 nt, Human Herpes Virus 4 (Epstein Barr virus)
accuauagguuauuaaccuagugguggaauaggguauugcagcuggguauauaccuauaggu

SEQ ID NO: 839 - RNA, 64 nt, Human Herpes Virus 4 (Epstein Barr virus)
cuggagcagaaggaacagagguagacgaggcacaggcacccccucugaggaccuguugcuucag

SEQ ID NO: 840 - RNA, 61 nt, Human Herpes Virus 4 (Epstein Barr virus)
agcauucccaagcaaacaaaacauguuuaaauuaacccaugucauguuugcggggaauguu

SEQ ID NO: 841 - RNA, 76 nt, Human Herpes Virus 4 (Epstein Barr virus)
ggcccggggaaguggagggggaucgcccgggucucuguuggcagaguccgggcgauccucugagacccuccgggcc

SEQ ID NO: 842 - RNA, 76 nt, Human Herpes Virus 4 (Epstein Barr virus); identical to SEQ ID NO: 841

SEQ ID NO: 843 - RNA, 80 nt, Human Herpes Virus 4 (Epstein Barr virus)
cggcgucccaaggguccgccgccgcccccacacccacagccgucgcggcgggggcggcggcgggcguagaggggccgcug

SEQ ID NO: 844 - RNA, 83 nt, Human Herpes Virus 4 (Epstein Barr virus)
gcgcggccucggcugggacacgggacguggucggcuggcaccaggccuggccaugucacgagacgcagccuccggguccgugc

SEQ ID NO: 845 - RNA, 60 nt, Human Herpes Virus 4 (Epstein Barr virus)
uuauuuucuccaaaucgcuccuugcaacaauggacacgcaagggcgaaugcagaaaauag

SEQ ID NO: 846 - RNA, 62 nt, Human Herpes Virus 4 (Epstein Barr virus)
ccuugaaggccucgguuauugccaccgcccccagguaggcagagggaucuagcccuucgggg

SEQ ID NO: 847 - RNA, 66 nt, Human Herpes Virus 4 (Epstein Barr virus)
gucguggcucucgaagcuggugaccaguucaucaauguuaaaguucacaagcuucucggccauggc

SEQ ID NO: 848 - RNA, 90 nt, Human Herpes Virus 4 (Epstein Barr virus)
aguagucccgcucccacaaacagguuguaaaucuuauuguccgcgaaugugccggguggauaugccgccugucgguugagaggggcuauu

SEQ ID NO: 849 - RNA, 56 nt, Human Herpes Virus 4 (Epstein Barr virus)
cccugggaugagcguuugggagagcugauucugcagcccagagaguagucucaggg

SEQ ID NO: 850 - RNA, 68 nt, Human Herpes Virus 4 (Epstein Barr virus)
auuuggccagcccggggagacagcugcacagggccuaaagaaaaaggucuccaacacgguggucaagu

SEQ ID NO: 851 - RNA, 59 nt, Human Herpes Virus 4 (Epstein Barr virus)
gccucuggggccgcccgggcugccggggucccuccggcuggccugggacccggggaggc

SEQ ID NO: 852 - RNA, 59 nt, Human Herpes Virus 4 (Epstein Barr virus); identical to SEQ ID NO: 851

SEQ ID NO: 853 - RNA, 59 nt, Human Herpes Virus 4 (Epstein Barr virus); identical to SEQ ID NO: 851

SEQ ID NO: 854 - RNA, 59 nt, Human Herpes Virus 4 (Epstein Barr virus); identical to SEQ ID NO: 851

SEQ ID NO: 855 - RNA, 69 nt, Human Herpes Virus 4 (Epstein Barr virus)
cugcguggcuggacggaggacgauagcccaggcacaucuggcaccuguccuugucugcugccaugcacg

SEQ ID NO: 856 - RNA, 64 nt, Human Herpes Virus 4 (Epstein Barr virus)
ggcggagccucaggaggguccccuccauaggguugaaccaggagggggaggauugggcuccgcc

SEQ ID NO: 857 - RNA, 73 nt, Human Herpes Virus 4 (Epstein Barr virus)
uaaucaccguuccucauuuugugugccuccucaaauguuccagaagucggccacaggggagguggcugaauua

SEQ ID NO: 858 - RNA, 92 nt, Human Herpes Virus 4 (Epstein Barr virus)
guggucauguuucccuccaagcggcacagauuagaagaugaugcauaaaauuuuauucuacaucaugccugguucgguggggucgugacuau

SEQ ID NO: 859 - RNA, 57 nt, Human Herpes Virus 4 (Epstein Barr virus)
caccggugaagacacaagggccucuucugccagcccggggcuguugugguacuggug

SEQ ID NO: 860 - RNA, 63 nt, Human Herpes Virus 4 (Epstein Barr virus)
gcggucagagucguacgugagguaaagcccauccgggggcagggccuggccggggcugaccgc

SEQ ID NO: 861 - RNA, 92 nt, Human Herpes Virus 4 (Epstein Barr virus)
gggguuguagagcucuggaaggcccucaucgcaguacacuggcacacugguaaacgugccccgauggcuaggccguccgggcagcaugcccc

SEQ ID NO: 862 - RNA, 71 nt, Human Herpes Virus 4 (Epstein Barr virus)
gagugggacacgacaacggccguaaucuuggagcucaggggggccucguagguguuguuguauuccagcuc

SEQ ID NO: 863 - RNA, 72 nt, Human Herpes Virus 4 (Epstein Barr virus)
cuauguggcuagacguauggccuacccaagacguugggggucucggguaggccaugauucuuccaggcauag

SEQ ID NO: 864 - RNA, 77 nt, Human Herpes Virus 4 (Epstein Barr virus)
ggguggcgguggaguaugcuucgucggggggcugggccugcagccgugccccgccgaugcgcgccucuaugucgcuc

SEQ ID NO: 865 - RNA, 62 nt, Human Herpes Virus 4 (Epstein Barr virus)
cgggguuugcccaacucuuauucuucccguuaacaggaagaaugauggugggggaaccaccg

SEQ ID NO: 866 - RNA, 56 nt, Human Herpes Virus 4 (Epstein Barr virus)
cgggcgcagccaugcgugaccgugaugagggggcagggucgcagggggugugucug

SEQ ID NO: 867 - RNA, 58 nt, Human Herpes Virus 4 (Epstein Barr virus)
uauuuucugcauucgcccuugcguguccauuguugcaaggagcgauuuggagaaaaua

SEQ ID NO: 868 - RNA, 58 nt, Human Herpes Virus 4 (Epstein Barr virus); identical to SEQ ID NO: 867

SEQ ID NO: 869 - RNA, 62 nt, Human Herpes Virus 4 (Epstein Barr virus)
ucucuaaugcguagcagccacucucuaagagacuacauuggaagguggcuggugauuggagg

SEQ ID NO: 870 - RNA, 89 nt, Human Herpes Virus 4 (Epstein Barr virus)
ccccugcgugucggcccgcugugcccgcaccgccagaggcgcauucaccaggcagcgcgggaggcagauguuggccagauugcaggugg

SEQ ID NO: 871 - RNA, 62 nt, Human Herpes Virus 4 (Epstein Barr virus)
cccggaggugccccggccggcuggggcacgagagcccggcccguccggcgcccucucggacg

SEQ ID NO: 872 - RNA, 59 nt, Human Herpes Virus 4 (Epstein Barr virus)
gaggugaagguagccguggagggcaacagcagucaggacucugcgguggccauugccuc

SEQ ID NO: 873 - RNA, 62 nt, Human Herpes Virus 4 (Epstein Barr virus)
uacggguaguagcacuggugguggaggaggaccugguggugacauugcuagucacacccgug

SEQ ID NO: 874 - RNA, 72 nt, Human Herpes Virus 4 (Epstein Barr virus)
cccggggaaguggagggggaucgcccgggucucuguuggcagaguccgggcgauccucugagacccuccggg

SEQ ID NO: 875 - RNA, 72 nt, Human Herpes Virus 4 (Epstein Barr virus); identical to SEQ ID NO: 874

SEQ ID NO: 876 - RNA, 59 nt, Human Herpes Virus 4 (Epstein Barr virus)
ccugucacuucccaagcccuggcaccugccagugaccugcguugggaaaaaugacaagg

SEQ ID NO: 877 - RNA, 58 nt, Human Herpes Virus 4 (Epstein Barr virus)
aggugaacagcggcccaccgguuuccagcgauacgucgaugggcagcuauauucaccu

SEQ ID NO: 878 - RNA, 58 nt, Human Herpes Virus 4 (Epstein Barr virus)
aggccagccggagggaccccggcagcccgggcgagucgccuucccucuccccuggccu

SEQ ID NO: 879 - RNA, 61 nt, Human Herpes Virus 4 (Epstein Barr virus)
uuaaccugaucagccccggaguugccuguuucaucacuaaccccgggccugaagagguuga

SEQ ID NO: 880 - RNA, 93 nt, Human Herpes Virus 4 (Epstein Barr virus)
gagccaggcgggcggccaugucuuccaugcucaugucaacagccuuaacagaaggcaaucugacuuugcguggagcugacaugcuauugguuu

SEQ ID NO: 881 - RNA, 78 nt, Human Herpes Virus 4 (Epstein Barr virus)
cuggcacgguggcuugggcugugguaaccggugggcucguaaaaguccagcggggccgcaguuugcuagaagugcugg

SEQ ID NO: 882 - RNA, 60 nt, Human Herpes Virus 4 (Epstein Barr virus)
ccgccaguagguagcagccggcuuucaguccuuggacggccgugugcaugccuuuggugg

SEQ ID NO: 883 - RNA, 59 nt, Human Herpes Virus 4 (Epstein Barr virus)
gaguccgucaucggggucggggucccacguguauggggccgggggcuccaugcggauuu

SEQ ID NO: 884 - RNA, 91 nt, Human Herpes Virus 4 (Epstein Barr virus)
ggcucuguaacauuuggugggaccugaugcugcuggugugcuguaaauaagugccuagcacaucacguaggcaccaggugucaccagggcu

SEQ ID NO: 885 - RNA, 83 nt, Human Herpes Virus 4 (Epstein Barr virus)
ccucuugucggacgaggaggaagagacuucacagagcagcagcuacacucuggggucucaggccucccagucuauccaggagg

SEQ ID NO: 886 - RNA, 64 nt, Human Herpes Virus 4 (Epstein Barr virus)
caccuuaucuggcacgggugcuggcugucacggccguggcccugcuccugauguuucugaggug

SEQ ID NO: 887 - RNA, 67 nt, Human Herpes Virus 4 (Epstein Barr virus)
gggaguuuuccgggcugcgaguaauuggugaugaggacgaggaugguucggaggauggggaauuuuc

SEQ ID NO: 888 - RNA, 84 nt, Human Herpes Virus 4 (Epstein Barr virus)
cuucaguuugugcuuguggaccucucagaguuucaggacgauuuaccuggaugcuggacggagauuuacaugcaggcauugaag

SEQ ID NO: 889 - RNA, 56 nt, Human Herpes Virus 4 (Epstein Barr virus)
gcgugcaccuggaagaugcagcugggguagaucuuuacaucuuuacagggcgcagc

SEQ ID NO: 890 - RNA, 62 nt, Human Herpes Virus 4 (Epstein Barr virus)
ggggggauccgggccacucgggucucgguggggcuggacuugagggcccaaagaggccccuc

SEQ ID NO: 891 - RNA, 95 nt, Human Herpes Virus 4 (Epstein Barr virus)
cggcggaauaucggugggaggcauaggccccacuccccuccuuucccugguauauuccgugggugccugugucaccgcugaggcggccauggccg

SEQ ID NO: 892 - RNA, 73 nt, Human Herpes Virus 4 (Epstein Barr virus)
ggguccagggggcagccgcggcccagcgcgccccguucacgggggaggaccgcggccgagccaccaggggccc

SEQ ID NO: 893 - RNA, 81 nt, Human Herpes Virus 4 (Epstein Barr virus)
ggcggccgccgguggguccgcugggccgcugccccgcuccgggugggggguggccccgcugggcaccgcugcgccgccgcc

SEQ ID NO: 894 - RNA, 81 nt, Human Herpes Virus 4 (Epstein Barr virus); identical to SEQ ID NO: 893

SEQ ID NO: 895 - RNA, 81 nt, Human Herpes Virus 4 (Epstein Barr virus); identical to SEQ ID NO: 893

SEQ ID NO: 896 - RNA, 81 nt, Human Herpes Virus 4 (Epstein Barr virus); identical to SEQ ID NO: 893

SEQ ID NO: 897 - RNA, 64 nt, Human Herpes Virus 4 (Epstein Barr virus)
gccauccgugggacuaaucauaaagccaaauugacgguuggcggaugcguccccgcagaugagc

SEQ ID NO: 898 - RNA, 90 nt, Human Herpes Virus 4 (Epstein Barr virus)
ggcggccaugcuaucggugcaacggggcagggggaggguggcggccauucccgccucucugcccuguuugcccgggagcgucgccuggcc

SEQ ID NO: 899 - RNA, 64 nt, Human Herpes Virus 4 (Epstein Barr virus)
gcuguacauccagcugcuguaugccugguaacccauaggccauccggcggccaggguuugcagu

SEQ ID NO: 900 - RNA, 64 nt, Human Herpes Virus 4 (Epstein Barr virus)
cugcugcagcuauggggucccuagaaauggugccaaugggcgcgggucccccuagccccggcgg

SEQ ID NO: 901 - RNA, 68 nt, Human Herpes Virus 4 (Epstein Barr virus)
ggcuggccugccuggaucugagcuauguggaaaugagggaauuugugguuuggggcaggcccccagcu

SEQ ID NO: 902 - RNA, 74 nt, Human Herpes Virus 4 (Epstein Barr virus)
ccgggccguggaaugagggccugagucucuuuaagcugcacaaggagcugaagcgcgccccauccgaagcccgg

SEQ ID NO: 903 - RNA, 63 nt, Human Herpes Virus 4 (Epstein Barr virus)
gguggcggucgccggggguggcaguggaggggggagcuucagcuggucuggguggcggccgcc

SEQ ID NO: 904 - RNA, 55 nt, Human Herpes Virus 4 (Epstein Barr virus)
ggccuugucugccucgggucucgccgcuaguugguccaggguccaggagaaggcu

SEQ ID NO: 905 - RNA, 72 nt, Human Herpes Virus 4 (Epstein Barr virus)
uggugggaccugaugcugcuggugugcuguaaauaagugccuagcacaucacguaggcaccaggugucacca

SEQ ID NO: 906 - RNA, 72 nt, Human Herpes Virus 4 (Epstein Barr virus); identical to SEQ ID NO: 905

SEQ ID NO: 907 - RNA, 87 nt, Human Herpes Virus 4 (Epstein Barr virus)
gaaaagggggcgaucugauucaggcaggagucuucugcuaucauaaguugcgaggaggcuuuaauguuggacucaggcccgcuuuuu

SEQ ID NO: 908 - RNA, 61 nt, Human Herpes Virus 4 (Epstein Barr virus)
gugccugaccaagugcuccuugcuucccacgguggggugugacaggaugcuugugaggcau

SEQ ID NO: 909 - RNA, 74 nt, Human Herpes Virus 4 (Epstein Barr virus)
cacuggugguggaggaggaccugguggugacauugcuagucacacccguggagguuccuguuccggccucggug

SEQ ID NO: 910 - RNA, 71 nt, Human Herpes Virus 4 (Epstein Barr virus)
ccugauugcugagaaccugcugcuaguggcgcugcguggcaccaacaacgaucccaggccucagcgucagg

SEQ ID NO: 911 - RNA, 55 nt, Human Herpes Virus 4 (Epstein Barr virus)
cccugguccgucuccccuccucccaacugcuggagccggucggaggaggccgggg

SEQ ID NO: 912 - RNA, 79 nt, Human Herpes Virus 4 (Epstein Barr virus)
ggccccuggugcccccacguacugcaggaugucgugcgcauaggugcugacucugacaugggcgggggugcccggggcc

SEQ ID NO: 913 - RNA, 70 nt, Human Herpes Virus 4 (Epstein Barr virus)
acccggucccuccggggggcagagacaggcagggccccccggcagcuggccccgaggaggcgcccggagu

SEQ ID NO: 914 - RNA, 70 nt, Human Herpes Virus 4 (Epstein Barr virus); identical to SEQ ID NO: 913

SEQ ID NO: 915 - RNA, 83 nt, Human Herpes Virus 4 (Epstein Barr virus)
gugcuuucggauuggaagaaaugacgcuggagaagcugcacauuuuuaagcaaaaagccagcguguuucuuauccccaggcgc

SEQ ID NO: 916 - RNA, 68 nt, Human Herpes Virus 4 (Epstein Barr virus)
cacgugucuaucugugcccugggucgucggcgcggcaccacggcagucuacgguacagaccuugcgug

SEQ ID NO: 917 - RNA, 70 nt, Human Herpes Virus 4 (Epstein Barr virus)
cacuuagccgcuucagcugggcagcaugcuuggauaacuuacuaaacucgcgcccaugggcggccaggug

SEQ ID NO: 918 - RNA, 55 nt, Human Herpes Virus 4 (Epstein Barr virus)
cccgcaguuguagacugucauuuuuaugggcgagugggcgguccacacgcgcggg

SEQ ID NO: 919 - RNA, 81 nt, Human Herpes Virus 4 (Epstein Barr virus)
uggugaccuaacacccgcccaucaccaccggacagauucugaacuuguccugugguguuuggugugguuuugggguacgca

SEQ ID NO: 920 - RNA, 69 nt, Human Herpes Virus 4 (Epstein Barr virus)
guuccaggucagaccuacgccauuaagaacaaguaccagcccuuuuuccaguggcaugggaccgggagc

SEQ ID NO: 921 - RNA, 61 nt, Human Herpes Virus 4 (Epstein Barr virus)
gggccagauuuguuguaggagcagcgagccgcgucguugcccugaccgcgcgucgaggccc

SEQ ID NO: 922 - RNA, 78 nt, Human Herpes Virus 4 (Epstein Barr virus)
ggaccagggucaacagguggucgugggauggcggggccuugucugccucgggucucgccgcuaguugguccagggucc

SEQ ID NO: 923 - RNA, 56 nt, Human Herpes Virus 4 (Epstein Barr virus)
gguucacguccagcuucuccaugcagaguuuucugaggagggcugggcccggggcu

SEQ ID NO: 924 - RNA, 56 nt, Human Herpes Virus 4 (Epstein Barr virus)
ggcccagaugucccucuaucauggcgcagacauucuccacgguggggggcaggguc

SEQ ID NO: 925 - RNA, 87 nt, Human Herpes Virus 4 (Epstein Barr virus)
ggggcauacuggggagacggcgggggagguuuccucaggcuuggcuaagugcaaggaucccaugcccccgcgguuuugcuuggcccc

SEQ ID NO: 926 - RNA, 85 nt, Human Herpes Virus 4 (Epstein Barr virus)
uugcgcgucccgcgccugcccuccgccaucaggcguucccacgggggcgccccuggcagagagguggcagcgggccaauucguag

SEQ ID NO: 927 - RNA, 74 nt, Human Herpes Virus 4 (Epstein Barr virus)
guguucuaacgggaaguguguaagcacacacguaauuugcaagcggugcuucacgcucuucguuaaaauaacac

SEQ ID NO: 928 - RNA, 72 nt, Human Herpes Virus 4 (Epstein Barr virus)
cuaugccuggaagaaucauggccuacccgagacccccaacgucuuggguaggccauacgucuagccacauag

SEQ ID NO: 929 - RNA, 79 nt, Human Herpes Virus 4 (Epstein Barr virus)
gugggcccaaugggguaguagguuuugggagggugccgugcuagauauuucaacugccacagaccccauuuugucccac

SEQ ID NO: 930 - RNA, 56 nt, Human Herpes Virus 4 (Epstein Barr virus)
gcccgcggccauugggcccagauugagagaccaguccaggggcccgagguuggagc

SEQ ID NO: 931 - RNA, 66 nt, Human Herpes Virus 4 (Epstein Barr virus)
ccgccggggucccuccggccggccugauggacccgguggggaggcaagcugagggggcucgggugg

SEQ ID NO: 932 - RNA, 66 nt, Human Herpes Virus 4 (Epstein Barr virus); identical to SEQ ID NO: 931

SEQ ID NO: 933 - RNA, 66 nt, Human Herpes Virus 4 (Epstein Barr virus); identical to SEQ ID NO: 931

SEQ ID NO: 934 - RNA, 70 nt, Human Herpes Virus 4 (Epstein Barr virus)
ccugggugugguggaguguugggcuuagcagaaaaaauuaaaguccacuuaccucuggcccgauaccggg

SEQ ID NO: 935 - RNA, 63 nt, Human Herpes Virus 4 (Epstein Barr virus)
ucgaggauacgggcgccagagucacagguggaggaggucccaggccuggcgucacgcacucgg

SEQ ID NO: 936 - RNA, 65 nt, Human Herpes Virus 4 (Epstein Barr virus)
gcuccggcucguggaguccgcaccuccuucugugcacgaaguuuugcggaaccaggagaaggggu

SEQ ID NO: 937 - RNA, 60 nt, Human Herpes Virus 4 (Epstein Barr virus)
cuggagguauccuaagcuccgccccuauauaccagguggguggagcuagguaggauucag

SEQ ID NO: 938 - RNA, 59 nt, Human Herpes Virus 4 (Epstein Barr virus)
gccgcugaccuaggacugaccugggcuuaugcagacgaguucauccugggcuuuguggc

SEQ ID NO: 939 - RNA, 92 nt, Human Herpes Virus 4 (Epstein Barr virus)
ccagauggagugcaccacagccaacuccaugguuauguacaauaacaaaauauguacagaaccaaagagguggccccgggacacuccucugg

SEQ ID NO: 940 - RNA, 84 nt, Human Herpes Virus 4 (Epstein Barr virus)
cccgcuucgguucucucugacuaggcucugauuuuccagcccauggagaucuagagucgaguuccaguuugacacggccgcggg

SEQ ID NO: 941 - RNA, 70 nt, Human Herpes Virus 4 (Epstein Barr virus)
gguggugacaggagggucgaccuccggcgaccuagugguccccuccggaucccccuccucucuauccacc

SEQ ID NO: 942 - RNA, 93 nt, Human Herpes Virus 4 (Epstein Barr virus)
cggccuaggcccggggaaguggagggggaucgcccgggucucuguuggcagaguccgggcgauccucugagacccuccgggcccggacggucg

SEQ ID NO: 943 - RNA, 70 nt, Human Herpes Virus 4 (Epstein Barr virus)
cacugucuacgaccccauagauugugacaguucuaguucaucuguacaaucuaggaaaccguaaucagug

SEQ ID NO: 944 - RNA, 71 nt, Human Herpes Virus 4 (Epstein Barr virus)
ggagguccguggaguaguggcggggggaggaugaaacgcucuuuuccuucaccgcuaccaccgccuccucc

SEQ ID NO: 945 - RNA, 58 nt, Human Herpes Virus 4 (Epstein Barr virus)
cguagucugucuugaggagauguagacuuguagacacugcaaaaccucaggaccuacg

SEQ ID NO: 946 - RNA, 67 nt, Human Herpes Virus 4 (Epstein Barr virus)
cgcggugucggccagcgguggcguggcuucgggguugucgugguuggcgggugucgcagagggagag

SEQ ID NO: 947 - RNA, 101 nt, Human Herpes Virus 4 (Epstein Barr virus)
aggcauuguuaaccuuugguggaaccuaguguuaguguugugcuguaaauaaguguccagcgcaccacuagucaccaggugucaccggaggcuacuugccu

SEQ ID NO: 948 - RNA, 101 nt, Human Herpes Virus 4 (Epstein Barr virus); identical to SEQ ID NO: 947

SEQ ID NO: 949 - RNA, 101 nt, Human Herpes Virus 4 (Epstein Barr virus); identical to SEQ ID NO: 947

SEQ ID NO: 950 - RNA, 62 nt, Human Herpes Virus 4 (Epstein Barr virus)
gccaauuuucuucgcacguccugcccccccgugcugggcagucagggccuggaagucuuggc

SEQ ID NO: 951 - RNA, 55 nt, Human Herpes Virus 4 (Epstein Barr virus)
uggaagucuuggcggcguugguauuuaaaaaccagcgaucccugagaacgcucca

SEQ ID NO: 952 - RNA, 71 nt, Human Herpes Virus 4 (Epstein Barr virus)
caccaggguccggccugggagcgcacccccauccccgccggagcggggcagcggacccagcggacccggug

SEQ ID NO: 953 - RNA, 66 nt, Human Herpes Virus 4 (Epstein Barr virus)
guccaggucuggcaggucgcaggugggcuccccaugcaccaccuuggccuccuuggccgugaggac

SEQ ID NO: 954 - RNA, 65 nt, Human Herpes Virus 4 (Epstein Barr virus)
cgguaucgacggcugcggcggcggaggcggcggcagucgcccccgaagucgcggcccggaggcug

SEQ ID NO: 955 - RNA, 79 nt, Human Herpes Virus 4 (Epstein Barr virus)
gggcaaggagcuguuuggcucggcuguggagcaggcuucccugcaauuuuacaagcggccacaaggggguucccggccu

SEQ ID NO: 956 - RNA, 62 nt, Human Herpes Virus 4 (Epstein Barr virus)
cuggaaacucuccggguagccggcacacaucgugccccuuuacccugcccaggggagcccag

SEQ ID NO: 957 - RNA, 69 nt, Human Herpes Virus 4 (Epstein Barr virus)
ggugacaccuggugacuaguggugcgcuggacacuuauuuacagcacaacacuaacacuagguuccacc

SEQ ID NO: 958 - RNA, 92 nt, Human Herpes Virus 4 (Epstein Barr virus)
ggcgacugcuccgguagagcucgucgaugaucuccacgaugccuaggguggcguagacaucugucacgaguuccaccggugaaagcucugcc

SEQ ID NO: 959 - RNA, 57 nt, Human Herpes Virus 4 (Epstein Barr virus)
uaguaggguccagucucaggcccccucacuuugggucuuagaaugguggccgggcug

SEQ ID NO: 960 - RNA, 68 nt, Human Herpes Virus 4 (Epstein Barr virus)
gcccagggggcucuacucgggagucucuggccccgccuuugagguccugagagacaugcaccaggggc

SEQ ID NO: 961 - RNA, 92 nt, Human Herpes Virus 4 (Epstein Barr virus)
ggucagagccagacuggguggugucugcagcaaaagaggaacuugcccaggcagucaguuauuuugcaugccaccucccugccugguggacu

SEQ ID NO: 962 - RNA, 55 nt, Human Herpes Virus 4 (Epstein Barr virus)
cuggaguuacugggugggagacagggauguauguggucccccgcugguaugccag

SEQ ID NO: 963 - RNA, 62 nt, Human Herpes Virus 4 (Epstein Barr virus)
ggguaugccauucccugagcugcuaggugaaugguuggggguucugggacuugcgccgaccc

SEQ ID NO: 964 - RNA, 87 nt, Human Herpes Virus 4 (Epstein Barr virus)
cagcauaguugucacuacgggacccaugaaguguuacagaauccaaguuacuguuuccaauucaggguccaguacaaacaacagcug

SEQ ID NO: 965 - RNA, 61 nt, Human Herpes Virus 4 (Epstein Barr virus)
ggccccccggcagcuggccccgaggaggcgcccggaguggggccggucggcugggcuggcc

SEQ ID NO: 966 - RNA, 66 nt, Human Herpes Virus 4 (Epstein Barr virus)
gggccauaguggcggcaguaugcucgaagcauugggcaauauaaauuacuggcgugaauugugccc

SEQ ID NO: 967 - RNA, 64 nt, Human Herpes Virus 4 (Epstein Barr virus)
guuccuggcccugggcaacagcuuuuacuuuauggugggggacauggugcugggagccgugaac

SEQ ID NO: 968 - RNA, 71 nt, Human Herpes Virus 4 (Epstein Barr virus)
ggcucugguccacaaagggggcccugucccgggacaucugaaucagguccuccugguuguaaucaaaggcc

SEQ ID NO: 969 - RNA, 62 nt, Human Herpes Virus 4 (Epstein Barr virus)
gcuccgggcuaucgugacgggucuccaaaaauuguggguggauucgugcggauguccagagu

SEQ ID NO: 970 - RNA, 74 nt, Human Herpes Virus 4 (Epstein Barr virus)
cggccgccgguggguccgcugggccgcugccccgcuccgggugggggguggccccgcugggcaccgcugcgccg

SEQ ID NO: 971 - RNA, 74 nt, Human Herpes Virus 4 (Epstein Barr virus); identical to SEQ ID NO: 970

SEQ ID NO: 972 - RNA, 81 nt, Human Herpes Virus 4 (Epstein Barr virus)
uggccaagacacgccgcucguggaccacgccaucuuccucccggcugauuguguggcugacggugccguguuccaccgcca

SEQ ID NO: 973 - RNA, 75 nt, Human Herpes Virus 4 (Epstein Barr virus)
gaggcccggagcuccggccguguggccgaggaugacuaugacuucucgagccuggcuuuggagcucuugccccuc

SEQ ID NO: 974 - RNA, 90 nt, Human Herpes Virus 4 (Epstein Barr virus)
uaggccugcgucccacuaaggggacaccaggcauacaaggacuggguaauaaccuuguaugccugcguccucuuagggugccacauccug

SEQ ID NO: 975 - RNA, 96 nt, Human Herpes Virus 4 (Epstein Barr virus)
ggcuccagcagaacgucgcagacccagcccuccucggcccuguccaccuguauguccaggugcacggacccggaggcugcgucucgugacauggcc

SEQ ID NO: 976 - RNA, 79 nt, Human Herpes Virus 4 (Epstein Barr virus)
cggcccccgggaagucccugggcacccucaacaaucccgccaccguccagauccaauuugccuacgacucccugcgccg

SEQ ID NO: 977 - RNA, 78 nt, Human Herpes Virus 4 (Epstein Barr virus)
ugugccgcuuggagggaaacaugaccaccugaagucuguuaaccaggucagugguuuuguuuccuugauagagacaca

SEQ ID NO: 978 - RNA, 93 nt, Human Herpes Virus 4 (Epstein Barr virus)
ggcacguucagcgcggccgucgugggcaguagucccgcucccacaaacagguuguaaaucuuauuguccgcgaaugugccggguggauaugcc

SEQ ID NO: 979 - RNA, 91 nt, Human Herpes Virus 4 (Epstein Barr virus)
cggacgcaggggcucgcuggugugggcccagagggggugauccgcgaugccccggcucucccugagggccggcaccaggaggcgccuucug

SEQ ID NO: 980 - RNA, 65 nt, Human Herpes Virus 4 (Epstein Barr virus)
ggguggccggcugcagccggguccgggguuccggcccuggagcucggggggcggccggguggccc

SEQ ID NO: 981 - RNA, 65 nt, Human Herpes Virus 4 (Epstein Barr virus); identical to SEQ ID NO: 980

SEQ ID NO: 982 - RNA, 65 nt, Human Herpes Virus 4 (Epstein Barr virus); identical to SEQ ID NO: 980

SEQ ID NO: 983 - RNA, 65 nt, Human Herpes Virus 4 (Epstein Barr virus); identical to SEQ ID NO: 980

SEQ ID NO: 984 - RNA, 65 nt, Human Herpes Virus 4 (Epstein Barr virus); identical to SEQ ID NO: 980

SEQ ID NO: 985 - RNA, 65 nt, Human Herpes Virus 4 (Epstein Barr virus)
ccgcgcgggcgcagccaugcgugaccgugaugagggggcagggucgcagggggugugucuggugg

SEQ ID NO: 986 - RNA, 65 nt, Human Herpes Virus 4 (Epstein Barr virus); identical to SEQ ID NO: 985

SEQ ID NO: 987 - RNA, 66 nt, Human Herpes Virus 4 (Epstein Barr virus)
uccgguggccgggacuguuucguugggucaucuggagucugacuuggcugaaccaccggccaugga

SEQ ID NO: 988 - RNA, 60 nt, Human Herpes Virus 4 (Epstein Barr virus)
ccgaggggcagggaggcagcucuuggcacugcgcguccagcugcaauaccugcuuguugg

SEQ ID NO: 989 - RNA, 74 nt, Human Herpes Virus 4 (Epstein Barr virus)
gggcgcgggccguacuuugguuguggaccaggcccaagaacucggggugcggccagagggcggcucggguaucc

SEQ ID NO: 990 - RNA, 90 nt, Human Herpes Virus 4 (Epstein Barr virus)
cauugguagccguucgugugauaaugagugucuugggggccgugccaagacccgagacaguaaugucaaauguccgauugcucgcaaaug

SEQ ID NO: 991 - RNA, 86 nt, Human Herpes Virus 4 (Epstein Barr virus)
ucagguguggaauuuagauagagugggugugugcucuuguuuaauuacaccaagaucaccacccucuauccauaucccacaauuga

SEQ ID NO: 992 - RNA, 86 nt, Human Herpes Virus 4 (Epstein Barr virus)
gcaugggcaaccggguuccauggcacauuuagagauaaacauagaugucuugucuugcucaugugcagaggaggggguguuggugu

SEQ ID NO: 993 - RNA, 55 nt, Human Herpes Virus 4 (Epstein Barr virus)
ccacgucccggggacggaagcuggauuuuggccagucuucaauuuuggggagugg

SEQ ID NO: 994 - RNA, 55 nt, Human Herpes Virus 4 (Epstein Barr virus)
ugggggaggucuuuggcuccucggcaugggcggagcagaccgaggcuuuugccca

SEQ ID NO: 995 - RNA, 71 nt, Human Herpes Virus 4 (Epstein Barr virus)
gggagcggagaccaggagggcgccuggaggcgggcccgaggggcucuggggugcccgaggucccugguucc

SEQ ID NO: 996 - RNA, 60 nt, Human Herpes Virus 4 (Epstein Barr virus)
ucucguugagcccggccgagagcagaaccguggccaccugcucgauggcggcuggagaga

SEQ ID NO: 997 - RNA, 92 nt, Human Herpes Virus 4 (Epstein Barr virus)
ugaggaugcagcuggccagaguggaguuuuccaccccggcaaagcgcauaaagggcguggagcagcacaccgucugggagguuaggugcuca

SEQ ID NO: 998 - RNA, 96 nt, Human Herpes Virus 4 (Epstein Barr virus)
ccccgauauaccuaguggguggagccuagagguagguauccauaggguuccauuauccuggagguauccuaagcuccgccccuauauaccaggugg

SEQ ID NO: 999 - RNA, 79 nt, Human Herpes Virus 4 (Epstein Barr virus)
ucaugccuccagcugccccugaccaguuaggacccuugacggaugucuuuaacggcgcggugcaguuggucaccaauga

SEQ ID NO: 1000 - RNA, 64 nt, Human Herpes Virus 4 (Epstein Barr virus)
gucaggucuggaccaggcccgguggggcuccucccuugcccuaucguaccugggaucgaaugac

SEQ ID NO: 1001 - RNA, 61 nt, Human Herpes Virus 4 (Epstein Barr virus)
cugggucuguggaggccgguggugggcucugaagugccuuguccggcuuuuguagguccgg

SEQ ID NO: 1002 - RNA, 77 nt, Human Herpes Virus 4 (Epstein Barr virus)
gcucguagguggggccuauguuuucacauaacaguuucaagcaggucucugggaugugaagggaggugcccuggagc

SEQ ID NO: 1003 - RNA, 86 nt, Human Herpes Virus 4 (Epstein Barr virus)
ggcuucuguugggucagacaguuuggugcgcuaguugugugcuuagcagcaacgcacaccaggcugacugccuuagcaguguggcc

SEQ ID NO: 1004 - RNA, 87 nt, Human Herpes Virus 4 (Epstein Barr virus)
cagcuguuguuuguacuggacccugaauuggaaacaguaacuuggauucuguaacacuucaugggucccguagugacaacuaugcug

SEQ ID NO: 1005 - RNA, 59 nt, Human Herpes Virus 4 (Epstein Barr virus)
gcccucuauaggcaccuggggcgcuaccucuuucagcgagccgggguggguguaggggu

SEQ ID NO: 1006 - RNA, 80 nt, Human Herpes Virus 4 (Epstein Barr virus)
gauauugcacagagucagcgccugccccucccucgagaacccaagguggaggcucugcacgccuggcuccccucacuguc

SEQ ID NO: 1007 - RNA, 78 nt, Human Herpes Virus 4 (Epstein Barr virus)
cccguggggggucuuaguggaagugacgugcugugaauacagguccauagcaccgcuauccacuaugucucgcccggg

SEQ ID NO: 1008 - RNA, 78 nt, Human Herpes Virus 4 (Epstein Barr virus); identical to SEQ ID NO: 1007

SEQ ID NO: 1009 - RNA, 64 nt, Human Herpes Virus 4 (Epstein Barr virus)
ccgguacccuacgcugccgauuuacauaauauaaauuguaaaugcugcaguaguagggaucugg

SEQ ID NO: 1010 - RNA, 91 nt, Human Herpes Virus 4 (Epstein Barr virus)
ggccuaggcccggggaaguggagggggaucgcccgggucucuguuggcagaguccgggcgauccucugagacccuccgggcccggacgguc

SEQ ID NO: 1011 - RNA, 91 nt, Human Herpes Virus 4 (Epstein Barr virus); identical to SEQ ID NO: 1010

SEQ ID NO: 1012 - RNA, 56 nt, Human Herpes Virus 4 (Epstein Barr virus)
gcgguauauggugugaugucguguggaggcaaccauggcggcacauugucuuccgu

SEQ ID NO: 1013 - RNA, 74 nt, Human Herpes Virus 4 (Epstein Barr virus)
guguuauuuuaacgaagagcgugaagcaccgcuugcaaauuacgugugugcuuacacacuucccguuagaacac

SEQ ID NO: 1014 - RNA, 85 nt, Human Herpes Virus 4 (Epstein Barr virus)
cuccuauagugacuuuauucaaguuuuggccacguuuaccgcagacccgggggacaccauagucuggaugaaguuaaacguggag

SEQ ID NO: 1015 - RNA, 80 nt, Human Herpes Virus 4 (Epstein Barr virus)
gacuuccagacuauuuucugcauucgcccuugcguguccauuguugcaaggagcgauuuggagaaaauaaacugugaguu

SEQ ID NO: 1016 - RNA, 63 nt, Human Herpes Virus 4 (Epstein Barr virus)
gcugucccucguaggucuuggugucguugauaaagcugaaggacaccagggggcgcgaguagc

SEQ ID NO: 1017 - RNA, 78 nt, Human Herpes Virus 4 (Epstein Barr virus)
cggguccaccaggccagccggagggaccccggcagcccgggcgagucgccuucccucuccccuggccucuccuucccg

SEQ ID NO: 1018 - RNA, 78 nt, Human Herpes Virus 4 (Epstein Barr virus); identical to SEQ ID NO: 1017

SEQ ID NO: 1019 - RNA, 78 nt, Human Herpes Virus 4 (Epstein Barr virus); identical to SEQ ID NO: 1017

SEQ ID NO: 1020 - RNA, 78 nt, Human Herpes Virus 4 (Epstein Barr virus); identical to SEQ ID NO: 1017

SEQ ID NO: 1021 - RNA, 78 nt, Human Herpes Virus 4 (Epstein Barr virus); identical to SEQ ID NO: 1017

SEQ ID NO: 1022 - RNA, 78 nt, Human Herpes Virus 4 (Epstein Barr virus); identical to SEQ ID NO: 1017

SEQ ID NO: 1023 - RNA, 82 nt, Human Herpes Virus 4 (Epstein Barr virus)
gcgguugucacaggugcuagacccuggaguugaaccaguaccacucgguuacaaagucauggucuaguaguugugacccugc

SEQ ID NO: 1024 - RNA, 58 nt, Human Herpes Virus 4 (Epstein Barr virus)
gucauuuagaaaccuugccuacgggcgcaccuguguccugggcaaggagcuguuuggc

SEQ ID NO: 1025 - RNA, 91 nt, Human Herpes Virus 4 (Epstein Barr virus)
gauguuaacuccgucgcggucuacauacacgcgcgucagcccaucuuuugucaucuugaccgcguuguagcacugguagaugguauccauc

SEQ ID NO: 1026 - RNA, 91 nt, Human Herpes Virus 4 (Epstein Barr virus)
cacuuucuuggggugcuucugcuucugccuggccuccgacgauguccuuuuccucgcgagcugaacagccagaggccucuccagugcggug

SEQ ID NO: 1027 - RNA, 63 nt, Human Herpes Virus 4 (Epstein Barr virus)
ucgaggucuccccugacgcuguggccgaguggcagaaucaccagagcccagaggaggccccgg

SEQ ID NO: 1028 - RNA, 97 nt, Human Herpes Virus 4 (Epstein Barr virus)
agcaguugugguuauaggggcgcuagucguggucaaggucguagacugguuugugcuaggacccgaugccgacggugaugguguagucacagccguu

SEQ ID NO: 1029 - RNA, 77 nt, Human Herpes Virus 4 (Epstein Barr virus)
gucacgguuguaggcgggguuaagcgugcaucuucugggaugcaacguuaagccccguuuagguggaacugcgggau

SEQ ID NO: 1030 - RNA, 61 nt, Human Herpes Virus 4 (Epstein Barr virus)
cggagaccaggagggcgccuggaggcgggcccgaggggcucuggggugcccgaggucccug

SEQ ID NO: 1031 - RNA, 61 nt, Human Herpes Virus 4 (Epstein Barr virus); identical to SEQ ID NO: 1030

SEQ ID NO: 1032 - RNA, 88 nt, Human Herpes Virus 4 (Epstein Barr virus)
aggauguggcacccuaagaggacgcaggcauacaagguuauuacccaguccuuguaugccugguguccccuuagugggacgcaggccu

SEQ ID NO: 1033 - RNA, 56 nt, Human Herpes Virus 4 (Epstein Barr virus)
gggauccgggccacucgggucucgguggggcuggacuugagggcccaaagaggccc

SEQ ID NO: 1034 - RNA, 56 nt, Human Herpes Virus 4 (Epstein Barr virus); identical to SEQ ID NO: 1033

SEQ ID NO: 1035 - RNA, 95 nt, Human Herpes Virus 4 (Epstein Barr virus)
uugagguguuugauggggaccuuaugcgaauugcgcuggccuggaacaaagaugagguuauaggucaggccuugcaaauauuggcccacucccaa

SEQ ID NO: 1036 - RNA, 62 nt, Human Herpes Virus 4 (Epstein Barr virus)
ccgaauaucuggaggucuucucugacaaauucuacgaugaggaauucuuccagaugcaccgg

SEQ ID NO: 1037 - RNA, 77 nt, Human Herpes Virus 4 (Epstein Barr virus)
gagaaccuggucacugccgugagcuacgggcgcgugaugcguacguuugagcauuucauggcuaggaucguggacuc

SEQ ID NO: 1038 - RNA, 71 nt, Human Herpes Virus 4 (Epstein Barr virus)
ggaaaaggggggcagcggggccgcguaggguagcggggucugccucggcgguuuguuguccagguuggucu

SEQ ID NO: 1039 - RNA, 87 nt, Human Herpes Virus 4 (Epstein Barr virus)
uccaccagggccuugcagaugcucuugccuagauacaggaugucguccaugcugaggggagguggggugucugcuccccccugcgga

SEQ ID NO: 1040 - RNA, 68 nt, Human Herpes Virus 4 (Epstein Barr virus)
ucgaccgagguccucgauguagauggccaggcgacugcuccgguagagcucgucgaugaucuccacga

SEQ ID NO: 1041 - RNA, 94 nt, Human Herpes Virus 4 (Epstein Barr virus)
ggcagccgggcggccgccgguggguccgcugggccgcugccccgcuccgggugggggguggccccgcugggcaccgcugcgccgccgccagguc

SEQ ID NO: 1042 - RNA, 94 nt, Human Herpes Virus 4 (Epstein Barr virus); identical to SEQ ID NO: 1041

SEQ ID NO: 1043 - RNA, 78 nt, Human Herpes Virus 4 (Epstein Barr virus)
accaggcgccgcaggggugguggaugugcgggggccucagcccccccugugcuucuaccaagacucccugacgguggu

SEQ ID NO: 1044 - RNA, 86 nt, Human Herpes Virus 4 (Epstein Barr virus)
ucaauugugggauauggauagaggguggugaucuugguguaauuaaacaagagcacacacccacucuaucuaaauuccacaccuga

SEQ ID NO: 1045 - RNA, 77 nt, Human Herpes Virus 4 (Epstein Barr virus)
ggaaugugcccuaucugagcccaagugggcuuauaugguguuauuuccacuugaggugucugauggggagugggucc

SEQ ID NO: 1046 - RNA, 91 nt, Human Herpes Virus 4 (Epstein Barr virus)
gcucgauggcggcuggagagaaggaugcccggcuccccgccgccuccugcacacgagcggccagggccuccaucucugccgccaucccggc

SEQ ID NO: 1047 - RNA, 90 nt, Human Herpes Virus 4 (Epstein Barr virus)
ggccgugcuggaugagguuagcguggacaguuugauacucaccaagauuguuccaggucagaccuacgccauuaagaacaaguaccagcc

SEQ ID NO: 1048 - RNA, 90 nt, Human Herpes Virus 4 (Epstein Barr virus)
ggccaugucacgagacgcagccuccggguccgugcaccuggacauacagguggacagggccgaggagggcugggucugcgacguucugcu

SEQ ID NO: 1049 - RNA, 65 nt, Human Herpes Virus 4 (Epstein Barr virus)
gguccuccaacagaugacuugccucggggguuacugcgggggccgggucaaguggcuggggcacc

SEQ ID NO: 1050 - RNA, 87 nt, Human Herpes Virus 4 (Epstein Barr virus)
agacgcgggccaccguccggggaaggucaguggggucccagcucagcaauucuccaaauucucucuccccaauagugccucgcuucu

SEQ ID NO: 1051 - RNA, 59 nt, Human Herpes Virus 4 (Epstein Barr virus)
ugacggggccccuccgaugccuggggaguccccccaggcggucggacugcgcccccuca

SEQ ID NO: 1052 - RNA, 64 nt, Human Herpes Virus 4 (Epstein Barr virus)
ggacgggccgccuguguggucuccugugaaaacuacaaucaggagguugccgaggggcucaucu

SEQ ID NO: 1053 - RNA, 68 nt, Human Herpes Virus 4 (Epstein Barr virus)
agccgguuucgugaguccaccuucgagucgugguccacgaccaugaagcugaccgugcgugaccugcu

SEQ ID NO: 1054 - RNA, 90 nt, Human Herpes Virus 4 (Epstein Barr virus)
guccaccaggcagggagguggcaugcaaaauaacugacugccugggcaaguuccucuuuugcugcagacaccacccagucuggcucugac

SEQ ID NO: 1055 - RNA, 71 nt, Human Herpes Virus 4 (Epstein Barr virus)
cugcaauuucucagugucacauugcacguguaguaaccugcaugcgcaagggucacauuggggauuaucag

SEQ ID NO: 1056 - RNA, 90 nt, Human Herpes Virus 4 (Epstein Barr virus)
gccccugagaucugccuccccucccucucccucguccuggucggaaaagucugaggaggagaaggagaauggggaggaguccaaaacggc

SEQ ID NO: 1057 - RNA, 94 nt, Human Herpes Virus 4 (Epstein Barr virus)
uggccuccccggguccaccaggccagccggagggaccccggcagcccgggcgagucgccuucccucuccccuggccucuccuucccgccuccca

SEQ ID NO: 1058 - RNA, 72 nt, Human Herpes Virus 4 (Epstein Barr virus)
gagcgcguccgagagggcgccggacgggccgggcucucgugccccagccggccggggcaccuccgggcucuc

SEQ ID NO: 1059 - RNA, 65 nt, Human Herpes Virus 4 (Epstein Barr virus)
gcccuggagcucgggggcggccggguggcccaccggguccgcuggguccgcugccccgcuccggc

SEQ ID NO: 1060 - RNA, 68 nt, Human Herpes Virus 4 (Epstein Barr virus)
ggccuacacagaccuccgugaaggcaggguccccaugggggagcucugcuuuucaacggagcucagcc

SEQ ID NO: 1061 - RNA, 55 nt, Human Herpes Virus 4 (Epstein Barr virus)
cggggguuuugccuccuucucgucucuuguuucggguaggggaguaaggccgcug

SEQ ID NO: 1062 - RNA, 85 nt, Human Herpes Virus 4 (Epstein Barr virus)
uuggagggcacccagccaccagcaacacagaggugcaguuuguagugauugcuggcacugacguguuucuggagcagcccugcag

SEQ ID NO: 1063 - RNA, 71 nt, Human Herpes Virus 4 (Epstein Barr virus)
gcugggccucacccucggggaccccuggacaucuggacaaaguuugggggcgcccgggggucgggcugggc

SEQ ID NO: 1064 - RNA, 71 nt, Human Herpes Virus 4 (Epstein Barr virus); identical to SEQ ID NO: 1063

SEQ ID NO: 1065 - RNA, 65 nt, Human Herpes Virus 4 (Epstein Barr virus)
gguggagcucguccggaagacggccugcaaguuugugcagacacgcugccggcgcgugcucgacc

SEQ ID NO: 1066 - RNA, 59 nt, Human Herpes Virus 4 (Epstein Barr virus)
gccguccacugccuucuucccugcucgccggggaguagggggggcuuacaggggagggc

SEQ ID NO: 1067 - RNA, 67 nt, Human Herpes Virus 4 (Epstein Barr virus)
cggggguccagccgggugcacacgcucagcucaaccgccagggcguacaccuggcuguacgccgccg

SEQ ID NO: 1068 - RNA, 96 nt, Human Herpes Virus 4 (Epstein Barr virus)
agaggcucuacggggaggaguuugagcgcgaguacuaucggcuggugacagcgggcaaguuuugugggcgggucuccaucaagucccugauguucu

SEQ ID NO: 1069 - RNA, 90 nt, Human Herpes Virus 4 (Epstein Barr virus)
gccguuuuggacuccuccccauucuccuucuccuccucagacuuuuccgaccaggacgagggagagggaggggaggcagaucucaggggc

SEQ ID NO: 1070 - RNA, 61 nt, Human Herpes Virus 4 (Epstein Barr virus)
ugcgaccgggcccuccagcgggcgcaaugagugccagagcugcugaagggccucgggggcg

SEQ ID NO: 1071 - RNA, 67 nt, Human Herpes Virus 4 (Epstein Barr virus)
guggaaccuaguguuaguguugugcuguaaauaaguguccagcgcaccacuagucaccaggugucac

SEQ ID NO: 1072 - RNA, 69 nt, Human Herpes Virus 4 (Epstein Barr virus)
ggugaccuaggcauagagagugaugagcccgcuucgacagagccgguucaugaucagcuacugccugcc

SEQ ID NO: 1073 - RNA, 68 nt, Human Herpes Virus 4 (Epstein Barr virus)
gcugaguccguauugucuggcagcagggaggccagcaggguguuccagucaucgggcgaagugggagc

SEQ ID NO: 1074 - RNA, 78 nt, Human Herpes Virus 4 (Epstein Barr virus)
ccgggccgccggggucccuccggccggccugauggacccgguggggaggcaagcugagggggcucgggugggaggcgg

SEQ ID NO: 1075 - RNA, 92 nt, Human Herpes Virus 4 (Epstein Barr virus)
cgugggguucuuugcggccccgacuaucgacccugcauuugcgauguacuuuucuaugacggggauggugagggccgcggugucggccagcg

SEQ ID NO: 1076 - RNA, 72 nt, Human Herpes Virus 4 (Epstein Barr virus)
uaguggguggagccuagagguagguauccauaggguuccauuauccuggagguauccuaagcuccgccccua

SEQ ID NO: 1077 - RNA, 85 nt, Human Herpes Virus 4 (Epstein Barr virus)
ccguguccugacaacauuccccgcaaacaugacauggguuaauuuaaacauguuuuguuugcuugggaaugcucuuagggccugg

SEQ ID NO: 1078 - RNA, 76 nt, Human Herpes Virus 4 (Epstein Barr virus)
cuuugucaagauguucaaggacguggaugcggcgguggacgccgaagugguccaguuuaugaacagcauggccaag

SEQ ID NO: 1079 - RNA, 56 nt, Human Herpes Virus 4 (Epstein Barr virus)
cagucagccuggugugcguugcugcuaagcacacaacuagcgcaccaaacugucug

SEQ ID NO: 1080 - RNA, 70 nt, Human Herpes Virus 4 (Epstein Barr virus)
ccguaagauaaagauggcugccucucaucuggaacggugggaagcucagcaguuguuuuuguggcauugg

SEQ ID NO: 1081 - RNA, 72 nt, Human Herpes Virus 4 (Epstein Barr virus)
gccuauacagagcccgagaugccgcacgggggggccucgcacucucccgucguuaucuuggagaaugucggc

SEQ ID NO: 1082 - RNA, 67 nt, Human Herpes Virus 4 (Epstein Barr virus)
cugucccuggacacuggacuaugaugcauuuuuuuagaauuguuucauagucaagguccaggaucag

SEQ ID NO: 1083 - RNA, 69 nt, Human Herpes Virus 4 (Epstein Barr virus)
ccaucaaggaccuggaauguggggaugagcugcgccuacagaucaucaacuauacccagcucauuuugg

SEQ ID NO: 1084 - RNA, 77 nt, Human Herpes Virus 4 (Epstein Barr virus)
agcugaauuuggacgcagcuacuugaccuuugcccccgugccuccagcgcugauaagugcugcguccacuuuguguu

SEQ ID NO: 1085 - RNA, 61 nt, Human Herpes Virus 4 (Epstein Barr virus)
ccauuggucgcacgccgccuccuggaauguaaacccccagagagagggcgugccgcccugg

SEQ ID NO: 1086 - RNA, 71 nt, Human Herpes Virus 4 (Epstein Barr virus)
gucuuugcaauuugccuaacauggaggauugaggacccaccuuuuaauucucuucuguuugcauugcuggc

SEQ ID NO: 1087 - RNA, 87 nt, Human Herpes Virus 4 (Epstein Barr virus)
ccaggccguuugcuugacccccgugauagggguccuggcccaaaauaaccaccuuaauaucagaggggucgcaaaagcgggcccagg

SEQ ID NO: 1088 - RNA, 63 nt, Human Herpes Virus 4 (Epstein Barr virus)
ggaugugccucaggagggucaggaaaauaggugacugucuuagauuaaccugaugcuuacacc

SEQ ID NO: 1089 - RNA, 74 nt, Human Herpes Virus 4 (Epstein Barr virus)
ggauagccuaugcuacccagauauagauuaggauagcauaugcuauccagauauuuggguaguauaugcuaccc

SEQ ID NO: 1090 - RNA, 62 nt, Human Herpes Virus 4 (Epstein Barr virus)
cuaugacguugcucucuucgugggcccgggagcccccguccacaaagagggccaggucagag

SEQ ID NO: 1091 - RNA, 55 nt, Human Herpes Virus 4 (Epstein Barr virus)
ucaaguaccacgaccuggaggagggggcugccacccccgggccguggaaugaggg

SEQ ID NO: 1092 - RNA, 79 nt, Human Herpes Virus 4 (Epstein Barr virus)
cgaauuggcccgcugccaccucucugccaggggcgcccccgugggaacgccugauggcggagggcaggcgcgggacgcg

SEQ ID NO: 1093 - RNA, 62 nt, Human Herpes Virus 4 (Epstein Barr virus)
gaacacagggggcuggauuuggcagcagcacuugugcuuuuguugauuuuuacccguguauc

SEQ ID NO: 1094 - RNA, 77 nt, Human Herpes Virus 4 (Epstein Barr virus)
ccagcacuuucaauuucugccgcaaaagauaacauuggguaucagcuaucugcugcaacagaauuuaaaaguggggg

SEQ ID NO: 1095 - RNA, 84 nt, Human Herpes Virus 4 (Epstein Barr virus)
ggagagucagucaggcaagccuaugacaugguaaugccuagaaguaaagaaagguuagucauaguagcuuagcugaacugggcc

SEQ ID NO: 1096 - RNA, 57 nt, Human Herpes Virus 4 (Epstein Barr virus)
gccgaccggccccgcgccuggcgccuccucggggccagccgccgggguugguucugc

SEQ ID NO: 1097 - RNA, 57 nt, Human Herpes Virus 4 (Epstein Barr virus); identical to SEQ ID NO: 1096

SEQ ID NO: 1098 - RNA, 70 nt, Human Herpes Virus 4 (Epstein Barr virus)
agcgcgccccauccgaagcccgggaccucaugcagagccucuuucugaccucggggaagauggggugccu

SEQ ID NO: 1099 - RNA, 82 nt, Human Herpes Virus 4 (Epstein Barr virus)
acccuucuugucaaccucuucaggcccgggguuagugaugaaacaggcaacuccggggcugaucagguuaauaaggagccgu

SEQ ID NO: 1100 - RNA, 63 nt, Human Herpes Virus 4 (Epstein Barr virus)
gucgagcacgcgccggcagcgugucugcacaaacuugcaggccgucuuccggacgagcuccac

SEQ ID NO: 1101 - RNA, 62 nt, Human Herpes Virus 4 (Epstein Barr virus)
cucugaccuggcccucuuuguggacgggggcucccgggcccacgaagagagcaacgucauag

SEQ ID NO: 1102 - RNA, 98 nt, Human Herpes Virus 4 (Epstein Barr virus)
ggcaggaacauaccuucccggcuaucccugaggcccuucuuccuuuuaacgggaggaagaaaggugggcuuugaggggugggggaauaugggucucuc

SEQ ID NO: 1103 - RNA, 77 nt, Human Herpes Virus 4 (Epstein Barr virus)
gccuccucucaggacccacccuauggccauucuaucaugcaacgggagaagaaacagcaggggggccgggaagaagc

SEQ ID NO: 1104 - RNA, 65 nt, Human Herpes Virus 4 (Epstein Barr virus)
cucguucaguaaaaccgucagucuccaacagaucauccucugagaagagcugacgguacuuauag

SEQ ID NO: 1105 - RNA, 73 nt, Human Herpes Virus 4 (Epstein Barr virus)
ggcaccccugggcaccauggucucaagauccugugcaugggcacacccaggguccaugggaucccagggcacc

SEQ ID NO: 1106 - RNA, 77 nt, Human Herpes Virus 4 (Epstein Barr virus)
cccccacuuuuaaauucuguugcagcagauagcugauacccaauguuaucuuuugcggcagaaauugaaagugcugg

SEQ ID NO: 1107 - RNA, 59 nt, Human Herpes Virus 4 (Epstein Barr virus)
gcccccgaggcccuucagcagcucuggcacucauugcgcccgcuggagggcccggucgc

SEQ ID NO: 1108 - RNA, 75 nt, Human Herpes Virus 4 (Epstein Barr virus)
ggccagggccaacuccgccagcucaucgccgcuguauuccgcguuuaaaccgauagcaugguggccuggcccccc

SEQ ID NO: 1109 - RNA, 71 nt, Human Herpes Virus 4 (Epstein Barr virus)
gcccagcccgacccccgggcgcccccaaacuuuguccagauguccagggguccccgagggugaggcccagc

SEQ ID NO: 1110 - RNA, 71 nt, Human Herpes Virus 4 (Epstein Barr virus); identical to SEQ ID NO: 1109

SEQ ID NO: 1111 - RNA, 90 nt, Human Herpes Virus 4 (Epstein Barr virus)
ggcguagggccuauuguagcaggcaugucuucauuccugcguaccgaauggcaugaaggcacagccuguuaccauuggcaccuuuuuucc

SEQ ID NO: 1112 - RNA, 87 nt, Human Herpes Virus 4 (Epstein Barr virus)
gccucuuggaugccaucauccccugcuugggacccgaccgcacuugcaugcggccggugguccugcggggggugacggucaggcagc

SEQ ID NO: 1113 - RNA, 78 nt, Human Herpes Virus 4 (Epstein Barr virus)
aggcugggcccgggagccguggacgggcgugggaggcuggacuuuacagacagugcacaggagacugggccucaggcu

SEQ ID NO: 1114 - RNA, 78 nt, Human Herpes Virus 4 (Epstein Barr virus); identical to SEQ ID NO: 1113

SEQ ID NO: 1115 - RNA, 78 nt, Human Herpes Virus 4 (Epstein Barr virus); identical to SEQ ID NO: 1113

SEQ ID NO: 1116 - RNA, 83 nt, Human Herpes Virus 4 (Epstein Barr virus)
gggcgaggcauggaagggaagacacgucggcugagguuuuagcaugccagaugaaauuuaccaccccuuucagagucuuggcc

SEQ ID NO: 1117 - RNA, 79 nt, Human Herpes Virus 4 (Epstein Barr virus)
gggggcugggccucacccucggggaccccuggacaucuggacaaaguuugggggcgcccgggggucgggcugggccgcc

SEQ ID NO: 1118 - RNA, 79 nt, Human Herpes Virus 4 (Epstein Barr virus); identical to SEQ ID NO: 1117

SEQ ID NO: 1119 - RNA, 79 nt, Human Herpes Virus 4 (Epstein Barr virus); identical to SEQ ID NO: 1117

SEQ ID NO: 1120 - RNA, 79 nt, Human Herpes Virus 4 (Epstein Barr virus); identical to SEQ ID NO: 1117

SEQ ID NO: 1121 - RNA, 72 nt, Human Herpes Virus 4 (Epstein Barr virus)
ggggggugauuccuagaggcgaugagacuggcgugcgcuaaaagugucauggccacaaugggguugucugcc

SEQ ID NO: 1122 - RNA, 72 nt, Human Herpes Virus 4 (Epstein Barr virus)
gcgccgcgcgggcgcagccaugcgugaccgugaugagggggcagggucgcagggggugugucuggugggggc

SEQ ID NO: 1123 - RNA, 59 nt, Human Herpes Virus 4 (Epstein Barr virus)
ccgauccgacccgcucuacuuuuugcaauuugcagccccaaagguggugcuguuggagg

SEQ ID NO: 1124 - RNA, 64 nt, Human Herpes Virus 4 (Epstein Barr virus)
ggggagacaggggaggggguuuggauccucgggucaaugacaccuucauaucccuuguuuuacc

SEQ ID NO: 1125 - RNA, 72 nt, Human Herpes Virus 4 (Epstein Barr virus)
cgggggugggcaccucgggcucaaaggcggaguugaugaaaggggccgaggcugagggggcggucaccgaug

SEQ ID NO: 1126 - RNA, 63 nt, Human Herpes Virus 4 (Epstein Barr virus)
acgucgccuauggaguugacucgucgucggcaaagagaccagagggcacccauggcgcggugu

SEQ ID NO: 1127 - RNA, 81 nt, Human Herpes Virus 4 (Epstein Barr virus)
gcgugacgcuauucuaaaguuccucaacaggccagauacguucucgguggccuugggggagcugggggugcaaguuuuggc

SEQ ID NO: 1128 - RNA, 78 nt, Human Herpes Virus 4 (Epstein Barr virus)
uguguuguguacgacgaugaugucauagaggugauugauguugaaaccaccgaagauucaucgucagugucacagcca

SEQ ID NO: 1129 - RNA, 80 nt, Human Herpes Virus 4 (Epstein Barr virus)
guucacugauuacgguuuccuagauuguacagaugaacuagaacugucacaaucuauggggucguagacagugugcuuac

SEQ ID NO: 1130 - RNA, 58 nt, Human Herpes Virus 4 (Epstein Barr virus)
agucucugccuccaggcaagggcgccagcuuuucuccccccagccugaggcccagucu

SEQ ID NO: 1131 - RNA, 58 nt, Human Herpes Virus 4 (Epstein Barr virus); identical to SEQ ID NO: 1130

SEQ ID NO: 1132 - RNA, 58 nt, Human Herpes Virus 4 (Epstein Barr virus); identical to SEQ ID NO: 1130

SEQ ID NO: 1133 - RNA, 58 nt, Human Herpes Virus 4 (Epstein Barr virus); identical to SEQ ID NO: 1130

SEQ ID NO: 1134 - RNA, 89 nt, Human Herpes Virus 4 (Epstein Barr virus)
gcucuguggcaccucaaggugaauauagcugcccaucgacguaucgcuggaaaccggugggccgcuguucaccuaaagugacgcaaggu

SEQ ID NO: 1135 - RNA, 65 nt, Human Herpes Virus 4 (Epstein Barr virus)
ccucuacgcccgccgccgcccccgccgcgacggcugugggugugggggcggcggcggacccuugg

SEQ ID NO: 1136 - RNA, 76 nt, Human Herpes Virus 4 (Epstein Barr virus)
cuuguccugugguguuuggugugguuuugggguacgcaggaguacguuggaaugcuuuggagccgagagggauggg

SEQ ID NO: 1137 - RNA, 96 nt, Human Herpes Virus 4 (Epstein Barr virus)
ccugcuggagaugaagggaggcugccgggagccggaacuggacacggaaacgcugacuaccauguuugagguuucuguggccuucuuuaagguggg

SEQ ID NO: 1138 - RNA, 75 nt, Human Herpes Virus 4 (Epstein Barr virus)
ccuuuuacuaacccuaauucgauagcauaugcuucccguuggguaacauaugcuauugaauuaggguuagucugg

SEQ ID NO: 1139 - RNA, 55 nt, Human Herpes Virus 4 (Epstein Barr virus)
cagcaggccuacuucuacgccagcgcgccucagggucuggacguggaguuugcag

SEQ ID NO: 1140 - RNA, 73 nt, Human Herpes Virus 4 (Epstein Barr virus)
gaccgggugcugggaccucgggugcccgcuggcuccaaccucgggccccuggacuggucucucaaucugggcc

SEQ ID NO: 1141 - RNA, 73 nt, Human Herpes Virus 4 (Epstein Barr virus); identical to SEQ ID NO: 1140

SEQ ID NO: 1142 - RNA, 63 nt, Human Herpes Virus 4 (Epstein Barr virus)
gaagaccgaggacuggacuuaguucaggcaugcuaggacuggagguguuuggcucuggucucc

SEQ ID NO: 1143 - RNA, 79 nt, Human Herpes Virus 4 (Epstein Barr virus)
aaagcaucguggucaaggagguuccaacccgaaauuugagaacauugcagaagguuuaagagcucuccuggcuaggagu

SEQ ID NO: 1144 - RNA, 97 nt, Human Herpes Virus 4 (Epstein Barr virus)
cagugaccuuguugguacuuuaagguugguccaauccauaggcuuuuuuugugaaaacccggggaucggacuagccuuagaguaacucaaggccaag

SEQ ID NO: 1145 - RNA, 55 nt, Human Herpes Virus 4 (Epstein Barr virus)
cccccggcagcuggccccgaggaggcgcccggaguggggccggucggcugggcug

SEQ ID NO: 1146 - RNA, 55 nt, Human Herpes Virus 4 (Epstein Barr virus); identical to SEQ ID NO: 1145

SEQ ID NO: 1147 - RNA, 71 nt, Human Herpes Virus 4 (Epstein Barr virus)
uccugauccuggaccuugacuaugaaacaauucuaaaaaaaugcaucauaguccaguguccagggacagug

SEQ ID NO: 1148 - RNA, 69 nt, Human Herpes Virus 4 (Epstein Barr virus)
ccgguccuugacccugaggugcaggauggcauugaccgcauccuggaccccauggucucagaggcccug

SEQ ID NO: 1149 - RNA, 80 nt, Human Herpes Virus 4 (Epstein Barr virus)
gcaggcaggggccgguuggcccacggggauccggguggauggaagggccugauccucuuuggcugacacaccucucgccc

SEQ ID NO: 1150 - RNA, 93 nt, Human Herpes Virus 4 (Epstein Barr virus)
gcagccgggcggccgccgguggguccgcugggccgcugccccgcuccgggugggggguggccccgcugggcaccgcugcgccgccgccagguc

SEQ ID NO: 1151 - RNA, 93 nt, Human Herpes Virus 4 (Epstein Barr virus); identical to SEQ ID NO: 1150

SEQ ID NO: 1152 - RNA, 75 nt, Human Herpes Virus 4 (Epstein Barr virus)
ccagccuucagccaccauuuuaccagggacgaggacauccucgacaauuuggagaaugggacgcucagggaucug

SEQ ID NO: 1153 - RNA, 57 nt, Human Herpes Virus 4 (Epstein Barr virus)
ccgacccccgggcgcccccaaacuuuguccagauguccagggguccccgagggugag

SEQ ID NO: 1154 - RNA, 57 nt, Human Herpes Virus 4 (Epstein Barr virus); identical to SEQ ID NO: 1153

SEQ ID NO: 1155 - RNA, 57 nt, Human Herpes Virus 4 (Epstein Barr virus); identical to SEQ ID NO: 1153

SEQ ID NO: 1156 - RNA, 82 nt, Human Herpes Virus 4 (Epstein Barr virus)
ccucaaacacugacauugcggaggccauccucgaugccauccucucgcggccugacgagggcuuccgccuguuuuguuugug

SEQ ID NO: 1157 - RNA, 61 nt, Human Herpes Virus 4 (Epstein Barr virus)
gcucaaguucgcacuuccuauacaguguuaaagccuuguaucggaaguuugggcuucgucc

SEQ ID NO: 1158 - RNA, 56 nt, Human Herpes Virus 4 (Epstein Barr virus)
cgugggcgaauuaacugagcuugcguaagcaaggcguaauuaaucccgcccguagg

SEQ ID NO: 1159 - RNA, 77 nt, Human Herpes Virus 4 (Epstein Barr virus)
ggggcugggccucacccucggggaccccuggacaucuggacaaaguuugggggcgcccgggggucgggcugggccgc

SEQ ID NO: 1160 - RNA, 77 nt, Human Herpes Virus 4 (Epstein Barr virus); identical to SEQ ID NO: 1159

SEQ ID NO: 1161 - RNA, 61 nt, Human Herpes Virus 4 (Epstein Barr virus)
cgugguuguguuggugcucagaauagcaguugugguuauaggggcgcuagucguggucaag

SEQ ID NO: 1162 - RNA, 66 nt, Human Herpes Virus 4 (Epstein Barr virus)
uguauugggacuugaagguggaggggggcggcguggagcugggccucuaaguacaggucgcguagg

SEQ ID NO: 1163 - RNA, 58 nt, Human Herpes Virus 4 (Epstein Barr virus)
ggagguggcggagcucucggagcuccucuauuggaacucuggcggccaugcuaucggu

SEQ ID NO: 1164 - RNA, 58 nt, Human Herpes Virus 4 (Epstein Barr virus)
ugcugggaccucgggugcccgcuggcuccaaccucgggccccuggacuggucucucaa

SEQ ID NO: 1165 - RNA, 97 nt, Human Herpes Virus 4 (Epstein Barr virus)
cuuggccuugaguuacucuaaggcuaguccgauccccggguuuucacaaaaaaagccuauggauuggaccaaccuuaaaguaccaacaaggucacug

SEQ ID NO: 1166 - RNA, 61 nt, Human Herpes Virus 4 (Epstein Barr virus)
guaggcacccgggcccgcgucgagccuucacccgaaugugucugcgggccacgguggccuc

SEQ ID NO: 1167 - RNA, 59 nt, Human Herpes Virus 4 (Epstein Barr virus)
gugauguucugugcaguaaccuuaguggugacauugaugguggaugcguuggaaguugu

SEQ ID NO: 1168 - RNA, 59 nt, Human Herpes Virus 4 (Epstein Barr virus)
auuuuuggggugucucuggaucuuugcgucaauguggagucacagggagacuuuauacu

SEQ ID NO: 1169 - RNA, 62 nt, Human Herpes Virus 4 (Epstein Barr virus)
acuauuuucugcauucgcccuugcguguccauuguugcaaggagcgauuuggagaaaauaaa

SEQ ID NO: 1170 - RNA, 65 nt, Human Herpes Virus 4 (Epstein Barr virus)
cuuuuaaauucuguugcagcagauagcugauacccaauguuaucuuuugcggcagaaauugaaag

SEQ ID NO: 1171 - RNA, 70 nt, Human Herpes Virus 4 (Epstein Barr virus)
gggggucuuaguggaagugacgugcugugaauacagguccauagcaccgcuauccacuaugucucgcccg

SEQ ID NO: 1172 - RNA, 66 nt, Human Herpes Virus 4 (Epstein Barr virus)
uauuaaccugaucagccccggaguugccuguuucaucacuaaccccgggccugaagagguugacaa

SEQ ID NO: 1173 - RNA, 65 nt, Human Herpes Virus 4 (Epstein Barr virus)
ucuaacgggaaguguguaagcacacacguaauuugcaagcggugcuucacgcucuucguuaaaau

SEQ ID NO: 1174 - RNA, 67 nt, Human Hepatitis B Virus
uccggccgaccacggggcgcaccucucuuuacgcggucuccccgucugugccuucucaucugccgga

SEQ ID NO: 1175 - RNA, 66 nt, Human Hepatitis B Virus
uggaugaugugguauugggggccaagucuguacaacaucuugagucccuuuuuaccucuauuacca

SEQ ID NO: 1176 - RNA, 73 nt, Human Hepatitis B Virus
uugccugagugcuguauggugaggugaacaauguuccggagacucuaaggccucccgauacagagcagaggcg

SEQ ID NO: 1177 - RNA, 59 nt, Human Hepatitis C Virus
guucuaucuaucccggccauauaacgggucaucgcauggcaugggauaugaugaugaac

SEQ ID NO: 1178 - RNA, 77 nt, Human Hepatitis C Virus
ggcggcguccuggcugcucuggccgcguauugccugucaacaggcugcguggucauagugggcaggauugucuuguc

SEQ ID NO: 1179 - RNA, 70 nt, Human Hepatitis C Virus
cucgccuggagcccuuguagucgguguggucugcgcagcaauacugcgccggcacguuggcccgggcgag

SEQ ID NO: 1180 - RNA, 81 nt, Human Hepatitis C Virus
uccgcuguugugccccgcgggacacgccgugggccuauucagggccgcggugugcacccguggaguggcuaaggcggugga

SEQ ID NO: 1181 - RNA, 71 nt, Human Hepatitis C Virus
ggucuuggaggguagugccagcaguaggggcguucgucgaggccgcuuccguuggcauaacugauaggacc

SEQ ID NO: 1182 - RNA, 68 nt, Human Hepatitis C Virus
gccauccugcacacuccggggugugucccuugcguucgcgaggguaacgccucgagguguuggguggc

SEQ ID NO: 1183 - RNA, 62 nt, Human Hepatitis C Virus
cuugugucaucggaggggugggcaacaacaccuugcucugccccacugauuguuuccgcaag

SEQ ID NO: 1184 - RNA, 78 nt, Human Hepatitis C Virus
ggccccucuauggcaaugaggguugcgggugggcgggauggcuccugucuccccguggcucucggccuagcuggggcc

SEQ ID NO: 1185 - RNA, 76 nt, Human Hepatitis C Virus
auacuaacgccauggcuagacgcuuucugcgugaagacaguaguuccucacaggggagugauucaugguggagugu

SEQ ID NO: 1186 - RNA, 60 nt, Human Hepatitis C Virus
guaccacuccaugcuccgguuccuggcuaagggacaucugggacuggauaugcgaggugc

SEQ ID NO: 1187 - RNA, 72 nt, Human Hepatitis C Virus
cagggacggcaaacuccccacaacgcagcuucgacgucauaucgaucugcuugucgggagcgccacccucug

SEQ ID NO: 1188 - RNA, 76 nt, Human Hepatitis C Virus
acagcagaggcggccgggagaagguuggcgagagggucacccccuucuauggccagcuccucggccagccagcugu

SEQ ID NO: 1189 - RNA, 76 nt, Human Hepatitis C Virus
ggcguagcaacgaguugcucagugcguugaugggcaguuuuuguucuuccgcagcgcacggggugacgagugcgcc

SEQ ID NO: 1190 - RNA, 75 nt, Human Hepatitis C Virus
guggccgcgucguguggcggcguuguucuugucggguuaauggcgcugacucugucgccauauuacaagcgcuac

SEQ ID NO: 1191 - RNA, 83 nt, Human Hepatitis C Virus
gaggagcgggccagcccacaaggucuugguccacauugguauacaucuggaugacaggacccuugggugaugcgaugguccuc

SEQ ID NO: 1192 - RNA, 65 nt, Human Hepatitis C Virus
ggccaccuccguguccagugcguaugcccgcugaggcaacgccagcaggagcaggaggagaggcc

SEQ ID NO: 1193 - RNA, 59 nt, Human Hepatitis C Virus
guucaucaucauaucccaugccaugcgaugacccguuauauggccgggauagauagaac

SEQ ID NO: 1194 - RNA, 76 nt, Human Hepatitis C Virus
ccgccuuagccacuccacgggugcacaccgcggcccugaauaggcccacggcgugucccgcggggcacaacagcgg

SEQ ID NO: 1195 - RNA, 81 nt, Human Hepatitis C Virus
ggggucuucuuggacuuccacgcuugcacgaggaauucaacccgcuguccuggugaguauuggaauccguaggagcuuccc

SEQ ID NO: 1196 - RNA, 72 nt, Human Hepatitis C Virus
cagaggguggcgcucccgacaagcagaucgauaugacgucgaagcugcguuguggggaguuugccgucccug

SEQ ID NO: 1197 - RNA, 92 nt, Human Hepatitis C Virus
ggucagaucguugguggaguuuacuuguugccgcgcaggggcccuagauugggugugcgcgcgacgaggaagacuuccgagcggucgcaacc

SEQ ID NO: 1198 - RNA, 55 nt, Human Hepatitis C Virus
guuccgcagaccacuauggcucucccgggaggggggguccuggaggcugcacgac

SEQ ID NO: 1199 - RNA, 85 nt, Human Hepatitis C Virus
cggugaguacaccggaauugccaggacgaccggguccuuucuuggauaaacccgcucaaugccuggagauuugggcgugcccccg

SEQ ID NO: 1200 - RNA, 85 nt, Human Hepatitis C Virus
ccaugacccgucgcugagauccggauccccaggcucccccuccagggggggcauggaagaauaggacucaacgucggagucgggg

SEQ ID NO: 1201 - RNA, 56 nt, Human Hepatitis C Virus
gacgacugguuccacagccacggccagaucucgcaggccguugugcgcccagucuc

SEQ ID NO: 1202 - RNA, 68 nt, Human Hepatitis C Virus
gccacacacgagcauggugcaguccuggagcccugcggcucgacaggcugcccgggccuugauguagc

SEQ ID NO: 1203 - RNA, 85 nt, Human Hepatitis C Virus
ccccgacuccgacguugaguccuauucuuccaugcccccccuggagggggagccuggggauccggaucucagcgacgggucaugg

SEQ ID NO: 1204 - RNA, 78 nt, Human Hepatitis C Virus
gcgcuaggcuucuguccagaggaggcagggcugccauauguggcaaguaccucuucaacugggcaguaagaacaaagc

SEQ ID NO: 1205 - RNA, 96 nt, Human Hepatitis C Virus
gcuccggaucccacaagccaucauggacaugaucgcuggugcucacuggggaguccuggcgggcauagcguauuucuccaugguggggaacugggc

SEQ ID NO: 1206 - RNA, 86 nt, Human Hepatitis C Virus
caugcaugucaugauguauuuggugauugggugcgucagggugacuucauucugaacagcgcccagucuguauagcagggguguug

SEQ ID NO: 1207 - RNA, 92 nt, Human Hepatitis C Virus
gcuucagccuaccaagugcgcaauuccucggggcuuuaccaugucaccaaugauugcccuaacucgaguauuguguacgaggcggccgaugc

SEQ ID NO: 1208 - RNA, 57 nt, Human Hepatitis C Virus
caauagcggccgcuggccggcuggacuuguccgguugguucacggcuggcuacagcg

SEQ ID NO: 1209 - RNA, 91 nt, Human Hepatitis C Virus (HCV-N)
cgcucccgugguggaguccaaguggcgagcuuuggagaccuucugggcaaagcacauguggaauuucaucagcgggauacaguacuuagcg

SEQ ID NO: 1210 - RNA, 77 nt, Human Hepatitis C Virus (HCV-N)
gcagaggcggcuaagcguagguuggccagggggucuccccccuccuuggccagcucuucagcuagccagcugucugc

SEQ ID NO: 1211 - RNA, 60 nt, Human Hepatitis C Virus (HCV-N)
ccugcacgccuuccccggcgccaaacuauuccaaggcgcuguggcggguggcugcugagg

SEQ ID NO: 1212 - RNA, 58 nt, Human Hepatitis C Virus (HCV-N)
uaucgcgggguucccaggcaggguggauaagcccgcuaaguacuguaucccgcugaug

SEQ ID NO: 1213 - RNA, 75 nt, Human Hepatitis C Virus (HCV-N)
gcggaguccucgcagcucuggccgcauauugccugacaacaggcagugugguuaucguggguaggaucaucuugu

SEQ ID NO: 1214 - RNA, 61 nt, Human Hepatitis C Virus (HCV-N)
ggcagggguggcuggcgcgcucguggccuucaaggucaugagcggcgaggcgcccucugcc

SEQ ID NO: 1215 - RNA, 61 nt, Human Hepatitis C Virus (HCV-N)
uucagggcaguccuguugaugugccaacugccauugguguuuauaagcuggauucucugag

SEQ ID NO: 1216 - RNA, 64 nt, Human Hepatitis C Virus (HCV-N)
ucgaggagguggcccugucgaacacuggagagauccccuucuacggcaaagccauccccaucga

SEQ ID NO: 1217 - RNA, 84 nt, Human Hepatitis C Virus (HCV-N)
guauugcuucaccccaaguccuguugucguggggacaaccgaucgucucggcaacccuacguacagcuggggggagaacgauac

SEQ ID NO: 1218 - RNA, 88 nt, Human Hepatitis C Virus (HCV-N)
cgugcaugcauguuagugcggaaagucgcugggggucauuauguccaaauggccuucaugagacugggcgcgcugacgggcacguacg

SEQ ID NO: 1219 - RNA, 88 nt, Human Hepatitis C Virus (HCV-N)
guuugagcuuggucuuuacugcccaguugaagagguauuugccgcaaguggcggcccucccccccugggacaguaguuuagcgcggac

SEQ ID NO: 1220 - RNA, 76 nt, Human Hepatitis C Virus (HCV-N)
auacuaacgccauggcuagacgcuuucugcgugaagacaguaguuccucacaggggagugaucuaugguggagugu

SEQ ID NO: 1221 - RNA, 57 nt, Human Hepatitis C Virus (HCV-N)
caguccucauuaauccacugguggagccucuucagcagcugggugaugguaaggcug

SEQ ID NO: 1222 - RNA, 62 nt, Human Hepatitis C Virus (HCV-N)
uuaugguggcuccaucuuagcccuagucacggcuagcugugaaagguccgugagccgcauga

SEQ ID NO: 1223 - RNA, 59 nt, Human Hepatitis C Virus (HCV-N)
uacugucccagggggggagggccgccacuugcggcaaauaccucuucaacugggcagua

SEQ ID NO: 1224 - RNA, 60 nt, Human Hepatitis C Virus (HCV-N)
uguauuugguuauggggugugugagggugaccucauuuuggacggccccuagccuauaca

SEQ ID NO: 1225 - RNA, 70 nt, Human Hepatitis C Virus (HCV-N)
uggcacuaccccugcacugucaacuucuccaucuuuaagguuaggauguauguggggggcguggagcaca

SEQ ID NO: 1226 - RNA, 90 nt, Human Hepatitis C Virus (HCV-N)
uuggcgccggggaaggcgugcaggggcccgugguguacgcguugauggggaauguuccaugccacguguugcugcagguuuucggcccga

SEQ ID NO: 1227 - RNA, 83 nt, Human Hepatitis C Virus (HCV-N)
ggggcaaguccccggggggggcggaguaccuagucauagccuccgugaagacucguaggcucgccgcauccuccuggguuccc

SEQ ID NO: 1228 - RNA, 56 nt, Human Hepatitis C Virus (HCV-N)
gcgcccgugguaaugguccuuaccccaguccugauguuagggucgguaccaugugc

SEQ ID NO: 1229 - RNA, 87 nt, Human Hepatitis C Virus (HCV-N)
cagguaaacuccaccaacgaucugaccaccgcccgggaacuugacguccugugggcggcgguugguguuacguuugguuuuucuuug

SEQ ID NO: 1230 - RNA, 67 nt, Human Hepatitis C Virus (HCV-N)
gagagcagccgccccaacgagcaaaucgacguggugucguauugucguaguggggaugguagcauuc

SEQ ID NO: 1231 - RNA, 56 nt, Human Hepatitis C Virus (HCV-N)
ggcaaugagggcauggggugggcaggauggcuccugucaccccgcggcucccggcc

SEQ ID NO: 1232 - RNA, 92 nt, Human Hepatitis C Virus (HCV-N)
ggucagaucguugguggaguuuaccuguugccgcgcaggggccccagguugggugugcgcgcgaucaggaagacuuccgagcggucgcaacc

SEQ ID NO: 1233 - RNA, 55 nt, Human Hepatitis C Virus (HCV-N); identical to SEQ ID NO: 1198

SEQ ID NO: 1234 - RNA, 76 nt, Human Hepatitis C Virus (HCV-N)
gguccucggcagagggcgccucgccgcucaugaccuugaaggccacgagcgcgccagccaccccugccccauagcc

SEQ ID NO: 1235 - RNA, 85 nt, Human Hepatitis C Virus (HCV-N)
cggugaguacaccggaauugccaggacgaccggguccuuucuuggaucaacccgcucaaugccuggagauuugggcgugcccccg

SEQ ID NO: 1236 - RNA, 55 nt, Human Hepatitis C Virus (HCV-N)
ucaucaucaugucccaggccaugcggugaccugacgcguggccgggguagaucga

SEQ ID NO: 1237 - RNA, 71 nt, Human Hepatitis C Virus (HCV-N)
gccacauuuugaguacguggccucggggugcuuccggaagcaguccguggggcaggucaagguguuauugc

SEQ ID NO: 1238 - RNA, 61 nt, Human Hepatitis C Virus (HCV-N)
ucuacgccguguuccggcucguggcugagggauguuugggacugggugugcacgguguuga

SEQ ID NO: 1239 - RNA, 73 nt, Human Hepatitis C Virus (HCV-N)
aaugugggggcgucaggcggcaggcuucuucuauggauagaaguuuagccuugacuguggacgccuuugccuu

SEQ ID NO: 1240 - RNA, 60 nt, Human Hepatitis C Virus (HCV-N)
ucaucgacaugguggcgggggcccacuggggaguccuggcgggccuugccuacuauucca

SEQ ID NO: 1241 - RNA, 95 nt, Human Hepatitis C Virus (HCV-N)
guggcacggugaccgauccuggaggcguagcgguggcgagcacgacaagccgcgcuccagccgucuccgcuugguccaggacugugccgaugccc

SEQ ID NO: 1242 - RNA, 74 nt, Human Hepatitis C Virus (M1LE)
ucccgugguggaguccaaguggcgcgcucuugagaccuucugggcgaagcacauguggaauuucaucagcggga

SEQ ID NO: 1243 - RNA, 71 nt, Human Hepatitis C Virus (M1LE)
uccuaccucgccgcugugagcgcgauaccgcgucuuggggcacggucgucguuucaauggugaagguggga

SEQ ID NO: 1244 - RNA, 77 nt, Human Hepatitis C Virus (M1LE)
gggguaugcaugaugauguccgcugccucauacacaaugcuugaguuggagcagucguucgugacaugguauauccc

SEQ ID NO: 1245 - RNA, 97 nt, Human Hepatitis C Virus (M1LE)
ggugcggcacggugaccgauccuggaggcguagcgguggcgagcacgacgagccgcgcuccagccgucuccgcuugauccaggacugugccgaugcc

SEQ ID NO: 1246 - RNA, 77 nt, Human Hepatitis C Virus (M1LE)
gcagagacggccaagcguagguuggccagggggucuccccccucccuggccagcucuucagcuagccaguugucugc

SEQ ID NO: 1247 - RNA, 70 nt, Human Hepatitis C Virus (M1LE)
cucuccuggugcccugguugucggggucgugugcgcagcaauacugcgccggcacgugggcccaggagag

SEQ ID NO: 1248 - RNA, 80 nt, Human Hepatitis C Virus (M1LE)
gggauccgacguugagucauacuccuccaugcccccccuugagggagagccgggggacccugaucuuagcgacgggucuu

SEQ ID NO: 1249 - RNA, 92 nt, Human Hepatitis C Virus (M1LE)
gggccccacagacccccggcguaggucgcguaauuuggguaaggucaucgauacccucacaugcggcuucgccgaccucaugggguacauuc

SEQ ID NO: 1250 - RNA, 73 nt, Human Hepatitis C Virus (M1LE)
acgugggcccaggagagggggcugugcaguggaugaaccggcugauagcguucgcuucucgggguaaccacgu

SEQ ID NO: 1251 - RNA, 78 nt, Human Hepatitis C Virus (M1LE)
ggccccucuauggugacgagggcauggggugggcaggauggcuccugucaccccguggcucucggccuaauuggggcc

SEQ ID NO: 1252 - RNA, 88 nt, Human Hepatitis C Virus (M1LE)
cgugcaugcauguuggugcggaaagccgccgggggucauuauguccaaauggccuucgugaagcuggccgcacugacaggcacguacg

SEQ ID NO: 1253 - RNA, 76 nt, Human Hepatitis C Virus (M1LE); identical to SEQ ID NO: 1220

SEQ ID NO: 1254 - RNA, 55 nt, Human Hepatitis C Virus (M1LE)
gguggagggcaucucgccgcucaugaucuuaaaagcuacgagugcgccagccacc

SEQ ID NO: 1255 - RNA, 80 nt, Human Hepatitis C Virus (M1LE)
auacuauaaaguguuccucgcuaggcucauauggugguuacaauaccuuaucaccagagccgaggcgcacuugcagaugu

SEQ ID NO: 1256 - RNA, 56 nt, Human Hepatitis C Virus (M1LE)
cgggccggcgagccuuggggauagguugucgccuuccacgagguugcgaccgcucg

SEQ ID NO: 1257 - RNA, 82 nt, Human Hepatitis C Virus (M1LE)
gaggccuuauugcuggcacuacccaccccgaccgugugguaucguacccgcguuggaggugugugguccaguguauugcuuc

SEQ ID NO: 1258 - RNA, 74 nt, Human Hepatitis C Virus (M1LE)
gugaugcuaucgcgggguucccaggcagaguggauaagccugcuaaauacuguaucccgcugaugaaauuccac

SEQ ID NO: 1259 - RNA, 70 nt, Human Hepatitis C Virus (M1LE)
ccggaaccuauccagcagggccgucaaccacauccgcuccgugugggaggacuugcuggaagacacugag

SEQ ID NO: 1260 - RNA, 60 nt, Human Hepatitis C Virus (M1LE)
ggcacuuuagugcucuugccgcugccagugggggcgugcagaugagccacuugaaauguc

SEQ ID NO: 1261 - RNA, 86 nt, Human Hepatitis C Virus (M1LE)
cugacgggaccacccacgugacagggggggugcaagcccacggugcuuacgggcuugcaucccucuuuaacguugggccccaucag

SEQ ID NO: 1262 - RNA, 93 nt, Human Hepatitis C Virus (M1LE)
cacaggucgggacaagaaccagguugagggggagguucaagugguuuccaccgcuacacaaucuuuccuggcgaccugcaucaauggcgugug

SEQ ID NO: 1263 - RNA, 87 nt, Human Hepatitis C Virus (M1LE)
cagguaaacuccaccaacgaucugaccaccgcccgggaacuuaacguccugugggcggcgguugguguuacguuugguuuuucuuug

SEQ ID NO: 1264 - RNA, 75 nt, Human Hepatitis C Virus (M1LE)
ucgauuccucgguccugugugagugcuaugacgcgggcugugcgugguacgagcucacgcccgccgagaccucga

SEQ ID NO: 1265 - RNA, 70 nt, Human Hepatitis C Virus (M1LE)
cgaaggccauuuggacauaaugacccccggcggcuuuccgcaccaacaugcaugcacgaaugagcccuug

SEQ ID NO: 1266 - RNA, 82 nt, Human Hepatitis C Virus (M1LE)
agcagagcagaaagcagccgucccaacgagcaagucgacauggcgucguauugucguaguggggacgcugauguuccuggcu

SEQ ID NO: 1267 - RNA, 92 nt, Human Hepatitis C Virus (M1LE)
ggucagaucguugguggaguuuaccuguugccgcgcaggggccccagguugggugugcgcgcgacuaggaagacuuccgagcggucgcaacc

SEQ ID NO: 1268 - RNA, 55 nt, Human Hepatitis C Virus (M1LE); identical to SEQ ID NO: 1198

SEQ ID NO: 1269 - RNA, 65 nt, Human Hepatitis C Virus (M1LE)
uuggacggcuccuagccuauacagcaaggguguuggcccgugcaguguagguuuuagccguguga

SEQ ID NO: 1270 - RNA, 85 nt, Human Hepatitis C Virus (M1LE)
cggugaguacaccggaauugccaggacgaccggguccuuucuuggauuaacccgcucaaugccuggagauuugggcgugcccccg

SEQ ID NO: 1271 - RNA, 91 nt, Human Hepatitis C Virus (M1LE)
ggauuuggccgagugugggggcgucaguuugcaggcuucuucuauagauagaagcuuagccuuaacuguggacgccuucgccuucaucucc

SEQ ID NO: 1272 - RNA, 66 nt, Human Hepatitis C Virus (M1LE)
gccgcugcuucugcuccuguuggcguugccgccacgugcuuacgccauggaccgggagauggcugc

SEQ ID NO: 1273 - RNA, 96 nt, Human Hepatitis C Virus (M1LE)
gcuccggaucccacaagcuaucguggauaugguggcgggggcccacuggggaguccuggcgggccuugccuacuauuccaugguggggaacugggc

SEQ ID NO: 1274 - RNA, 66 nt, Human Hepatitis C Virus (M1LE)
ggugugcaggggcccgugguguacgcguugauggggaauguuccaugccacguguugcugcagguu

SEQ ID NO: 1275 - RNA, 63 nt, Human Hepatitis C Virus (M1LE)
gcagaacugcgguuaucgccggugccgcgcgagcggcgugcugacgacuagcugcgguaauac

SEQ ID NO: 1276 - RNA, 76 nt, Human Hepatitis C Virus (M1LE)
cgcuaaguuacugucccagggggggagggccgccacuuguggcaaguaccucuucaacugggcaguaaagaccaag

SEQ ID NO: 1277 - RNA, 22 nt, Human Herpes Virus 1
uuucuccccccucuuccgaggc

SEQ ID NO: 1278 - RNA, 22 nt, Human Herpes Virus 1
uugugaggcgggggggggagag

SEQ ID NO: 1279 - RNA, 22 nt, Human Herpes Virus 1
uuucuccccccucuuccgaggc

SEQ ID NO: 1280 - RNA, 22 nt, Human Herpes Virus 1
uugugaggcgggggggggagag

SEQ ID NO: 1281 - RNA, 22 nt, Human Herpes Virus 1
ugggcccugcuccggcggggcc

SEQ ID NO: 1282 - RNA, 22 nt, Human Herpes Virus 1
uccgcuggggcccccagggucc

SEQ ID NO: 1283 - RNA, 22 nt, Human Herpes Virus 1
uccgggcccgucgugucuuucg

SEQ ID NO: 1284 - RNA, 22 nt, Human Herpes Virus 1
gucgggcacguacacggguggc

SEQ ID NO: 1285 - RNA, 22 nt, Human Herpes Virus 1
cgccgccgccgcggaccugcug

SEQ ID NO: 1286 - RNA, 22 nt, Human Herpes Virus 1
gcgcccccugcuggcggcggcg

SEQ ID NO: 1287 - RNA, 22 nt, Human Herpes Virus 1
cgccgccgccgcggaccugcug

SEQ ID NO: 1288 - RNA, 22 nt, Human Herpes Virus 1
gcgcccccugcuggcggcggcg

SEQ ID NO: 1289 - RNA, 22 nt, Human Herpes Virus 1
cggccgugugggcgcccgagcu

SEQ ID NO: 1290 - RNA, 22 nt, Human Herpes Virus 1
caguacgcccugaucacgcggc

SEQ ID NO: 1291 - RNA, 22 nt, Human Herpes Virus 1
uccagcacagccgcggucgucc

SEQ ID NO: 1292 - RNA, 22 nt, Human Herpes Virus 1
ggcgcagcggcagguuguggug

SEQ ID NO: 1293 - RNA, 22 nt, Human Herpes Virus 1
ggccucgacgcggcgacgggug

SEQ ID NO: 1294 - RNA, 21 nt, Human Herpes Virus 1
cccugucgcgucaggaggccc

SEQ ID NO: 1295 - RNA, 22 nt, Human Herpes Virus 1
ucgcuuccccccgggagauccg

SEQ ID NO: 1296 - RNA, 19 nt, Human Herpes Virus 1
uggguggggacuaugugag

SEQ ID NO: 1297 - RNA, 22 nt, Human Herpes Virus 1
ggccgccugccgcgggauccug

SEQ ID NO: 1298 - RNA, 22 nt, Human Herpes Virus 1
ggcuucgacggcgaccuggcgg

SEQ ID NO: 1299 - RNA, 22 nt, Human Herpes Virus 1
ggccgccugccgcgggauccug

SEQ ID NO: 1300 - RNA, 22 nt, Human Herpes Virus 1
ggcuucgacggcgaccuggcgg

SEQ ID NO: 1301 - RNA, 22 nt, Human Herpes Virus 1
ggguggccggugccgcgcgggu

SEQ ID NO: 1302 - RNA, 22 nt, Human Herpes Virus 1
caaggccgggucggccgccucg

SEQ ID NO: 1303 - RNA, 22 nt, Human Herpes Virus 1
ugcuggccgcgggguugggguc

SEQ ID NO: 1304 - RNA, 22 nt, Human Herpes Virus 1
ccgaagaugcguggcuaggcgc

SEQ ID NO: 1305 - RNA, 22 nt, Human Herpes Virus 1
ggguuuggaucucugaccugag

SEQ ID NO: 1306 - RNA, 18 nt, Human Herpes Virus 1
guagagaugcccgaaccc

SEQ ID NO: 1307 - RNA, 22 nt, Human Herpes Virus 1
ggguuuggaucucugaccugag

SEQ ID NO: 1308 - RNA, 18 nt, Human Herpes Virus 1
guagagaugcccgaaccc

SEQ ID NO: 1309 - RNA, 22 nt, Human Herpes Virus 1
gggccccgacgugcgggugggu

SEQ ID NO: 1310 - RNA, 22 nt, Human Herpes Virus 1
cgcgccgcgcugugggaggggc

SEQ ID NO: 1311 - RNA, 22 nt, Human Herpes Virus 1
ccccgagccacgccagaaccuu

SEQ ID NO: 1312 - RNA, 22 nt, Human Herpes Virus 1
acgggguggcguggcuucgggg

SEQ ID NO: 1313 - RNA, 22 nt, Human Herpes Virus 1
uaggcccguccggccguggggg

SEQ ID NO: 1314 - RNA, 22 nt, Human Herpes Virus 1
cccgaggucggccagggccgcc

SEQ ID NO: 1315 - RNA, 22 nt, Human Herpes Virus 1
ugggagaccgggguugucgugg

SEQ ID NO: 1316 - RNA, 22 nt, Human Herpes Virus 1
gcgguacccuggggucucuggg

SEQ ID NO: 1317 - RNA, 22 nt, Human Herpes Virus 1
ggggggugcucugauagucucg

SEQ ID NO: 1318 - RNA, 20 nt, Human Herpes Virus 1
cgugaucgggguacuucgcc

SEQ ID NO: 1319 - RNA, 22 nt, Human Herpes Virus 1
uccugucgggucacgaaugcga

SEQ ID NO: 1320 - RNA, 22 nt, Human Herpes Virus 1
uacgccguguccuucacggggc

SEQ ID NO: 1321 - RNA, 22 nt, Human Herpes Virus 1
gccauggcggccggccgcuucg

SEQ ID NO: 1322 - RNA, 20 nt, Human Herpes Virus 1
cacgcggcggccgccguggc

SEQ ID NO: 1323 - RNA, 22 nt, Human Herpes Virus 1
ugggcguacgaagggauguacg

SEQ ID NO: 1324 - RNA, 22 nt, Human Herpes Virus 1
gacguacgugucgucguccaug

SEQ ID NO: 1325 - RNA, 22 nt, Human Herpes Virus 1
agcggcugucccccgcgcgggu

SEQ ID NO: 1326 - RNA, 22 nt, Human Herpes Virus 1
gaccacgcgguggcgcuguuca

SEQ ID NO: 1327 - RNA, 22 nt, Human Herpes Virus 1
ugccgcacgcggugggggccga

SEQ ID NO: 1328 - RNA, 21 nt, Human Herpes Virus 1
caaccccgacgugcguugcac

SEQ ID NO: 1329 - RNA, 22 nt, Human Herpes Virus 1
ggaaaggaaagaggaaacaggc

SEQ ID NO: 1330 - RNA, 21 nt, Human Herpes Virus 1
uuguguucccuuuucuuucuu

SEQ ID NO: 1331 - RNA, 22 nt, Human Herpes Virus 1
gggcccagcgcgaucuacggga

SEQ ID NO: 1332 - RNA, 21 nt, Human Herpes Virus 1
ccgaggcgucgcugccggccc

SEQ ID NO: 1333 - RNA, 22 nt, Human Herpes Virus 1
ucucccgggcaaacgugcgcgc

SEQ ID NO: 1334 - RNA, 21 nt, Human Herpes Virus 1
gguauggagccugggguggug

SEQ ID NO: 1335 - RNA, 22 nt, Human Herpes Virus 1
uguggcucggggcggggguguc

SEQ ID NO: 1336 - RNA, 22 nt, Human Herpes Virus 1
aaacugccuccaccgggcccac

SEQ ID NO: 1337 - RNA, 22 nt, Human Herpes Virus 1
uaucugggucaccguuagcgcg

SEQ ID NO: 1338 - RNA, 20 nt, Human Herpes Virus 1
cgcucgcguggcauuagaug

SEQ ID NO: 1339 - RNA, 22 nt, Human Herpes Virus 1
gacguaccuggccaccggggcc

SEQ ID NO: 1340 - RNA, 20 nt, Human Herpes Virus 1
ccgacgccguccggugcguu

SEQ ID NO: 1341 - RNA, 22 nt, Human Herpes Virus 1
uucacccuggguggcggcuguu

SEQ ID NO: 1342 - RNA, 22 nt, Human Herpes Virus 1
acacggcgccgcucugcgguau

SEQ ID NO: 1343 - RNA, 22 nt, Human Herpes Virus 1
gccccccgggccuccggagagg

SEQ ID NO: 1344 - RNA, 21 nt, Human Herpes Virus 1
cgcucggcggcccgggcgggc

SEQ ID NO: 1345 - RNA, 22 nt, Human Herpes Virus 1
cacccgagggccccccgcucgu

SEQ ID NO: 1346 - RNA, 22 nt, Human Herpes Virus 1
ugggcggcggcccgucgguggg

SEQ ID NO: 1347 - RNA, 22 nt, Human Herpes Virus 1
gcggcggcggccgccagcgcgu

SEQ ID NO: 1348 - RNA, 21 nt, Human Herpes Virus 1
gcgcuggccgccgccgccagc

SEQ ID NO: 1349 - RNA, 22 nt, Human Herpes Virus 1
gcggcggcggccgccagcgcgu

SEQ ID NO: 1350 - RNA, 21 nt, Human Herpes Virus 1
gcgcuggccgccgccgccagc

SEQ ID NO: 1351 - RNA, 22 nt, Human Herpes Virus 1
uguugcgaccuggagagcuggc

SEQ ID NO: 1352 - RNA, 22 nt, Human Herpes Virus 1
agcccuucauguucgucaacgg

SEQ ID NO: 1353 - RNA, 22 nt, Human Herpes Virus 1
gcggagccggcccggcgaacuc

SEQ ID NO: 1354 - RNA, 22 nt, Human Herpes Virus 1
aggcggccugggucuuccgcgg

SEQ ID NO: 1355 - RNA, 22 nt, Human Herpes Virus 1
gcggagccggcccggcgaacuc

SEQ ID NO: 1356 - RNA, 22 nt, Human Herpes Virus 1
aggcggccugggucuuccgcgg

SEQ ID NO: 1357 - RNA, 22 nt, Human Herpes Virus 1
acggggugcucccggcggcccc

SEQ ID NO: 1358 - RNA, 20 nt, Human Herpes Virus 1
cgggacgcgaguacccacgu

SEQ ID NO: 1359 - RNA, 22 nt, Human Herpes Virus 1
uccuugucugugccggaggugg

SEQ ID NO: 1360 - RNA, 21 nt, Human Herpes Virus 1
gcccggggggcggaacgagga

SEQ ID NO: 1361 - RNA, 22 nt, Human Herpes Virus 1
uuggugccgguggggcguaccg

SEQ ID NO: 1362 - RNA, 20 nt, Human Herpes Virus 1
gugcagcggacuggcaccga

SEQ ID NO: 1363 - RNA, 22 nt, Human Herpes Virus 1
ggggggguucgggcaucucuac

SEQ ID NO: 1364 - RNA, 22 nt, Human Herpes Virus 1
gucagagauccaaacccuccgg

SEQ ID NO: 1365 - RNA, 22 nt, Human Herpes Virus 1
ggucucuuuuguguggugcguu

SEQ ID NO: 1366 - RNA, 22 nt, Human Herpes Virus 1
gggcugccgccagguugggggc

SEQ ID NO: 1367 - RNA, 22 nt, Human Herpes Virus 1
acccgcccccgcgccucgcccg

SEQ ID NO: 1368 - RNA, 22 nt, Human Herpes Virus 1
ggcgauggggugggguucaugg

SEQ ID NO: 1369 - RNA, 22 nt, Human Herpes Virus 1
cggcggcguggggcagguaccg

SEQ ID NO: 1370 - RNA, 22 nt, Human Herpes Virus 1
guccagccgcaccugcgccugc

SEQ ID NO: 1371 - RNA, 22 nt, Human Herpes Virus 1
ugcccccgaagccacgccaccc

SEQ ID NO: 1372 - RNA, 19 nt, Human Herpes Virus 1
gcguggcucggggucgcgg

SEQ ID NO: 1373 - RNA, 22 nt, Human Herpes Virus 1
uaaggcgucgcggcguccugga

SEQ ID NO: 1374 - RNA, 22 nt, Human Herpes Virus 1
uuuggugggauuugcggcgcca

SEQ ID NO: 1375 - RNA, 22 nt, Human Herpes Virus 1
cggcggcgcgcucaaccaccgc

SEQ ID NO: 1376 - RNA, 22 nt, Human Herpes Virus 1
guaggcccagcauguccgccgg

SEQ ID NO: 1377 - RNA, 22 nt, Human Herpes Virus 1
uccggcgcguccucggcgggag

SEQ ID NO: 1378 - RNA, 22 nt, Human Herpes Virus 1
uguaccacugccacugucggua

SEQ ID NO: 1379 - RNA, 22 nt, Human Herpes Virus 1
aaugggggggcggcaaggcggg

SEQ ID NO: 1380 - RNA, 22 nt, Human Herpes Virus 1
cgccgucccguuggucccggcg

SEQ ID NO: 1381 - RNA, 22 nt, Human Herpes Virus 1
uggucccccgcggguggcccgc

SEQ ID NO: 1382 - RNA, 22 nt, Human Herpes Virus 1
cgccagucccggggaggacacg

SEQ ID NO: 1383 - RNA, 22 nt, Human Herpes Virus 1
gcccguccccgccccguacguc

SEQ ID NO: 1384 - RNA, 20 nt, Human Herpes Virus 1
augcgggggguggcacgggu

SEQ ID NO: 1385 - RNA, 22 nt, Human Herpes Virus 1
gggggcgcagggcccacgggcc

SEQ ID NO: 1386 - RNA, 20 nt, Human Herpes Virus 1
gugcggggcauugugucucc

SEQ ID NO: 1387 - RNA, 22 nt, Human Herpes Virus 1
cguccucgccgacccgggcuuc

SEQ ID NO: 1388 - RNA, 18 nt, Human Herpes Virus 1
cccugguggucggggacg

SEQ ID NO: 1389 - RNA, 22 nt, Human Herpes Virus 1
gagccguaccgggccaaugggu

SEQ ID NO: 1390 - RNA, 22 nt, Human Herpes Virus 1
cacacgggcccgggggguuuag

SEQ ID NO: 1391 - RNA, 22 nt, Human Herpes Virus 1
ucgagcguaccgacgggcggca

SEQ ID NO: 1392 - RNA, 22 nt, Human Herpes Virus 1
gacuggccgucaggagcucggc

SEQ ID NO: 1393 - RNA, 22 nt, Human Herpes Virus 1
cacccgagggccccccgcucgu

SEQ ID NO: 1394 - RNA, 22 nt, Human Herpes Virus 1
ugggcggcggcccgucgguggg

SEQ ID NO: 1395 - RNA, 22 nt, Human Herpes Virus 1
cgugguccccggggacguggcg

SEQ ID NO: 1396 - RNA, 22 nt, Human Herpes Virus 1
uccggaucucgggcgccgcgcg

SEQ ID NO: 1397 - RNA, 22 nt, Human Herpes Virus 1
cgucaccaugcagcgccggacg

SEQ ID NO: 1398 - RNA, 22 nt, Human Herpes Virus 1
ggcuggcgcggugccugacgcc

SEQ ID NO: 1399 - RNA, 22 nt, Human Herpes Virus 1
cgaaaaccccccgggggcucuu

SEQ ID NO: 1400 - RNA, 22 nt, Human Herpes Virus 1
ggcccccgguaucgggucuuug

SEQ ID NO: 1401 - RNA, 22 nt, Human Herpes Virus 1
ccauagccacgggccccguggg

SEQ ID NO: 1402 - RNA, 19 nt, Human Herpes Virus 1
cauggggaaugguuuaugg

SEQ ID NO: 1403 - RNA, 22 nt, Human Herpes Virus 1
ucgauggcgcugcccgggcggg

SEQ ID NO: 1404 - RNA, 19 nt, Human Herpes Virus 1
uguccgaugccgucgucga

SEQ ID NO: 1405 - RNA, 22 nt, Human Herpes Virus 1
ccgucaggugggccaggcgcuu

SEQ ID NO: 1406 - RNA, 22 nt, Human Herpes Virus 1
gugucugcucaguucggcggug

SEQ ID NO: 1407 - RNA, 22 nt, Human Herpes Virus 1
ccaugggcgguggaggaguucc

SEQ ID NO: 1408 - RNA, 21 nt, Human Herpes Virus 1
agcucauccaacgccgcaugg

SEQ ID NO: 1409 - RNA, 22 nt, Human Herpes Virus 1
agcggggcccacgcggucaaug

SEQ ID NO: 1410 - RNA, 22 nt, Human Herpes Virus 1
cucgcugacgguggcccgcuug

SEQ ID NO: 1411 - RNA, 22 nt, Human Herpes Virus 1
uccccugcggcguugcgacaua

SEQ ID NO: 1412 - RNA, 20 nt, Human Herpes Virus 1
uacucgcgagcgcggggggg

SEQ ID NO: 1413 - RNA, 22 nt, Human Herpes Virus 1
gcgugccggcgucggggcgggg

SEQ ID NO: 1414 - RNA, 22 nt, Human Herpes Virus 1
uccguucggggugggcccgccg

SEQ ID NO: 1415 - RNA, 22 nt, Human Herpes Virus 1
ucgucgucagcaccgucaucca

SEQ ID NO: 1416 - RNA, 19 nt, Human Herpes Virus 1
uguauuggugcgauggcga

SEQ ID NO: 1417 - RNA, 22 nt, Human Herpes Virus 1
gguccucgucgguggcgcuggc

SEQ ID NO: 1418 - RNA, 22 nt, Human Herpes Virus 1
gcccgccacaaacgggagcucc

SEQ ID NO: 1419 - RNA, 22 nt, Human Herpes Virus 1
aaagacccgauaccgggggccg

SEQ ID NO: 1420 - RNA, 22 nt, Human Herpes Virus 1
gaagagcccccgggggguuuuc

SEQ ID NO: 1421 - RNA, 22 nt, Human Herpes Virus 1
uggccccaggccucgcccagcc

SEQ ID NO: 1422 - RNA, 22 nt, Human Herpes Virus 1
gcggggcgcgcuggugggccag

SEQ ID NO: 1423 - RNA, 22 nt, Human Herpes Virus 1
aggcgcaccccgaucgcacgcu

SEQ ID NO: 1424 - RNA, 22 nt, Human Herpes Virus 1
ugcgcgaucgggcggcgccucg

SEQ ID NO: 1425 - RNA, 22 nt, Human Herpes Virus 1
cgccgccaucgcgcccuuucgc

SEQ ID NO: 1426 - RNA, 22 nt, Human Herpes Virus 1
cgagggggcgcggcgacuggcc

SEQ ID NO: 1427 - RNA, 22 nt, Human Herpes Virus 1
ugcugggccuaccguggacucc

SEQ ID NO: 1428 - RNA, 22 nt, Human Herpes Virus 1
gggggagcggugguugagcgcg

SEQ ID NO: 1429 - RNA, 22 nt, Human Herpes Virus 1
ccgcgggcaggaggcauccggc

SEQ ID NO: 1430 - RNA, 16 nt, Human Herpes Virus 1
cgggccaggcucgcgg

SEQ ID NO: 1431 - RNA, 22 nt, Human Herpes Virus 1
cgcgcggggcucguaucucauu

SEQ ID NO: 1432 - RNA, 22 nt, Human Herpes Virus 1
ucggggcccgggccccgccccc

SEQ ID NO: 1433 - RNA, 22 nt, Human Herpes Virus 1
ucggcggaccacuccggcggcc

SEQ ID NO: 1434 - RNA, 22 nt, Human Herpes Virus 1
cgccggccagguccucgcccgg

SEQ ID NO: 1435 - RNA, 22 nt, Human Herpes Virus 1
cgguuccgcgguaccccgaguc

SEQ ID NO: 1436 - RNA, 22 nt, Human Herpes Virus 1
cccaguauuacguggugcccgg

SEQ ID NO: 1437 - RNA, 22 nt, Human Herpes Virus 1
agcucccuuagcguggggccgg

SEQ ID NO: 1438 - RNA, 22 nt, Human Herpes Virus 1
gccccgggcaccagggaacucg

SEQ ID NO: 1439 - RNA, 22 nt, Human Herpes Virus 1
cguauuggucccaauggggucu

SEQ ID NO: 1440 - RNA, 22 nt, Human Herpes Virus 1
gugccagcccugggaccgaacc

SEQ ID NO: 1441 - RNA, 22 nt, Human Herpes Virus 1
ggggcugcagcuggaccagggg

SEQ ID NO: 1442 - RNA, 22 nt, Human Herpes Virus 1
ccuggagaucacguacagcucc

SEQ ID NO: 1443 - RNA, 22 nt, Human Herpes Virus 1
aaugggggggcggcaaggcggg

SEQ ID NO: 1444 - RNA, 22 nt, Human Herpes Virus 1
cgccgucccguuggucccggcg

SEQ ID NO: 1445 - RNA, 22 nt, Human Herpes Virus 1
gcguccccgcacgcccgggcgu

SEQ ID NO: 1446 - RNA, 22 nt, Human Herpes Virus 1
gccagggccgugugcagcgcgu

SEQ ID NO: 1447 - RNA, 22 nt, Human Herpes Virus 1
gggggguucgggcaucucuacc

SEQ ID NO: 1448 - RNA, 20 nt, Human Herpes Virus 1
gucagagauccaaacccucc

SEQ ID NO: 1449 - RNA, 22 nt, Human Herpes Virus 1
cgcccgcgcaggccccgggccg

SEQ ID NO: 1450 - RNA, 22 nt, Human Herpes Virus 1
gcguccgggggaccuccgggug

SEQ ID NO: 1451 - RNA, 22 nt, Human Herpes Virus 1
ggcccggcggucgauaaucuug

SEQ ID NO: 1452 - RNA, 22 nt, Human Herpes Virus 1
guugcucgauggggugcgggcc

SEQ ID NO: 1453 - RNA, 22 nt, Human Herpes Virus 1
ugcgggugguuguuauccauga

SEQ ID NO: 1454 - RNA, 22 nt, Human Herpes Virus 1
uugguggccaagacgagcccgc

SEQ ID NO: 1455 - RNA, 22 nt, Human Herpes Virus 1
cgucgagugccuggccgccugc

SEQ ID NO: 1456 - RNA, 22 nt, Human Herpes Virus 1
cgcuggccgagggcuucgacgg

SEQ ID NO: 1457 - RNA, 22 nt, Human Herpes Virus 1
uaccuuccccgcccggucgagu

SEQ ID NO: 1458 - RNA, 22 nt, Human Herpes Virus 1
uggccugggcccgggacuuugg

SEQ ID NO: 1459 - RNA, 22 nt, Human Herpes Virus 1
gagguuuugagcagcugggcaa

SEQ ID NO: 1460 - RNA, 21 nt, Human Herpes Virus 1
caccagcuggcgaaaggcuuc

SEQ ID NO: 1461 - RNA, 22 nt, Human Herpes Virus 1
ugcagcaucuggucggccgugc

SEQ ID NO: 1462 - RNA, 22 nt, Human Herpes Virus 1
gaggacggccuggacguugcga

SEQ ID NO: 1463 - RNA, 22 nt, Human Herpes Virus 1
ucgcgcagcacauccuccacgg

SEQ ID NO: 1464 - RNA, 22 nt, Human Herpes Virus 1
ugggauggaggucgguguggca

SEQ ID NO: 1465 - RNA, 22 nt, Human Herpes Virus 1
ggucggugaugucgggcgucgg

SEQ ID NO: 1466 - RNA, 22 nt, Human Herpes Virus 1
ucugcgcuugcgauucuagccu

SEQ ID NO: 1467 - RNA, 22 nt, Human Herpes Virus 1
ucaucuucuucggccgccucug

SEQ ID NO: 1468 - RNA, 22 nt, Human Herpes Virus 1
gggcggagggaggcgguggugg

SEQ ID NO: 1469 - RNA, 22 nt, Human Herpes Virus 1
ggggucgcugucauagugcaaa

SEQ ID NO: 1470 - RNA, 17 nt, Human Herpes Virus 1
acuaugacaccggccuu

SEQ ID NO: 1471 - RNA, 22 nt, Human Herpes Virus 1
cgcgcggggcucguaucucauu

SEQ ID NO: 1472 - RNA, 22 nt, Human Herpes Virus 1
ucggggcccgggccccgccccc

SEQ ID NO: 1473 - RNA, 22 nt, Human Herpes Virus 1
ccccacgcagggucugcgagca

SEQ ID NO: 1474 - RNA, 22 nt, Human Herpes Virus 1
uacgccuaccucugccuggggu

SEQ ID NO: 1475 - RNA, 22 nt, Human Herpes Virus 1
ccgccucccccgagucuucgga

SEQ ID NO: 1476 - RNA, 22 nt, Human Herpes Virus 1
ccgaggcacggaugagcggcca

SEQ ID NO: 1477 - RNA, 22 nt, Human Herpes Virus 1
gggguuacgcggguaguaggcg

SEQ ID NO: 1478 - RNA, 21 nt, Human Herpes Virus 1
ucgccuugaacggcugacccu

SEQ ID NO: 1479 - RNA, 22 nt, Human Herpes Virus 1
gaguccccgcugucauacaggg

SEQ ID NO: 1480 - RNA, 19 nt, Human Herpes Virus 1
cccugucgggcaggggcuc

SEQ ID NO: 1481 - RNA, 22 nt, Human Herpes Virus 1
ccgucucgaacaguuccguguc

SEQ ID NO: 1482 - RNA, 22 nt, Human Herpes Virus 1
aggcggagucgucgucauggug

SEQ ID NO: 1483 - RNA, 22 nt, Human Herpes Virus 1
ccgucucgaacaguuccguguc

SEQ ID NO: 1484 - RNA, 22 nt, Human Herpes Virus 1
aggcggagucgucgucauggug

SEQ ID NO: 1485 - RNA, 22 nt, Human Herpes Virus 1
ggcuggcggcuccgcgccuguc

SEQ ID NO: 1486 - RNA, 22 nt, Human Herpes Virus 1
cacacgcgcagacugucgacgg

SEQ ID NO: 1487 - RNA, 22 nt, Human Herpes Virus 1
uggggucggggguggggucgga

SEQ ID NO: 1488 - RNA, 22 nt, Human Herpes Virus 1
gguugcaccaccaggaccaccg

SEQ ID NO: 1489 - RNA, 22 nt, Human Herpes Virus 1
gcggacccaggcccgggggauu

SEQ ID NO: 1490 - RNA, 22 nt, Human Herpes Virus 1
gcccggacggcguggguugcgg

SEQ ID NO: 1491 - RNA, 22 nt, Human Herpes Virus 1
ccggugagcuuguagccgaucc

SEQ ID NO: 1492 - RNA, 22 nt, Human Herpes Virus 1
gugggugacgacguagcuggcg

SEQ ID NO: 1493 - RNA, 22 nt, Human Herpes Virus 1
ugcccgcccaggcggccguguc

SEQ ID NO: 1494 - RNA, 22 nt, Human Herpes Virus 1
uggccagggccgccagcaggca

SEQ ID NO: 1495 - RNA, 22 nt, Human Herpes Virus 1
ucgggccgugccuggggcccga

SEQ ID NO: 1496 - RNA, 22 nt, Human Herpes Virus 1
uggcccgcggagccggcccggc

SEQ ID NO: 1497 - RNA, 22 nt, Human Herpes Virus 1
ucgggccgugccuggggcccga

SEQ ID NO: 1498 - RNA, 22 nt, Human Herpes Virus 1
uggcccgcggagccggcccggc

SEQ ID NO: 1499 - RNA, 22 nt, Human Herpes Virus 1
gccagccccuggcgagacagau

SEQ ID NO: 1500 - RNA, 22 nt, Human Herpes Virus 1
ggucgucuggcccagggggccg

SEQ ID NO: 1501 - RNA, 22 nt, Human Herpes Virus 1
cagcccugucgccgguaugggg

SEQ ID NO: 1502 - RNA, 22 nt, Human Herpes Virus 1
cgcgcgccgcgcguugggcccu

SEQ ID NO: 1503 - RNA, 22 nt, Human Herpes Virus 1
ugcucucggaggaagccgucaa

SEQ ID NO: 1504 - RNA, 22 nt, Human Herpes Virus 1
uaagcggcugucccccgcgcgg

SEQ ID NO: 1505 - RNA, 22 nt, Human Herpes Virus 1
uauggagccgguuguguuugga

SEQ ID NO: 1506 - RNA, 20 nt, Human Herpes Virus 1
cccgcacgacggcccagugc

SEQ ID NO: 1507 - RNA, 22 nt, Human Herpes Virus 1
ugggcgggagccaugguguuuu

SEQ ID NO: 1508 - RNA, 22 nt, Human Herpes Virus 1
aacccgcggcuccugcggacuu

SEQ ID NO: 1509 - RNA, 22 nt, Human Herpes Virus 1
cgggccugucguguagauucga

SEQ ID NO: 1510 - RNA, 22 nt, Human Herpes Virus 1
uugugucgcagggcggcccgcg

SEQ ID NO: 1511 - RNA, 22 nt, Human Herpes Virus 1
ugcgauugguucugggggcacg

SEQ ID NO: 1512 - RNA, 22 nt, Human Herpes Virus 1
gcagccccgggaccaccgcgac

SEQ ID NO: 1513 - RNA, 22 nt, Human Herpes Virus 1
ccgcuguggccucaccugacca

SEQ ID NO: 1514 - RNA, 22 nt, Human Herpes Virus 1
cggaacgggaggccacagcgcc

SEQ ID NO: 1515 - RNA, 22 nt, Human Herpes Virus 1
gaguggcuucuggagcgcucgc

SEQ ID NO: 1516 - RNA, 18 nt, Human Herpes Virus 1
acgcacccagaaccgcuu

SEQ ID NO: 1517 - RNA, 22 nt, Human Herpes Virus 1
ccgccagcacggugccgcugcg

SEQ ID NO: 1518 - RNA, 22 nt, Human Herpes Virus 1
cagcgaaucccgggcggcgccg

SEQ ID NO: 1519 - RNA, 22 nt, Human Herpes Virus 1
cccaugcggcguuggaugagcu

SEQ ID NO: 1520 - RNA, 21 nt, Human Herpes Virus 1
aacuccuccaccgcccauggg

SEQ ID NO: 1521 - RNA, 22 nt, Human Herpes Virus 1
gaggcccauagcucggcgagcg

SEQ ID NO: 1522 - RNA, 20 nt, Human Herpes Virus 1
cugcuucgcuggauggccuu

SEQ ID NO: 1523 - RNA, 22 nt, Human Herpes Virus 1
ccccgccgcuugaucauuauca

SEQ ID NO: 1524 - RNA, 21 nt, Human Herpes Virus 1
uccggagaucaugcgcgggug

SEQ ID NO: 1525 - RNA, 22 nt, Human Herpes Virus 1
ucgguauucgaggccacacgcg

SEQ ID NO: 1526 - RNA, 22 nt, Human Herpes Virus 1
gaaguggaccugggaccgcgcc

SEQ ID NO: 1527 - RNA, 22 nt, Human Herpes Virus 1
ggccggcagcgccccgugggug

SEQ ID NO: 1528 - RNA, 22 nt, Human Herpes Virus 1
aaccgcgucagggcgcccucgg

SEQ ID NO: 1529 - RNA, 22 nt, Human Herpes Virus 1
cagugcucgcacuucgcccuaa

SEQ ID NO: 1530 - RNA, 22 nt, Human Herpes Virus 1
ugggacgaagugcgaacgcuuc

SEQ ID NO: 1531 - RNA, 22 nt, Human Herpes Virus 1
cgccgucgaagcccucggccag

SEQ ID NO: 1532 - RNA, 22 nt, Human Herpes Virus 1
gcggccaggcacucgacggcca

SEQ ID NO: 1533 - RNA, 22 nt, Human Herpes Virus 1
cgcgcgggggacagccgcuuag

SEQ ID NO: 1534 - RNA, 22 nt, Human Herpes Virus 1
ugacggcuuccuccgagagcag

SEQ ID NO: 1535 - RNA, 22 nt, Human Herpes Virus 1
cgcggcgcccggcgucgucguc

SEQ ID NO: 1536 - RNA, 21 nt, Human Herpes Virus 1
cgggcggcgucggggucgucg

SEQ ID NO: 1537 - RNA, 22 nt, Human Herpes Virus 1
cgcggcgcccggcgucgucguc

SEQ ID NO: 1538 - RNA, 21 nt, Human Herpes Virus 1
cgggcggcgucggggucgucg

SEQ ID NO: 1539 - RNA, 22 nt, Human Herpes Virus 1
gcgccgcccgggauucgcuggg

SEQ ID NO: 1540 - RNA, 22 nt, Human Herpes Virus 1
cgcagcggcaccgugcuggcgg

SEQ ID NO: 1541 - RNA, 22 nt, Human Herpes Virus 1
gcgguugucgucugauuauuug

SEQ ID NO: 1542 - RNA, 16 nt, Human Herpes Virus 1
caggagacgggaccgc

SEQ ID NO: 1543 - RNA, 22 nt, Human Herpes Virus 1
caggguggcguggcccgcggcg

SEQ ID NO: 1544 - RNA, 22 nt, Human Herpes Virus 1
ccggcggggcgcggcggcuuug

SEQ ID NO: 1545 - RNA, 22 nt, Human Herpes Virus 1
ucgugcucccagaggcgcgaca

SEQ ID NO: 1546 - RNA, 22 nt, Human Herpes Virus 1
gggcguacgaagggauguacgg

SEQ ID NO: 1547 - RNA, 22 nt, Human Herpes Virus 1
gggagucugcaccgccgcauua

SEQ ID NO: 1548 - RNA, 22 nt, Human Herpes Virus 1
aucgccggggguguggggcccu

SEQ ID NO: 1549 - RNA, 22 nt, Human Herpes Virus 1
uugucggguggcucccgccgga

SEQ ID NO: 1550 - RNA, 22 nt, Human Herpes Virus 1
accucgcgggggccgcuuaagc

SEQ ID NO: 1551 - RNA, 22 nt, Human Herpes Virus 1
uacucuggguucccuagguucu

SEQ ID NO: 1552 - RNA, 22 nt, Human Herpes Virus 1
acccggggcucccggggaacac

SEQ ID NO: 1553 - RNA, 22 nt, Human Herpes Virus 1
gaguuagacaggcaagcacuac

SEQ ID NO: 1554 - RNA, 16 nt, Human Herpes Virus 1
cuugccugucaaacuc

SEQ ID NO: 1555 - RNA, 22 nt, Human Herpes Virus 1
gaguuagacaggcaagcacuac

SEQ ID NO: 1556 - RNA, 16 nt, Human Herpes Virus 1
cuugccugucaaacuc

SEQ ID NO: 1557 - RNA, 22 nt, Human Herpes Virus 1
ucgcacucgucccuggcucagg

SEQ ID NO: 1558 - RNA, 22 nt, Human Herpes Virus 1
ucugugccgggcgcgugcgacg

SEQ ID NO: 1559 - RNA, 22 nt, Human Herpes Virus 1
ucgcacucgucccuggcucagg

SEQ ID NO: 1560 - RNA, 22 nt, Human Herpes Virus 1
ucugugccgggcgcgugcgacg

SEQ ID NO: 1561 - RNA, 22 nt, Human Herpes Virus 1
ugccccuggcgcuauguccggc

SEQ ID NO: 1562 - RNA, 22 nt, Human Herpes Virus 1
ggggccuggagcuggggguggg

SEQ ID NO: 1563 - RNA, 22 nt, Human Herpes Virus 1
cggcgagcaccuggccaugcug

SEQ ID NO: 1564 - RNA, 22 nt, Human Herpes Virus 1
cugcuggccaagaugcuguuuu

SEQ ID NO: 1565 - RNA, 22 nt, Human Herpes Virus 1
uacgaagccauacgcgcuucua

SEQ ID NO: 1566 - RNA, 22 nt, Human Herpes Virus 1
aggugcgggaguuucacgccac

SEQ ID NO: 1567 - RNA, 22 nt, Human Herpes Virus 1
gguggacaucaugucccaguuu

SEQ ID NO: 1568 - RNA, 21 nt, Human Herpes Virus 1
augggagacgagggggccgcc

SEQ ID NO: 1569 - RNA, 22 nt, Human Herpes Virus 1
ggccgagggcgcccugacgcgg

SEQ ID NO: 1570 - RNA, 21 nt, Human Herpes Virus 1
acccacggggcgcugccggcc

SEQ ID NO: 1571 - RNA, 22 nt, Human Herpes Virus 1
aguccguggguggcgcgacggu

SEQ ID NO: 1572 - RNA, 22 nt, Human Herpes Virus 1
ucgucguccucgacgggggugu

SEQ ID NO: 1573 - RNA, 22 nt, Human Herpes Virus 1
uggguucggggggcccgggggg

SEQ ID NO: 1574 - RNA, 22 nt, Human Herpes Virus 1
uccggccccuccggacccagcg

SEQ ID NO: 1575 - RNA, 22 nt, Human Herpes Virus 1
agcgcgugaggccgcccgcggg

SEQ ID NO: 1576 - RNA, 22 nt, Human Herpes Virus 1
uccgcguggcgcgucuuccggg

SEQ ID NO: 1577 - RNA, 22 nt, Human Herpes Virus 1
agcgcgugaggccgcccgcggg

SEQ ID NO: 1578 - RNA, 22 nt, Human Herpes Virus 1
uccgcguggcgcgucuuccggg

SEQ ID NO: 1579 - RNA, 22 nt, Human Herpes Virus 1
gcccgccgcgcgcaggucccgu

SEQ ID NO: 1580 - RNA, 22 nt, Human Herpes Virus 1
ccggaucccguacgugaucgug

SEQ ID NO: 1581 - RNA, 22 nt, Human Herpes Virus 1
ccccccgcgcucgcgaguacuu

SEQ ID NO: 1582 - RNA, 22 nt, Human Herpes Virus 1
uaugucgcaacgccgcagggga

SEQ ID NO: 1583 - RNA, 22 nt, Human Herpes Virus 1
cccccgcgcauggugccccgca

SEQ ID NO: 1584 - RNA, 22 nt, Human Herpes Virus 1
uguucgguaucgucguuggggg

SEQ ID NO: 1585 - RNA, 22 nt, Human Herpes Virus 1
ccagcgcuccguguucguagcg

SEQ ID NO: 1586 - RNA, 22 nt, Human Herpes Virus 1
cgaacugcgucuuggggagcuu

SEQ ID NO: 1587 - RNA, 22 nt, Human Herpes Virus 1
ucccgcugcgcauccccccguc

SEQ ID NO: 1588 - RNA, 19 nt, Human Herpes Virus 1
acgguggacagcaucggga

SEQ ID NO: 1589 - RNA, 22 nt, Human Herpes Virus 1
ggccgcgcccagggccgucacc

SEQ ID NO: 1590 - RNA, 20 nt, Human Herpes Virus 1
cgcggugcgcccgcacggcc

SEQ ID NO: 1591 - RNA, 22 nt, Human Herpes Virus 1
uccgcauccucuucguccucgu

SEQ ID NO: 1592 - RNA, 22 nt, Human Herpes Virus 1
aggacgaggacgacgacggcaa

SEQ ID NO: 1593 - RNA, 22 nt, Human Herpes Virus 1
uggccccaaucucaucccggcu

SEQ ID NO: 1594 - RNA, 22 nt, Human Herpes Virus 1
auaccggggggagaugcgccac

SEQ ID NO: 1595 - RNA, 22 nt, Human Herpes Virus 1
ccugcgucgccccgugucugug

SEQ ID NO: 1596 - RNA, 22 nt, Human Herpes Virus 1
aguguacccuggcgguccaggg

SEQ ID NO: 1597 - RNA, 22 nt, Human Herpes Virus 1
ccccaggcagagguaggcguag

SEQ ID NO: 1598 - RNA, 19 nt, Human Herpes Virus 1
ucgcagacccugcgugggg

SEQ ID NO: 1599 - RNA, 22 nt, Human Herpes Virus 1
ucggccauggccgcuaggaagg

SEQ ID NO: 1600 - RNA, 22 nt, Human Herpes Virus 1
cgggucgcuggcggccgcgccc

SEQ ID NO: 1601 - RNA, 22 nt, Human Herpes Virus 1
uccggacgucuucggaggcccc

SEQ ID NO: 1602 - RNA, 22 nt, Human Herpes Virus 1
ggccuccgacggugcguuuagg

SEQ ID NO: 1603 - RNA, 22 nt, Human Herpes Virus 1
ugggcaggugugguggaugacg

SEQ ID NO: 1604 - RNA, 22 nt, Human Herpes Virus 1
ggagugcgccgugcucuguugg

SEQ ID NO: 1605 - RNA, 22 nt, Human Herpes Virus 1
ugggcaggugugguggaugacg

SEQ ID NO: 1606 - RNA, 22 nt, Human Herpes Virus 1
ggagugcgccgugcucuguugg

SEQ ID NO: 1607 - RNA, 22 nt, Human Herpes Virus 1
ugguuaaugucgggacacuggg

SEQ ID NO: 1608 - RNA, 22 nt, Human Herpes Virus 1
ucggggucggggcacuuuggaa

SEQ ID NO: 1609 - RNA, 22 nt, Human Herpes Virus 1
agggggcauuagggagaaaaaa

SEQ ID NO: 1610 - RNA, 22 nt, Human Herpes Virus 1
guuuucuuugugccuguacuca

SEQ ID NO: 1611 - RNA, 22 nt, Human Herpes Virus 1
ggccacaggccagacgggcgcg

SEQ ID NO: 1612 - RNA, 22 nt, Human Herpes Virus 1
cgcgccccugcucguggaucuu

SEQ ID NO: 1613 - RNA, 22 nt, Human Herpes Virus 1
uucccgcccggucucgucguug

SEQ ID NO: 1614 - RNA, 22 nt, Human Herpes Virus 1
ccacgcgagccgggcgucaugg

SEQ ID NO: 1615 - RNA, 22 nt, Human Herpes Virus 1
cgccguuccguuuuccggaaua

SEQ ID NO: 1616 - RNA, 21 nt, Human Herpes Virus 1
uugggggagacgguuucggug

SEQ ID NO: 1617 - RNA, 22 nt, Human Herpes Virus 1
ucguuuuuguguauuggugcga

SEQ ID NO: 1618 - RNA, 22 nt, Human Herpes Virus 1
cgguugguccagacgcgggcga

SEQ ID NO: 1619 - RNA, 22 nt, Human Herpes Virus 1
gccgacgaggggcgcggugggc

SEQ ID NO: 1620 - RNA, 20 nt, Human Herpes Virus 1
caccacgugucccucgcggu

SEQ ID NO: 1621 - RNA, 22 nt, Human Herpes Virus 1
agcggccuguuugacggcaucc

SEQ ID NO: 1622 - RNA, 22 nt, Human Herpes Virus 1
augugguuaucacgggccgccg

SEQ ID NO: 1623 - RNA, 22 nt, Human Herpes Virus 1
ggggaggguuggagaccggggu

SEQ ID NO: 1624 - RNA, 20 nt, Human Herpes Virus 1
cccuucaccgacaacccccc

SEQ ID NO: 1625 - RNA, 22 nt, Human Herpes Virus 1
acgcccuucugaccgcgcgucu

SEQ ID NO: 1626 - RNA, 22 nt, Human Herpes Virus 1
cgcugagccccucgggggggcg

SEQ ID NO: 1627 - RNA, 22 nt, Human Herpes Virus 1
ggacgucacccgccgccacccg

SEQ ID NO: 1628 - RNA, 22 nt, Human Herpes Virus 1
ggcgugcggccuguggcguugc

SEQ ID NO: 1629 - RNA, 22 nt, Human Herpes Virus 1
gcguagcgcagggggguguacg

SEQ ID NO: 1630 - RNA, 22 nt, Human Herpes Virus 1
gugaaucccccgucaaacgcgg

SEQ ID NO: 1631 - RNA, 22 nt, Human Herpes Virus 1
acccgcccgugggccaggcgcu

SEQ ID NO: 1632 - RNA, 22 nt, Human Herpes Virus 1
cugcugcaugucugcggcgggg

SEQ ID NO: 1633 - RNA, 22 nt, Human Herpes Virus 1
uucccggccuggccgcccugug

SEQ ID NO: 1634 - RNA, 22 nt, Human Herpes Virus 1
ggggcggccggucgggucgacg

SEQ ID NO: 1635 - RNA, 22 nt, Human Herpes Virus 1
uagcauaucacauaccccguuc

SEQ ID NO: 1636 - RNA, 20 nt, Human Herpes Virus 1
gggcggggguggauacgcug

SEQ ID NO: 1637 - RNA, 22 nt, Human Herpes Virus 1
aguugagccgcgccauccucac

SEQ ID NO: 1638 - RNA, 22 nt, Human Herpes Virus 1
ugcagacgguggugcccagcgg

SEQ ID NO: 1639 - RNA, 22 nt, Human Herpes Virus 1
uugacgaacaugaagggcugga

SEQ ID NO: 1640 - RNA, 18 nt, Human Herpes Virus 1
agcucuccaggucgcaac

SEQ ID NO: 1641 - RNA, 22 nt, Human Herpes Virus 1
ggccacgaucacguacgggauc

SEQ ID NO: 1642 - RNA, 20 nt, Human Herpes Virus 1
ggaccugcgcgcggcgggcc

SEQ ID NO: 1643 - RNA, 22 nt, Human Herpes Virus 1
aauaaaugcguguuuucaucca

SEQ ID NO: 1644 - RNA, 22 nt, Human Herpes Virus 1
auggaggggcgggugugauaga

SEQ ID NO: 1645 - RNA, 22 nt, Human Herpes Virus 1
ugcaacgcacgucgggguugcc

SEQ ID NO: 1646 - RNA, 21 nt, Human Herpes Virus 1
ggcccccaccgcgugcggcac

SEQ ID NO: 1647 - RNA, 22 nt, Human Herpes Virus 1
gggcaaucagcgguucgccccg

SEQ ID NO: 1648 - RNA, 22 nt, Human Herpes Virus 1
ggggggcacacggugagggccc

SEQ ID NO: 1649 - RNA, 22 nt, Human Herpes Virus 1
gggcaaucagcgguucgccccg

SEQ ID NO: 1650 - RNA, 22 nt, Human Herpes Virus 1
ggggggcacacggugagggccc

SEQ ID NO: 1651 - RNA, 22 nt, Human Herpes Virus 1
aauaggcgggcgggcgaggaaa

SEQ ID NO: 1652 - RNA, 22 nt, Human Herpes Virus 1
ugaucgcgccccccguugucuc

SEQ ID NO: 1653 - RNA, 22 nt, Human Herpes Virus 1
aauaggcgggcgggcgaggaaa

SEQ ID NO: 1654 - RNA, 22 nt, Human Herpes Virus 1
ugaucgcgccccccguugucuc

SEQ ID NO: 1655 - RNA, 22 nt, Human Herpes Virus 1
ugcagagcucggcaugaugccc

SEQ ID NO: 1656 - RNA, 22 nt, Human Herpes Virus 1
ugcaccgcaccgagcgcuuugg

SEQ ID NO: 1657 - RNA, 22 nt, Human Herpes Virus 1
gccauggcgcccggcgcgccgg

SEQ ID NO: 1658 - RNA, 22 nt, Human Herpes Virus 1
ugcgcgcgcuggggccugggcg

SEQ ID NO: 1659 - RNA, 22 nt, Human Herpes Virus 1
cgcgaucgcguccgcgcaugug

SEQ ID NO: 1660 - RNA, 20 nt, Human Herpes Virus 1
agcugccggacgcuggcgcg

SEQ ID NO: 1661 - RNA, 22 nt, Human Herpes Virus 1
gccggcagcgccgccgucgcaa

SEQ ID NO: 1662 - RNA, 22 nt, Human Herpes Virus 1
gacgguggaugcggccgugcgg

SEQ ID NO: 1663 - RNA, 22 nt, Human Herpes Virus 1
ccgcuggguccggaggggccgg

SEQ ID NO: 1664 - RNA, 22 nt, Human Herpes Virus 1
cgggccccccgaacccagcggg

SEQ ID NO: 1665 - RNA, 22 nt, Human Herpes Virus 1
agugcucgcacuucgcccuaau

SEQ ID NO: 1666 - RNA, 20 nt, Human Herpes Virus 1
ugggacgaagugcgaacgcu

SEQ ID NO: 1667 - RNA, 22 nt, Human Herpes Virus 1
gcgcggggaggggggcgcgggc

SEQ ID NO: 1668 - RNA, 21 nt, Human Herpes Virus 1
uccgcgccgcucuucuucguc

SEQ ID NO: 1669 - RNA, 22 nt, Human Herpes Virus 1
gggaccgcagcgcgcagucggg

SEQ ID NO: 1670 - RNA, 19 nt, Human Herpes Virus 1
uggcgcgugcgccccuccc

SEQ ID NO: 1671 - RNA, 22 nt, Human Herpes Virus 1
cgaagaucggcugcuauccccg

SEQ ID NO: 1672 - RNA, 22 nt, Human Herpes Virus 1
ggcgguggugggguuucuucuc

SEQ ID NO: 1673 - RNA, 22 nt, Human Herpes Virus 1
ccgccgcccaccccgagcccag

SEQ ID NO: 1674 - RNA, 21 nt, Human Herpes Virus 1
gggcccucggguggggcgcgg

SEQ ID NO: 1675 - RNA, 22 nt, Human Herpes Virus 1
ugccugcuggcggcccuggcca

SEQ ID NO: 1676 - RNA, 22 nt, Human Herpes Virus 1
gacacggccgccugggcgggca

SEQ ID NO: 1677 - RNA, 22 nt, Human Herpes Virus 1
gcgccgggaccaggagcugugu

SEQ ID NO: 1678 - RNA, 16 nt, Human Herpes Virus 1
ccagcuccccccgcgc

SEQ ID NO: 1679 - RNA, 22 nt, Human Herpes Virus 1
cgcgccacggccuccgcguucu

SEQ ID NO: 1680 - RNA, 22 nt, Human Herpes Virus 1
gacgggguaggccgugcccguu

SEQ ID NO: 1681 - RNA, 22 nt, Human Herpes Virus 1
acccagucccaggccacgguga

SEQ ID NO: 1682 - RNA, 20 nt, Human Herpes Virus 1
ccguggcccgggccuuggug

SEQ ID NO: 1683 - RNA, 22 nt, Human Herpes Virus 1
ccacgagucccgcggcgcgcgc

SEQ ID NO: 1684 - RNA, 22 nt, Human Herpes Virus 1
uggcgcgggccgcggccguguc

SEQ ID NO: 1685 - RNA, 22 nt, Human Herpes Virus 1
cgcgccagcguccggcagcugc

SEQ ID NO: 1686 - RNA, 21 nt, Human Herpes Virus 1
acaugcgcggacgcgaucgcg

SEQ ID NO: 1687 - RNA, 22 nt, Human Herpes Virus 1
uccagcugcucgagucccugcc

SEQ ID NO: 1688 - RNA, 22 nt, Human Herpes Virus 1
acgcgggacaucgcgcagcgcg

SEQ ID NO: 1689 - RNA, 22 nt, Human Herpes Virus 1
ugucguugcggagcaucccgcg

SEQ ID NO: 1690 - RNA, 22 nt, Human Herpes Virus 1
cggggugguuccgucacgcccc

SEQ ID NO: 1691 - RNA, 22 nt, Human Herpes Virus 1
ggcuggcgugggcgcgccuggc

SEQ ID NO: 1692 - RNA, 22 nt, Human Herpes Virus 1
agugcgcguccgccgcuucgcu

SEQ ID NO: 1693 - RNA, 22 nt, Human Herpes Virus 1
gcgacgccucgggaucccggca

SEQ ID NO: 1694 - RNA, 22 nt, Human Herpes Virus 1
ugggcccugagggcgucgaaau

SEQ ID NO: 1695 - RNA, 22 nt, Human Herpes Virus 1
cgacggcguuggcgcgggccgc

SEQ ID NO: 1696 - RNA, 22 nt, Human Herpes Virus 1
ggccacgcggagaugucggugg

SEQ ID NO: 1697 - RNA, 22 nt, Human Herpes Virus 1
acaccugugaaggcugggugug

SEQ ID NO: 1698 - RNA, 20 nt, Human Herpes Virus 1
ucgcgcacccgccgcugugu

SEQ ID NO: 1699 - RNA, 22 nt, Human Herpes Virus 1
cgccguggucggggugcgccgc

SEQ ID NO: 1700 - RNA, 21 nt, Human Herpes Virus 1
cacgaccgcuucggccaggcg

SEQ ID NO: 1701 - RNA, 22 nt, Human Herpes Virus 1
uggcggcguuggcgucggcgug

SEQ ID NO: 1702 - RNA, 20 nt, Human Herpes Virus 1
ugucggcgaagcgcaggucg

SEQ ID NO: 1703 - RNA, 22 nt, Human Herpes Virus 1
ugggucgucgggccgagggacg

SEQ ID NO: 1704 - RNA, 22 nt, Human Herpes Virus 1
uguguaccggccuacgagccgg

SEQ ID NO: 1705 - RNA, 22 nt, Human Herpes Virus 1
ggguggaugcggucgugaggcc

SEQ ID NO: 1706 - RNA, 21 nt, Human Herpes Virus 1
cccauagcuggcagucggccu

SEQ ID NO: 1707 - RNA, 22 nt, Human Herpes Virus 1
ccacggagggcugcguggccgu

SEQ ID NO: 1708 - RNA, 22 nt, Human Herpes Virus 1
aggccucgacggccucccggcg

SEQ ID NO: 1709 - RNA, 22 nt, Human Herpes Virus 1
agccggucgccccgcggcccgc

SEQ ID NO: 1710 - RNA, 22 nt, Human Herpes Virus 1
cagauccacggggagguuggug

SEQ ID NO: 1711 - RNA, 22 nt, Human Herpes Virus 1
ucccuuugaggugagucggguc

SEQ ID NO: 1712 - RNA, 22 nt, Human Herpes Virus 1
ggcccgauaaugguggggggug

SEQ ID NO: 1713 - RNA, 22 nt, Human Herpes Virus 1
ccgcgccccacccgagggcccc

SEQ ID NO: 1714 - RNA, 20 nt, Human Herpes Virus 1
gggcucggggugggcggcgg

SEQ ID NO: 1715 - RNA, 22 nt, Human Herpes Virus 1
cggggcgcccgaggccucgaac

SEQ ID NO: 1716 - RNA, 22 nt, Human Herpes Virus 1
uccgccucgggcgccccccaga

SEQ ID NO: 1717 - RNA, 22 nt, Human Herpes Virus 1
ucugguucgaggauaugacccc

SEQ ID NO: 1718 - RNA, 19 nt, Human Herpes Virus 1
uugucuucccgacuacgga

SEQ ID NO: 1719 - RNA, 22 nt, Human Herpes Virus 1
uguguuggccgacuggcccggc

SEQ ID NO: 1720 - RNA, 20 nt, Human Herpes Virus 1
gccauuugggccgccccgca

SEQ ID NO: 1721 - RNA, 22 nt, Human Herpes Virus 1
gggcugacggccgugggcgaca

SEQ ID NO: 1722 - RNA, 21 nt, Human Herpes Virus 1
ucgcgcgcgcuguuucugccc

SEQ ID NO: 1723 - RNA, 22 nt, Human Herpes Virus 1
ggcgucccggcgcggcgagcgu

SEQ ID NO: 1724 - RNA, 22 nt, Human Herpes Virus 1
cggucccgcgucgggucgugga

SEQ ID NO: 1725 - RNA, 22 nt, Human Herpes Virus 1
uggggggcgcccgaggcggagg

SEQ ID NO: 1726 - RNA, 22 nt, Human Herpes Virus 1
ucgaggccucgggcgccccggc

SEQ ID NO: 1727 - RNA, 22 nt, Human Herpes Virus 1
ccgcgcuggccugggacgacug

SEQ ID NO: 1728 - RNA, 22 nt, Human Herpes Virus 1
cgcucgccuggccgaagcgguc

SEQ ID NO: 1729 - RNA, 22 nt, Human Herpes Virus 1
caaaucggcggcgcgggccgug

SEQ ID NO: 1730 - RNA, 22 nt, Human Herpes Virus 1
cgugugcugcgcugcuggcguu

SEQ ID NO: 1731 - RNA, 22 nt, Human Herpes Virus 1
uaugaucgcgggcaccccaccg

SEQ ID NO: 1732 - RNA, 22 nt, Human Herpes Virus 1
cgggggggaucgcgacaucgug

SEQ ID NO: 1733 - RNA, 22 nt, Human Herpes Virus 1
agcuguacgugaucuccagggg

SEQ ID NO: 1734 - RNA, 22 nt, Human Herpes Virus 1
cccugguccagcugcagccccc

SEQ ID NO: 1735 - RNA, 22 nt, Human Herpes Virus 1
ugacgcccguggcguagugguc

SEQ ID NO: 1736 - RNA, 22 nt, Human Herpes Virus 1
uggcgcugcugcggguggccau

SEQ ID NO: 1737 - RNA, 22 nt, Human Herpes Virus 1
uccccugugguguuuuugguua

SEQ ID NO: 1738 - RNA, 22 nt, Human Herpes Virus 1
ucgucgacaaacagggggaaag

SEQ ID NO: 1739 - RNA, 22 nt, Human Herpes Virus 1
gcccccugggccagacgaccgc

SEQ ID NO: 1740 - RNA, 22 nt, Human Herpes Virus 1
uggaucugucucgccaggggcu

SEQ ID NO: 1741 - RNA, 22 nt, Human Herpes Virus 1
gccggggcccuugucaacgcca

SEQ ID NO: 1742 - RNA, 22 nt, Human Herpes Virus 1
gacguugacacggcccgcgccg

SEQ ID NO: 1743 - RNA, 22 nt, Human Herpes Virus 1
aagcguucgcacuucgucccaa

SEQ ID NO: 1744 - RNA, 22 nt, Human Herpes Virus 1
uagggcgaagugcgagcacugg

SEQ ID NO: 1745 - RNA, 22 nt, Human Herpes Virus 1
gcgccagaggggcgagguccgu

SEQ ID NO: 1746 - RNA, 22 nt, Human Herpes Virus 1
gucggauuaugcccucuacggg

SEQ ID NO: 1747 - RNA, 22 nt, Human Herpes Virus 1
cggggcgcccgaggccucgaac

SEQ ID NO: 1748 - RNA, 22 nt, Human Herpes Virus 1
uccgccucgggcgccccccaga

SEQ ID NO: 1749 - RNA, 22 nt, Human Herpes Virus 1
cgaagacucggcggacgcuggu

SEQ ID NO: 1750 - RNA, 20 nt, Human Herpes Virus 1
gcgcuggcggccgccgauug

SEQ ID NO: 1751 - RNA, 22 nt, Human Herpes Virus 1
cgaagacucggcggacgcuggu

SEQ ID NO: 1752 - RNA, 20 nt, Human Herpes Virus 1
gcgcuggcggccgccgauug

SEQ ID NO: 1753 - RNA, 22 nt, Human Herpes Virus 1
cgauaccgggggccgcccgggg

SEQ ID NO: 1754 - RNA, 21 nt, Human Herpes Virus 1
ccgggggguuuucguccgcgg

SEQ ID NO: 1755 - RNA, 22 nt, Human Herpes Virus 1
ggccgugguguugcggagcgcc

SEQ ID NO: 1756 - RNA, 22 nt, Human Herpes Virus 1
cgcgcccaggagcacugccgcc

SEQ ID NO: 1757 - RNA, 22 nt, Human Herpes Virus 1
gccagucgccgcgcccccucgc

SEQ ID NO: 1758 - RNA, 22 nt, Human Herpes Virus 1
gaaagggcgcgauggcggcguc

SEQ ID NO: 1759 - RNA, 22 nt, Human Herpes Virus 1
ugccugcuggcggcccuggcca

SEQ ID NO: 1760 - RNA, 22 nt, Human Herpes Virus 1
gacacggccgccugggcgggca

SEQ ID NO: 1761 - RNA, 22 nt, Human Herpes Virus 1
gccaggguccuugaccccacuu

SEQ ID NO: 1762 - RNA, 22 nt, Human Herpes Virus 1
guggugguguucgacuuugcca

SEQ ID NO: 1763 - RNA, 22 nt, Human Herpes Virus 1
gccccccgucucugacccucca

SEQ ID NO: 1764 - RNA, 22 nt, Human Herpes Virus 1
gagggucagccguucaaggcga

SEQ ID NO: 1765 - RNA, 22 nt, Human Herpes Virus 1
cggcgucgccugcacaggaagg

SEQ ID NO: 1766 - RNA, 22 nt, Human Herpes Virus 1
cgguuggcggcgacgcuucggg

SEQ ID NO: 1767 - RNA, 22 nt, Human Herpes Virus 1
gggcacacuuccucggcccccg

SEQ ID NO: 1768 - RNA, 20 nt, Human Herpes Virus 1
gggggccgagggagguuucc

SEQ ID NO: 1769 - RNA, 22 nt, Human Herpes Virus 1
gggcacacuuccucggcccccg

SEQ ID NO: 1770 - RNA, 20 nt, Human Herpes Virus 1
gggggccgagggagguuucc

SEQ ID NO: 1771 - RNA, 22 nt, Human Herpes Virus 1
ucgccccgcccccgacgucagg

SEQ ID NO: 1772 - RNA, 22 nt, Human Herpes Virus 1
ugacgcuggagggcgguguugc

SEQ ID NO: 1773 - RNA, 22 nt, Human Herpes Virus 1
uacuucaccuucggugggggcu

SEQ ID NO: 1774 - RNA, 22 nt, Human Herpes Virus 1
cguacucccaccagcugagccg

SEQ ID NO: 1775 - RNA, 22 nt, Human Herpes Virus 1
ccgcccgugcgccgucgacggg

SEQ ID NO: 1776 - RNA, 19 nt, Human Herpes Virus 1
cgacgacggcgcgcgucgg

SEQ ID NO: 1777 - RNA, 22 nt, Human Herpes Virus 1
cccgcgaagacccccccggagc

SEQ ID NO: 1778 - RNA, 22 nt, Human Herpes Virus 1
uugggcccgggggccugguggc

SEQ ID NO: 1779 - RNA, 22 nt, Human Herpes Virus 1
ugacccacguacuccaagaagg

SEQ ID NO: 1780 - RNA, 22 nt, Human Herpes Virus 1
uguguuuuugugccuggcucuc

SEQ ID NO: 1781 - RNA, 22 nt, Human Herpes Virus 1
ugacccacguacuccaagaagg

SEQ ID NO: 1782 - RNA, 22 nt, Human Herpes Virus 1
uguguuuuugugccuggcucuc

SEQ ID NO: 1783 - RNA, 22 nt, Human Herpes Virus 1
cggugggcuuugguacaaauac

SEQ ID NO: 1784 - RNA, 22 nt, Human Herpes Virus 1
uguagaugagggcacgcaacgc

SEQ ID NO: 1785 - RNA, 22 nt, Human Herpes Virus 1
ccccuccccacgcgcccccaac

SEQ ID NO: 1786 - RNA, 22 nt, Human Herpes Virus 1
uaggggcggugaugggggccgc

SEQ ID NO: 1787 - RNA, 22 nt, Human Herpes Virus 1
uccgggccccaacgagcccucc

SEQ ID NO: 1788 - RNA, 22 nt, Human Herpes Virus 1
ggucggguuugggaccgagggg

SEQ ID NO: 1789 - RNA, 22 nt, Human Herpes Virus 1
agggcggcgggucguggcggga

SEQ ID NO: 1790 - RNA, 22 nt, Human Herpes Virus 1
uuucgggggcggccgugccgcc

SEQ ID NO: 1791 - RNA, 22 nt, Human Herpes Virus 1
gccuggcgcgccgcggcucgug

SEQ ID NO: 1792 - RNA, 22 nt, Human Herpes Virus 1
accgggcucgguuccggcgccg

SEQ ID NO: 1793 - RNA, 22 nt, Human Herpes Virus 1
gccuggcgcgccgcggcucgug

SEQ ID NO: 1794 - RNA, 22 nt, Human Herpes Virus 1
accgggcucgguuccggcgccg

SEQ ID NO: 1795 - RNA, 22 nt, Human Herpes Virus 1
cgucugccugcagaucgaggag

SEQ ID NO: 1796 - RNA, 22 nt, Human Herpes Virus 1
ucgcggucugcgggggcgaugg

SEQ ID NO: 1797 - RNA, 22 nt, Human Herpes Virus 1
uguacgagcaacccggggaggu

SEQ ID NO: 1798 - RNA, 22 nt, Human Herpes Virus 1
cgucuccggaagcccgugggcc

SEQ ID NO: 1799 - RNA, 22 nt, Human Herpes Virus 1
ucgcgcagccacgcgcgcaggc

SEQ ID NO: 1800 - RNA, 22 nt, Human Herpes Virus 1
cggcgugcggcggcggcgggga

SEQ ID NO: 1801 - RNA, 22 nt, Human Herpes Virus 1
cgucgagugccuggccgccugc

SEQ ID NO: 1802 - RNA, 22 nt, Human Herpes Virus 1
cgcuggccgagggcuucgacgg

SEQ ID NO: 1803 - RNA, 22 nt, Human Herpes Virus 1
uccucggggucuuccggggcga

SEQ ID NO: 1804 - RNA, 22 nt, Human Herpes Virus 1
ucucggacagcuccgggggcag

SEQ ID NO: 1805 - RNA, 22 nt, Human Herpes Virus 1
uuugcgguaccagggguaaggg

SEQ ID NO: 1806 - RNA, 22 nt, Human Herpes Virus 1
ucgcccccgggcccguggggcg

SEQ ID NO: 1807 - RNA, 22 nt, Human Herpes Virus 1
gggcggucgggcgauugauaua

SEQ ID NO: 1808 - RNA, 22 nt, Human Herpes Virus 1
cauuagucccgaagaccgccgg

SEQ ID NO: 1809 - RNA, 22 nt, Human Herpes Virus 1
ugacgcccggcucgcgugggug

SEQ ID NO: 1810 - RNA, 22 nt, Human Herpes Virus 1
caacgacgagaccgggcgggaa

SEQ ID NO: 1811 - RNA, 22 nt, Human Herpes Virus 1
uccugaccgcggguuccgaguu

SEQ ID NO: 1812 - RNA, 22 nt, Human Herpes Virus 1
ccugggacugugcgguugggac

SEQ ID NO: 1813 - RNA, 22 nt, Human Herpes Virus 1
uccugaccgcggguuccgaguu

SEQ ID NO: 1814 - RNA, 22 nt, Human Herpes Virus 1
ccugggacugugcgguugggac

SEQ ID NO: 1815 - RNA, 22 nt, Human Herpes Virus 1
gggcgggcggaaaggcgagagc

SEQ ID NO: 1816 - RNA, 22 nt, Human Herpes Virus 1
ucccgccguugcguucacgcca

SEQ ID NO: 1817 - RNA, 22 nt, Human Herpes Virus 1
gcccggugcggcccggggggga

SEQ ID NO: 1818 - RNA, 22 nt, Human Herpes Virus 1
cccccagucguacaggggauuu

SEQ ID NO: 1819 - RNA, 22 nt, Human Herpes Virus 1
cggggauccggguggccggggg

SEQ ID NO: 1820 - RNA, 21 nt, Human Herpes Virus 1
cccggcgugcgcggcaaaccg

SEQ ID NO: 1821 - RNA, 22 nt, Human Herpes Virus 1
gcgucuggccccgcuggaucag

SEQ ID NO: 1822 - RNA, 17 nt, Human Herpes Virus 1
gccguggggcuggucgc

SEQ ID NO: 1823 - RNA, 22 nt, Human Herpes Virus 1
ugccagaugacguggcaucgcg

SEQ ID NO: 1824 - RNA, 22 nt, Human Herpes Virus 1
cgcaaugccaccgggcuggccc

SEQ ID NO: 1825 - RNA, 22 nt, Human Herpes Virus 1
acguggguacucgcgucccggg

SEQ ID NO: 1826 - RNA, 22 nt, Human Herpes Virus 1
cggggccgccgggagcaccccg

SEQ ID NO: 1827 - RNA, 22 nt, Human Herpes Virus 1
cgcggcgccgggcgcgccgagc

SEQ ID NO: 1828 - RNA, 22 nt, Human Herpes Virus 1
uuggcgugagcggccccgcucc

SEQ ID NO: 1829 - RNA, 22 nt, Human Herpes Virus 1
cgguguuguugucugggucacc

SEQ ID NO: 1830 - RNA, 22 nt, Human Herpes Virus 1
ugucccggaccgucgcaccaac

SEQ ID NO: 1831 - RNA, 22 nt, Human Herpes Virus 1
ggcgucccggcgcggcgagcgu

SEQ ID NO: 1832 - RNA, 22 nt, Human Herpes Virus 1
cggucccgcgucgggucgugga

SEQ ID NO: 1833 - RNA, 22 nt, Human Herpes Virus 1
ugaugggccgccacggccccgu

SEQ ID NO: 1834 - RNA, 22 nt, Human Herpes Virus 1
gggugguggcgcgccagucguu

SEQ ID NO: 1835 - RNA, 22 nt, Human Herpes Virus 1
ucggcccgaguggaccacguua

SEQ ID NO: 1836 - RNA, 22 nt, Human Herpes Virus 1
ucucguuuccggacgggucgcg

SEQ ID NO: 1837 - RNA, 22 nt, Human Herpes Virus 1
uuguccaggaugaaccgggugg

SEQ ID NO: 1838 - RNA, 21 nt, Human Herpes Virus 1
cccucguacuucuugauggcc

SEQ ID NO: 1839 - RNA, 22 nt, Human Herpes Virus 1
uaucggcggcucauggccacgg

SEQ ID NO: 1840 - RNA, 22 nt, Human Herpes Virus 1
ugcgccaggccccagccgaagc

SEQ ID NO: 1841 - RNA, 22 nt, Human Herpes Virus 1
agcggccggccggcgcuuaggg

SEQ ID NO: 1842 - RNA, 22 nt, Human Herpes Virus 1
ccuuggccgccccggcugcagg

SEQ ID NO: 1843 - RNA, 22 nt, Human Herpes Virus 1
agcggccggccggcgcuuaggg

SEQ ID NO: 1844 - RNA, 22 nt, Human Herpes Virus 1
ccuuggccgccccggcugcagg

SEQ ID NO: 1845 - RNA, 22 nt, Human Herpes Virus 1
agcucccguuuguggcgggcgg

SEQ ID NO: 1846 - RNA, 22 nt, Human Herpes Virus 1
gccagcgccaccgacgaggacc

SEQ ID NO: 1847 - RNA, 22 nt, Human Herpes Virus 1
gacacgccggugcccauguccc

SEQ ID NO: 1848 - RNA, 22 nt, Human Herpes Virus 1
gccgugcugccggcgcuggacg

SEQ ID NO: 1849 - RNA, 22 nt, Human Herpes Virus 1
gacacgccggugcccauguccc

SEQ ID NO: 1850 - RNA, 22 nt, Human Herpes Virus 1
gccgugcugccggcgcuggacg

SEQ ID NO: 1851 - RNA, 22 nt, Human Herpes Virus 1
accgcggacucggucggcaccu

SEQ ID NO: 1852 - RNA, 22 nt, Human Herpes Virus 1
gcgggcccccggccgccgcgga

SEQ ID NO: 1853 - RNA, 22 nt, Human Herpes Virus 1
ggagguccugacgaacaucacc

SEQ ID NO: 1854 - RNA, 18 nt, Human Herpes Virus 1
guguacgacagcgccccc

SEQ ID NO: 1855 - RNA, 22 nt, Human Herpes Virus 1
uacguggacaggcucuggagca

SEQ ID NO: 1856 - RNA, 22 nt, Human Herpes Virus 1
ugauauuaccggagaccuucug

SEQ ID NO: 1857 - RNA, 22 nt, Human Herpes Virus 1
cggcccccaucaccgccccuaa

SEQ ID NO: 1858 - RNA, 22 nt, Human Herpes Virus 1
ugggggcgcguggggaggggcc

SEQ ID NO: 1859 - RNA, 22 nt, Human Herpes Virus 1
ggauagcuuccggagucuccau

SEQ ID NO: 1860 - RNA, 20 nt, Human Herpes Virus 1
ugugagacuucgggggcgcu

SEQ ID NO: 1861 - RNA, 22 nt, Human Herpes Virus 1
ugcaccucgcugcgaaccagcc

SEQ ID NO: 1862 - RNA, 22 nt, Human Herpes Virus 1
ggcugcgcgugcgggcgcagga

SEQ ID NO: 1863 - RNA, 22 nt, Human Herpes Virus 1
agcguucgcacuucgucccaau

SEQ ID NO: 1864 - RNA, 20 nt, Human Herpes Virus 1
uagggcgaagugcgagcacu

SEQ ID NO: 1865 - RNA, 22 nt, Human Herpes Virus 1
ggccgcggcgggcccaccgauc

SEQ ID NO: 1866 - RNA, 20 nt, Human Herpes Virus 1
ucgucagcccgccgacgacc

SEQ ID NO: 1867 - RNA, 22 nt, Human Herpes Virus 1
uuuguuccugcgcccggcgcgu

SEQ ID NO: 1868 - RNA, 22 nt, Human Herpes Virus 1
gacggcgggcugucgccagagg

SEQ ID NO: 1869 - RNA, 22 nt, Human Herpes Virus 1
cccgguggcauugcgucgcgag

SEQ ID NO: 1870 - RNA, 19 nt, Human Herpes Virus 1
gcgaugccacgucaucugg

SEQ ID NO: 1871 - RNA, 22 nt, Human Herpes Virus 1
cuccauccggucucccggggca

SEQ ID NO: 1872 - RNA, 21 nt, Human Herpes Virus 1
cacagagacuuugguggacga

SEQ ID NO: 1873 - RNA, 22 nt, Human Herpes Virus 1
cggcguccggguggcggucgag

SEQ ID NO: 1874 - RNA, 21 nt, Human Herpes Virus 1
ucggccgucgccaucgccacg

SEQ ID NO: 1875 - RNA, 22 nt, Human Herpes Virus 1
cccgucagcgccgcguucucgc

SEQ ID NO: 1876 - RNA, 20 nt, Human Herpes Virus 1
guaggcgcggcgcaggcugg

SEQ ID NO: 1877 - RNA, 22 nt, Human Herpes Virus 1
cccgucagcgccgcguucucgc

SEQ ID NO: 1878 - RNA, 20 nt, Human Herpes Virus 1
guaggcgcggcgcaggcugg

SEQ ID NO: 1879 - RNA, 22 nt, Human Herpes Virus 1
caccgucccccgacgaccucuu

SEQ ID NO: 1880 - RNA, 22 nt, Human Herpes Virus 1
caaggacggcggggggccugca

SEQ ID NO: 1881 - RNA, 22 nt, Human Herpes Virus 1
cgcaacggcgggagcuggguua

SEQ ID NO: 1882 - RNA, 21 nt, Human Herpes Virus 1
gcauucgcucucgccuuuccg

SEQ ID NO: 1883 - RNA, 22 nt, Human Herpes Virus 1
gccccccccuccaaccggggcc

SEQ ID NO: 1884 - RNA, 17 nt, Human Herpes Virus 1
uugguuggagggggcgc

SEQ ID NO: 1885 - RNA, 22 nt, Human Herpes Virus 1
ucgggcggcgccucggcacuau

SEQ ID NO: 1886 - RNA, 15 nt, Human Herpes Virus 1
ucucgacgccgccau

SEQ ID NO: 1887 - RNA, 22 nt, Human Herpes Virus 1
cggcggcccgugauaaccacau

SEQ ID NO: 1888 - RNA, 22 nt, Human Herpes Virus 1
ugugggcgucaaguggcuggcg

SEQ ID NO: 1889 - RNA, 22 nt, Human Herpes Virus 1
uagaguuugacaggcaagcaug

SEQ ID NO: 1890 - RNA, 22 nt, Human Herpes Virus 1
gugcuugccugucuaacucgcu

SEQ ID NO: 1891 - RNA, 22 nt, Human Herpes Virus 1
uagaguuugacaggcaagcaug

SEQ ID NO: 1892 - RNA, 22 nt, Human Herpes Virus 1
gugcuugccugucuaacucgcu

SEQ ID NO: 1893 - RNA, 22 nt, Human Herpes Virus 1
ggccgaagcgcgugcgcacgcg

SEQ ID NO: 1894 - RNA, 22 nt, Human Herpes Virus 1
cgcggcacaggcgcagcggcgg

SEQ ID NO: 1895 - RNA, 22 nt, Human Herpes Virus 1
ggccgaagcgcgugcgcacgcg

SEQ ID NO: 1896 - RNA, 22 nt, Human Herpes Virus 1
cgcggcacaggcgcagcggcgg

SEQ ID NO: 1897 - RNA, 22 nt, Human Herpes Virus 1
gcgggugcuguacggcggccug

SEQ ID NO: 1898 - RNA, 22 nt, Human Herpes Virus 1
ggccucuggggggcgcccgagg

SEQ ID NO: 1899 - RNA, 22 nt, Human Herpes Virus 1
gucgucguacucguccccguca

SEQ ID NO: 1900 - RNA, 22 nt, Human Herpes Virus 1
cggggguccggggcggcgaggc

SEQ ID NO: 1901 - RNA, 22 nt, Human Herpes Virus 1
gcgcccccgaagucucacaugu

SEQ ID NO: 1902 - RNA, 20 nt, Human Herpes Virus 1
cguauggagacuccggaagc

SEQ ID NO: 1903 - RNA, 22 nt, Human Herpes Virus 1
gccgccgcccaccccgagccca

SEQ ID NO: 1904 - RNA, 22 nt, Human Herpes Virus 1
gggcccucggguggggcgcgga

SEQ ID NO: 1905 - RNA, 22 nt, Human Herpes Virus 1
gccgcgcccgccggcccagccg

SEQ ID NO: 1906 - RNA, 22 nt, Human Herpes Virus 1
ucacggccgguggcggccaucg

SEQ ID NO: 1907 - RNA, 22 nt, Human Herpes Virus 1
gcuggcggcggcggccagcgca

SEQ ID NO: 1908 - RNA, 20 nt, Human Herpes Virus 1
gcgcuggcggccgccgccgc

SEQ ID NO: 1909 - RNA, 22 nt, Human Herpes Virus 1
gcuggcggcggcggccagcgca

SEQ ID NO: 1910 - RNA, 20 nt, Human Herpes Virus 1
gcgcuggcggccgccgccgc

SEQ ID NO: 1911 - RNA, 22 nt, Human Herpes Virus 1
ucgccaggggcuggccguuacg

SEQ ID NO: 1912 - RNA, 22 nt, Human Herpes Virus 1
uuacugaugaacgagcuccugc

SEQ ID NO: 1913 - RNA, 22 nt, Human Herpes Virus 1
aggcgaccgcgcaccgacuggc

SEQ ID NO: 1914 - RNA, 22 nt, Human Herpes Virus 1
ggggcgcugccgggacgcucgg

SEQ ID NO: 1915 - RNA, 22 nt, Human Herpes Virus 1
ugcucgacgcaccguuuguugu

SEQ ID NO: 1916 - RNA, 22 nt, Human Herpes Virus 1
gagaggcgggcguacucgcgca

SEQ ID NO: 1917 - RNA, 22 nt, Human Herpes Virus 1
uagauguacguaaugaauucac

SEQ ID NO: 1918 - RNA, 21 nt, Human Herpes Virus 1
ucguggguuaugaacuucucc

SEQ ID NO: 1919 - RNA, 22 nt, Human Herpes Virus 1
gcucggucugccggccuggcgg

SEQ ID NO: 1920 - RNA, 18 nt, Human Herpes Virus 1
caggugaggcaggucggc

SEQ ID NO: 1921 - RNA, 22 nt, Human Herpes Virus 1
uggcccagacgccguacccggu

SEQ ID NO: 1922 - RNA, 22 nt, Human Herpes Virus 1
uacugggcguggugauggacga

SEQ ID NO: 1923 - RNA, 22 nt, Human Herpes Virus 1
ugcccgggacccacguggcggc

SEQ ID NO: 1924 - RNA, 22 nt, Human Herpes Virus 1
cgcgagggacacguggugcccg

SEQ ID NO: 1925 - RNA, 22 nt, Human Herpes Virus 1
gcuggcggcgagauugaugccc

SEQ ID NO: 1926 - RNA, 22 nt, Human Herpes Virus 1
guauacagacggagccguuggu

SEQ ID NO: 1927 - RNA, 22 nt, Human Herpes Virus 1
cgaugucgcgaucccccccgcg

SEQ ID NO: 1928 - RNA, 22 nt, Human Herpes Virus 1
cgguggggugcccgcgaucaua

SEQ ID NO: 1929 - RNA, 22 nt, Human Herpes Virus 1
ugcgcccgcacgcgcagcccgg

SEQ ID NO: 1930 - RNA, 22 nt, Human Herpes Virus 1
ggcugguucgcagcgaggugca

SEQ ID NO: 1931 - RNA, 22 nt, Human Herpes Virus 1
acccugacggagguccuggguc

SEQ ID NO: 1932 - RNA, 22 nt, Human Herpes Virus 1
augcgggggggaccgucgaggg

SEQ ID NO: 1933 - RNA, 22 nt, Human Herpes Virus 1
uuucguccucgcccucgucauu

SEQ ID NO: 1934 - RNA, 22 nt, Human Herpes Virus 1
ggucggggguggggucggaacu

SEQ ID NO: 1935 - RNA, 22 nt, Human Herpes Virus 1
ccgggccggcuccgcgggccag

SEQ ID NO: 1936 - RNA, 22 nt, Human Herpes Virus 1
ucgggccccaggcacggcccga

SEQ ID NO: 1937 - RNA, 22 nt, Human Herpes Virus 1
ccgggccggcuccgcgggccag

SEQ ID NO: 1938 - RNA, 22 nt, Human Herpes Virus 1
ucgggccccaggcacggcccga

SEQ ID NO: 1939 - RNA, 22 nt, Human Herpes Virus 1
cccccgagucggacccggaggc

SEQ ID NO: 1940 - RNA, 22 nt, Human Herpes Virus 1
cuccgaagggacggcuccgggg

SEQ ID NO: 1941 - RNA, 22 nt, Human Herpes Virus 1
gggauggaaggacgggaagugg

SEQ ID NO: 1942 - RNA, 22 nt, Human Herpes Virus 1
ccccccugccuuccacccuccg

SEQ ID NO: 1943 - RNA, 22 nt, Human Herpes Virus 1
gggauggaaggacgggaagugg

SEQ ID NO: 1944 - RNA, 22 nt, Human Herpes Virus 1
ccccccugccuuccacccuccg

SEQ ID NO: 1945 - RNA, 22 nt, Human Herpes Virus 1
cgccauggcggccggccgcuuc

SEQ ID NO: 1946 - RNA, 22 nt, Human Herpes Virus 1
cacgcggcggccgccguggcca

SEQ ID NO: 1947 - RNA, 22 nt, Human Herpes Virus 1
acgcguucugcggcgcaggccu

SEQ ID NO: 1948 - RNA, 20 nt, Human Herpes Virus 1
ccagcgccgaggacagcagc

SEQ ID NO: 1949 - RNA, 22 nt, Human Herpes Virus 1
uacaggggccauguugggccgc

SEQ ID NO: 1950 - RNA, 22 nt, Human Herpes Virus 1
cugguccacacccaguggcucc

SEQ ID NO: 1951 - RNA, 22 nt, Human Herpes Virus 1
gggugggucggcggagggggga

SEQ ID NO: 1952 - RNA, 22 nt, Human Herpes Virus 1
ccuucagggccaccgcccauac

SEQ ID NO: 1953 - RNA, 22 nt, Human Herpes Virus 1
ucgaauccgaugcugucucgga

SEQ ID NO: 1954 - RNA, 20 nt, Human Herpes Virus 1
caaggcuguaucggauucua

SEQ ID NO: 1955 - RNA, 22 nt, Human Herpes Virus 1
ucggcggaccacuccggcggcc

SEQ ID NO: 1956 - RNA, 21 nt, Human Herpes Virus 1
cgccggccagguccucgcccg

SEQ ID NO: 1957 - RNA, 22 nt, Human Herpes Virus 1
ugcaggcugcggccgcgugguc

SEQ ID NO: 1958 - RNA, 22 nt, Human Herpes Virus 1
gccuggaggccggggcccgcgc

SEQ ID NO: 1959 - RNA, 22 nt, Human Herpes Virus 1
cagauguacauguccguggggg

SEQ ID NO: 1960 - RNA, 19 nt, Human Herpes Virus 1
gcggaugugcucgucuccc

SEQ ID NO: 1961 - RNA, 22 nt, Human Herpes Virus 1
cggagcuggcccgcgccguugu

SEQ ID NO: 1962 - RNA, 20 nt, Human Herpes Virus 1
accugcgggaucagccaccu

SEQ ID NO: 1963 - RNA, 22 nt, Human Herpes Virus 1
caagcucuguucgcgcuccaga

SEQ ID NO: 1964 - RNA, 22 nt, Human Herpes Virus 1
uggagccgagccucuagcugca

SEQ ID NO: 1965 - RNA, 22 nt, Human Herpes Virus 1
gguggaaggcagggggguguag

SEQ ID NO: 1966 - RNA, 22 nt, Human Herpes Virus 1
uccacuucccguccuuccaucc

SEQ ID NO: 1967 - RNA, 22 nt, Human Herpes Virus 1
gguggaaggcagggggguguag

SEQ ID NO: 1968 - RNA, 22 nt, Human Herpes Virus 1
uccacuucccguccuuccaucc

SEQ ID NO: 1969 - RNA, 22 nt, Human Herpes Virus 1
gcauguuggugguggacgcggu

SEQ ID NO: 1970 - RNA, 22 nt, Human Herpes Virus 1
gcgucgggcgccgccgagcaga

SEQ ID NO: 1971 - RNA, 22 nt, Human Herpes Virus 1
gggcaugaaaacgaccuccaca

SEQ ID NO: 1972 - RNA, 21 nt, Human Herpes Virus 1
ugggggugugcguucgaugcg

SEQ ID NO: 1973 - RNA, 22 nt, Human Herpes Virus 1
ugggggaguuugagacggccga

SEQ ID NO: 1974 - RNA, 22 nt, Human Herpes Virus 1
ggucaacccagccuucuccgcg

SEQ ID NO: 1975 - RNA, 22 nt, Human Herpes Virus 1
uacccuggggucucugggagcu

SEQ ID NO: 1976 - RNA, 22 nt, Human Herpes Virus 1
ucccuagguucucggggugguc

SEQ ID NO: 1977 - RNA, 22 nt, Human Herpes Virus 1
ugcccgcccaggcggccguguc

SEQ ID NO: 1978 - RNA, 22 nt, Human Herpes Virus 1
uggccagggccgccagcaggca

SEQ ID NO: 1979 - RNA, 22 nt, Human Herpes Virus 1
uccccggggaccacgcgcgggu

SEQ ID NO: 1980 - RNA, 20 nt, Human Herpes Virus 1
auggccuccgcguccggggu

SEQ ID NO: 1981 - RNA, 22 nt, Human Herpes Virus 1
ggcucagcuggugggaguacgc

SEQ ID NO: 1982 - RNA, 22 nt, Human Herpes Virus 1
cguagcccccaccgaaggugaa

SEQ ID NO: 1983 - RNA, 22 nt, Human Herpes Virus 1
uccgacgcgcgccgucgucggg

SEQ ID NO: 1984 - RNA, 18 nt, Human Herpes Virus 1
gucgacggcgcacgggcg

SEQ ID NO: 1985 - RNA, 22 nt, Human Herpes Virus 1
uacggggcggcccgugcggguu

SEQ ID NO: 1986 - RNA, 19 nt, Human Herpes Virus 1
cgaccacgggcugucauuc

SEQ ID NO: 1987 - RNA, 22 nt, Human Herpes Virus 1
uggagccagcccgcccucacag

SEQ ID NO: 1988 - RNA, 21 nt, Human Herpes Virus 1
gggggcgggacuggccaaucg

SEQ ID NO: 1989 - RNA, 22 nt, Human Herpes Virus 1
uggagccagcccgcccucacag

SEQ ID NO: 1990 - RNA, 21 nt, Human Herpes Virus 1
gggggcgggacuggccaaucg

SEQ ID NO: 1991 - RNA, 22 nt, Human Herpes Virus 2
ucucgaccgcgguucccgaguc

SEQ ID NO: 1992 - RNA, 22 nt, Human Herpes Virus 2
uugggagucugcgguugggagc

SEQ ID NO: 1993 - RNA, 22 nt, Human Herpes Virus 2
ucaggcccgccgccgcguggcc

SEQ ID NO: 1994 - RNA, 22 nt, Human Herpes Virus 2
gccacagcggcaggaccgggcc

SEQ ID NO: 1995 - RNA, 22 nt, Human Herpes Virus 2
uggguucucugggagaucgugg

SEQ ID NO: 1996 - RNA, 22 nt, Human Herpes Virus 2
ugggcucucggggaacccgggg

SEQ ID NO: 1997 - RNA, 22 nt, Human Herpes Virus 2
gaggccguggagcuugccagcg

SEQ ID NO: 1998 - RNA, 22 nt, Human Herpes Virus 2
ugacgagcuucgcgguacuacu

SEQ ID NO: 1999 - RNA, 22 nt, Human Herpes Virus 2
uccugccugcuggcggcccugg

SEQ ID NO: 2000 - RNA, 22 nt, Human Herpes Virus 2
ccgccugggcgggcaacuggac

SEQ ID NO: 2001 - RNA, 22 nt, Human Herpes Virus 2
gccccggcgggcgcguucccgc

SEQ ID NO: 2002 - RNA, 20 nt, Human Herpes Virus 2
gcgcgcccgccaggaacggc

SEQ ID NO: 2003 - RNA, 22 nt, Human Herpes Virus 2
gggcggccgccgaggugcgggg

SEQ ID NO: 2004 - RNA, 20 nt, Human Herpes Virus 2
gcaccucggcggccaagccc

SEQ ID NO: 2005 - RNA, 22 nt, Human Herpes Virus 2
ucguacaucgugaccuaccucg

SEQ ID NO: 2006 - RNA, 22 nt, Human Herpes Virus 2
aggagugcauggccguguaucg

SEQ ID NO: 2007 - RNA, 22 nt, Human Herpes Virus 2
ucgggguggggggagagugucg

SEQ ID NO: 2008 - RNA, 22 nt, Human Herpes Virus 2
caccaccacucccaccccgacc

SEQ ID NO: 2009 - RNA, 22 nt, Human Herpes Virus 2
gagggcggccucggccggcgga

SEQ ID NO: 2010 - RNA, 22 nt, Human Herpes Virus 2
cgaaggucugcgcgaggccgcu

SEQ ID NO: 2011 - RNA, 22 nt, Human Herpes Virus 2
gcgucggggaggaggcggggac

SEQ ID NO: 2012 - RNA, 20 nt, Human Herpes Virus 2
ggggccuucuucuugggcgc

SEQ ID NO: 2013 - RNA, 22 nt, Human Herpes Virus 2
ucggggugggaguggugguggg

SEQ ID NO: 2014 - RNA, 22 nt, Human Herpes Virus 2
cacgacacucuccccccacccc

SEQ ID NO: 2015 - RNA, 22 nt, Human Herpes Virus 2
agaguucacucggcacgcaugc

SEQ ID NO: 2016 - RNA, 22 nt, Human Herpes Virus 2
gugcuugccuagcgaacucacc

SEQ ID NO: 2017 - RNA, 22 nt, Human Herpes Virus 2
cgucccggucgccgccgcacca

SEQ ID NO: 2018 - RNA, 22 nt, Human Herpes Virus 2
gcgcggcggagaccgggacggc

SEQ ID NO: 2019 - RNA, 22 nt, Human Herpes Virus 2
ucaggcccgguccugccgcugu

SEQ ID NO: 2020 - RNA, 22 nt, Human Herpes Virus 2
gccacgcggcggcgggccugac

SEQ ID NO: 2021 - RNA, 22 nt, Human Herpes Virus 2
cccguggucucgggagcagggc

SEQ ID NO: 2022 - RNA, 21 nt, Human Herpes Virus 2
gacgcccccgcgggccacggg

SEQ ID NO: 2023 - RNA, 22 nt, Human Herpes Virus 2
ugcgggcgcauggcgcccuggc

SEQ ID NO: 2024 - RNA, 22 nt, Human Herpes Virus 2
ccugggcgcggccgcccgcgac

SEQ ID NO: 2025 - RNA, 22 nt, Human Herpes Virus 2
gccugcggccccgcggacaccc

SEQ ID NO: 2026 - RNA, 22 nt, Human Herpes Virus 2
gggugcugcugccgcgcggcua

SEQ ID NO: 2027 - RNA, 22 nt, Human Herpes Virus 2
ccucggggcggugcugggggcg

SEQ ID NO: 2028 - RNA, 22 nt, Human Herpes Virus 2
cccucgggcuguccgcgugggc

SEQ ID NO: 2029 - RNA, 22 nt, Human Herpes Virus 2
ccgcggcccgcgccggcgccgu

SEQ ID NO: 2030 - RNA, 22 nt, Human Herpes Virus 2
cgcgcgccgcgggccucguggg

SEQ ID NO: 2031 - RNA, 22 nt, Human Herpes Virus 2
ucgguucgucgggcgcgggaac

SEQ ID NO: 2032 - RNA, 22 nt, Human Herpes Virus 2
auguaccgaccgacgagccgca

SEQ ID NO: 2033 - RNA, 22 nt, Human Herpes Virus 2
agcguucgcacuucguccuaau

SEQ ID NO: 2034 - RNA, 20 nt, Human Herpes Virus 2
uagggcaaagugcgagcgcu

SEQ ID NO: 2035 - RNA, 22 nt, Human Herpes Virus 2
ccgucuacguggcgcuggggcg

SEQ ID NO: 2036 - RNA, 22 nt, Human Herpes Virus 2
ggcccggcggagcugcgcgggc

SEQ ID NO: 2037 - RNA, 22 nt, Human Herpes Virus 2
gggggcuugcacccgcggcuga

SEQ ID NO: 2038 - RNA, 20 nt, Human Herpes Virus 2
guccauggugucgagcucuu

SEQ ID NO: 2039 - RNA, 22 nt, Human Herpes Virus 2
gggccuggcgauccugggccug

SEQ ID NO: 2040 - RNA, 20 nt, Human Herpes Virus 2
ggccuggucguccgcggccc

SEQ ID NO: 2041 - RNA, 22 nt, Human Herpes Virus 2
uggucggcguggggaccggcug

SEQ ID NO: 2042 - RNA, 22 nt, Human Herpes Virus 2
acguuggacuacgaccgaccac

SEQ ID NO: 2043 - RNA, 22 nt, Human Herpes Virus 2
gcguuccgguugucauccugga

SEQ ID NO: 2044 - RNA, 22 nt, Human Herpes Virus 2
gcgggguggcgggccugcgcgu

SEQ ID NO: 2045 - RNA, 22 nt, Human Herpes Virus 2
ucggcggccccgcggagguugu

SEQ ID NO: 2046 - RNA, 22 nt, Human Herpes Virus 2
cuggccuucccgguguuggucg

SEQ ID NO: 2047 - RNA, 22 nt, Human Herpes Virus 2
gcggggcuuggagcgaccgagg

SEQ ID NO: 2048 - RNA, 22 nt, Human Herpes Virus 2
uacgagggcacaagccccggag

SEQ ID NO: 2049 - RNA, 22 nt, Human Herpes Virus 2
uggaagggcagaagauggggag

SEQ ID NO: 2050 - RNA, 22 nt, Human Herpes Virus 2
cugcauccccucgccuuccauu

SEQ ID NO: 2051 - RNA, 22 nt, Human Herpes Virus 2
acgcgggcgaccgcggcgcccc

SEQ ID NO: 2052 - RNA, 18 nt, Human Herpes Virus 2
cccggguaccgcccgcgu

SEQ ID NO: 2053 - RNA, 22 nt, Human Herpes Virus 2
cgacggugcgcugguuuucggg

SEQ ID NO: 2054 - RNA, 22 nt, Human Herpes Virus 2
cgaugcugucgaccgucacgcc

SEQ ID NO: 2055 - RNA, 22 nt, Human Herpes Virus 2
cguguguggcgauggccacggc

SEQ ID NO: 2056 - RNA, 22 nt, Human Herpes Virus 2
uguugcccucgaccgccacgcg

SEQ ID NO: 2057 - RNA, 22 nt, Human Herpes Virus 2
agaguucacucggcacgcaugc

SEQ ID NO: 2058 - RNA, 22 nt, Human Herpes Virus 2
gugcuugccuagcgaacucacc

SEQ ID NO: 2059 - RNA, 22 nt, Human Herpes Virus 2
gcugcagcggugcgagggucga

SEQ ID NO: 2060 - RNA, 22 nt, Human Herpes Virus 2
gaccauccgccgccagcuggcg

SEQ ID NO: 2061 - RNA, 22 nt, Human Herpes Virus 2
uggccgccacggcgguccggcu

SEQ ID NO: 2062 - RNA, 22 nt, Human Herpes Virus 2
cccuggcccgcgagguggccgc

SEQ ID NO: 2063 - RNA, 22 nt, Human Herpes Virus 2
cguccucgccgacccgggguuc

SEQ ID NO: 2064 - RNA, 17 nt, Human Herpes Virus 2
ccugguggucggggacg

SEQ ID NO: 2065 - RNA, 22 nt, Human Herpes Virus 2
agggucucauuagcaucgcggg

SEQ ID NO: 2066 - RNA, 22 nt, Human Herpes Virus 2
ccgcgccgggcgcuaaugagau

SEQ ID NO: 2067 - RNA, 22 nt, Human Herpes Virus 2
ggucccagcgccacugcgucgc

SEQ ID NO: 2068 - RNA, 22 nt, Human Herpes Virus 2
gacgugcuggucgcgcuggugg

SEQ ID NO: 2069 - RNA, 22 nt, Human Herpes Virus 2
cggcgggcgcuccgcggccguc

SEQ ID NO: 2070 - RNA, 19 nt, Human Herpes Virus 2
gcccgcgcggugccugccg

SEQ ID NO: 2071 - RNA, 22 nt, Human Herpes Virus 2
cccccgcgcauggcgggccuac

SEQ ID NO: 2072 - RNA, 22 nt, Human Herpes Virus 2
gccgcccgcuagucugggggcg

SEQ ID NO: 2073 - RNA, 22 nt, Human Herpes Virus 2
ucggggcccgcggcccgaagca

SEQ ID NO: 2074 - RNA, 22 nt, Human Herpes Virus 2
ccccguccccgggcugcgccuc

SEQ ID NO: 2075 - RNA, 22 nt, Human Herpes Virus 2
cccccgggccgcgggcgaggac

SEQ ID NO: 2076 - RNA, 22 nt, Human Herpes Virus 2
cucacccucgugccggggaccg

SEQ ID NO: 2077 - RNA, 22 nt, Human Herpes Virus 2
uggugucggacagcuccggcgg

SEQ ID NO: 2078 - RNA, 22 nt, Human Herpes Virus 2
uguacgggggcuuggggccgug

SEQ ID NO: 2079 - RNA, 22 nt, Human Herpes Virus 2
ggcagggcguuucguuggucua

SEQ ID NO: 2080 - RNA, 21 nt, Human Herpes Virus 2
uacaacaacaacgcccauguc

SEQ ID NO: 2081 - RNA, 22 nt, Human Herpes Virus 2
uugccggugauggcccggaggg

SEQ ID NO: 2082 - RNA, 21 nt, Human Herpes Virus 2
ccuggggguuuaccagguagc

SEQ ID NO: 2083 - RNA, 22 nt, Human Herpes Virus 2
acgggugaguucgcuaggcaag

SEQ ID NO: 2084 - RNA, 22 nt, Human Herpes Virus 2
ccgagugaacucucccgccccg

SEQ ID NO: 2085 - RNA, 22 nt, Human Herpes Virus 2
agggucucauuagcaucgcggg

SEQ ID NO: 2086 - RNA, 22 nt, Human Herpes Virus 2
ccgcgccgggcgcuaaugagau

SEQ ID NO: 2087 - RNA, 22 nt, Human Herpes Virus 2
agcgcccccaggcggccggcgu

SEQ ID NO: 2088 - RNA, 21 nt, Human Herpes Virus 2
ccgucgccgcgggcggcgcuu

SEQ ID NO: 2089 - RNA, 22 nt, Human Herpes Virus 2
gguccucgcccggcagcggcga

SEQ ID NO: 2090 - RNA, 22 nt, Human Herpes Virus 2
cacguccuccgggucgggcacc

SEQ ID NO: 2091 - RNA, 22 nt, Human Herpes Virus 2
gguccucgcccggcagcggcga

SEQ ID NO: 2092 - RNA, 22 nt, Human Herpes Virus 2
cacguccuccgggucgggcacc

SEQ ID NO: 2093 - RNA, 22 nt, Human Herpes Virus 2
uggcggcgccucucggccggcu

SEQ ID NO: 2094 - RNA, 22 nt, Human Herpes Virus 2
cgggccccgagcggguggccga

SEQ ID NO: 2095 - RNA, 22 nt, Human Herpes Virus 2
cagugcucgcacuuugcccuaa

SEQ ID NO: 2096 - RNA, 22 nt, Human Herpes Virus 2
uaggacgaagugcgaacgcuuc

SEQ ID NO: 2097 - RNA, 22 nt, Human Herpes Virus 2
gcccuguaccgguaccugcgcg

SEQ ID NO: 2098 - RNA, 21 nt, Human Herpes Virus 2
ccaggcacacaugcggggccg

SEQ ID NO: 2099 - RNA, 22 nt, Human Herpes Virus 2
ugcagcagcgcgaggagccguu

SEQ ID NO: 2100 - RNA, 22 nt, Human Herpes Virus 2
ggagggcggcuccccuagcugc

SEQ ID NO: 2101 - RNA, 22 nt, Human Herpes Virus 2
cgucccggucgccgccgcacca

SEQ ID NO: 2102 - RNA, 21 nt, Human Herpes Virus 2
ugcgcggcggagaccgggacg

SEQ ID NO: 2103 - RNA, 22 nt, Human Herpes Virus 2
gcggacagcauggccaggucaa

SEQ ID NO: 2104 - RNA, 22 nt, Human Herpes Virus 2
cgucuggccaggcggucggcgu

SEQ ID NO: 2105 - RNA, 22 nt, Human Herpes Virus 2
gcgggguccaggcaaggcaggg

SEQ ID NO: 2106 - RNA, 22 nt, Human Herpes Virus 2
cacugcuuggccucgagcccgu

SEQ ID NO: 2107 - RNA, 22 nt, Human Herpes Virus 2
gccggcccgggcgccagcccgc

SEQ ID NO: 2108 - RNA, 21 nt, Human Herpes Virus 2
ucgucgggccgcugggucggc

SEQ ID NO: 2109 - RNA, 22 nt, Human Herpes Virus 2
gcgggcgagggcgucuaaggcc

SEQ ID NO: 2110 - RNA, 20 nt, Human Herpes Virus 2
gggccuccgccucgacccgc

SEQ ID NO: 2111 - RNA, 22 nt, Human Herpes Virus 2
ucgccgccgguccaggcggucc

SEQ ID NO: 2112 - RNA, 18 nt, Human Herpes Virus 2
ggcgguggugguggcggc

SEQ ID NO: 2113 - RNA, 22 nt, Human Herpes Virus 2
ccuccucgcggaguaugaccgu

SEQ ID NO: 2114 - RNA, 22 nt, Human Herpes Virus 2
ggugcugccgccgcgggaggau

SEQ ID NO: 2115 - RNA, 22 nt, Human Herpes Virus 2
ggccgguggcgacgacggcgac

SEQ ID NO: 2116 - RNA, 22 nt, Human Herpes Virus 2
gacgccgguggucccggcgacg

SEQ ID NO: 2117 - RNA, 22 nt, Human Herpes Virus 2
ggcggggggaaggcgccggagg

SEQ ID NO: 2118 - RNA, 21 nt, Human Herpes Virus 2
ugccgccgccugccccccgcc

SEQ ID NO: 2119 - RNA, 22 nt, Human Herpes Virus 2
ucgggccugaucgcguucuggg

SEQ ID NO: 2120 - RNA, 22 nt, Human Herpes Virus 2
agagcauaaagaccaggcccgg

SEQ ID NO: 2121 - RNA, 22 nt, Human Herpes Virus 2
gcgcgcgcgcgccucccccgcg

SEQ ID NO: 2122 - RNA, 22 nt, Human Herpes Virus 2
cagggcguggaggcagucgcgc

SEQ ID NO: 2123 - RNA, 22 nt, Human Herpes Virus 2
ggcggggggcaggcggcggcag

SEQ ID NO: 2124 - RNA, 20 nt, Human Herpes Virus 2
uccggcgccuuccccccgcc

SEQ ID NO: 2125 - RNA, 22 nt, Human Herpes Virus 2
cgccgcccucuuggcccccacc

SEQ ID NO: 2126 - RNA, 22 nt, Human Herpes Virus 2
gcgaggggcgagcgcggggcgg

SEQ ID NO: 2127 - RNA, 22 nt, Human Herpes Virus 2
ggugggcuuccggcggccgccg

SEQ ID NO: 2128 - RNA, 20 nt, Human Herpes Virus 2
ggggucggcgaagcgccgcc

SEQ ID NO: 2129 - RNA, 22 nt, Human Herpes Virus 2
aggggccacguggugaugucgg

SEQ ID NO: 2130 - RNA, 22 nt, Human Herpes Virus 2
gccaucgacacgauggacucca

SEQ ID NO: 2131 - RNA, 22 nt, Human Herpes Virus 2
gagggggagcgcgacggguccc

SEQ ID NO: 2132 - RNA, 21 nt, Human Herpes Virus 2
ggagagacccgacucucccuc

SEQ ID NO: 2133 - RNA, 22 nt, Human Herpes Virus 2
gaggcggcgcuggaccgcgucg

SEQ ID NO: 2134 - RNA, 22 nt, Human Herpes Virus 2
gacguggucgagcugcgccgcc

SEQ ID NO: 2135 - RNA, 22 nt, Human Herpes Virus 2
gcgacgugggugauguccgggg

SEQ ID NO: 2136 - RNA, 18 nt, Human Herpes Virus 2
gcgucguugucauguugc

SEQ ID NO: 2137 - RNA, 22 nt, Human Herpes Virus 2
ggacggcgucgucucgccgcgg

SEQ ID NO: 2138 - RNA, 22 nt, Human Herpes Virus 2
gaugguggacgaggccguucgc

SEQ ID NO: 2139 - RNA, 22 nt, Human Herpes Virus 2
ggacggcgucgucucgccgcgg

SEQ ID NO: 2140 - RNA, 22 nt, Human Herpes Virus 2
gaugguggacgaggccguucgc

SEQ ID NO: 2141 - RNA, 22 nt, Human Herpes Virus 2
gggcggugggucguggguguug

SEQ ID NO: 2142 - RNA, 17 nt, Human Herpes Virus 2
caccucgaucaccgucc

SEQ ID NO: 2143 - RNA, 22 nt, Human Herpes Virus 2
ggcguggacggccgcggugguc

SEQ ID NO: 2144 - RNA, 22 nt, Human Herpes Virus 2
ggcguaguggcaguagaacacg

SEQ ID NO: 2145 - RNA, 22 nt, Human Herpes Virus 2
gccgcuggagccuugcgcccaa

SEQ ID NO: 2146 - RNA, 14 nt, Human Herpes Virus 2
cgcgauccgguggc

SEQ ID NO: 2147 - RNA, 22 nt, Human Herpes Virus 2
uccggcggcguugaucgugggg

SEQ ID NO: 2148 - RNA, 19 nt, Human Herpes Virus 2
uggucguaaagccgccgga

SEQ ID NO: 2149 - RNA, 22 nt, Human Herpes Virus 2
uggcacacuuccucggcccccg

SEQ ID NO: 2150 - RNA, 22 nt, Human Herpes Virus 2
ggggccgagggagguuucucgu

SEQ ID NO: 2151 - RNA, 22 nt, Human Herpes Virus 2
uggccagcugccggggcagcgu

SEQ ID NO: 2152 - RNA, 20 nt, Human Herpes Virus 2
gcccccaggcgcugcgucgc

SEQ ID NO: 2153 - RNA, 22 nt, Human Herpes Virus 2
cggacccgcggaggaggaggag

SEQ ID NO: 2154 - RNA, 22 nt, Human Herpes Virus 2
cuccgccgccgcgggcccgggc

SEQ ID NO: 2155 - RNA, 22 nt, Human Herpes Virus 2
ucgccuuuacauaccccgcggc

SEQ ID NO: 2156 - RNA, 21 nt, Human Herpes Virus 2
cgcgaggaaggacaggggcga

SEQ ID NO: 2157 - RNA, 22 nt, Human Herpes Virus 2
gggcaggcucgcguuccgaggc

SEQ ID NO: 2158 - RNA, 22 nt, Human Herpes Virus 2
uugggauguaaagcagcugccc

SEQ ID NO: 2159 - RNA, 22 nt, Human Herpes Virus 2
ggaggggagaggagaagggcgc

SEQ ID NO: 2160 - RNA, 22 nt, Human Herpes Virus 2
cagccuuccuucuccggagucc

SEQ ID NO: 2161 - RNA, 22 nt, Human Herpes Virus 2
gacgcccagcgaaccggacucc

SEQ ID NO: 2162 - RNA, 22 nt, Human Herpes Virus 2
caagaucgggcugcgcgugugc

SEQ ID NO: 2163 - RNA, 22 nt, Human Herpes Virus 2
gcccgcggcggcggaggacccg

SEQ ID NO: 2164 - RNA, 16 nt, Human Herpes Virus 2
cuccuccuccgcgggu

SEQ ID NO: 2165 - RNA, 22 nt, Human Herpes Virus 2
agcgggagcuccgggucgguca

SEQ ID NO: 2166 - RNA, 22 nt, Human Herpes Virus 2
gccgccucucgguccucccguu

SEQ ID NO: 2167 - RNA, 22 nt, Human Herpes Virus 2
gacucgagguccggcuccugga

SEQ ID NO: 2168 - RNA, 17 nt, Human Herpes Virus 2
aguuggaguucaggguc

SEQ ID NO: 2169 - RNA, 22 nt, Human Herpes Virus 2
ugguuucucugcguugcgucug

SEQ ID NO: 2170 - RNA, 22 nt, Human Herpes Virus 2
ugggcggcgaaccgguagccgg

SEQ ID NO: 2171 - RNA, 22 nt, Human Herpes Virus 2
ugcccgacccggaggacgugcg

SEQ ID NO: 2172 - RNA, 22 nt, Human Herpes Virus 2
cgccgcugccgggcgaggaccu

SEQ ID NO: 2173 - RNA, 22 nt, Human Herpes Virus 2
cggccgcggugauguugccgga

SEQ ID NO: 2174 - RNA, 21 nt, Human Herpes Virus 2
acgagccgggucacgcggcug

SEQ ID NO: 2175 - RNA, 22 nt, Human Herpes Virus 2
uccgcggggguauaaaaggugc

SEQ ID NO: 2176 - RNA, 22 nt, Human Herpes Virus 2
gggccguguuugucuccggcgg

SEQ ID NO: 2177 - RNA, 22 nt, Human Herpes Virus 2
gggcgggggggaaggccgccag

SEQ ID NO: 2178 - RNA, 20 nt, Human Herpes Virus 2
cggggucugccgucccgcuc

SEQ ID NO: 2179 - RNA, 22 nt, Human Herpes Virus 2
ugcgcucgaccgccgcgcgcuc

SEQ ID NO: 2180 - RNA, 22 nt, Human Herpes Virus 2
gaacggcggggucgaugguguc

SEQ ID NO: 2181 - RNA, 22 nt, Human Herpes Virus 2
gcggccugggcgucgcugaggg

SEQ ID NO: 2182 - RNA, 17 nt, Human Herpes Virus 2
agcacguacauggccgu

SEQ ID NO: 2183 - RNA, 22 nt, Human Herpes Virus 2
gacgcuugacggggccgacccc

SEQ ID NO: 2184 - RNA, 22 nt, Human Herpes Virus 2
gggggacccccgugggccgugc

SEQ ID NO: 2185 - RNA, 22 nt, Human Herpes Virus 2
gcggccgagggccccggcgcgg

SEQ ID NO: 2186 - RNA, 19 nt, Human Herpes Virus 2
ugaggggggaaucggccgu

SEQ ID NO: 2187 - RNA, 22 nt, Human Herpes Virus 2
ugccggggugcgaaugcggccc

SEQ ID NO: 2188 - RNA, 19 nt, Human Herpes Virus 2
gcugccuuauacccggcgc

SEQ ID NO: 2189 - RNA, 22 nt, Human Herpes Virus 2
ggcgcgcauggaggggguccgc

SEQ ID NO: 2190 - RNA, 22 nt, Human Herpes Virus 2
gggccgcuucuucuugcgcgcc

SEQ ID NO: 2191 - RNA, 22 nt, Human Herpes Virus 2
ggcgcgcauggaggggguccgc

SEQ ID NO: 2192 - RNA, 22 nt, Human Herpes Virus 2
gggccgcuucuucuugcgcgcc

SEQ ID NO: 2193 - RNA, 22 nt, Human Herpes Virus 2
gggucgucggcgacguggcccg

SEQ ID NO: 2194 - RNA, 22 nt, Human Herpes Virus 2
gucgcgcgcguagaagccgucg

SEQ ID NO: 2195 - RNA, 22 nt, Human Herpes Virus 2
gggggucuggggcucugaccug

SEQ ID NO: 2196 - RNA, 22 nt, Human Herpes Virus 2
ggucagguggcccgagcccccc

SEQ ID NO: 2197 - RNA, 22 nt, Human Herpes Virus 2
gggggucuggggcucugaccug

SEQ ID NO: 2198 - RNA, 22 nt, Human Herpes Virus 2
ggucagguggcccgagcccccc

SEQ ID NO: 2199 - RNA, 22 nt, Human Herpes Virus 2
gcugcagcuaggggagccgccc

SEQ ID NO: 2200 - RNA, 19 nt, Human Herpes Virus 2
cuccucgcgcugcugcagc

SEQ ID NO: 2201 - RNA, 22 nt, Human Herpes Virus 2
caucggcaccgccaucccaccc

SEQ ID NO: 2202 - RNA, 22 nt, Human Herpes Virus 2
gugggcgggugggggggcuggu

SEQ ID NO: 2203 - RNA, 22 nt, Human Herpes Virus 2
ugcugcgccaggaaaaucucau

SEQ ID NO: 2204 - RNA, 22 nt, Human Herpes Virus 2
ugagacgcuggcguggugcaag

SEQ ID NO: 2205 - RNA, 22 nt, Human Herpes Virus 2
cgcgccgaugaucaggcccggg

SEQ ID NO: 2206 - RNA, 20 nt, Human Herpes Virus 2
cgggggcguggugcggcgcg

SEQ ID NO: 2207 - RNA, 22 nt, Human Herpes Virus 2
uggcggcccggggggugcugca

SEQ ID NO: 2208 - RNA, 22 nt, Human Herpes Virus 2
gcgccgacccccugguccgcca

SEQ ID NO: 2209 - RNA, 22 nt, Human Herpes Virus 2
uggaucuccgcgcagacaucgc

SEQ ID NO: 2210 - RNA, 22 nt, Human Herpes Virus 2
gugugugcaccgcgaagaaucc

SEQ ID NO: 2211 - RNA, 22 nt, Human Herpes Virus 2
cgcgcccgccggaagcgaccgu

SEQ ID NO: 2212 - RNA, 21 nt, Human Herpes Virus 2
cggcgcccgagcccggcgcgc

SEQ ID NO: 2213 - RNA, 22 nt, Human Herpes Virus 2
ucgggguagccggccacccgcc

SEQ ID NO: 2214 - RNA, 22 nt, Human Herpes Virus 2
ggcgggcgucggggcccccagg

SEQ ID NO: 2215 - RNA, 22 nt, Human Herpes Virus 2
gguggucccggagaucgccccc

SEQ ID NO: 2216 - RNA, 16 nt, Human Herpes Virus 2
gaucccgugaccgacc

SEQ ID NO: 2217 - RNA, 22 nt, Human Herpes Virus 2
ucgacgcggcccagcugcugca

SEQ ID NO: 2218 - RNA, 21 nt, Human Herpes Virus 2
uacaguuggcccaacgucgac

SEQ ID NO: 2219 - RNA, 22 nt, Human Herpes Virus 2
ucgcgcaugacccaggcucaga

SEQ ID NO: 2220 - RNA, 22 nt, Human Herpes Virus 2
ucugggccgggcaggcgcgacc

SEQ ID NO: 2221 - RNA, 22 nt, Human Herpes Virus 2
accaggcggucggcuucccccc

SEQ ID NO: 2222 - RNA, 22 nt, Human Herpes Virus 2
gggaagguggcccgcauccaac

SEQ ID NO: 2223 - RNA, 22 nt, Human Herpes Virus 2
uggaaggcgaggggaugcagga

SEQ ID NO: 2224 - RNA, 21 nt, Human Herpes Virus 2
uccccaucuucugcccuucca

SEQ ID NO: 2225 - RNA, 22 nt, Human Herpes Virus 2
uggaaggcgaggggaugcagga

SEQ ID NO: 2226 - RNA, 21 nt, Human Herpes Virus 2
uccccaucuucugcccuucca

SEQ ID NO: 2227 - RNA, 22 nt, Human Herpes Virus 2
ucgcgccugcccggcccagacu

SEQ ID NO: 2228 - RNA, 22 nt, Human Herpes Virus 2
ucugagccugggucaugcgcga

SEQ ID NO: 2229 - RNA, 22 nt, Human Herpes Virus 2
ugcccgacccggaggacgugcg

SEQ ID NO: 2230 - RNA, 22 nt, Human Herpes Virus 2
cgccgcugccgggcgaggaccu

SEQ ID NO: 2231 - RNA, 22 nt, Human Herpes Virus 2
uuugcugggaacucgcccgccg

SEQ ID NO: 2232 - RNA, 22 nt, Human Herpes Virus 2
cgggggguguggucgggcggac

SEQ ID NO: 2233 - RNA, 22 nt, Human Herpes Virus 2
gcguucuggggcuuccguugcg

SEQ ID NO: 2234 - RNA, 22 nt, Human Herpes Virus 2
cccggggcggguaggccagagc

SEQ ID NO: 2235 - RNA, 22 nt, Human Herpes Virus 2
gcauggagcugcguacgcgucg

SEQ ID NO: 2236 - RNA, 22 nt, Human Herpes Virus 2
gugccgggugucgcgcaugcgc

SEQ ID NO: 2237 - RNA, 22 nt, Human Herpes Virus 2
cccuggaggaggccgaggcgga

SEQ ID NO: 2238 - RNA, 19 nt, Human Herpes Virus 2
gcuuuggccgcguccgggg

SEQ ID NO: 2239 - RNA, 22 nt, Human Herpes Virus 2
ggggagguagggaggggagagg

SEQ ID NO: 2240 - RNA, 21 nt, Human Herpes Virus 2
uuccuucuccggagucccucu

SEQ ID NO: 2241 - RNA, 22 nt, Human Herpes Virus 2
ggcccgcgucaucccgcgggcu

SEQ ID NO: 2242 - RNA, 20 nt, Human Herpes Virus 2
gcccggacggggggcgggcc

SEQ ID NO: 2243 - RNA, 22 nt, Human Herpes Virus 2
ggcccgcgucaucccgcgggcu

SEQ ID NO: 2244 - RNA, 20 nt, Human Herpes Virus 2
gcccggacggggggcgggcc

SEQ ID NO: 2245 - RNA, 22 nt, Human Herpes Virus 2
ccgggcuuccggcagcccggcc

SEQ ID NO: 2246 - RNA, 19 nt, Human Herpes Virus 2
agcugggccuggagcccgg

SEQ ID NO: 2247 - RNA, 22 nt, Human Herpes Virus 2
ggcgugcugggaggggcggcgu

SEQ ID NO: 2248 - RNA, 22 nt, Human Herpes Virus 2
gguccgccacgccccgcgcguc

SEQ ID NO: 2249 - RNA, 22 nt, Human Herpes Virus 2
uuuugcgucgucuccgcggucg

SEQ ID NO: 2250 - RNA, 22 nt, Human Herpes Virus 2
uacgccccggaggacgccgagc

SEQ ID NO: 2251 - RNA, 22 nt, Human Herpes Virus 2
gguggucgagauggcgucggag

SEQ ID NO: 2252 - RNA, 22 nt, Human Herpes Virus 2
ucggcgcggagcaucucgucca

SEQ ID NO: 2253 - RNA, 22 nt, Human Herpes Virus 2
ucgccacccgcacgauggcguc

SEQ ID NO: 2254 - RNA, 20 nt, Human Herpes Virus 2
aucgcgcgggaggggcuggu

SEQ ID NO: 2255 - RNA, 22 nt, Human Herpes Virus 2
gcacagcgcgucccccgucguc

SEQ ID NO: 2256 - RNA, 22 nt, Human Herpes Virus 2
ggccggggcgcguaguccgcga

SEQ ID NO: 2257 - RNA, 22 nt, Human Herpes Virus 2
ccgucaugaccugggggccugg

SEQ ID NO: 2258 - RNA, 22 nt, Human Herpes Virus 2
gggccccugggucagccgacgg

SEQ ID NO: 2259 - RNA, 22 nt, Human Herpes Virus 2
ccggugaccuacggcgagaugg

SEQ ID NO: 2260 - RNA, 20 nt, Human Herpes Virus 2
caaccucgucacggcgcugg

SEQ ID NO: 2261 - RNA, 22 nt, Human Herpes Virus 2
cccugcggguccgcugcagcug

SEQ ID NO: 2262 - RNA, 22 nt, Human Herpes Virus 2
gcaugcgcggaucaaaaccgcc

SEQ ID NO: 2263 - RNA, 22 nt, Human Herpes Virus 2
cacgcacgccccgguggggcgc

SEQ ID NO: 2264 - RNA, 22 nt, Human Herpes Virus 2
gccgccaccagggagucgagga

SEQ ID NO: 2265 - RNA, 22 nt, Human Herpes Virus 2
aguaccagaccgaaaacaagga

SEQ ID NO: 2266 - RNA, 21 nt, Human Herpes Virus 2
uccguuuuucgguggggugcu

SEQ ID NO: 2267 - RNA, 22 nt, Human Herpes Virus 2
cgccagggccacgacgcucgag

SEQ ID NO: 2268 - RNA, 22 nt, Human Herpes Virus 2
guagcgcgugaggccgggcgcc

SEQ ID NO: 2269 - RNA, 22 nt, Human Herpes Virus 2
cgccagggccacgacgcucgag

SEQ ID NO: 2270 - RNA, 22 nt, Human Herpes Virus 2
guagcgcgugaggccgggcgcc

SEQ ID NO: 2271 - RNA, 22 nt, Human Herpes Virus 2
cggcgcagcucgaccacgucga

SEQ ID NO: 2272 - RNA, 22 nt, Human Herpes Virus 2
uucucgacgcgguccagcgccg

SEQ ID NO: 2273 - RNA, 22 nt, Human Herpes Virus 2
gcccccgcgcacgcgcgacugc

SEQ ID NO: 2274 - RNA, 22 nt, Human Herpes Virus 2
ucugucgcgacgccgcggggga

SEQ ID NO: 2275 - RNA, 22 nt, Human Herpes Virus 2
augaccagcaccgccaggguac

SEQ ID NO: 2276 - RNA, 22 nt, Human Herpes Virus 2
ggcccggguugcugggggcggc

SEQ ID NO: 2277 - RNA, 22 nt, Human Herpes Virus 2
cgugcuggagcgccuggugccg

SEQ ID NO: 2278 - RNA, 22 nt, Human Herpes Virus 2
gccccgcgcuccggcagcugcu

SEQ ID NO: 2279 - RNA, 22 nt, Human Herpes Virus 2
ggagguggagucgcggugaagg

SEQ ID NO: 2280 - RNA, 22 nt, Human Herpes Virus 2
ucccaccucggucuccuccucc

SEQ ID NO: 2281 - RNA, 22 nt, Human Herpes Virus 2
ggagguggagucgcggugaagg

SEQ ID NO: 2282 - RNA, 22 nt, Human Herpes Virus 2
ucccaccucggucuccuccucc

SEQ ID NO: 2283 - RNA, 22 nt, Human Herpes Virus 2
cccccggcggcggucaagguuu

SEQ ID NO: 2284 - RNA, 22 nt, Human Herpes Virus 2
acccgggugacuucgucugggg

SEQ ID NO: 2285 - RNA, 22 nt, Human Herpes Virus 2
ggcgcccggccucacgcgcuac

SEQ ID NO: 2286 - RNA, 18 nt, Human Herpes Virus 2
cgucguggcccuggcgcc

SEQ ID NO: 2287 - RNA, 22 nt, Human Herpes Virus 2
ggcgcccggccucacgcgcuac

SEQ ID NO: 2288 - RNA, 18 nt, Human Herpes Virus 2
cgucguggcccuggcgcc

SEQ ID NO: 2289 - RNA, 22 nt, Human Herpes Virus 2
ugaacgucucaugggcggccgc

SEQ ID NO: 2290 - RNA, 22 nt, Human Herpes Virus 2
gccgcccaugaucacgcacaac

SEQ ID NO: 2291 - RNA, 22 nt, Human Herpes Virus 2
gaccgacgcaaccuccggggcu

SEQ ID NO: 2292 - RNA, 17 nt, Human Herpes Virus 2
cggggggggccucgguc

SEQ ID NO: 2293 - RNA, 22 nt, Human Herpes Virus 2
gggcggcagcagcgccgggucg

SEQ ID NO: 2294 - RNA, 20 nt, Human Herpes Virus 2
cggccugagccugcccgccc

SEQ ID NO: 2295 - RNA, 22 nt, Human Herpes Virus 2
ccgggcccgcggcggcggagga

SEQ ID NO: 2296 - RNA, 22 nt, Human Herpes Virus 2
cuccuccuccgcggguccgccg

SEQ ID NO: 2297 - RNA, 22 nt, Human Herpes Virus 2
ggccccgaggacgccguucgca

SEQ ID NO: 2298 - RNA, 22 nt, Human Herpes Virus 2
ccgccgagcaggcccucgcccg

SEQ ID NO: 2299 - RNA, 22 nt, Human Herpes Virus 2
cguggcgcccggggacguggcg

SEQ ID NO: 2300 - RNA, 22 nt, Human Herpes Virus 2
uccggaucucgggcgcggcgcg

SEQ ID NO: 2301 - RNA, 22 nt, Human Herpes Virus 2
cguggcgcccggggacguggcg

SEQ ID NO: 2302 - RNA, 22 nt, Human Herpes Virus 2
uccggaucucgggcgcggcgcg

SEQ ID NO: 2303 - RNA, 22 nt, Human Herpes Virus 2
gcgcgcguagaagccgucgacc

SEQ ID NO: 2304 - RNA, 21 nt, Human Herpes Virus 2
ucggcggcguagcuggugugc

SEQ ID NO: 2305 - RNA, 22 nt, Human Herpes Virus 2
gguuccgggacguggcggccuu

SEQ ID NO: 2306 - RNA, 22 nt, Human Herpes Virus 2
accggccugccgcuccgggagu

SEQ ID NO: 2307 - RNA, 22 nt, Human Herpes Virus 2
ugugaggcggucggccugucgg

SEQ ID NO: 2308 - RNA, 22 nt, Human Herpes Virus 2
gacgcuggcgcgcaucaugggc

SEQ ID NO: 2309 - RNA, 22 nt, Human Herpes Virus 2
cgccgggagcgccgccgucgcg

SEQ ID NO: 2310 - RNA, 22 nt, Human Herpes Virus 2
cgacgguggacgcggccgugcg

SEQ ID NO: 2311 - RNA, 22 nt, Human Herpes Virus 2
ccgucggcugacccaggggccc

SEQ ID NO: 2312 - RNA, 17 nt, Human Herpes Virus 2
cccccaggucaugacgg

SEQ ID NO: 2313 - RNA, 22 nt, Human Herpes Virus 2
gggccgcggacgaccaggccgg

SEQ ID NO: 2314 - RNA, 21 nt, Human Herpes Virus 2
ggcccaggaucgccaggcccu

SEQ ID NO: 2315 - RNA, 22 nt, Human Herpes Virus 2
ucuggugggcgguuggcgcgcg

SEQ ID NO: 2316 - RNA, 22 nt, Human Herpes Virus 2
cgagccaccgucccgcccgcca

SEQ ID NO: 2317 - RNA, 22 nt, Human Herpes Virus 2
uccgcccucccccgcgggcuga

SEQ ID NO: 2318 - RNA, 22 nt, Human Herpes Virus 2
gucagugggaaggcagggggaa

SEQ ID NO: 2319 - RNA, 22 nt, Human Herpes Virus 2
cgucaacgcccguaagcuugua

SEQ ID NO: 2320 - RNA, 22 nt, Human Herpes Virus 2
caagggggugugggugacgacg

SEQ ID NO: 2321 - RNA, 22 nt, Human Herpes Virus 2
ugcgggucgaggcggaggcccg

SEQ ID NO: 2322 - RNA, 22 nt, Human Herpes Virus 2
gaggccuuagacgcccucgccc

SEQ ID NO: 2323 - RNA, 22 nt, Human Herpes Virus 2
cggggguguuggugccgcgggg

SEQ ID NO: 2324 - RNA, 21 nt, Human Herpes Virus 2
ccuccgcgcccggcccucccg

SEQ ID NO: 2325 - RNA, 22 nt, Human Herpes Virus 2
cgcaggaggcugggcuggccgg

SEQ ID NO: 2326 - RNA, 22 nt, Human Herpes Virus 2
ggccgucucaaacucccccacg

SEQ ID NO: 2327 - RNA, 22 nt, Human Herpes Virus 2
gaucgcugaccuggcgcaccuc

SEQ ID NO: 2328 - RNA, 20 nt, Human Herpes Virus 2
gcagcgccugguugcugauc

SEQ ID NO: 2329 - RNA, 22 nt, Human Herpes Virus 2
ucuccucuuccugcuccuccuc

SEQ ID NO: 2330 - RNA, 21 nt, Human Herpes Virus 2
ggaggggcgggcguggcgggc

SEQ ID NO: 2331 - RNA, 22 nt, Human Herpes Virus 2
gccaugagcgcguaggucagcg

SEQ ID NO: 2332 - RNA, 22 nt, Human Herpes Virus 2
gugcugcaccacgggcuggcgg

SEQ ID NO: 2333 - RNA, 22 nt, Human Herpes Virus 2
ugggugcuucggggacuugacg

SEQ ID NO: 2334 - RNA, 22 nt, Human Herpes Virus 2
agcccucacgucuucgcccacc

SEQ ID NO: 2335 - RNA, 22 nt, Human Herpes Virus 2
uggucgugggggcgcugguggc

SEQ ID NO: 2336 - RNA, 22 nt, Human Herpes Virus 2
ccccggcggccccggcggcccc

SEQ ID NO: 2337 - RNA, 22 nt, Human Herpes Virus 2
gcgaggggaugcaggaggagga

SEQ ID NO: 2338 - RNA, 22 nt, Human Herpes Virus 2
uucugcccuuccauccuccguu

SEQ ID NO: 2339 - RNA, 22 nt, Human Herpes Virus 2
ucgccaucgggacagucccgcg

SEQ ID NO: 2340 - RNA, 20 nt, Human Herpes Virus 2
ggcggcgggacccggggcgg

SEQ ID NO: 2341 - RNA, 22 nt, Human Herpes Virus 2
gggcgacgggcacgcacgugga

SEQ ID NO: 2342 - RNA, 21 nt, Human Herpes Virus 2
ucuccgagcaugcgcgcgcuc

SEQ ID NO: 2343 - RNA, 22 nt, Human Herpes Virus 2
aaaaggaaccgaugcgcccgcg

SEQ ID NO: 2344 - RNA, 22 nt, Human Herpes Virus 2
uccgggugcgucggugccccgc

SEQ ID NO: 2345 - RNA, 22 nt, Human Herpes Virus 2
gcgcaggggcggggcgaucucg

SEQ ID NO: 2346 - RNA, 22 nt, Human Herpes Virus 2
acgucgccccccccucccgcuu

SEQ ID NO: 2347 - RNA, 22 nt, Human Herpes Virus 2
ggcguacccgggauccuccgcc

SEQ ID NO: 2348 - RNA, 20 nt, Human Herpes Virus 2
uugcggggcuuggacgcgcc

SEQ ID NO: 2349 - RNA, 22 nt, Human Herpes Virus 2
acaaagccagguacucuccgcu

SEQ ID NO: 2350 - RNA, 22 nt, Human Herpes Virus 2
aggggaggggagcugggcuugu

SEQ ID NO: 2351 - RNA, 22 nt, Human Herpes Virus 2
uggcgagccggggggagcgucc

SEQ ID NO: 2352 - RNA, 21 nt, Human Herpes Virus 2
ggugcgucuuuggguccguug

SEQ ID NO: 2353 - RNA, 22 nt, Human Herpes Virus 2
gcagagacgaggcgcgucgugu

SEQ ID NO: 2354 - RNA, 22 nt, Human Herpes Virus 2
gcggccguuugugucgcaggcg

SEQ ID NO: 2355 - RNA, 22 nt, Human Herpes Virus 2
uccgagcuggcggaggaucccg

SEQ ID NO: 2356 - RNA, 22 nt, Human Herpes Virus 2
gggcguuccgcucaacacggac

SEQ ID NO: 2357 - RNA, 22 nt, Human Herpes Virus 2
ggauggcgugucuacucgaggu

SEQ ID NO: 2358 - RNA, 22 nt, Human Herpes Virus 2
ucgcgaguuggcgaggugcugc

SEQ ID NO: 2359 - RNA, 22 nt, Human Herpes Virus 2
cggcggggggcaggcggcggca

SEQ ID NO: 2360 - RNA, 22 nt, Human Herpes Virus 2
uccggcgccuuccccccgcccu

SEQ ID NO: 2361 - RNA, 22 nt, Human Herpes Virus 2
gcggacgcggacgggguuucgc

SEQ ID NO: 2362 - RNA, 21 nt, Human Herpes Virus 2
acaccccagccgccccuccgc

SEQ ID NO: 2363 - RNA, 22 nt, Human Herpes Virus 2
gcccgccgcgcgcaggucccgu

SEQ ID NO: 2364 - RNA, 22 nt, Human Herpes Virus 2
ccggaucccguacgugaucgug

SEQ ID NO: 2365 - RNA, 22 nt, Human Herpes Virus 2
cgcccccgaccgcccuggccgc

SEQ ID NO: 2366 - RNA, 20 nt, Human Herpes Virus 2
gccagggcguacgcggugug

SEQ ID NO: 2367 - RNA, 22 nt, Human Herpes Virus 2
cccgcaucucuucgccccgggc

SEQ ID NO: 2368 - RNA, 22 nt, Human Herpes Virus 2
uggauccgauggagaagcggcu

SEQ ID NO: 2369 - RNA, 22 nt, Human Herpes Virus 2
gcgcagggccgcguggcuggcg

SEQ ID NO: 2370 - RNA, 22 nt, Human Herpes Virus 2
cccccgcgcgcgcccgacgucg

SEQ ID NO: 2371 - RNA, 22 nt, Human Herpes Virus 2
gggcgccggucgggucgcggcg

SEQ ID NO: 2372 - RNA, 22 nt, Human Herpes Virus 2
ucgcccccgcaccgccgccccc

SEQ ID NO: 2373 - RNA, 22 nt, Human Herpes Virus 2
ccccaggccguguuggcguucg

SEQ ID NO: 2374 - RNA, 22 nt, Human Herpes Virus 2
accgcgcccggcacgaaccugg

SEQ ID NO: 2375 - RNA, 22 nt, Human Herpes Virus 2
ccgugccacccgaacccgggcc

SEQ ID NO: 2376 - RNA, 22 nt, Human Herpes Virus 2
uccggguucggggugggcggcg

SEQ ID NO: 2377 - RNA, 22 nt, Human Herpes Virus 2
cgggccccggccuccaggcccg

SEQ ID NO: 2378 - RNA, 21 nt, Human Herpes Virus 2
ggcccaggcggccgccgccug

SEQ ID NO: 2379 - RNA, 22 nt, Human Herpes Virus 2
ccccaucugcggacuggcagcc

SEQ ID NO: 2380 - RNA, 22 nt, Human Herpes Virus 2
ccccggucuguggguggugaug

SEQ ID NO: 2381 - RNA, 22 nt, Human Herpes Virus 2
ggccccggggugccuccgcuug

SEQ ID NO: 2382 - RNA, 20 nt, Human Herpes Virus 2
acgcgggcgguacccgggcc

SEQ ID NO: 2383 - RNA, 22 nt, Human Herpes Virus 2
gcgcgcggggccgacaggcgcu

SEQ ID NO: 2384 - RNA, 22 nt, Human Herpes Virus 2
gcgucggggucuacgcgggccg

SEQ ID NO: 2385 - RNA, 22 nt, Human Herpes Virus 2
gccucgagacgcgcaucucgug

SEQ ID NO: 2386 - RNA, 22 nt, Human Herpes Virus 2
aacagaucgcgggcgaggacga

SEQ ID NO: 2387 - RNA, 22 nt, Human Herpes Virus 2
uguucgucccccuaaccacaca

SEQ ID NO: 2388 - RNA, 22 nt, Human Herpes Virus 2
ugugguuucccgggaagacaca

SEQ ID NO: 2389 - RNA, 22 nt, Human Herpes Virus 2
cguggagugccuggccgccugc

SEQ ID NO: 2390 - RNA, 22 nt, Human Herpes Virus 2
gcuggcggagggcuucgacggc

SEQ ID NO: 2391 - RNA, 22 nt, Human Herpes Virus 2
cguggagugccuggccgccugc

SEQ ID NO: 2392 - RNA, 22 nt, Human Herpes Virus 2
gcuggcggagggcuucgacggc

SEQ ID NO: 2393 - RNA, 22 nt, Human Herpes Virus 2
gcccagaucgccgcgcuggugg

SEQ ID NO: 2394 - RNA, 20 nt, Human Herpes Virus 2
cgaccgccaggcgggugggc

SEQ ID NO: 2395 - RNA, 22 nt, Human Herpes Virus 2
ggggugaagcguguuuaccaca

SEQ ID NO: 2396 - RNA, 21 nt, Human Herpes Virus 2
uggaggacccguuccagcccc

SEQ ID NO: 2397 - RNA, 22 nt, Human Herpes Virus 2
ucucgagcacccgucggggggg

SEQ ID NO: 2398 - RNA, 21 nt, Human Herpes Virus 2
cccacgacgggcgcaggggac

SEQ ID NO: 2399 - RNA, 22 nt, Human Herpes Virus 2
uccccggcacgagggugagcac

SEQ ID NO: 2400 - RNA, 22 nt, Human Herpes Virus 2
cucgcccgcggcccgggggccc

SEQ ID NO: 2401 - RNA, 22 nt, Human Herpes Virus 2
ccucggccagucgcucggucug

SEQ ID NO: 2402 - RNA, 22 nt, Human Herpes Virus 2
uggcgggccaggugggggaggu

SEQ ID NO: 2403 - RNA, 22 nt, Human Herpes Virus 2
ucggggggguacggcgaggugc

SEQ ID NO: 2404 - RNA, 21 nt, Human Herpes Virus 2
ucgccgugaagaccauccggg

SEQ ID NO: 2405 - RNA, 22 nt, Human Herpes Virus 2
gggccacgccaagcccgaggcg

SEQ ID NO: 2406 - RNA, 22 nt, Human Herpes Virus 2
uguuucgggaggcgguggauau

SEQ ID NO: 2407 - RNA, 22 nt, Human Herpes Virus 2
ugcgugaucaugggcggcgcgg

SEQ ID NO: 2408 - RNA, 22 nt, Human Herpes Virus 2
uggcggccgcccaugagacguu

SEQ ID NO: 2409 - RNA, 22 nt, Human Herpes Virus 2
cgcgcucgcugucgcucuugcg

SEQ ID NO: 2410 - RNA, 20 nt, Human Herpes Virus 2
gcagacggcagaugugcgcg

SEQ ID NO: 2411 - RNA, 22 nt, Human Herpes Virus 2
ucgggagcaggacagccgaccc

SEQ ID NO: 2412 - RNA, 22 nt, Human Herpes Virus 2
ucggcuguccagcgucgucgcc

SEQ ID NO: 2413 - RNA, 22 nt, Human Herpes Virus 2
acgcugucucgauccucuucga

SEQ ID NO: 2414 - RNA, 22 nt, Human Herpes Virus 2
gacugacgacgaugacagcgac

SEQ ID NO: 2415 - RNA, 22 nt, Human Herpes Virus 2
uccguguugagcggaacgcccc

SEQ ID NO: 2416 - RNA, 21 nt, Human Herpes Virus 2
ggauccuccgccagcucggac

SEQ ID NO: 2417 - RNA, 22 nt, Human Herpes Virus 2
ggacgugggugggcgcggggag

SEQ ID NO: 2418 - RNA, 21 nt, Human Herpes Virus 2
gggcccgagccuucuccgucc

SEQ ID NO: 2419 - RNA, 22 nt, Human Herpes Virus 2
uacuucaucuucggcgggggcu

SEQ ID NO: 2420 - RNA, 22 nt, Human Herpes Virus 2
cguacucucaccagcugagucg

SEQ ID NO: 2421 - RNA, 22 nt, Human Herpes Virus 2
gcguguggaccauggcgcgcag

SEQ ID NO: 2422 - RNA, 21 nt, Human Herpes Virus 2
cagccgcgccccggcccgcgu

SEQ ID NO: 2423 - RNA, 22 nt, Human Herpes Virus 2
uccucgcccgcgaucuguuggg

SEQ ID NO: 2424 - RNA, 22 nt, Human Herpes Virus 2
acgagaugcgcgucucgaggcc

SEQ ID NO: 2425 - RNA, 22 nt, Human Herpes Virus 2
gggcuuggccgccgaggugcgc

SEQ ID NO: 2426 - RNA, 22 nt, Human Herpes Virus 2
cccccgcaccucggcggccgcc

SEQ ID NO: 2427 - RNA, 22 nt, Human Herpes Virus 2
ugggggaguuugagacggccga

SEQ ID NO: 2428 - RNA, 22 nt, Human Herpes Virus 2
ggccagcccagccuccugcgcg

SEQ ID NO: 2429 - RNA, 22 nt, Human Herpes Virus 2
ucaacguuucgguucgggggag

SEQ ID NO: 2430 - RNA, 22 nt, Human Herpes Virus 2
cggccccgugaaucguguuggu

SEQ ID NO: 2431 - RNA, 22 nt, Human Herpes Virus 2
ccaggagcugggccuggagccc

SEQ ID NO: 2432 - RNA, 22 nt, Human Herpes Virus 2
gccguccagaccggcccgacgg

SEQ ID NO: 2433 - RNA, 22 nt, Human Herpes Virus 2
ugcaggugggccgacgugccgg

SEQ ID NO: 2434 - RNA, 15 nt, Human Herpes Virus 2
auguggcccccguac

SEQ ID NO: 2435 - RNA, 22 nt, Human Herpes Virus 2
gcgaagcugcugcggucgcgcc

SEQ ID NO: 2436 - RNA, 22 nt, Human Herpes Virus 2
cgcgacccgcggccggugccgc

SEQ ID NO: 2437 - RNA, 22 nt, Human Herpes Virus 2
aacccaaggcagagguacgcgu

SEQ ID NO: 2438 - RNA, 22 nt, Human Herpes Virus 2
ucgcagacccuguguggggcag

SEQ ID NO: 2439 - RNA, 22 nt, Human Herpes Virus 2
uggaagggcagaagauggggag

SEQ ID NO: 2440 - RNA, 22 nt, Human Herpes Virus 2
cugcauccccucgccuuccauu

SEQ ID NO: 2441 - RNA, 22 nt, Human Herpes Virus 2
uggcaccgcgacuccgugucgu

SEQ ID NO: 2442 - RNA, 22 nt, Human Herpes Virus 2
cggcacggcaucggugcugccg

SEQ ID NO: 2443 - RNA, 22 nt, Human Herpes Virus 2
accccucgggggacuuccaggc

SEQ ID NO: 2444 - RNA, 22 nt, Human Herpes Virus 2
cucggccuccuccagggaccuc

SEQ ID NO: 2445 - RNA, 22 nt, Human Herpes Virus 2
ggccaggucgguccaccccgcg

SEQ ID NO: 2446 - RNA, 20 nt, Human Herpes Virus 2
gcagggucgccagcacggcc

SEQ ID NO: 2447 - RNA, 22 nt, Human Herpes Virus 2
ugcccgcccaggcggccguggc

SEQ ID NO: 2448 - RNA, 22 nt, Human Herpes Virus 2
ugcccagggccgccagcaggca

SEQ ID NO: 2449 - RNA, 22 nt, Human Herpes Virus 2
ccggauguagucguagugcggg

SEQ ID NO: 2450 - RNA, 21 nt, Human Herpes Virus 2
cgucuacgaucaggcucucgg

SEQ ID NO: 2451 - RNA, 22 nt, Human Herpes Virus 2
agcgcucgcacuuugcccuaau

SEQ ID NO: 2452 - RNA, 20 nt, Human Herpes Virus 2
uaggacgaagugcgaacgcu

SEQ ID NO: 2453 - RNA, 22 nt, Human Herpes Virus 2
agcgcucgcacuuugcccuaau

SEQ ID NO: 2454 - RNA, 20 nt, Human Herpes Virus 2
uaggacgaagugcgaacgcu

SEQ ID NO: 2455 - RNA, 22 nt, Human Herpes Virus 2
agugcucgcacuuugcccuaau

SEQ ID NO: 2456 - RNA, 20 nt, Human Herpes Virus 2
uaggacgaagugcgaacgcu

SEQ ID NO: 2457 - RNA, 22 nt, Human Herpes Virus 2
ccgucccggucuccgccgcgca

SEQ ID NO: 2458 - RNA, 22 nt, Human Herpes Virus 2
ugcggcggcgaccgggacgccg

SEQ ID NO: 2459 - RNA, 22 nt, Human Herpes Virus 2
ccgucccggucuccgccgcgca

SEQ ID NO: 2460 - RNA, 22 nt, Human Herpes Virus 2
ugcggcggcgaccgggacgccg

SEQ ID NO: 2461 - RNA, 22 nt, Human Herpes Virus 2
cagccgcccccuggucagcuuu

SEQ ID NO: 2462 - RNA, 22 nt, Human Herpes Virus 2
gcccgcugaucgaggggcagcu

SEQ ID NO: 2463 - RNA, 22 nt, Human Herpes Virus 2
ccgcccccgccccgucaucgcc

SEQ ID NO: 2464 - RNA, 19 nt, Human Herpes Virus 2
augagggcccggguugcgg

SEQ ID NO: 2465 - RNA, 22 nt, Human Herpes Virus 2
cgcgcguccgcguccguggcgg

SEQ ID NO: 2466 - RNA, 22 nt, Human Herpes Virus 2
gccgccgcuccgcccgcgcggc

SEQ ID NO: 2467 - RNA, 22 nt, Human Herpes Virus 2
cgcgcguccgcguccguggcgg

SEQ ID NO: 2468 - RNA, 22 nt, Human Herpes Virus 2
gccgccgcuccgcccgcgcggc

SEQ ID NO: 2469 - RNA, 22 nt, Human Herpes Virus 2
cguccaccccggaagguuggcc

SEQ ID NO: 2470 - RNA, 19 nt, Human Herpes Virus 2
acuuuccgggacgacaaag

SEQ ID NO: 2471 - RNA, 22 nt, Human Herpes Virus 2
ccgugccacccgaacccgggcc

SEQ ID NO: 2472 - RNA, 22 nt, Human Herpes Virus 2
uccggguucggggugggcggcg

SEQ ID NO: 2473 - RNA, 22 nt, Human Herpes Virus 2
ccgucgggccggucuggacggc

SEQ ID NO: 2474 - RNA, 22 nt, Human Herpes Virus 2
gcuccaggcccagcuccuggcc

SEQ ID NO: 2475 - RNA, 22 nt, Human Herpes Virus 2
cgcuacacgacccuggagaucc

SEQ ID NO: 2476 - RNA, 22 nt, Human Herpes Virus 2
ggggcucggggggguacggcga

SEQ ID NO: 2477 - RNA, 22 nt, Human Herpes Virus 2
gggugagcgcgcgcaugcucgg

SEQ ID NO: 2478 - RNA, 22 nt, Human Herpes Virus 2
uccacgugcgugcccgucgccc

SEQ ID NO: 2479 - RNA, 22 nt, Human Herpes Virus 2
gggacgcggccgucugguucga

SEQ ID NO: 2480 - RNA, 19 nt, Human Herpes Virus 2
aacuagagguuauauuccc

SEQ ID NO: 2481 - RNA, 22 nt, Human Herpes Virus 2
ucuggggcugguucccauauug

SEQ ID NO: 2482 - RNA, 22 nt, Human Herpes Virus 2
agggggaggcgacgcagcgccu

SEQ ID NO: 2483 - RNA, 22 nt, Human Herpes Virus 2
cgccgccgucucccgggggaug

SEQ ID NO: 2484 - RNA, 22 nt, Human Herpes Virus 2
uccagaagucccgggggaacuc

SEQ ID NO: 2485 - RNA, 22 nt, Human Herpes Virus 2
ucugggggccuuucucugugug

SEQ ID NO: 2486 - RNA, 20 nt, Human Herpes Virus 2
caucucgagggccccgggac

SEQ ID NO: 2487 - RNA, 22 nt, Human Herpes Virus 2
gcucgcgaaccacauccaccca

SEQ ID NO: 2488 - RNA, 22 nt, Human Herpes Virus 2
gcgugggugugaauuucggggg

SEQ ID NO: 2489 - RNA, 22 nt, Human Herpes Virus 2
ugcucgccguggucaacgaccc

SEQ ID NO: 2490 - RNA, 22 nt, Human Herpes Virus 2
ggggcugaucgcgugcgugcag

SEQ ID NO: 2491 - RNA, 22 nt, Human Herpes Virus 2
gcgggccacggggaguaggggg

SEQ ID NO: 2492 - RNA, 22 nt, Human Herpes Virus 2
gcuugcugcccgaaggaagccg

SEQ ID NO: 2493 - RNA, 22 nt, Human Herpes Virus 2
gggggaggcgugcuggaauucc

SEQ ID NO: 2494 - RNA, 20 nt, Human Herpes Virus 2
aggccagccacgccaacccc

SEQ ID NO: 2495 - RNA, 22 nt, Human Herpes Virus 2
ugggaugcccgccgcccugacc

SEQ ID NO: 2496 - RNA, 21 nt, Human Herpes Virus 2
guggggcacggguacaaccag

SEQ ID NO: 2497 - RNA, 22 nt, Human Herpes Virus 2
gaucgacccccgcgccgccgcg

SEQ ID NO: 2498 - RNA, 22 nt, Human Herpes Virus 2
ggugguggcgggccucgggaca

SEQ ID NO: 2499 - RNA, 22 nt, Human Herpes Virus 2
cgccgccugggccccgccgauc

SEQ ID NO: 2500 - RNA, 20 nt, Human Herpes Virus 2
ucagcgggagucuggaggcg

SEQ ID NO: 2501 - RNA, 22 nt, Human Herpes Virus 2
agcgggcugcgcggccgacucg

SEQ ID NO: 2502 - RNA, 22 nt, Human Herpes Virus 2
guguuggacccggcggcccgcc

SEQ ID NO: 2503 - RNA, 22 nt, Human Herpes Virus 2
gcguguaauacguggccggccg

SEQ ID NO: 2504 - RNA, 18 nt, Human Herpes Virus 2
ggucggccgcgucgacgu

SEQ ID NO: 2505 - RNA, 22 nt, Human Herpes Virus 2
ccgcguacgcccuggccgugcu

SEQ ID NO: 2506 - RNA, 18 nt, Human Herpes Virus 2
cagggcggucgggggcgg

SEQ ID NO: 2507 - RNA, 22 nt, Human Herpes Virus 2
ggcgugggcgcgccuggccgcc

SEQ ID NO: 2508 - RNA, 17 nt, Human Herpes Virus 2
agugcgcguccuccgcc

SEQ ID NO: 2509 - RNA, 22 nt, Human Herpes Virus 2
uuuccgcgccgucccggcccac

SEQ ID NO: 2510 - RNA, 22 nt, Human Herpes Virus 2
ugggccgugaugcgcgggcggc

SEQ ID NO: 2511 - RNA, 22 nt, Human Herpes Virus 2
ugugcguucgcggggcgcgucc

SEQ ID NO: 2512 - RNA, 21 nt, Human Herpes Virus 2
gagcgcuuuucgaacgccagc

SEQ ID NO: 2513 - RNA, 22 nt, Human Herpes Virus 2
ccucggggcuccgccagggcgc

SEQ ID NO: 2514 - RNA, 22 nt, Human Herpes Virus 2
gucagcgggggagcccugggcg

SEQ ID NO: 2515 - RNA, 22 nt, Human Herpes Virus 2
ccugcacccgcacuccgcccac

SEQ ID NO: 2516 - RNA, 22 nt, Human Herpes Virus 2
uggagcaggaggcgcuguuucg

SEQ ID NO: 2517 - RNA, 22 nt, Human Herpes Virus 2
cgccuccagacucccgcugagc

SEQ ID NO: 2518 - RNA, 20 nt, Human Herpes Virus 2
ucggcggggcccaggcggcg

SEQ ID NO: 2519 - RNA, 22 nt, Human Herpes Virus 2
gcccucagcgcguccccgacca

SEQ ID NO: 2520 - RNA, 19 nt, Human Herpes Virus 2
ucggcgaggacguuggggu

SEQ ID NO: 2521 - RNA, 22 nt, Human Herpes Virus 2
ucggggacagaggacgccggcc

SEQ ID NO: 2522 - RNA, 22 nt, Human Herpes Virus 2
ucuggguguuuucuuucuuuuu

SEQ ID NO: 2523 - RNA, 22 nt, Human Herpes Virus 2
gcgcauagcgccgcgucgccgc

SEQ ID NO: 2524 - RNA, 22 nt, Human Herpes Virus 2
gcgcccgcgcgcgcugugcggc

SEQ ID NO: 2525 - RNA, 22 nt, Human Herpes Virus 2
ucguugaucuucgcgcccucga

SEQ ID NO: 2526 - RNA, 22 nt, Human Herpes Virus 2
agggccacgaggucgacccgca

SEQ ID NO: 2527 - RNA, 22 nt, Human Herpes Virus 2
uggccggcaguacccuggcggu

SEQ ID NO: 2528 - RNA, 22 nt, Human Herpes Virus 2
uugcguuuuggguacgccgccg

SEQ ID NO: 2529 - RNA, 22 nt, Human Herpes Virus 2
gggaggcgucguagaugagaua

SEQ ID NO: 2530 - RNA, 22 nt, Human Herpes Virus 2
ucucucgcgcgugggccucccc

SEQ ID NO: 2531 - RNA, 22 nt, Human Herpes Virus 2
ucgacgcccuccuggccgcacg

SEQ ID NO: 2532 - RNA, 22 nt, Human Herpes Virus 2
ucggcccggcgggggggcgcga

SEQ ID NO: 2533 - RNA, 22 nt, Human Herpes Virus 2
ggaggggagaggagaagggcgc

SEQ ID NO: 2534 - RNA, 22 nt, Human Herpes Virus 2
cagccuuccuucuccggagucc

SEQ ID NO: 2535 - RNA, 22 nt, Human Herpes Virus 2
uacacccccgcgcaccucgacc

SEQ ID NO: 2536 - RNA, 22 nt, Human Herpes Virus 2
gcauaagaggucgcgggggcgu

SEQ ID NO: 2537 - RNA, 22 nt, Human Herpes Virus 2
cggacccgcggaggaggaggag

SEQ ID NO: 2538 - RNA, 21 nt, Human Herpes Virus 2
cuccgccgccgcgggcccggg

SEQ ID NO: 2539 - RNA, 22 nt, Human Herpes Virus 2
uaggcgucggggucuacgcggg

SEQ ID NO: 2540 - RNA, 22 nt, Human Herpes Virus 2
gccgccagcgccccgcgccuaa

SEQ ID NO: 2541 - RNA, 22 nt, Human Herpes Virus 2
ucccggguagccgcccggcgcc

SEQ ID NO: 2542 - RNA, 22 nt, Human Herpes Virus 2
ccgcccggcgguccggcccggg

SEQ ID NO: 2543 - RNA, 22 nt, Human Herpes Virus 2
acgggugaguucgcuaggcaag

SEQ ID NO: 2544 - RNA, 21 nt, Human Herpes Virus 2
ccgagugaacucucccgcccc

SEQ ID NO: 2545 - RNA, 22 nt, Human Herpes Virus 2
cggagggcuucuggccgcgucg

SEQ ID NO: 2546 - RNA, 20 nt, Human Herpes Virus 2
cggugcggaccaugcccccg

SEQ ID NO: 2547 - RNA, 22 nt, Human Herpes Virus 2
acgaugcagcagcugggccgcg

SEQ ID NO: 2548 - RNA, 21 nt, Human Herpes Virus 2
ugcugcgccugcugcgcacgu

SEQ ID NO: 2549 - RNA, 22 nt, Human Herpes Virus 2
accagcagcccgaugggggugu

SEQ ID NO: 2550 - RNA, 20 nt, Human Herpes Virus 2
gccuccgcggggcaggcggu

SEQ ID NO: 2551 - RNA, 22 nt, Human Herpes Virus 2
ccccuuucucccccccuuccga

SEQ ID NO: 2552 - RNA, 22 nt, Human Herpes Virus 2
gggggccggggugagggaggga

SEQ ID NO: 2553 - RNA, 22 nt, Human Herpes Virus 2
gggaacguggcggaccugcugc

SEQ ID NO: 2554 - RNA, 20 nt, Human Herpes Virus 2
cgcguggagccgccgcaccc

SEQ ID NO: 2555 - RNA, 22 nt, Human Herpes Virus 2
ggggggacgggacgugggcccc

SEQ ID NO: 2556 - RNA, 22 nt, Human Herpes Virus 2
caggcucgcguuccgaggccgg

SEQ ID NO: 2557 - RNA, 22 nt, Human Herpes Virus 2
ucgggcgcaugugucugccgag

SEQ ID NO: 2558 - RNA, 22 nt, Human Herpes Virus 2
uguggaccugcauguuucccga

SEQ ID NO: 2559 - RNA, 22 nt, Human Herpes Virus 2
uccgggcagggcggcggcgacg

SEQ ID NO: 2560 - RNA, 22 nt, Human Herpes Virus 2
ucgucgccguccgugcucgaga

SEQ ID NO: 2561 - RNA, 22 nt, Human Herpes Virus 2
gagacgaggggucggaauccaa

SEQ ID NO: 2562 - RNA, 22 nt, Human Herpes Virus 2
ugguuacggaccccuuucuccc

SEQ ID NO: 2563 - RNA, 22 nt, Human Herpes Virus 2
gagacgaggggucggaauccaa

SEQ ID NO: 2564 - RNA, 22 nt, Human Herpes Virus 2
ugguuacggaccccuuucuccc

SEQ ID NO: 2565 - RNA, 22 nt, Human Herpes Virus 2
uuucgggccucguccgaagccc

SEQ ID NO: 2566 - RNA, 22 nt, Human Herpes Virus 2
gccuccgauggggcauguagga

SEQ ID NO: 2567 - RNA, 22 nt, Human Herpes Virus 2
gcgcgggcggcacgcgcgagag

SEQ ID NO: 2568 - RNA, 22 nt, Human Herpes Virus 2
ucgcgccaccgccagcccuugc

SEQ ID NO: 2569 - RNA, 22 nt, Human Herpes Virus 2
ccgcgcaggaaacgcccccggg

SEQ ID NO: 2570 - RNA, 20 nt, Human Herpes Virus 2
cgcgggggcgccuguaucgg

SEQ ID NO: 2571 - RNA, 22 nt, Human Herpes Virus 2
cggccccggggcgcggccuucc

SEQ ID NO: 2572 - RNA, 20 nt, Human Herpes Virus 2
cgggccgcgugucgggcccg

SEQ ID NO: 2573 - RNA, 22 nt, Human Herpes Virus 2
ggucggucacgggaucgcucgg

SEQ ID NO: 2574 - RNA, 22 nt, Human Herpes Virus 2
gggggcgaucuccgggaccacc

SEQ ID NO: 2575 - RNA, 22 nt, Human Herpes Virus 2
cccggucagcgccgcguucucg

SEQ ID NO: 2576 - RNA, 22 nt, Human Herpes Virus 2
guaggcgcggcgcaggcugguc

SEQ ID NO: 2577 - RNA, 22 nt, Human Herpes Virus 2
ucggaggaggagaccgaggugg

SEQ ID NO: 2578 - RNA, 22 nt, Human Herpes Virus 2
ucaccgcgacuccaccuccgag

SEQ ID NO: 2579 - RNA, 22 nt, Human Herpes Virus 2
aacacgccgaccgccuggccag

SEQ ID NO: 2580 - RNA, 22 nt, Human Herpes Virus 2
uggccaugcuguccgccauucg

SEQ ID NO: 2581 - RNA, 22 nt, Human Herpes Virus 2
ccaucgaccccgccguucgggc

SEQ ID NO: 2582 - RNA, 22 nt, Human Herpes Virus 2
cgagcgcgcggcggucgagcgc

SEQ ID NO: 2583 - RNA, 22 nt, Human Herpes Virus 2
uagaggcuguccgccgggcgug

SEQ ID NO: 2584 - RNA, 22 nt, Human Herpes Virus 2
cgacccccgaacagccccuggg

SEQ ID NO: 2585 - RNA, 22 nt, Human Herpes Virus 2
agguacucguccuccagcagcg

SEQ ID NO: 2586 - RNA, 22 nt, Human Herpes Virus 2
cagcugcugggugcgggggccc

SEQ ID NO: 2587 - RNA, 22 nt, Human Herpes Virus 2
gcgcgccuccggcguacggcau

SEQ ID NO: 2588 - RNA, 22 nt, Human Herpes Virus 2
ugguggccggaggcccgauuuu

SEQ ID NO: 2589 - RNA, 22 nt, Human Herpes Virus 2
gggaugucaggggcccgccgcc

SEQ ID NO: 2590 - RNA, 22 nt, Human Herpes Virus 2
ggcgcgccucugacccaccccc

SEQ ID NO: 2591 - RNA, 22 nt, Human Herpes Virus 2
uacccgggcaccacguggcccu

SEQ ID NO: 2592 - RNA, 22 nt, Human Herpes Virus 2
guuggccgccacgugcgugccg

SEQ ID NO: 2593 - RNA, 22 nt, Human Herpes Virus 2
uaggcgcggggcgcuggcggcg

SEQ ID NO: 2594 - RNA, 22 nt, Human Herpes Virus 2
gcggcccgcguagaccccgacg

SEQ ID NO: 2595 - RNA, 22 nt, Human Herpes Virus 2
ucccuccugacgggggagcugu

SEQ ID NO: 2596 - RNA, 22 nt, Human Herpes Virus 2
gcgcccccucgccgacgaggca

SEQ ID NO: 2597 - RNA, 22 nt, Human Herpes Virus 2
uuacggcaacaaagggccuccg

SEQ ID NO: 2598 - RNA, 22 nt, Human Herpes Virus 2
gagccucuuugggccgugggua

SEQ ID NO: 2599 - RNA, 22 nt, Human Herpes Virus 2
cgccuggucgagcgucuuggcc

SEQ ID NO: 2600 - RNA, 22 nt, Human Herpes Virus 2
gucuugagguuggccaggcccu

SEQ ID NO: 2601 - RNA, 22 nt, Human Herpes Virus 2
ucagcaccccaccgaaaaacgg

SEQ ID NO: 2602 - RNA, 22 nt, Human Herpes Virus 2
cuuguuuucggucugguacucc

SEQ ID NO: 2603 - RNA, 22 nt, Human Herpes Virus 2
ugcgaggugcugcccgccgugc

SEQ ID NO: 2604 - RNA, 22 nt, Human Herpes Virus 2
ggccggcggcgcgggaccugcg

SEQ ID NO: 2605 - RNA, 22 nt, Human Herpes Virus 2
ugcgaggugcugcccgccgugc

SEQ ID NO: 2606 - RNA, 22 nt, Human Herpes Virus 2
ggccggcggcgcgggaccugcg

SEQ ID NO: 2607 - RNA, 22 nt, Human Herpes Virus 2
ucucgaccgcgguucccgaguc

SEQ ID NO: 2608 - RNA, 22 nt, Human Herpes Virus 2
uugggagucugcgguugggagc

SEQ ID NO: 2609 - RNA, 22 nt, Human Herpes Virus 2
ggcggggcggcggucgccagca

SEQ ID NO: 2610 - RNA, 22 nt, Human Herpes Virus 2
uggcgaccgucaagagccuggg

SEQ ID NO: 2611 - RNA, 22 nt, Human Herpes Virus 2
gacggagcggcggcccggcggg

SEQ ID NO: 2612 - RNA, 20 nt, Human Herpes Virus 2
gcgggccgccgucucgaguc

SEQ ID NO: 2613 - RNA, 22 nt, Human Herpes Virus 2
ggcggggcgccgggggucgcgg

SEQ ID NO: 2614 - RNA, 22 nt, Human Herpes Virus 2
ugggguccggguacgccccgcg

SEQ ID NO: 2615 - RNA, 22 nt, Human Herpes Virus 2
ggcggggcgccgggggucgcgg

SEQ ID NO: 2616 - RNA, 22 nt, Human Herpes Virus 2
ugggguccggguacgccccgcg

SEQ ID NO: 2617 - RNA, 22 nt, Human Herpes Virus 2
gcgguccagugacacucgcgca

SEQ ID NO: 2618 - RNA, 19 nt, Human Herpes Virus 2
guagguguuauuggggugc

SEQ ID NO: 2619 - RNA, 22 nt, Human Herpes Virus 2
gggcgucccuguguccccgggg

SEQ ID NO: 2620 - RNA, 22 nt, Human Herpes Virus 2
ucggggggaggacggggguguc

SEQ ID NO: 2621 - RNA, 22 nt, Human Herpes Virus 2
gggcggggagcuugggagugug

SEQ ID NO: 2622 - RNA, 22 nt, Human Herpes Virus 2
cagccugcuaguccccguccug

SEQ ID NO: 2623 - RNA, 22 nt, Human Herpes Virus 2
ucgcgucccucgcggggcugcg

SEQ ID NO: 2624 - RNA, 22 nt, Human Herpes Virus 2
ggcgcaccucgggguaugcgac

SEQ ID NO: 2625 - RNA, 22 nt, Human Herpes Virus 2
acgggggggauuuagagggcgc

SEQ ID NO: 2626 - RNA, 20 nt, Human Herpes Virus 2
ccgcgccgugucccccgugu

SEQ ID NO: 2627 - RNA, 22 nt, Human Herpes Virus 2
ggggcggacggccccuacguca

SEQ ID NO: 2628 - RNA, 22 nt, Human Herpes Virus 2
cgaacuggggcgccgccagcuc

SEQ ID NO: 2629 - RNA, 22 nt, Human Herpes Virus 2
gcccccgccggggcgcgcggcu

SEQ ID NO: 2630 - RNA, 22 nt, Human Herpes Virus 2
augccgccccuuugggggagug

SEQ ID NO: 2631 - RNA, 22 nt, Human Herpes Virus 2
gagcccgggggagcggcggggg

SEQ ID NO: 2632 - RNA, 22 nt, Human Herpes Virus 2
uccguuguaucuugucccggca

SEQ ID NO: 2633 - RNA, 22 nt, Human Herpes Virus 2
ugggaguaguggggggcguggu

SEQ ID NO: 2634 - RNA, 20 nt, Human Herpes Virus 2
cguguccuccuuuaugucca

SEQ ID NO: 2635 - RNA, 22 nt, Human Herpes Virus 2
ucaccaggugcgguugcagggg

SEQ ID NO: 2636 - RNA, 22 nt, Human Herpes Virus 2
cugcaccaagaucuguuugaag

SEQ ID NO: 2637 - RNA, 22 nt, Human Herpes Virus 2
gagggccugcguaacccacggg

SEQ ID NO: 2638 - RNA, 22 nt, Human Herpes Virus 2
ccugcggguugcgggggagagu

SEQ ID NO: 2639 - RNA, 22 nt, Human Herpes Virus 2
cgcccaccgguccuucgcgggg

SEQ ID NO: 2640 - RNA, 22 nt, Human Herpes Virus 2
uggcccuuggacgggugggccu

SEQ ID NO: 2641 - RNA, 22 nt, Human Herpes Virus 2
ugcaggcgguugucgaggcggu

SEQ ID NO: 2642 - RNA, 22 nt, Human Herpes Virus 2
cguucgcgaggagccgccgaag

SEQ ID NO: 2643 - RNA, 22 nt, Human Herpes Virus 2
cggucgggggcggcggcggcgg

SEQ ID NO: 2644 - RNA, 22 nt, Human Herpes Virus 2
gcccgcuucgccgacuccgacg

SEQ ID NO: 2645 - RNA, 22 nt, Human Herpes Virus 2
gcgugggugugaauuucggggg

SEQ ID NO: 2646 - RNA, 16 nt, Human Herpes Virus 2
gagguuuauauccugc

SEQ ID NO: 2647 - RNA, 22 nt, Human Herpes Virus 2
gggugggucagaggcgcgcccc

SEQ ID NO: 2648 - RNA, 22 nt, Human Herpes Virus 2
gcggcgggccccugacaucccc

SEQ ID NO: 2649 - RNA, 22 nt, Human Herpes Virus 2
uugggcggcccccggccuuugc

SEQ ID NO: 2650 - RNA, 22 nt, Human Herpes Virus 2
gggccuguucggggcgugucug

SEQ ID NO: 2651 - RNA, 22 nt, Human Herpes Virus 2
cgguccgaugaccgccucggcc

SEQ ID NO: 2652 - RNA, 20 nt, Human Herpes Virus 2
gccggaaccggucgcggucg

SEQ ID NO: 2653 - RNA, 22 nt, Human Herpes Virus 2
cggggccaacgugcgguaccgc

SEQ ID NO: 2654 - RNA, 22 nt, Human Herpes Virus 2
cgcuggugcccauguccccgcg

SEQ ID NO: 2655 - RNA, 22 nt, Human Herpes Virus 2
ucgcuguucgaggccacgcgcg

SEQ ID NO: 2656 - RNA, 22 nt, Human Herpes Virus 2
gaaguggaccucgggccgcgcc

SEQ ID NO: 2657 - RNA, 22 nt, Human Herpes Virus 2
ccgucaggugggccaggcgcuu

SEQ ID NO: 2658 - RNA, 22 nt, Human Herpes Virus 2
gugucugcucaguucggcggug

SEQ ID NO: 2659 - RNA, 22 nt, Human Herpes Virus 2
uguugguggugguggaggggcg

SEQ ID NO: 2660 - RNA, 21 nt, Human Herpes Virus 2
cucccccgccgacuuuguuag

SEQ ID NO: 2661 - RNA, 22 nt, Human Herpes Virus 2
gccuuugcggucuggcggucgc

SEQ ID NO: 2662 - RNA, 20 nt, Human Herpes Virus 2
gcgaccgccgggucugcggu

SEQ ID NO: 2663 - RNA, 22 nt, Human Herpes Virus 2
agcgcgcggaggccaccgagcg

SEQ ID NO: 2664 - RNA, 22 nt, Human Herpes Virus 2
cgggaggcgcuggccgcgcgcg

SEQ ID NO: 2665 - RNA, 22 nt, Human Herpes Virus 2
gcgggaggggggggcgacgugu

SEQ ID NO: 2666 - RNA, 22 nt, Human Herpes Virus 2
acgagaucgccccgccccugcg

SEQ ID NO: 2667 - RNA, 22 nt, Human Herpes Virus 2
caccgcgugcgccgccgucggc

SEQ ID NO: 2668 - RNA, 22 nt, Human Herpes Virus 2
uggcggcccaugcgcacgagga

SEQ ID NO: 2669 - RNA, 22 nt, Human Herpes Virus 2
cgagcacggacggcgacgacgg

SEQ ID NO: 2670 - RNA, 22 nt, Human Herpes Virus 2
gucgucgccgccgcccugcccg

SEQ ID NO: 2671 - RNA, 22 nt, Human Herpes Virus 2
acgccccggucuggcuccaggu

SEQ ID NO: 2672 - RNA, 22 nt, Human Herpes Virus 2
uggcgccagggagggggcgagg

SEQ ID NO: 2673 - RNA, 22 nt, Human Herpes Virus 2
agggggcuggggcucgcgucgc

SEQ ID NO: 2674 - RNA, 22 nt, Human Herpes Virus 2
gccgccguccccaccacccucc

SEQ ID NO: 2675 - RNA, 22 nt, Human Herpes Virus 2
gcacgcgccugcguucggucag

SEQ ID NO: 2676 - RNA, 20 nt, Human Herpes Virus 2
ccuaccgacggccgcgcggc

SEQ ID NO: 2677 - RNA, 22 nt, Human Herpes Virus 2
gcggagggcuucgacggcgacc

SEQ ID NO: 2678 - RNA, 22 nt, Human Herpes Virus 2
gcuggccggagcccggcccgcc

SEQ ID NO: 2679 - RNA, 22 nt, Human Herpes Virus 2
gcggagggcuucgacggcgacc

SEQ ID NO: 2680 - RNA, 22 nt, Human Herpes Virus 2
gcuggccggagcccggcccgcc

SEQ ID NO: 2681 - RNA, 22 nt, Human Herpes Virus 2
gggucugccgucccgcucacgg

SEQ ID NO: 2682 - RNA, 22 nt, Human Herpes Virus 2
aggacgcggggcgaagguccac

SEQ ID NO: 2683 - RNA, 22 nt, Human Herpes Virus 2
gcagguguuucugccccucgac

SEQ ID NO: 2684 - RNA, 19 nt, Human Herpes Virus 2
gauggggcggacccaccgc

SEQ ID NO: 2685 - RNA, 22 nt, Human Herpes Virus 2
gggcggggggaaggcgccggag

SEQ ID NO: 2686 - RNA, 22 nt, Human Herpes Virus 2
ugccgccgccugccccccgccg

SEQ ID NO: 2687 - RNA, 22 nt, Human Herpes Virus 2
accgcgccguccagaccggccc

SEQ ID NO: 2688 - RNA, 22 nt, Human Herpes Virus 2
gucgaguaguuggaugguggug

SEQ ID NO: 2689 - RNA, 22 nt, Human Herpes Virus 2
gggcggccgccgaggugcgggg

SEQ ID NO: 2690 - RNA, 22 nt, Human Herpes Virus 2
gcaccucggcggccaagccccg

SEQ ID NO: 2691 - RNA, 22 nt, Human Herpes Virus 2
uguccccggagccacgccacgc

SEQ ID NO: 2692 - RNA, 22 nt, Human Herpes Virus 2
ugucggcgugguugggggucgu

SEQ ID NO: 2693 - RNA, 22 nt, Human Herpes Virus 2
accaaccuccccguggaucugc

SEQ ID NO: 2694 - RNA, 22 nt, Human Herpes Virus 2
gggccgcggggccgcggguucg

SEQ ID NO: 2695 - RNA, 22 nt, Human Herpes Virus 2
agcguucgcacuucguccuaau

SEQ ID NO: 2696 - RNA, 20 nt, Human Herpes Virus 2
uagggcaaagugcgagcacu

SEQ ID NO: 2697 - RNA, 22 nt, Human Herpes Virus 2
agcguucgcacuucguccuaau

SEQ ID NO: 2698 - RNA, 20 nt, Human Herpes Virus 2
uagggcaaagugcgagcacu

SEQ ID NO: 2699 - RNA, 22 nt, Human Herpes Virus 2
cggggccaacgugcgguaccgc

SEQ ID NO: 2700 - RNA, 22 nt, Human Herpes Virus 2
cgcuggugcccauguccccgcg

SEQ ID NO: 2701 - RNA, 22 nt, Human Herpes Virus 2
gcgcaggggcggggcgaucucg

SEQ ID NO: 2702 - RNA, 22 nt, Human Herpes Virus 2
acgucgccccccccucccgcuu

SEQ ID NO: 2703 - RNA, 22 nt, Human Herpes Virus 2
gcccgccccuccuuacccuggc

SEQ ID NO: 2704 - RNA, 22 nt, Human Herpes Virus 2
ucggggcgagggggcucgcgcg

SEQ ID NO: 2705 - RNA, 22 nt, Human Herpes Virus 2
gcccgccccuccuuacccuggc

SEQ ID NO: 2706 - RNA, 22 nt, Human Herpes Virus 2
ucggggcgagggggcucgcgcg

SEQ ID NO: 2707 - RNA, 22 nt, Human Herpes Virus 2
uccgcguccggcccccaggucc

SEQ ID NO: 2708 - RNA, 20 nt, Human Herpes Virus 2
ccccggcggccucgcgcuga

SEQ ID NO: 2709 - RNA, 22 nt, Human Herpes Virus 2
gggugggcggcgguccgucggc

SEQ ID NO: 2710 - RNA, 22 nt, Human Herpes Virus 2
ccgccggucgucuccgccgcgg

SEQ ID NO: 2711 - RNA, 22 nt, Human Herpes Virus 2
uugcgccuguggggcggugcgg

SEQ ID NO: 2712 - RNA, 22 nt, Human Herpes Virus 2
gucaccgucuuccacguguacg

SEQ ID NO: 2713 - RNA, 22 nt, Human Herpes Virus 2
cggauugggcguggggccgccg

SEQ ID NO: 2714 - RNA, 22 nt, Human Herpes Virus 2
gcuccuccaggccguggaucca

SEQ ID NO: 2715 - RNA, 22 nt, Human Herpes Virus 2
gccuggaggacccguuccagcc

SEQ ID NO: 2716 - RNA, 20 nt, Human Herpes Virus 2
ugcuggaacgugccugccgc

SEQ ID NO: 2717 - RNA, 22 nt, Human Herpes Virus 2
uccacguacugcagggccucga

SEQ ID NO: 2718 - RNA, 22 nt, Human Herpes Virus 2
ucgguggccgcgcgguacgucu

SEQ ID NO: 2719 - RNA, 22 nt, Human Herpes Virus 2
cgggcgucgggaugcgggguca

SEQ ID NO: 2720 - RNA, 22 nt, Human Herpes Virus 2
cuccgcugcguccucgaacgcg

SEQ ID NO: 2721 - RNA, 22 nt, Human Herpes Virus 2
ucuccucuuccugcuccuccuc

SEQ ID NO: 2722 - RNA, 22 nt, Human Herpes Virus 2
ggaggggcgggcguggcgggca

SEQ ID NO: 2723 - RNA, 22 nt, Human Herpes Virus 2
gggcggggagcuugggagugug

SEQ ID NO: 2724 - RNA, 22 nt, Human Herpes Virus 2
cagccugcuaguccccguccug

SEQ ID NO: 2725 - RNA, 22 nt, Human Herpes Virus 2
gacccagcucaagggacugucg

SEQ ID NO: 2726 - RNA, 22 nt, Human Herpes Virus 2
uugcggucccgggccuggguaa

SEQ ID NO: 2727 - RNA, 22 nt, Human Herpes Virus 2
ucggaggaggagaccgaggugg

SEQ ID NO: 2728 - RNA, 22 nt, Human Herpes Virus 2
ucaccgcgacuccaccuccgag

SEQ ID NO: 2729 - RNA, 22 nt, Human Herpes Virus 2
ucgggggggcgguuugggugcc

SEQ ID NO: 2730 - RNA, 20 nt, Human Herpes Virus 2
ugggcccgaggccccccggg

SEQ ID NO: 2731 - RNA, 22 nt, Human Herpes Virus 2
uccggggacaguucuccaggua

SEQ ID NO: 2732 - RNA, 22 nt, Human Herpes Virus 2
ucgaagucccggagguccgugg

SEQ ID NO: 2733 - RNA, 22 nt, Human Herpes Virus 2
ggugggggaggucgguggggug

SEQ ID NO: 2734 - RNA, 22 nt, Human Herpes Virus 2
gccccggccggcuccgcguuug

SEQ ID NO: 2735 - RNA, 22 nt, Human Herpes Virus 2
ggaucagcaaccaggcgcugcu

SEQ ID NO: 2736 - RNA, 22 nt, Human Herpes Virus 2
gugcgccaggucagcgaucgcc

SEQ ID NO: 2737 - RNA, 22 nt, Human Herpes Virus 2
uguccggggcggugauaugccg

SEQ ID NO: 2738 - RNA, 22 nt, Human Herpes Virus 2
cuaaaucuucgucgcggagguc

SEQ ID NO: 2739 - RNA, 22 nt, Human Herpes Virus 2
gcgcacggacggcgaccugcgg

SEQ ID NO: 2740 - RNA, 21 nt, Human Herpes Virus 2
ggcgggggauguguccauggc

SEQ ID NO: 2741 - RNA, 22 nt, Human Herpes Virus 2
ccgcccaccccgaacccggacc

SEQ ID NO: 2742 - RNA, 22 nt, Human Herpes Virus 2
gcccggguucggguggcacggu

SEQ ID NO: 2743 - RNA, 22 nt, Human Herpes Virus 2
ccccuuucucccccccuuccga

SEQ ID NO: 2744 - RNA, 22 nt, Human Herpes Virus 2
gggggccggggugagggaggga

SEQ ID NO: 2745 - RNA, 22 nt, Human Herpes Virus 2
ccuccgccaccucgaccagacu

SEQ ID NO: 2746 - RNA, 20 nt, Human Herpes Virus 2
cuguuugaggauggcggcgg

SEQ ID NO: 2747 - RNA, 22 nt, Human Herpes Virus 2
caucucauuagcgcccggcgcg

SEQ ID NO: 2748 - RNA, 22 nt, Human Herpes Virus 2
ccgcgaugcuaaugagacccuc

SEQ ID NO: 2749 - RNA, 22 nt, Human Herpes Virus 2
gcgggguccccuccagggcugc

SEQ ID NO: 2750 - RNA, 22 nt, Human Herpes Virus 2
ggggcgguuugggugccccgcc

SEQ ID NO: 2751 - RNA, 22 nt, Human Herpes Virus 2
ccuugcggggggggauggcgga

SEQ ID NO: 2752 - RNA, 20 nt, Human Herpes Virus 2
ccgcugccccccccgcacgg

SEQ ID NO: 2753 - RNA, 22 nt, Human Herpes Virus 2
ugggucuggugugugcaggugg

SEQ ID NO: 2754 - RNA, 22 nt, Human Herpes Virus 2
ccaucugcgucguggggcuccu

SEQ ID NO: 2755 - RNA, 22 nt, Human Herpes Virus 2
uacacggcgagguuggaccgcc

SEQ ID NO: 2756 - RNA, 22 nt, Human Herpes Virus 2
ggggcacggcccgcagguguac

SEQ ID NO: 2757 - RNA, 22 nt, Human Herpes Virus 2
accgagcucguguucguggggg

SEQ ID NO: 2758 - RNA, 22 nt, Human Herpes Virus 2
ucuccgagggcgagcucggcuu

SEQ ID NO: 2759 - RNA, 22 nt, Human Herpes Virus 2
gguccccugcgcccgucguggg

SEQ ID NO: 2760 - RNA, 22 nt, Human Herpes Virus 2
ccgacgggugcucgagacgguc

SEQ ID NO: 2761 - RNA, 22 nt, Human Herpes Virus 2
gggggggcucgggccaccugac

SEQ ID NO: 2762 - RNA, 22 nt, Human Herpes Virus 2
gucagagccccagaccccccgc

SEQ ID NO: 2763 - RNA, 22 nt, Human Herpes Virus 2
uagggguucagggccugggcca

SEQ ID NO: 2764 - RNA, 22 nt, Human Herpes Virus 2
cgaaguccagguccaccuccuu

SEQ ID NO: 2765 - RNA, 22 nt, Human Herpes Virus 2
cguucaccaccacgccccccac

SEQ ID NO: 2766 - RNA, 20 nt, Human Herpes Virus 2
ggggguggcggcgguggucg

SEQ ID NO: 2767 - RNA, 22 nt, Human Herpes Virus 2
cgaugacgccccggaugacgug

SEQ ID NO: 2768 - RNA, 22 nt, Human Herpes Virus 2
uacgcggaggggcguuuucugu

SEQ ID NO: 2769 - RNA, 22 nt, Human Herpes Virus 2
ucgcgccugcccggcccagacu

SEQ ID NO: 2770 - RNA, 22 nt, Human Herpes Virus 2
ucugagccugggucaugcgcga

SEQ ID NO: 2771 - RNA, 22 nt, Human Herpes Virus 2
acauggcggcguuggcgucggc

SEQ ID NO: 2772 - RNA, 20 nt, Human Herpes Virus 2
gaugucggcaaagcgcaggu

SEQ ID NO: 2773 - RNA, 22 nt, Human Herpes Virus 2
aaggccgugguguugcggagcg

SEQ ID NO: 2774 - RNA, 22 nt, Human Herpes Virus 2
cgccgaggagcaccgcggccag

SEQ ID NO: 2775 - RNA, 22 nt, Human Herpes Virus 2
uaggcgccgucgagcucguggg

SEQ ID NO: 2776 - RNA, 22 nt, Human Herpes Virus 2
cgcgagcuguucggcggcgggg

SEQ ID NO: 2777 - RNA, 22 nt, Human Herpes Virus 2
gggugggcggcgguccgucggc

SEQ ID NO: 2778 - RNA, 22 nt, Human Herpes Virus 2
ccgccggucgucuccgccgcgg

SEQ ID NO: 2779 - RNA, 22 nt, Human Herpes Virus 2
ucgcgcaugacccaggcucaga

SEQ ID NO: 2780 - RNA, 22 nt, Human Herpes Virus 2
ucugggccgggcaggcgcgacc

SEQ ID NO: 2781 - RNA, 22 nt, Human Herpes Virus 2
acccguggucucgggagcaggg

SEQ ID NO: 2782 - RNA, 22 nt, Human Herpes Virus 2
gacgcccccgcgggccacgggg

SEQ ID NO: 2783 - RNA, 22 nt, Human Herpes Virus 2
gugcggggggggcagcgggguc

SEQ ID NO: 2784 - RNA, 22 nt, Human Herpes Virus 2
ccgauccgccauccccccccgc

SEQ ID NO: 2785 - RNA, 22 nt, Human Herpes Virus 2
gggcuuggccgccgaggugcgc

SEQ ID NO: 2786 - RNA, 22 nt, Human Herpes Virus 2
cccccgcaccucggcggccgcc

SEQ ID NO: 2787 - RNA, 22 nt, Human Herpes Virus 2
ggggggcggggucgccucgggc

SEQ ID NO: 2788 - RNA, 20 nt, Human Herpes Virus 2
uuuugguuuuccgcuuccgg

SEQ ID NO: 2789 - RNA, 22 nt, Human Herpes Virus 2
uucacgcgggugcuggugucuc

SEQ ID NO: 2790 - RNA, 22 nt, Human Herpes Virus 2
ggccgccgguagcaccccgugg

SEQ ID NO: 2791 - RNA, 22 nt, Human Herpes Virus 2
gggccggauaccgcgggggcgu

SEQ ID NO: 2792 - RNA, 22 nt, Human Herpes Virus 2
cagaagucccgcggcauugcca

SEQ ID NO: 2793 - RNA, 22 nt, Human Herpes Virus 2
uggagccgguucacgacgguca

SEQ ID NO: 2794 - RNA, 19 nt, Human Herpes Virus 2
accgucggggccgauucga

SEQ ID NO: 2795 - RNA, 22 nt, Human Herpes Virus 2
uccggggcuugugcccucguag

SEQ ID NO: 2796 - RNA, 22 nt, Human Herpes Virus 2
ucggucgcuccaagccccgcgg

SEQ ID NO: 2797 - RNA, 22 nt, Human Herpes Virus 2
ccgugccgcuggcguugcgccg

SEQ ID NO: 2798 - RNA, 22 nt, Human Herpes Virus 2
gugccacgucagcuggcaggug

SEQ ID NO: 2799 - RNA, 22 nt, Human Herpes Virus 2
ccgcccaccccgaacccggacc

SEQ ID NO: 2800 - RNA, 22 nt, Human Herpes Virus 2
gcccggguucggguggcacggu

SEQ ID NO: 2801 - RNA, 22 nt, Human Herpes Virus 2
gaaggcggcgggcgcgccgccg

SEQ ID NO: 2802 - RNA, 22 nt, Human Herpes Virus 2
cggcgcagcgcgcggccagcga

SEQ ID NO: 2803 - RNA, 22 nt, Human Herpes Virus 2
gaaucucgggucgccccaugca

SEQ ID NO: 2804 - RNA, 19 nt, Human Herpes Virus 2
gcugcguggggugggucgc

SEQ ID NO: 2805 - RNA, 22 nt, Human Herpes Virus 2
gcauccugacggugguguggac

SEQ ID NO: 2806 - RNA, 21 nt, Human Herpes Virus 2
uacaucaccgcaacgaucuac

SEQ ID NO: 2807 - RNA, 22 nt, Human Herpes Virus 2
guuacguaucgaaguuacgaag

SEQ ID NO: 2808 - RNA, 20 nt, Human Herpes Virus 2
cggggcuucguggguaguag

SEQ ID NO: 2809 - RNA, 22 nt, Human Herpes Virus 2
caucucauuagcgcccggcgcg

SEQ ID NO: 2810 - RNA, 22 nt, Human Herpes Virus 2
ccgcgaugcuaaugagacccuc

SEQ ID NO: 2811 - RNA, 22 nt, Human Herpes Virus 2
gggggggcucgggccaccugac

SEQ ID NO: 2812 - RNA, 22 nt, Human Herpes Virus 2
gucagagccccagaccccccgc

SEQ ID NO: 2813 - RNA, 22 nt, Human Herpes Virus 2
cccggucagcgccgcguucucg

SEQ ID NO: 2814 - RNA, 22 nt, Human Herpes Virus 2
guaggcgcggcgcaggcugguc

SEQ ID NO: 2815 - RNA, 22 nt, Human Herpes Virus 2
ucaccaccacgccccccaccgc

SEQ ID NO: 2816 - RNA, 18 nt, Human Herpes Virus 2
gguggcggcgguggucgg

SEQ ID NO: 2817 - RNA, 22 nt, Human Herpes Virus 2
uuuccacggcacucucggccca

SEQ ID NO: 2818 - RNA, 22 nt, Human Herpes Virus 2
gcugucgggaguggcuugguuu

SEQ ID NO: 2819 - RNA, 18 nt, Human immunodeficiency virus type 1
ggcaaaugguacaucagg

SEQ ID NO: 2820 - RNA, 18 nt, Human immunodeficiency virus type 1 (SE8131)
ccacugcuuaagccucaa

SEQ ID NO: 2821 - RNA, 19 nt, Human immunodeficiency virus type 1 (SE8131)
cccacugcuuaagccucaa

SEQ ID NO: 2822 - RNA, 22 nt, Human immunodeficiency virus type 1 (HIV1084i)
ugggucucucuagguagaccag

SEQ ID NO: 2823 - RNA, 22 nt, Human immunodeficiency virus type 1 (HIV1084i)
uggcuaucuagggaacccacug

SEQ ID NO: 2824 - RNA, 22 nt, Human immunodeficiency virus type 1 (HIV1084i)
ggaacccacugcuuaagccuca

SEQ ID NO: 2825 - RNA, 22 nt, Human immunodeficiency virus type 1 (HIV1084i)
agugcucuaaguagugugugcc

SEQ ID NO: 2826 - RNA, 22 nt, Human immunodeficiency virus type 1 (HIV1084i)
ggaacccacugcuuaagccuca

SEQ ID NO: 2827 - RNA, 22 nt, Human immunodeficiency virus type 1 (HIV1084i)
agugcucuaaguagugugugcc

SEQ ID NO: 2828 - RNA, 22 nt, Human immunodeficiency virus type 1 (HIV1084i)
ugggucucucuagguagaccag

SEQ ID NO: 2829 - RNA, 22 nt, Human immunodeficiency virus type 1 (HIV1084i)
uggcuaucuagggaacccacug

SEQ ID NO: 2830 - RNA, 22 nt, Human immunodeficiency virus type 1 (HIV1084i)
ggaugugggggaugcauauuuu

SEQ ID NO: 2831 - RNA, 18 nt, Human immunodeficiency virus type 1 (HIV1084i)
uacugcauucaccauacc

SEQ ID NO: 2832 - RNA, 17 nt, Human immunodeficiency virus type 1 (HIV1084i)
uuggauggugcuucaag

SEQ ID NO: 2833 - RNA, 17 nt, Human immunodeficiency virus type 1 (HIV1084i)
uuggauggugcuucaag

SEQ ID NO: 2834 - RNA, 18 nt, Human immunodeficiency virus type 1 (BLAI)
ggcaaaugguacaucagg

SEQ ID NO: 2835 - RNA, 18 nt, Human immunodeficiency virus type 1 (BLAI)
ggcaaaugguacaucagg

SEQ ID NO: 2836 - RNA, 22 nt, Human immunodeficiency virus type 1 (BLAI)
uuuuagggaagaucuggccuuc

SEQ ID NO: 2837 - RNA, 22 nt, Human immunodeficiency virus type 1 (BLAI)
aggccagggaauuuucuucaga

SEQ ID NO: 2838 - RNA, 22 nt, Human immunodeficiency virus type 1 (BLAI)
ggaacccacugcuuaagccuca

SEQ ID NO: 2839 - RNA, 22 nt, Human immunodeficiency virus type 1 (BLAI)
agugcuucaaguagugugugcc

SEQ ID NO: 2840 - RNA, 17 nt, Human immunodeficiency virus type 1 (BLAI)
cuaacuagggaacccac

SEQ ID NO: 2841 - RNA, 21 nt, Human immunodeficiency virus type 1 (BLAI)
cuggcuaacuagggaacccac

SEQ ID NO: 2842 - RNA, 20 nt, Human immunodeficiency virus type 1 (BLAI)
cugggucucucugguuagac

SEQ ID NO: 2843 - RNA, 18 nt, Human immunodeficiency virus type 1 (BLAI)
gcuaacuagggaacccac

SEQ ID NO: 2844 - RNA, 20 nt, Human immunodeficiency virus type 1 (BLAI)
gggucucucugguuagacca

SEQ ID NO: 2845 - RNA, 19 nt, Human immunodeficiency virus type 1 (BLAI)
ggucucucugguuagacca

SEQ ID NO: 2846 - RNA, 21 nt, Human immunodeficiency virus type 1 (BLAI)
gucucucugguuagaccagau

SEQ ID NO: 2847 - RNA, 17 nt, Human immunodeficiency virus type 1 (BLAI)
ucucugguuagaccaga

SEQ ID NO: 2848 - RNA, 17 nt, Human immunodeficiency virus type 1 (BLAI)
ucuggcuaacuagggaa

SEQ ID NO: 2849 - RNA, 17 nt, Human immunodeficiency virus type 1 (BLAI)
cuaacuagggaacccac

SEQ ID NO: 2850 - RNA, 21 nt, Human immunodeficiency virus type 1 (BLAI)
cuggcuaacuagggaacccac

SEQ ID NO: 2851 - RNA, 20 nt, Human immunodeficiency virus type 1 (BLAI)
cugggucucucugguuagac

SEQ ID NO: 2852 - RNA, 18 nt, Human immunodeficiency virus type 1 (BLAI)
gcuaacuagggaacccac

SEQ ID NO: 2853 - RNA, 20 nt, Human immunodeficiency virus type 1 (BLAI)
gggucucucugguuagacca

SEQ ID NO: 2854 - RNA, 19 nt, Human immunodeficiency virus type 1 (BLAI)
ggucucucugguuagacca

SEQ ID NO: 2855 - RNA, 21 nt, Human immunodeficiency virus type 1 (BLAI)
gucucucugguuagaccagau

SEQ ID NO: 2856 - RNA, 17 nt, Human immunodeficiency virus type 1 (BLAI)
ucucugguuagaccaga

SEQ ID NO: 2857 - RNA, 17 nt, Human immunodeficiency virus type 1 (BLAI)
ucuggcuaacuagggaa

SEQ ID NO: 2858 - RNA, 22 nt, Human immunodeficiency virus type 1 (BLAI)
ggauuuggcuccauggcuuagg

SEQ ID NO: 2859 - RNA, 18 nt, Human immunodeficiency virus type 1 (BLAI)
ugggcaggaguggaagcc

SEQ ID NO: 2860 - RNA, 18 nt, Human immunodeficiency virus type 1 (BLAI)
ggcaaaugguacaucagg

SEQ ID NO: 2861 - RNA, 22 nt, Human immunodeficiency virus type 1 (BLAI)
ucucucugguuagaccagauuu

SEQ ID NO: 2862 - RNA, 21 nt, Human immunodeficiency virus type 1 (BLAI)
ucucuggcuaacuagggaacc

SEQ ID NO: 2863 - RNA, 22 nt, Human immunodeficiency virus type 1 (BAL)
uauggcuucauggcuuagggca

SEQ ID NO: 2864 - RNA, 21 nt, Human immunodeficiency virus type 1 (BAL)
ugggcaggaguggaagccaua

SEQ ID NO: 2865 - RNA, 20 nt, Human immunodeficiency virus type 1 (BAL)
aaaauaacacaaucacacuc

SEQ ID NO: 2866 - RNA, 20 nt, Human immunodeficiency virus type 1 (BAL)
aaucacacucccaugcagaa

SEQ ID NO: 2867 - RNA, 19 nt, Human immunodeficiency virus type 1 (BAL)
acaaucacacucccaugca

SEQ ID NO: 2868 - RNA, 20 nt, Human immunodeficiency virus type 1 (BAL)
acacucccaugcagaauaaa

SEQ ID NO: 2869 - RNA, 19 nt, Human immunodeficiency virus type 1 (BAL)
aucacacucccaugcagaa

SEQ ID NO: 2870 - RNA, 17 nt, Human immunodeficiency virus type 1 (BAL)
cacacucccaugcagaa

SEQ ID NO: 2871 - RNA, 22 nt, Human immunodeficiency virus type 1 (BAL)
cucccaugcagaauaaaacaaa

SEQ ID NO: 2872 - RNA, 19 nt, Human immunodeficiency virus type 1 (BAL)
uaacacaaucacacuccca

SEQ ID NO: 2873 - RNA, 18 nt, Human immunodeficiency virus type 1 (BAL)
ucacacucccaugcagaa

SEQ ID NO: 2874 - RNA, 18 nt, Human immunodeficiency virus type 1 (BAL)
ucccaugcagaauaaaac

SEQ ID NO: 2875 - RNA, 18 nt, Human immunodeficiency virus type 1 (BAL)
uacacaccagggccaggg

SEQ ID NO: 2876 - RNA, 20 nt, Human immunodeficiency virus type 1 (BAL)
aaaauaacacaaucacacuc

SEQ ID NO: 2877 - RNA, 19 nt, Human immunodeficiency virus type 1 (BAL)
aaucacacucccaugcaga

SEQ ID NO: 2878 - RNA, 19 nt, Human immunodeficiency virus type 1 (BAL)
acaaucacacucccaugca

SEQ ID NO: 2879 - RNA, 18 nt, Human immunodeficiency virus type 1 (BAL)
aucacacucccaugcaga

SEQ ID NO: 2880 - RNA, 19 nt, Human immunodeficiency virus type 1 (BAL)
uaacacaaucacacuccca

SEQ ID NO: 2881 - RNA, 17 nt, Human immunodeficiency virus type 1 (BAL)
ucacacucccaugcaga

SEQ ID NO: 2882 - RNA, 22 nt, Human Herpes Virus 4 (Epstein Barr virus)
ucccggcguuaucaugguagaa

SEQ ID NO: 2883 - RNA, 22 nt, Human Herpes Virus 4 (Epstein Barr virus)
agccugaaugaugcucggguag

SEQ ID NO: 2884 - RNA, 22 nt, Human Herpes Virus 4 (Epstein Barr virus)
gccucugggguccaggagucug

SEQ ID NO: 2885 - RNA, 22 nt, Human Herpes Virus 4 (Epstein Barr virus)
auccugggccccccggaggggc

SEQ ID NO: 2886 - RNA, 22 nt, Human Herpes Virus 4 (Epstein Barr virus)
uggggguguggcuuugaugaca

SEQ ID NO: 2887 - RNA, 22 nt, Human Herpes Virus 4 (Epstein Barr virus)
uuguuagaccggcacauaccuu

SEQ ID NO: 2888 - RNA, 22 nt, Human Herpes Virus 4 (Epstein Barr virus)
uccgacgccucagaacggcggc

SEQ ID NO: 2889 - RNA, 22 nt, Human Herpes Virus 4 (Epstein Barr virus)
cgggccgcggauggggcugggg

SEQ ID NO: 2890 - RNA, 22 nt, Human Herpes Virus 4 (Epstein Barr virus)
agauuuccuggcuccgugacaa

SEQ ID NO: 2891 - RNA, 22 nt, Human Herpes Virus 4 (Epstein Barr virus)
ucacccugccggagaagauucu

SEQ ID NO: 2892 - RNA, 22 nt, Human Herpes Virus 4 (Epstein Barr virus)
acccuaauucaauagcauaugu

SEQ ID NO: 2893 - RNA, 22 nt, Human Herpes Virus 4 (Epstein Barr virus)
auaugcuaucgaauuaggguua

SEQ ID NO: 2894 - RNA, 22 nt, Human Herpes Virus 4 (Epstein Barr virus)
acccccuguuccagauucugac

SEQ ID NO: 2895 - RNA, 19 nt, Human Herpes Virus 4 (Epstein Barr virus)
gccuggaagcugggugggu

SEQ ID NO: 2896 - RNA, 22 nt, Human Herpes Virus 4 (Epstein Barr virus)
ucaccccccgcaggaccaccgg

SEQ ID NO: 2897 - RNA, 22 nt, Human Herpes Virus 4 (Epstein Barr virus)
ucgggucccaagcaggggauga

SEQ ID NO: 2898 - RNA, 22 nt, Human Herpes Virus 4 (Epstein Barr virus)
uguccccagcggggccagcgcg

SEQ ID NO: 2899 - RNA, 22 nt, Human Herpes Virus 4 (Epstein Barr virus)
ccuggcccucuuuguggacggg

SEQ ID NO: 2900 - RNA, 22 nt, Human Herpes Virus 4 (Epstein Barr virus)
uggguccgcugggccgcugccc

SEQ ID NO: 2901 - RNA, 22 nt, Human Herpes Virus 4 (Epstein Barr virus)
gguggccccgcugggcaccgcu

SEQ ID NO: 2902 - RNA, 22 nt, Human Herpes Virus 4 (Epstein Barr virus)
uggguccgcugggccgcugccc

SEQ ID NO: 2903 - RNA, 22 nt, Human Herpes Virus 4 (Epstein Barr virus)
gguggccccgcugggcaccgcu

SEQ ID NO: 2904 - RNA, 22 nt, Human Herpes Virus 4 (Epstein Barr virus)
uggcggguggagauagggacca

SEQ ID NO: 2905 - RNA, 22 nt, Human Herpes Virus 4 (Epstein Barr virus)
cuaacugugucccacuccaccu

SEQ ID NO: 2906 - RNA, 22 nt, Human Herpes Virus 4 (Epstein Barr virus)
uccaucagcucucuuuuccccg

SEQ ID NO: 2907 - RNA, 22 nt, Human Herpes Virus 4 (Epstein Barr virus)
cuggagcugaaguugauggaug

SEQ ID NO: 2908 - RNA, 22 nt, Human Herpes Virus 4 (Epstein Barr virus)
uggguccgcugggccgcugccc

SEQ ID NO: 2909 - RNA, 22 nt, Human Herpes Virus 4 (Epstein Barr virus)
gguggccccgcugggcaccgcu

SEQ ID NO: 2910 - RNA, 22 nt, Human Herpes Virus 4 (Epstein Barr virus)
ggcucuuaguugcugggccacc

SEQ ID NO: 2911 - RNA, 17 nt, Human Herpes Virus 4 (Epstein Barr virus)
uccgcaacuauggagcc

SEQ ID NO: 2912 - RNA, 22 nt, Human Herpes Virus 4 (Epstein Barr virus)
caucucaggagucucuauguca

SEQ ID NO: 2913 - RNA, 22 nt, Human Herpes Virus 4 (Epstein Barr virus)
auaguauuggcuccuggcggug

SEQ ID NO: 2914 - RNA, 22 nt, Human Herpes Virus 4 (Epstein Barr virus)
cggggucuauagauggaggaua

SEQ ID NO: 2915 - RNA, 22 nt, Human Herpes Virus 4 (Epstein Barr virus)
ucugggcuauuaugggacuccg

SEQ ID NO: 2916 - RNA, 22 nt, Human Herpes Virus 4 (Epstein Barr virus)
gggcccagcuccagcagcucuu

SEQ ID NO: 2917 - RNA, 22 nt, Human Herpes Virus 4 (Epstein Barr virus)
ggggcgcugcuggugugaggag

SEQ ID NO: 2918 - RNA, 22 nt, Human Herpes Virus 4 (Epstein Barr virus)
ggcccccugguggagaauauaa

SEQ ID NO: 2919 - RNA, 22 nt, Human Herpes Virus 4 (Epstein Barr virus)
auaaaaucaccacgguggucca

SEQ ID NO: 2920 - RNA, 22 nt, Human Herpes Virus 4 (Epstein Barr virus)
ucacggaccgcucauucccugc

SEQ ID NO: 2921 - RNA, 22 nt, Human Herpes Virus 4 (Epstein Barr virus)
uguaugugaugguucaguagag

SEQ ID NO: 2922 - RNA, 22 nt, Human Herpes Virus 4 (Epstein Barr virus)
ugacggccccuccgugccccua

SEQ ID NO: 2923 - RNA, 18 nt, Human Herpes Virus 4 (Epstein Barr virus)
gcacaggcggccgugcag

SEQ ID NO: 2924 - RNA, 22 nt, Human Herpes Virus 4 (Epstein Barr virus)
ggugucaccggugaugcgccug

SEQ ID NO: 2925 - RNA, 18 nt, Human Herpes Virus 4 (Epstein Barr virus)
uguugggcuggugacauc

SEQ ID NO: 2926 - RNA, 22 nt, Human Herpes Virus 4 (Epstein Barr virus)
gggccaccucuuugguucugua

SEQ ID NO: 2927 - RNA, 22 nt, Human Herpes Virus 4 (Epstein Barr virus)
uacauaaccauggaguuggcug

SEQ ID NO: 2928 - RNA, 22 nt, Human Herpes Virus 4 (Epstein Barr virus)
gccugggcggggcgguugccug

SEQ ID NO: 2929 - RNA, 22 nt, Human Herpes Virus 4 (Epstein Barr virus)
gcagguuagccuggccuggguc

SEQ ID NO: 2930 - RNA, 22 nt, Human Herpes Virus 4 (Epstein Barr virus)
uucccucaguguuugccagcuu

SEQ ID NO: 2931 - RNA, 18 nt, Human Herpes Virus 4 (Epstein Barr virus)
uguggacaccugagggag

SEQ ID NO: 2932 - RNA, 22 nt, Human Herpes Virus 4 (Epstein Barr virus)
ccccgggugggauccauggcug

SEQ ID NO: 2933 - RNA, 20 nt, Human Herpes Virus 4 (Epstein Barr virus)
gaggccggcccgcccggcgg

SEQ ID NO: 2934 - RNA, 22 nt, Human Herpes Virus 4 (Epstein Barr virus)
cccgccuccagcaccgggacuc

SEQ ID NO: 2935 - RNA, 22 nt, Human Herpes Virus 4 (Epstein Barr virus)
gcucgaguacgacugugaggug

SEQ ID NO: 2936 - RNA, 22 nt, Human Herpes Virus 4 (Epstein Barr virus)
gcgauguacccccggggaucgc

SEQ ID NO: 2937 - RNA, 20 nt, Human Herpes Virus 4 (Epstein Barr virus)
agcuccguggguaacauugu

SEQ ID NO: 2938 - RNA, 22 nt, Human Herpes Virus 4 (Epstein Barr virus)
ggacuggucagcggggacgggu

SEQ ID NO: 2939 - RNA, 21 nt, Human Herpes Virus 4 (Epstein Barr virus)
cggccuccuccgaccggcucc

SEQ ID NO: 2940 - RNA, 22 nt, Human Herpes Virus 4 (Epstein Barr virus)
uucuccagauucagacucuuua

SEQ ID NO: 2941 - RNA, 20 nt, Human Herpes Virus 4 (Epstein Barr virus)
gagguacaaaugcuggagag

SEQ ID NO: 2942 - RNA, 22 nt, Human Herpes Virus 4 (Epstein Barr virus)
ccaugcuaguacugcagugggc

SEQ ID NO: 2943 - RNA, 18 nt, Human Herpes Virus 4 (Epstein Barr virus)
ugcugcugcuggucaugg

SEQ ID NO: 2944 - RNA, 22 nt, Human Herpes Virus 4 (Epstein Barr virus)
uauggaggggcucuuggcauuc

SEQ ID NO: 2945 - RNA, 22 nt, Human Herpes Virus 4 (Epstein Barr virus)
cagggcgcacaucuccauaagg

SEQ ID NO: 2946 - RNA, 22 nt, Human Herpes Virus 4 (Epstein Barr virus)
uuaacagggggucucgcggggu

SEQ ID NO: 2947 - RNA, 17 nt, Human Herpes Virus 4 (Epstein Barr virus)
ccgcuuccccuuguuaa

SEQ ID NO: 2948 - RNA, 22 nt, Human Herpes Virus 4 (Epstein Barr virus)
uucacuagugaaggcaacuaac

SEQ ID NO: 2949 - RNA, 22 nt, Human Herpes Virus 4 (Epstein Barr virus)
uaguugugcccacugguguuua

SEQ ID NO: 2950 - RNA, 22 nt, Human Herpes Virus 4 (Epstein Barr virus)
gauugccggcugggggcugggg

SEQ ID NO: 2951 - RNA, 22 nt, Human Herpes Virus 4 (Epstein Barr virus)
cugcucccacccgguucccucc

SEQ ID NO: 2952 - RNA, 22 nt, Human Herpes Virus 4 (Epstein Barr virus)
cguguccaaccauuugauuaga

SEQ ID NO: 2953 - RNA, 22 nt, Human Herpes Virus 4 (Epstein Barr virus)
cgggaagugugggugggcugcg

SEQ ID NO: 2954 - RNA, 22 nt, Human Herpes Virus 4 (Epstein Barr virus)
gggucucagaacccaggaccag

SEQ ID NO: 2955 - RNA, 22 nt, Human Herpes Virus 4 (Epstein Barr virus)
uauagguccuggcugagauucu

SEQ ID NO: 2956 - RNA, 22 nt, Human Herpes Virus 4 (Epstein Barr virus)
ggauaagaaacacgcuggcuuu

SEQ ID NO: 2957 - RNA, 20 nt, Human Herpes Virus 4 (Epstein Barr virus)
agcgucauuucuuccaaucc

SEQ ID NO: 2958 - RNA, 22 nt, Human Herpes Virus 4 (Epstein Barr virus)
acgcgcgcccaaggcuuggguc

SEQ ID NO: 2959 - RNA, 21 nt, Human Herpes Virus 4 (Epstein Barr virus)
uccacauguucgguguguguu

SEQ ID NO: 2960 - RNA, 22 nt, Human Herpes Virus 4 (Epstein Barr virus)
gaaugugccggguggauaugcc

SEQ ID NO: 2961 - RNA, 20 nt, Human Herpes Virus 4 (Epstein Barr virus)
gcuauugacuggcgcgcuuc

SEQ ID NO: 2962 - RNA, 22 nt, Human Herpes Virus 4 (Epstein Barr virus)
cgagggcaccucuagcuucgug

SEQ ID NO: 2963 - RNA, 22 nt, Human Herpes Virus 4 (Epstein Barr virus)
auagagcucccggacgccuuca

SEQ ID NO: 2964 - RNA, 22 nt, Human Herpes Virus 4 (Epstein Barr virus)
cguggugcuguccugcugaagg

SEQ ID NO: 2965 - RNA, 22 nt, Human Herpes Virus 4 (Epstein Barr virus)
ucggucagacggccgcgcugcg

SEQ ID NO: 2966 - RNA, 22 nt, Human Herpes Virus 4 (Epstein Barr virus)
gagggggcucugugggcuggga

SEQ ID NO: 2967 - RNA, 22 nt, Human Herpes Virus 4 (Epstein Barr virus)
ucagcaguagugcuccccuuuu

SEQ ID NO: 2968 - RNA, 22 nt, Human Herpes Virus 4 (Epstein Barr virus)
gacucggccuuaaggcggugga

SEQ ID NO: 2969 - RNA, 20 nt, Human Herpes Virus 4 (Epstein Barr virus)
ucagccucggggucugaguu

SEQ ID NO: 2970 - RNA, 22 nt, Human Herpes Virus 4 (Epstein Barr virus)
ccuauagguuauuaaccuagug

SEQ ID NO: 2971 - RNA, 21 nt, Human Herpes Virus 4 (Epstein Barr virus)
gcuggguauauaccuauaggu

SEQ ID NO: 2972 - RNA, 22 nt, Human Herpes Virus 4 (Epstein Barr virus)
uggagcagaaggaacagaggua

SEQ ID NO: 2973 - RNA, 21 nt, Human Herpes Virus 4 (Epstein Barr virus)
ucugaggaccuguugcuucag

SEQ ID NO: 2974 - RNA, 22 nt, Human Herpes Virus 4 (Epstein Barr virus)
gcauucccaagcaaacaaaaca

SEQ ID NO: 2975 - RNA, 22 nt, Human Herpes Virus 4 (Epstein Barr virus)
ugucauguuugcggggaauguu

SEQ ID NO: 2976 - RNA, 22 nt, Human Herpes Virus 4 (Epstein Barr virus)
aaguggagggggaucgcccggg

SEQ ID NO: 2977 - RNA, 22 nt, Human Herpes Virus 4 (Epstein Barr virus)
cgggcgauccucugagacccuc

SEQ ID NO: 2978 - RNA, 22 nt, Human Herpes Virus 4 (Epstein Barr virus)
aaguggagggggaucgcccggg

SEQ ID NO: 2979 - RNA, 22 nt, Human Herpes Virus 4 (Epstein Barr virus)
cgggcgauccucugagacccuc

SEQ ID NO: 2980 - RNA, 22 nt, Human Herpes Virus 4 (Epstein Barr virus)
aaggguccgccgccgcccccac

SEQ ID NO: 2981 - RNA, 22 nt, Human Herpes Virus 4 (Epstein Barr virus)
gggcggcggcgggcguagaggg

SEQ ID NO: 2982 - RNA, 22 nt, Human Herpes Virus 4 (Epstein Barr virus)
gcugggacacgggacguggucg

SEQ ID NO: 2983 - RNA, 22 nt, Human Herpes Virus 4 (Epstein Barr virus)
gccaugucacgagacgcagccu

SEQ ID NO: 2984 - RNA, 22 nt, Human Herpes Virus 4 (Epstein Barr virus)
uuauuuucuccaaaucgcuccu

SEQ ID NO: 2985 - RNA, 20 nt, Human Herpes Virus 4 (Epstein Barr virus)
agggcgaaugcagaaaauag

SEQ ID NO: 2986 - RNA, 22 nt, Human Herpes Virus 4 (Epstein Barr virus)
uugaaggccucgguuauugcca

SEQ ID NO: 2987 - RNA, 22 nt, Human Herpes Virus 4 (Epstein Barr virus)
cagagggaucuagcccuucggg

SEQ ID NO: 2988 - RNA, 22 nt, Human Herpes Virus 4 (Epstein Barr virus)
ucguggcucucgaagcugguga

SEQ ID NO: 2989 - RNA, 20 nt, Human Herpes Virus 4 (Epstein Barr virus)
acaagcuucucggccauggc

SEQ ID NO: 2990 - RNA, 22 nt, Human Herpes Virus 4 (Epstein Barr virus)
ccacaaacagguuguaaaucuu

SEQ ID NO: 2991 - RNA, 22 nt, Human Herpes Virus 4 (Epstein Barr virus)
auaugccgccugucgguugaga

SEQ ID NO: 2992 - RNA, 22 nt, Human Herpes Virus 4 (Epstein Barr virus)
cccugggaugagcguuugggag

SEQ ID NO: 2993 - RNA, 18 nt, Human Herpes Virus 4 (Epstein Barr virus)
cagagaguagucucaggg

SEQ ID NO: 2994 - RNA, 22 nt, Human Herpes Virus 4 (Epstein Barr virus)
uuuggccagcccggggagacag

SEQ ID NO: 2995 - RNA, 21 nt, Human Herpes Virus 4 (Epstein Barr virus)
ucuccaacacgguggucaagu

SEQ ID NO: 2996 - RNA, 22 nt, Human Herpes Virus 4 (Epstein Barr virus)
ccucuggggccgcccgggcugc

SEQ ID NO: 2997 - RNA, 22 nt, Human Herpes Virus 4 (Epstein Barr virus)
cuggccugggacccggggaggc

SEQ ID NO: 2998 - RNA, 22 nt, Human Herpes Virus 4 (Epstein Barr virus)
ccucuggggccgcccgggcugc

SEQ ID NO: 2999 - RNA, 22 nt, Human Herpes Virus 4 (Epstein Barr virus)
cuggccugggacccggggaggc

SEQ ID NO: 3000 - RNA, 22 nt, Human Herpes Virus 4 (Epstein Barr virus)
ccucuggggccgcccgggcugc

SEQ ID NO: 3001 - RNA, 22 nt, Human Herpes Virus 4 (Epstein Barr virus)
cuggccugggacccggggaggc

SEQ ID NO: 3002 - RNA, 22 nt, Human Herpes Virus 4 (Epstein Barr virus)
ccucuggggccgcccgggcugc

SEQ ID NO: 3003 - RNA, 22 nt, Human Herpes Virus 4 (Epstein Barr virus)
cuggccugggacccggggaggc

SEQ ID NO: 3004 - RNA, 22 nt, Human Herpes Virus 4 (Epstein Barr virus)
uggcuggacggaggacgauagc

SEQ ID NO: 3005 - RNA, 22 nt, Human Herpes Virus 4 (Epstein Barr virus)
caccuguccuugucugcugcca

SEQ ID NO: 3006 - RNA, 22 nt, Human Herpes Virus 4 (Epstein Barr virus)
cggagccucaggaggguccccu

SEQ ID NO: 3007 - RNA, 22 nt, Human Herpes Virus 4 (Epstein Barr virus)
agggggaggauugggcuccgcc

SEQ ID NO: 3008 - RNA, 22 nt, Human Herpes Virus 4 (Epstein Barr virus)
ucaccguuccucauuuugugug

SEQ ID NO: 3009 - RNA, 22 nt, Human Herpes Virus 4 (Epstein Barr virus)
cacaggggagguggcugaauua

SEQ ID NO: 3010 - RNA, 22 nt, Human Herpes Virus 4 (Epstein Barr virus)
uccaagcggcacagauuagaag

SEQ ID NO: 3011 - RNA, 22 nt, Human Herpes Virus 4 (Epstein Barr virus)
ucuacaucaugccugguucggu

SEQ ID NO: 3012 - RNA, 22 nt, Human Herpes Virus 4 (Epstein Barr virus)
caccggugaagacacaagggcc

SEQ ID NO: 3013 - RNA, 19 nt, Human Herpes Virus 4 (Epstein Barr virus)
ggcuguugugguacuggug

SEQ ID NO: 3014 - RNA, 22 nt, Human Herpes Virus 4 (Epstein Barr virus)
cggucagagucguacgugaggu

SEQ ID NO: 3015 - RNA, 21 nt, Human Herpes Virus 4 (Epstein Barr virus)
ggccuggccggggcugaccgc

SEQ ID NO: 3016 - RNA, 22 nt, Human Herpes Virus 4 (Epstein Barr virus)
uggaaggcccucaucgcaguac

SEQ ID NO: 3017 - RNA, 22 nt, Human Herpes Virus 4 (Epstein Barr virus)
ugccccgauggcuaggccgucc

SEQ ID NO: 3018 - RNA, 22 nt, Human Herpes Virus 4 (Epstein Barr virus)
ugggacacgacaacggccguaa

SEQ ID NO: 3019 - RNA, 22 nt, Human Herpes Virus 4 (Epstein Barr virus)
guagguguuguuguauuccagc

SEQ ID NO: 3020 - RNA, 22 nt, Human Herpes Virus 4 (Epstein Barr virus)
uggcuagacguauggccuaccc

SEQ ID NO: 3021 - RNA, 22 nt, Human Herpes Virus 4 (Epstein Barr virus)
ggguaggccaugauucuuccag

SEQ ID NO: 3022 - RNA, 22 nt, Human Herpes Virus 4 (Epstein Barr virus)
uggaguaugcuucgucgggggg

SEQ ID NO: 3023 - RNA, 22 nt, Human Herpes Virus 4 (Epstein Barr virus)
ccccgccgaugcgcgccucuau

SEQ ID NO: 3024 - RNA, 22 nt, Human Herpes Virus 4 (Epstein Barr virus)
ggguuugcccaacucuuauucu

SEQ ID NO: 3025 - RNA, 22 nt, Human Herpes Virus 4 (Epstein Barr virus)
aaugauggugggggaaccaccg

SEQ ID NO: 3026 - RNA, 22 nt, Human Herpes Virus 4 (Epstein Barr virus)
cgggcgcagccaugcgugaccg

SEQ ID NO: 3027 - RNA, 18 nt, Human Herpes Virus 4 (Epstein Barr virus)
ucgcagggggugugucug

SEQ ID NO: 3028 - RNA, 22 nt, Human Herpes Virus 4 (Epstein Barr virus)
aaggagcgauuuggagaaaaua

SEQ ID NO: 3029 - RNA, 19 nt, Human Herpes Virus 4 (Epstein Barr virus)
uauuuucugcauucgcccu

SEQ ID NO: 3030 - RNA, 22 nt, Human Herpes Virus 4 (Epstein Barr virus)
uauuuucugcauucgcccuugc

SEQ ID NO: 3031 - RNA, 22 nt, Human Herpes Virus 4 (Epstein Barr virus)
aaggagcgauuuggagaaaaua

SEQ ID NO: 3032 - RNA, 19 nt, Human Herpes Virus 4 (Epstein Barr virus)
uauuuucugcauucgcccu

SEQ ID NO: 3033 - RNA, 22 nt, Human Herpes Virus 4 (Epstein Barr virus)
uauuuucugcauucgcccuugc

SEQ ID NO: 3034 - RNA, 22 nt, Human Herpes Virus 4 (Epstein Barr virus)
ucuaaugcguagcagccacucu

SEQ ID NO: 3035 - RNA, 21 nt, Human Herpes Virus 4 (Epstein Barr virus)
aagguggcuggugauuggagg

SEQ ID NO: 3036 - RNA, 22 nt, Human Herpes Virus 4 (Epstein Barr virus)
cgugucggcccgcugugcccgc

SEQ ID NO: 3037 - RNA, 22 nt, Human Herpes Virus 4 (Epstein Barr virus)
gggaggcagauguuggccagau

SEQ ID NO: 3038 - RNA, 22 nt, Human Herpes Virus 4 (Epstein Barr virus)
ccggaggugccccggccggcug

SEQ ID NO: 3039 - RNA, 22 nt, Human Herpes Virus 4 (Epstein Barr virus)
gcccguccggcgcccucucgga

SEQ ID NO: 3040 - RNA, 22 nt, Human Herpes Virus 4 (Epstein Barr virus)
gaggugaagguagccguggagg

SEQ ID NO: 3041 - RNA, 20 nt, Human Herpes Virus 4 (Epstein Barr virus)
ucugcgguggccauugccuc

SEQ ID NO: 3042 - RNA, 22 nt, Human Herpes Virus 4 (Epstein Barr virus)
uacggguaguagcacugguggu

SEQ ID NO: 3043 - RNA, 18 nt, Human Herpes Virus 4 (Epstein Barr virus)
uugcuagucacacccgug

SEQ ID NO: 3044 - RNA, 22 nt, Human Herpes Virus 4 (Epstein Barr virus)
aaguggagggggaucgcccggg

SEQ ID NO: 3045 - RNA, 22 nt, Human Herpes Virus 4 (Epstein Barr virus)
cgggcgauccucugagacccuc

SEQ ID NO: 3046 - RNA, 22 nt, Human Herpes Virus 4 (Epstein Barr virus)
aaguggagggggaucgcccggg

SEQ ID NO: 3047 - RNA, 22 nt, Human Herpes Virus 4 (Epstein Barr virus)
cgggcgauccucugagacccuc

SEQ ID NO: 3048 - RNA, 22 nt, Human Herpes Virus 4 (Epstein Barr virus)
ccugucacuucccaagcccugg

SEQ ID NO: 3049 - RNA, 20 nt, Human Herpes Virus 4 (Epstein Barr virus)
cguugggaaaaaugacaagg

SEQ ID NO: 3050 - RNA, 22 nt, Human Herpes Virus 4 (Epstein Barr virus)
aggugaacagcggcccaccggu

SEQ ID NO: 3051 - RNA, 17 nt, Human Herpes Virus 4 (Epstein Barr virus)
ggcagcuauauucaccu

SEQ ID NO: 3052 - RNA, 22 nt, Human Herpes Virus 4 (Epstein Barr virus)
aggccagccggagggaccccgg

SEQ ID NO: 3053 - RNA, 21 nt, Human Herpes Virus 4 (Epstein Barr virus)
gccuucccucuccccuggccu

SEQ ID NO: 3054 - RNA, 22 nt, Human Herpes Virus 4 (Epstein Barr virus)
uaaccugaucagccccggaguu

SEQ ID NO: 3055 - RNA, 21 nt, Human Herpes Virus 4 (Epstein Barr virus)
ccccgggccugaagagguuga

SEQ ID NO: 3056 - RNA, 22 nt, Human Herpes Virus 4 (Epstein Barr virus)
ucuuccaugcucaugucaacag

SEQ ID NO: 3057 - RNA, 22 nt, Human Herpes Virus 4 (Epstein Barr virus)
ucugacuuugcguggagcugac

SEQ ID NO: 3058 - RNA, 22 nt, Human Herpes Virus 4 (Epstein Barr virus)
uggcuugggcugugguaaccgg

SEQ ID NO: 3059 - RNA, 22 nt, Human Herpes Virus 4 (Epstein Barr virus)
agcggggccgcaguuugcuaga

SEQ ID NO: 3060 - RNA, 22 nt, Human Herpes Virus 4 (Epstein Barr virus)
cgccaguagguagcagccggcu

SEQ ID NO: 3061 - RNA, 21 nt, Human Herpes Virus 4 (Epstein Barr virus)
ccgugugcaugccuuuggugg

SEQ ID NO: 3062 - RNA, 22 nt, Human Herpes Virus 4 (Epstein Barr virus)
gaguccgucaucggggucgggg

SEQ ID NO: 3063 - RNA, 20 nt, Human Herpes Virus 4 (Epstein Barr virus)
cgggggcuccaugcggauuu

SEQ ID NO: 3064 - RNA, 22 nt, Human Herpes Virus 4 (Epstein Barr virus)
ugggaccugaugcugcuggugu

SEQ ID NO: 3065 - RNA, 22 nt, Human Herpes Virus 4 (Epstein Barr virus)
cuagcacaucacguaggcacca

SEQ ID NO: 3066 - RNA, 22 nt, Human Herpes Virus 4 (Epstein Barr virus)
acgaggaggaagagacuucaca

SEQ ID NO: 3067 - RNA, 22 nt, Human Herpes Virus 4 (Epstein Barr virus)
uggggucucaggccucccaguc

SEQ ID NO: 3068 - RNA, 22 nt, Human Herpes Virus 4 (Epstein Barr virus)
ccuuaucuggcacgggugcugg

SEQ ID NO: 3069 - RNA, 22 nt, Human Herpes Virus 4 (Epstein Barr virus)
cugcuccugauguuucugaggu

SEQ ID NO: 3070 - RNA, 22 nt, Human Herpes Virus 4 (Epstein Barr virus)
uuuuccgggcugcgaguaauug

SEQ ID NO: 3071 - RNA, 22 nt, Human Herpes Virus 4 (Epstein Barr virus)
ugguucggaggauggggaauuu

SEQ ID NO: 3072 - RNA, 22 nt, Human Herpes Virus 4 (Epstein Barr virus)
uuguggaccucucagaguuuca

SEQ ID NO: 3073 - RNA, 22 nt, Human Herpes Virus 4 (Epstein Barr virus)
augcuggacggagauuuacaug

SEQ ID NO: 3074 - RNA, 22 nt, Human Herpes Virus 4 (Epstein Barr virus)
gcgugcaccuggaagaugcagc

SEQ ID NO: 3075 - RNA, 21 nt, Human Herpes Virus 4 (Epstein Barr virus)
uacaucuuuacagggcgcagc

SEQ ID NO: 3076 - RNA, 22 nt, Human Herpes Virus 4 (Epstein Barr virus)
ggggauccgggccacucggguc

SEQ ID NO: 3077 - RNA, 22 nt, Human Herpes Virus 4 (Epstein Barr virus)
cuugagggcccaaagaggcccc

SEQ ID NO: 3078 - RNA, 22 nt, Human Herpes Virus 4 (Epstein Barr virus)
ucggugggaggcauaggcccca

SEQ ID NO: 3079 - RNA, 22 nt, Human Herpes Virus 4 (Epstein Barr virus)
ugggugccugugucaccgcuga

SEQ ID NO: 3080 - RNA, 22 nt, Human Herpes Virus 4 (Epstein Barr virus)
uccagggggcagccgcggccca

SEQ ID NO: 3081 - RNA, 22 nt, Human Herpes Virus 4 (Epstein Barr virus)
gaccgcggccgagccaccaggg

SEQ ID NO: 3082 - RNA, 22 nt, Human Herpes Virus 4 (Epstein Barr virus)
uggguccgcugggccgcugccc

SEQ ID NO: 3083 - RNA, 22 nt, Human Herpes Virus 4 (Epstein Barr virus)
gguggccccgcugggcaccgcu

SEQ ID NO: 3084 - RNA, 22 nt, Human Herpes Virus 4 (Epstein Barr virus)
uggguccgcugggccgcugccc

SEQ ID NO: 3085 - RNA, 22 nt, Human Herpes Virus 4 (Epstein Barr virus)
gguggccccgcugggcaccgcu

SEQ ID NO: 3086 - RNA, 22 nt, Human Herpes Virus 4 (Epstein Barr virus)
uggguccgcugggccgcugccc

SEQ ID NO: 3087 - RNA, 22 nt, Human Herpes Virus 4 (Epstein Barr virus)
gguggccccgcugggcaccgcu

SEQ ID NO: 3088 - RNA, 22 nt, Human Herpes Virus 4 (Epstein Barr virus)
uggguccgcugggccgcugccc

SEQ ID NO: 3089 - RNA, 22 nt, Human Herpes Virus 4 (Epstein Barr virus)
gguggccccgcugggcaccgcu

SEQ ID NO: 3090 - RNA, 22 nt, Human Herpes Virus 4 (Epstein Barr virus)
gccauccgugggacuaaucaua

SEQ ID NO: 3091 - RNA, 19 nt, Human Herpes Virus 4 (Epstein Barr virus)
ugcguccccgcagaugagc

SEQ ID NO: 3092 - RNA, 22 nt, Human Herpes Virus 4 (Epstein Barr virus)
ucggugcaacggggcaggggga

SEQ ID NO: 3093 - RNA, 22 nt, Human Herpes Virus 4 (Epstein Barr virus)
cucucugcccuguuugcccggg

SEQ ID NO: 3094 - RNA, 22 nt, Human Herpes Virus 4 (Epstein Barr virus)
uguacauccagcugcuguaugc

SEQ ID NO: 3095 - RNA, 22 nt, Human Herpes Virus 4 (Epstein Barr virus)
auccggcggccaggguuugcag

SEQ ID NO: 3096 - RNA, 22 nt, Human Herpes Virus 4 (Epstein Barr virus)
ugcugcagcuauggggucccua

SEQ ID NO: 3097 - RNA, 19 nt, Human Herpes Virus 4 (Epstein Barr virus)
gucccccuagccccggcgg

SEQ ID NO: 3098 - RNA, 22 nt, Human Herpes Virus 4 (Epstein Barr virus)
uggccugccuggaucugagcua

SEQ ID NO: 3099 - RNA, 22 nt, Human Herpes Virus 4 (Epstein Barr virus)
ugguuuggggcaggcccccagc

SEQ ID NO: 3100 - RNA, 22 nt, Human Herpes Virus 4 (Epstein Barr virus)
ccgggccguggaaugagggccu

SEQ ID NO: 3101 - RNA, 20 nt, Human Herpes Virus 4 (Epstein Barr virus)
gcgccccauccgaagcccgg

SEQ ID NO: 3102 - RNA, 22 nt, Human Herpes Virus 4 (Epstein Barr virus)
uggcggucgccggggguggcag

SEQ ID NO: 3103 - RNA, 22 nt, Human Herpes Virus 4 (Epstein Barr virus)
gcuggucuggguggcggccgcc

SEQ ID NO: 3104 - RNA, 22 nt, Human Herpes Virus 4 (Epstein Barr virus)
ggccuugucugccucgggucuc

SEQ ID NO: 3105 - RNA, 19 nt, Human Herpes Virus 4 (Epstein Barr virus)
caggguccaggagaaggcu

SEQ ID NO: 3106 - RNA, 22 nt, Human Herpes Virus 4 (Epstein Barr virus)
gaccugaugcugcuggugugcu

SEQ ID NO: 3107 - RNA, 22 nt, Human Herpes Virus 4 (Epstein Barr virus)
gaccugaugcugcuggugugcu

SEQ ID NO: 3108 - RNA, 22 nt, Human Herpes Virus 4 (Epstein Barr virus)
ugauucaggcaggagucuucug

SEQ ID NO: 3109 - RNA, 22 nt, Human Herpes Virus 4 (Epstein Barr virus)
gaggcuuuaauguuggacucag

SEQ ID NO: 3110 - RNA, 22 nt, Human Herpes Virus 4 (Epstein Barr virus)
ugccugaccaagugcuccuugc

SEQ ID NO: 3111 - RNA, 22 nt, Human Herpes Virus 4 (Epstein Barr virus)
ugacaggaugcuugugaggcau

SEQ ID NO: 3112 - RNA, 22 nt, Human Herpes Virus 4 (Epstein Barr virus)
ugguggaggaggaccugguggu

SEQ ID NO: 3113 - RNA, 22 nt, Human Herpes Virus 4 (Epstein Barr virus)
acccguggagguuccuguuccg

SEQ ID NO: 3114 - RNA, 22 nt, Human Herpes Virus 4 (Epstein Barr virus)
ccugauugcugagaaccugcug

SEQ ID NO: 3115 - RNA, 15 nt, Human Herpes Virus 4 (Epstein Barr virus)
ggccucagcgucagg

SEQ ID NO: 3116 - RNA, 22 nt, Human Herpes Virus 4 (Epstein Barr virus)
cccugguccgucuccccuccuc

SEQ ID NO: 3117 - RNA, 21 nt, Human Herpes Virus 4 (Epstein Barr virus)
gccggucggaggaggccgggg

SEQ ID NO: 3118 - RNA, 22 nt, Human Herpes Virus 4 (Epstein Barr virus)
ugcccccacguacugcaggaug

SEQ ID NO: 3119 - RNA, 22 nt, Human Herpes Virus 4 (Epstein Barr virus)
cucugacaugggcgggggugcc

SEQ ID NO: 3120 - RNA, 22 nt, Human Herpes Virus 4 (Epstein Barr virus)
cccggucccuccggggggcaga

SEQ ID NO: 3121 - RNA, 22 nt, Human Herpes Virus 4 (Epstein Barr virus)
uggccccgaggaggcgcccgga

SEQ ID NO: 3122 - RNA, 22 nt, Human Herpes Virus 4 (Epstein Barr virus)
cccggucccuccggggggcaga

SEQ ID NO: 3123 - RNA, 22 nt, Human Herpes Virus 4 (Epstein Barr virus)
uggccccgaggaggcgcccgga

SEQ ID NO: 3124 - RNA, 22 nt, Human Herpes Virus 4 (Epstein Barr virus)
ucggauuggaagaaaugacgcu

SEQ ID NO: 3125 - RNA, 22 nt, Human Herpes Virus 4 (Epstein Barr virus)
agcguguuucuuauccccaggc

SEQ ID NO: 3126 - RNA, 22 nt, Human Herpes Virus 4 (Epstein Barr virus)
ucuaucugugcccugggucguc

SEQ ID NO: 3127 - RNA, 22 nt, Human Herpes Virus 4 (Epstein Barr virus)
cagucuacgguacagaccuugc

SEQ ID NO: 3128 - RNA, 22 nt, Human Herpes Virus 4 (Epstein Barr virus)
cacuuagccgcuucagcugggc

SEQ ID NO: 3129 - RNA, 19 nt, Human Herpes Virus 4 (Epstein Barr virus)
gcccaugggcggccaggug

SEQ ID NO: 3130 - RNA, 22 nt, Human Herpes Virus 4 (Epstein Barr virus)
cccgcaguuguagacugucauu

SEQ ID NO: 3131 - RNA, 21 nt, Human Herpes Virus 4 (Epstein Barr virus)
ugggcgguccacacgcgcggg

SEQ ID NO: 3132 - RNA, 22 nt, Human Herpes Virus 4 (Epstein Barr virus)
cacccgcccaucaccaccggac

SEQ ID NO: 3133 - RNA, 22 nt, Human Herpes Virus 4 (Epstein Barr virus)
uccugugguguuuggugugguu

SEQ ID NO: 3134 - RNA, 22 nt, Human Herpes Virus 4 (Epstein Barr virus)
uccaggucagaccuacgccauu

SEQ ID NO: 3135 - RNA, 22 nt, Human Herpes Virus 4 (Epstein Barr virus)
uccaguggcaugggaccgggag

SEQ ID NO: 3136 - RNA, 22 nt, Human Herpes Virus 4 (Epstein Barr virus)
ggccagauuuguuguaggagca

SEQ ID NO: 3137 - RNA, 22 nt, Human Herpes Virus 4 (Epstein Barr virus)
cccugaccgcgcgucgaggccc

SEQ ID NO: 3138 - RNA, 22 nt, Human Herpes Virus 4 (Epstein Barr virus)
ucaacagguggucgugggaugg

SEQ ID NO: 3139 - RNA, 22 nt, Human Herpes Virus 4 (Epstein Barr virus)
gggucucgccgcuaguuggucc

SEQ ID NO: 3140 - RNA, 22 nt, Human Herpes Virus 4 (Epstein Barr virus)
gguucacguccagcuucuccau

SEQ ID NO: 3141 - RNA, 18 nt, Human Herpes Virus 4 (Epstein Barr virus)
agggcugggcccggggcu

SEQ ID NO: 3142 - RNA, 22 nt, Human Herpes Virus 4 (Epstein Barr virus)
ggcccagaugucccucuaucau

SEQ ID NO: 3143 - RNA, 18 nt, Human Herpes Virus 4 (Epstein Barr virus)
acgguggggggcaggguc

SEQ ID NO: 3144 - RNA, 22 nt, Human Herpes Virus 4 (Epstein Barr virus)
gacggcgggggagguuuccuca

SEQ ID NO: 3145 - RNA, 22 nt, Human Herpes Virus 4 (Epstein Barr virus)
aggaucccaugcccccgcgguu

SEQ ID NO: 3146 - RNA, 22 nt, Human Herpes Virus 4 (Epstein Barr virus)
cgccugcccuccgccaucaggc

SEQ ID NO: 3147 - RNA, 22 nt, Human Herpes Virus 4 (Epstein Barr virus)
cccuggcagagagguggcagcg

SEQ ID NO: 3148 - RNA, 22 nt, Human Herpes Virus 4 (Epstein Barr virus)
uaacgggaaguguguaagcaca

SEQ ID NO: 3149 - RNA, 22 nt, Human Herpes Virus 4 (Epstein Barr virus)
ugcuucacgcucuucguuaaaa

SEQ ID NO: 3150 - RNA, 22 nt, Human Herpes Virus 4 (Epstein Barr virus)
uggaagaaucauggccuacccg

SEQ ID NO: 3151 - RNA, 22 nt, Human Herpes Virus 4 (Epstein Barr virus)
uggguaggccauacgucuagcc

SEQ ID NO: 3152 - RNA, 22 nt, Human Herpes Virus 4 (Epstein Barr virus)
caaugggguaguagguuuuggg

SEQ ID NO: 3153 - RNA, 22 nt, Human Herpes Virus 4 (Epstein Barr virus)
ucaacugccacagaccccauuu

SEQ ID NO: 3154 - RNA, 22 nt, Human Herpes Virus 4 (Epstein Barr virus)
gcccgcggccauugggcccaga

SEQ ID NO: 3155 - RNA, 22 nt, Human Herpes Virus 4 (Epstein Barr virus)
uccaggggcccgagguuggagc

SEQ ID NO: 3156 - RNA, 22 nt, Human Herpes Virus 4 (Epstein Barr virus)
ggggucccuccggccggccuga

SEQ ID NO: 3157 - RNA, 22 nt, Human Herpes Virus 4 (Epstein Barr virus)
gcaagcugagggggcucgggug

SEQ ID NO: 3158 - RNA, 22 nt, Human Herpes Virus 4 (Epstein Barr virus)
ggggucccuccggccggccuga

SEQ ID NO: 3159 - RNA, 22 nt, Human Herpes Virus 4 (Epstein Barr virus)
gcaagcugagggggcucgggug

SEQ ID NO: 3160 - RNA, 22 nt, Human Herpes Virus 4 (Epstein Barr virus)
ggggucccuccggccggccuga

SEQ ID NO: 3161 - RNA, 22 nt, Human Herpes Virus 4 (Epstein Barr virus)
gcaagcugagggggcucgggug

SEQ ID NO: 3162 - RNA, 22 nt, Human Herpes Virus 4 (Epstein Barr virus)
ugggugugguggaguguugggc

SEQ ID NO: 3163 - RNA, 22 nt, Human Herpes Virus 4 (Epstein Barr virus)
uccacuuaccucuggcccgaua

SEQ ID NO: 3164 - RNA, 22 nt, Human Herpes Virus 4 (Epstein Barr virus)
ucgaggauacgggcgccagagu

SEQ ID NO: 3165 - RNA, 19 nt, Human Herpes Virus 4 (Epstein Barr virus)
ccuggcgucacgcacucgg

SEQ ID NO: 3166 - RNA, 22 nt, Human Herpes Virus 4 (Epstein Barr virus)
gcuccggcucguggaguccgca

SEQ ID NO: 3167 - RNA, 19 nt, Human Herpes Virus 4 (Epstein Barr virus)
cggaaccaggagaaggggu

SEQ ID NO: 3168 - RNA, 22 nt, Human Herpes Virus 4 (Epstein Barr virus)
uggagguauccuaagcuccgcc

SEQ ID NO: 3169 - RNA, 20 nt, Human Herpes Virus 4 (Epstein Barr virus)
uggagcuagguaggauucag

SEQ ID NO: 3170 - RNA, 22 nt, Human Herpes Virus 4 (Epstein Barr virus)
gccgcugaccuaggacugaccu

SEQ ID NO: 3171 - RNA, 19 nt, Human Herpes Virus 4 (Epstein Barr virus)
ucauccugggcuuuguggc

SEQ ID NO: 3172 - RNA, 22 nt, Human Herpes Virus 4 (Epstein Barr virus)
agccaacuccaugguuauguac

SEQ ID NO: 3173 - RNA, 22 nt, Human Herpes Virus 4 (Epstein Barr virus)
uacagaaccaaagagguggccc

SEQ ID NO: 3174 - RNA, 22 nt, Human Herpes Virus 4 (Epstein Barr virus)
ucucugacuaggcucugauuuu

SEQ ID NO: 3175 - RNA, 22 nt, Human Herpes Virus 4 (Epstein Barr virus)
aucuagagucgaguuccaguuu

SEQ ID NO: 3176 - RNA, 22 nt, Human Herpes Virus 4 (Epstein Barr virus)
uggugacaggagggucgaccuc

SEQ ID NO: 3177 - RNA, 22 nt, Human Herpes Virus 4 (Epstein Barr virus)
gaucccccuccucucuauccac

SEQ ID NO: 3178 - RNA, 22 nt, Human Herpes Virus 4 (Epstein Barr virus)
aaguggagggggaucgcccggg

SEQ ID NO: 3179 - RNA, 22 nt, Human Herpes Virus 4 (Epstein Barr virus)
cgggcgauccucugagacccuc

SEQ ID NO: 3180 - RNA, 22 nt, Human Herpes Virus 4 (Epstein Barr virus)
uacgaccccauagauugugaca

SEQ ID NO: 3181 - RNA, 22 nt, Human Herpes Virus 4 (Epstein Barr virus)
uacaaucuaggaaaccguaauc

SEQ ID NO: 3182 - RNA, 22 nt, Human Herpes Virus 4 (Epstein Barr virus)
uccguggaguaguggcgggggg

SEQ ID NO: 3183 - RNA, 22 nt, Human Herpes Virus 4 (Epstein Barr virus)
uccuucaccgcuaccaccgccu

SEQ ID NO: 3184 - RNA, 22 nt, Human Herpes Virus 4 (Epstein Barr virus)
cguagucugucuugaggagaug

SEQ ID NO: 3185 - RNA, 21 nt, Human Herpes Virus 4 (Epstein Barr virus)
ugcaaaaccucaggaccuacg

SEQ ID NO: 3186 - RNA, 22 nt, Human Herpes Virus 4 (Epstein Barr virus)
gcggugucggccagcgguggcg

SEQ ID NO: 3187 - RNA, 22 nt, Human Herpes Virus 4 (Epstein Barr virus)
ucgugguuggcgggugucgcag

SEQ ID NO: 3188 - RNA, 20 nt, Human Herpes Virus 4 (Epstein Barr virus)
cgcaccacuagucaccaggu

SEQ ID NO: 3189 - RNA, 22 nt, Human Herpes Virus 4 (Epstein Barr virus)
cgcaccacuagucaccaggugu

SEQ ID NO: 3190 - RNA, 20 nt, Human Herpes Virus 4 (Epstein Barr virus)
cgcaccacuagucaccaggu

SEQ ID NO: 3191 - RNA, 22 nt, Human Herpes Virus 4 (Epstein Barr virus)
cgcaccacuagucaccaggugu

SEQ ID NO: 3192 - RNA, 20 nt, Human Herpes Virus 4 (Epstein Barr virus)
cgcaccacuagucaccaggu

SEQ ID NO: 3193 - RNA, 22 nt, Human Herpes Virus 4 (Epstein Barr virus)
cgcaccacuagucaccaggugu

SEQ ID NO: 3194 - RNA, 22 nt, Human Herpes Virus 4 (Epstein Barr virus)
gccaauuuucuucgcacguccu

SEQ ID NO: 3195 - RNA, 18 nt, Human Herpes Virus 4 (Epstein Barr virus)
gggccuggaagucuuggc

SEQ ID NO: 3196 - RNA, 22 nt, Human Herpes Virus 4 (Epstein Barr virus)
uggaagucuuggcggcguuggu

SEQ ID NO: 3197 - RNA, 22 nt, Human Herpes Virus 4 (Epstein Barr virus)
cagcgaucccugagaacgcucc

SEQ ID NO: 3198 - RNA, 22 nt, Human Herpes Virus 4 (Epstein Barr virus)
uccggccugggagcgcaccccc

SEQ ID NO: 3199 - RNA, 22 nt, Human Herpes Virus 4 (Epstein Barr virus)
gggcagcggacccagcggaccc

SEQ ID NO: 3200 - RNA, 22 nt, Human Herpes Virus 4 (Epstein Barr virus)
aggucuggcaggucgcaggugg

SEQ ID NO: 3201 - RNA, 22 nt, Human Herpes Virus 4 (Epstein Barr virus)
ccuuggccuccuuggccgugag

SEQ ID NO: 3202 - RNA, 22 nt, Human Herpes Virus 4 (Epstein Barr virus)
uaucgacggcugcggcggcgga

SEQ ID NO: 3203 - RNA, 22 nt, Human Herpes Virus 4 (Epstein Barr virus)
ccgaagucgcggcccggaggcu

SEQ ID NO: 3204 - RNA, 22 nt, Human Herpes Virus 4 (Epstein Barr virus)
agcuguuuggcucggcugugga

SEQ ID NO: 3205 - RNA, 22 nt, Human Herpes Virus 4 (Epstein Barr virus)
uacaagcggccacaaggggguu

SEQ ID NO: 3206 - RNA, 22 nt, Human Herpes Virus 4 (Epstein Barr virus)
uggaaacucuccggguagccgg

SEQ ID NO: 3207 - RNA, 17 nt, Human Herpes Virus 4 (Epstein Barr virus)
ugcccaggggagcccag

SEQ ID NO: 3208 - RNA, 22 nt, Human Herpes Virus 4 (Epstein Barr virus)
caccuggugacuaguggugcgc

SEQ ID NO: 3209 - RNA, 22 nt, Human Herpes Virus 4 (Epstein Barr virus)
cacaacacuaacacuagguucc

SEQ ID NO: 3210 - RNA, 22 nt, Human Herpes Virus 4 (Epstein Barr virus)
uagagcucgucgaugaucucca

SEQ ID NO: 3211 - RNA, 22 nt, Human Herpes Virus 4 (Epstein Barr virus)
gacaucugucacgaguuccacc

SEQ ID NO: 3212 - RNA, 22 nt, Human Herpes Virus 4 (Epstein Barr virus)
uaguaggguccagucucaggcc

SEQ ID NO: 3213 - RNA, 22 nt, Human Herpes Virus 4 (Epstein Barr virus)
ucuuagaaugguggccgggcug

SEQ ID NO: 3214 - RNA, 22 nt, Human Herpes Virus 4 (Epstein Barr virus)
agggggcucuacucgggagucu

SEQ ID NO: 3215 - RNA, 22 nt, Human Herpes Virus 4 (Epstein Barr virus)
guccugagagacaugcaccagg

SEQ ID NO: 3216 - RNA, 22 nt, Human Herpes Virus 4 (Epstein Barr virus)
acuggguggugucugcagcaaa

SEQ ID NO: 3217 - RNA, 22 nt, Human Herpes Virus 4 (Epstein Barr virus)
uugcaugccaccucccugccug

SEQ ID NO: 3218 - RNA, 22 nt, Human Herpes Virus 4 (Epstein Barr virus)
uggaguuacugggugggagaca

SEQ ID NO: 3219 - RNA, 18 nt, Human Herpes Virus 4 (Epstein Barr virus)
cccccgcugguaugccag

SEQ ID NO: 3220 - RNA, 22 nt, Human Herpes Virus 4 (Epstein Barr virus)
gguaugccauucccugagcugc

SEQ ID NO: 3221 - RNA, 22 nt, Human Herpes Virus 4 (Epstein Barr virus)
gguucugggacuugcgccgacc

SEQ ID NO: 3222 - RNA, 22 nt, Human Herpes Virus 4 (Epstein Barr virus)
uacgggacccaugaaguguuac

SEQ ID NO: 3223 - RNA, 22 nt, Human Herpes Virus 4 (Epstein Barr virus)
uuuccaauucaggguccaguac

SEQ ID NO: 3224 - RNA, 22 nt, Human Herpes Virus 4 (Epstein Barr virus)
ggccccccggcagcuggccccg

SEQ ID NO: 3225 - RNA, 22 nt, Human Herpes Virus 4 (Epstein Barr virus)
gggccggucggcugggcuggcc

SEQ ID NO: 3226 - RNA, 22 nt, Human Herpes Virus 4 (Epstein Barr virus)
gggccauaguggcggcaguaug

SEQ ID NO: 3227 - RNA, 18 nt, Human Herpes Virus 4 (Epstein Barr virus)
cuggcgugaauugugccc

SEQ ID NO: 3228 - RNA, 22 nt, Human Herpes Virus 4 (Epstein Barr virus)
uccuggcccugggcaacagcuu

SEQ ID NO: 3229 - RNA, 22 nt, Human Herpes Virus 4 (Epstein Barr virus)
gacauggugcugggagccguga

SEQ ID NO: 3230 - RNA, 22 nt, Human Herpes Virus 4 (Epstein Barr virus)
ugguccacaaagggggcccugu

SEQ ID NO: 3231 - RNA, 22 nt, Human Herpes Virus 4 (Epstein Barr virus)
gguccuccugguuguaaucaaa

SEQ ID NO: 3232 - RNA, 22 nt, Human Herpes Virus 4 (Epstein Barr virus)
uccgggcuaucgugacgggucu

SEQ ID NO: 3233 - RNA, 22 nt, Human Herpes Virus 4 (Epstein Barr virus)
gauucgugcggauguccagagu

SEQ ID NO: 3234 - RNA, 22 nt, Human Herpes Virus 4 (Epstein Barr virus)
uggguccgcugggccgcugccc

SEQ ID NO: 3235 - RNA, 22 nt, Human Herpes Virus 4 (Epstein Barr virus)
gguggccccgcugggcaccgcu

SEQ ID NO: 3236 - RNA, 22 nt, Human Herpes Virus 4 (Epstein Barr virus)
uggguccgcugggccgcugccc

SEQ ID NO: 3237 - RNA, 22 nt, Human Herpes Virus 4 (Epstein Barr virus)
gguggccccgcugggcaccgcu

SEQ ID NO: 3238 - RNA, 22 nt, Human Herpes Virus 4 (Epstein Barr virus)
acgccgcucguggaccacgcca

SEQ ID NO: 3239 - RNA, 22 nt, Human Herpes Virus 4 (Epstein Barr virus)
uuguguggcugacggugccgug

SEQ ID NO: 3240 - RNA, 22 nt, Human Herpes Virus 4 (Epstein Barr virus)
gagcuccggccguguggccgag

SEQ ID NO: 3241 - RNA, 22 nt, Human Herpes Virus 4 (Epstein Barr virus)
ucgagccuggcuuuggagcucu

SEQ ID NO: 3242 - RNA, 22 nt, Human Herpes Virus 4 (Epstein Barr virus)
uaaggggacaccaggcauacaa

SEQ ID NO: 3243 - RNA, 22 nt, Human Herpes Virus 4 (Epstein Barr virus)
uguaugccugcguccucuuagg

SEQ ID NO: 3244 - RNA, 22 nt, Human Herpes Virus 4 (Epstein Barr virus)
acccagcccuccucggcccugu

SEQ ID NO: 3245 - RNA, 22 nt, Human Herpes Virus 4 (Epstein Barr virus)
gcacggacccggaggcugcguc

SEQ ID NO: 3246 - RNA, 22 nt, Human Herpes Virus 4 (Epstein Barr virus)
cggcccccgggaagucccuggg

SEQ ID NO: 3247 - RNA, 19 nt, Human Herpes Virus 4 (Epstein Barr virus)
ccuacgacucccugcgccg

SEQ ID NO: 3248 - RNA, 22 nt, Human Herpes Virus 4 (Epstein Barr virus)
gagggaaacaugaccaccugaa

SEQ ID NO: 3249 - RNA, 22 nt, Human Herpes Virus 4 (Epstein Barr virus)
ucagugguuuuguuuccuugau

SEQ ID NO: 3250 - RNA, 22 nt, Human Herpes Virus 4 (Epstein Barr virus)
gcggccgucgugggcaguaguc

SEQ ID NO: 3251 - RNA, 22 nt, Human Herpes Virus 4 (Epstein Barr virus)
uauuguccgcgaaugugccggg

SEQ ID NO: 3252 - RNA, 22 nt, Human Herpes Virus 4 (Epstein Barr virus)
uggugugggcccagagggggug

SEQ ID NO: 3253 - RNA, 22 nt, Human Herpes Virus 4 (Epstein Barr virus)
ucccugagggccggcaccagga

SEQ ID NO: 3254 - RNA, 22 nt, Human Herpes Virus 4 (Epstein Barr virus)
uggccggcugcagccggguccg

SEQ ID NO: 3255 - RNA, 22 nt, Human Herpes Virus 4 (Epstein Barr virus)
agcucggggggcggccgggugg

SEQ ID NO: 3256 - RNA, 22 nt, Human Herpes Virus 4 (Epstein Barr virus)
uggccggcugcagccggguccg

SEQ ID NO: 3257 - RNA, 22 nt, Human Herpes Virus 4 (Epstein Barr virus)
agcucggggggcggccgggugg

SEQ ID NO: 3258 - RNA, 22 nt, Human Herpes Virus 4 (Epstein Barr virus)
uggccggcugcagccggguccg

SEQ ID NO: 3259 - RNA, 22 nt, Human Herpes Virus 4 (Epstein Barr virus)
agcucggggggcggccgggugg

SEQ ID NO: 3260 - RNA, 22 nt, Human Herpes Virus 4 (Epstein Barr virus)
uggccggcugcagccggguccg

SEQ ID NO: 3261 - RNA, 22 nt, Human Herpes Virus 4 (Epstein Barr virus)
agcucggggggcggccgggugg

SEQ ID NO: 3262 - RNA, 22 nt, Human Herpes Virus 4 (Epstein Barr virus)
uggccggcugcagccggguccg

SEQ ID NO: 3263 - RNA, 22 nt, Human Herpes Virus 4 (Epstein Barr virus)
agcucggggggcggccgggugg

SEQ ID NO: 3264 - RNA, 22 nt, Human Herpes Virus 4 (Epstein Barr virus)
gcgcgggcgcagccaugcguga

SEQ ID NO: 3265 - RNA, 22 nt, Human Herpes Virus 4 (Epstein Barr virus)
ucgcagggggugugucuggugg

SEQ ID NO: 3266 - RNA, 22 nt, Human Herpes Virus 4 (Epstein Barr virus)
gcgcgggcgcagccaugcguga

SEQ ID NO: 3267 - RNA, 22 nt, Human Herpes Virus 4 (Epstein Barr virus)
ucgcagggggugugucuggugg

SEQ ID NO: 3268 - RNA, 22 nt, Human Herpes Virus 4 (Epstein Barr virus)
guggccgggacuguuucguugg

SEQ ID NO: 3269 - RNA, 22 nt, Human Herpes Virus 4 (Epstein Barr virus)
uuggcugaaccaccggccaugg

SEQ ID NO: 3270 - RNA, 22 nt, Human Herpes Virus 4 (Epstein Barr virus)
ccgaggggcagggaggcagcuc

SEQ ID NO: 3271 - RNA, 20 nt, Human Herpes Virus 4 (Epstein Barr virus)
cugcaauaccugcuuguugg

SEQ ID NO: 3272 - RNA, 22 nt, Human Herpes Virus 4 (Epstein Barr virus)
gcgggccguacuuugguugugg

SEQ ID NO: 3273 - RNA, 22 nt, Human Herpes Virus 4 (Epstein Barr virus)
cggccagagggcggcucgggua

SEQ ID NO: 3274 - RNA, 22 nt, Human Herpes Virus 4 (Epstein Barr virus)
ucgugugauaaugagugucuug

SEQ ID NO: 3275 - RNA, 22 nt, Human Herpes Virus 4 (Epstein Barr virus)
gagacaguaaugucaaaugucc

SEQ ID NO: 3276 - RNA, 22 nt, Human Herpes Virus 4 (Epstein Barr virus)
uuagauagagugggugugugcu

SEQ ID NO: 3277 - RNA, 22 nt, Human Herpes Virus 4 (Epstein Barr virus)
gaucaccacccucuauccauau

SEQ ID NO: 3278 - RNA, 22 nt, Human Herpes Virus 4 (Epstein Barr virus)
uuccauggcacauuuagagaua

SEQ ID NO: 3279 - RNA, 22 nt, Human Herpes Virus 4 (Epstein Barr virus)
ucuugcucaugugcagaggagg

SEQ ID NO: 3280 - RNA, 22 nt, Human Herpes Virus 4 (Epstein Barr virus)
ccacgucccggggacggaagcu

SEQ ID NO: 3281 - RNA, 21 nt, Human Herpes Virus 4 (Epstein Barr virus)
gucuucaauuuuggggagugg

SEQ ID NO: 3282 - RNA, 22 nt, Human Herpes Virus 4 (Epstein Barr virus)
ugggggaggucuuuggcuccuc

SEQ ID NO: 3283 - RNA, 21 nt, Human Herpes Virus 4 (Epstein Barr virus)
gcagaccgaggcuuuugccca

SEQ ID NO: 3284 - RNA, 22 nt, Human Herpes Virus 4 (Epstein Barr virus)
gagcggagaccaggagggcgcc

SEQ ID NO: 3285 - RNA, 21 nt, Human Herpes Virus 4 (Epstein Barr virus)
gugcccgaggucccugguucc

SEQ ID NO: 3286 - RNA, 22 nt, Human Herpes Virus 4 (Epstein Barr virus)
ucucguugagcccggccgagag

SEQ ID NO: 3287 - RNA, 20 nt, Human Herpes Virus 4 (Epstein Barr virus)
cucgauggcggcuggagaga

SEQ ID NO: 3288 - RNA, 22 nt, Human Herpes Virus 4 (Epstein Barr virus)
gccagaguggaguuuuccaccc

SEQ ID NO: 3289 - RNA, 22 nt, Human Herpes Virus 4 (Epstein Barr virus)
gcguggagcagcacaccgucug

SEQ ID NO: 3290 - RNA, 22 nt, Human Herpes Virus 4 (Epstein Barr virus)
gguggagccuagagguagguau

SEQ ID NO: 3291 - RNA, 22 nt, Human Herpes Virus 4 (Epstein Barr virus)
ggagguauccuaagcuccgccc

SEQ ID NO: 3292 - RNA, 22 nt, Human Herpes Virus 4 (Epstein Barr virus)
agcugccccugaccaguuagga

SEQ ID NO: 3293 - RNA, 22 nt, Human Herpes Virus 4 (Epstein Barr virus)
cuuuaacggcgcggugcaguug

SEQ ID NO: 3294 - RNA, 22 nt, Human Herpes Virus 4 (Epstein Barr virus)
ggucuggaccaggcccgguggg

SEQ ID NO: 3295 - RNA, 22 nt, Human Herpes Virus 4 (Epstein Barr virus)
uaucguaccugggaucgaauga

SEQ ID NO: 3296 - RNA, 22 nt, Human Herpes Virus 4 (Epstein Barr virus)
ugggucuguggaggccgguggu

SEQ ID NO: 3297 - RNA, 17 nt, Human Herpes Virus 4 (Epstein Barr virus)
ggcuuuuguagguccgg

SEQ ID NO: 3298 - RNA, 22 nt, Human Herpes Virus 4 (Epstein Barr virus)
uggggccuauguuuucacauaa

SEQ ID NO: 3299 - RNA, 22 nt, Human Herpes Virus 4 (Epstein Barr virus)
ugggaugugaagggaggugccc

SEQ ID NO: 3300 - RNA, 22 nt, Human Herpes Virus 4 (Epstein Barr virus)
ucagacaguuuggugcgcuagu

SEQ ID NO: 3301 - RNA, 22 nt, Human Herpes Virus 4 (Epstein Barr virus)
cgcacaccaggcugacugccuu

SEQ ID NO: 3302 - RNA, 22 nt, Human Herpes Virus 4 (Epstein Barr virus)
uacuggacccugaauuggaaac

SEQ ID NO: 3303 - RNA, 22 nt, Human Herpes Virus 4 (Epstein Barr virus)
uaacacuucaugggucccguag

SEQ ID NO: 3304 - RNA, 22 nt, Human Herpes Virus 4 (Epstein Barr virus)
cccucuauaggcaccuggggcg

SEQ ID NO: 3305 - RNA, 22 nt, Human Herpes Virus 4 (Epstein Barr virus)
gagccgggguggguguaggggu

SEQ ID NO: 3306 - RNA, 22 nt, Human Herpes Virus 4 (Epstein Barr virus)
cagagucagcgccugccccucc

SEQ ID NO: 3307 - RNA, 22 nt, Human Herpes Virus 4 (Epstein Barr virus)
aggcucugcacgccuggcuccc

SEQ ID NO: 3308 - RNA, 22 nt, Human Herpes Virus 4 (Epstein Barr virus)
gcaccgcuauccacuaugucuc

SEQ ID NO: 3309 - RNA, 22 nt, Human Herpes Virus 4 (Epstein Barr virus)
uagcaccgcuauccacuauguc

SEQ ID NO: 3310 - RNA, 23 nt, Human Herpes Virus 4 (Epstein Barr virus)
uagcaccgcuauccacuaugucu

SEQ ID NO: 3311 - RNA, 20 nt, Human Herpes Virus 4 (Epstein Barr virus)
ucuuaguggaagugacgugc

SEQ ID NO: 3312 - RNA, 21 nt, Human Herpes Virus 4 (Epstein Barr virus)
ucuuaguggaagugacgugcu

SEQ ID NO: 3313 - RNA, 23 nt, Human Herpes Virus 4 (Epstein Barr virus)
ucuuaguggaagugacgugcugu

SEQ ID NO: 3314 - RNA, 22 nt, Human Herpes Virus 4 (Epstein Barr virus)
gcaccgcuauccacuaugucuc

SEQ ID NO: 3315 - RNA, 22 nt, Human Herpes Virus 4 (Epstein Barr virus)
uagcaccgcuauccacuauguc

SEQ ID NO: 3316 - RNA, 23 nt, Human Herpes Virus 4 (Epstein Barr virus)
uagcaccgcuauccacuaugucu

SEQ ID NO: 3317 - RNA, 20 nt, Human Herpes Virus 4 (Epstein Barr virus)
ucuuaguggaagugacgugc

SEQ ID NO: 3318 - RNA, 21 nt, Human Herpes Virus 4 (Epstein Barr virus)
ucuuaguggaagugacgugcu

SEQ ID NO: 3319 - RNA, 23 nt, Human Herpes Virus 4 (Epstein Barr virus)
ucuuaguggaagugacgugcugu

SEQ ID NO: 3320 - RNA, 22 nt, Human Herpes Virus 4 (Epstein Barr virus)
gguacccuacgcugccgauuua

SEQ ID NO: 3321 - RNA, 22 nt, Human Herpes Virus 4 (Epstein Barr virus)
aaugcugcaguaguagggaucu

SEQ ID NO: 3322 - RNA, 22 nt, Human Herpes Virus 4 (Epstein Barr virus)
aaguggagggggaucgcccggg

SEQ ID NO: 3323 - RNA, 22 nt, Human Herpes Virus 4 (Epstein Barr virus)
cgggcgauccucugagacccuc

SEQ ID NO: 3324 - RNA, 22 nt, Human Herpes Virus 4 (Epstein Barr virus)
aaguggagggggaucgcccggg

SEQ ID NO: 3325 - RNA, 22 nt, Human Herpes Virus 4 (Epstein Barr virus)
cgggcgauccucugagacccuc

SEQ ID NO: 3326 - RNA, 22 nt, Human Herpes Virus 4 (Epstein Barr virus)
gcgguauauggugugaugucgu

SEQ ID NO: 3327 - RNA, 21 nt, Human Herpes Virus 4 (Epstein Barr virus)
uggcggcacauugucuuccgu

SEQ ID NO: 3328 - RNA, 22 nt, Human Herpes Virus 4 (Epstein Barr virus)
uaacgaagagcgugaagcaccg

SEQ ID NO: 3329 - RNA, 22 nt, Human Herpes Virus 4 (Epstein Barr virus)
gugugcuuacacacuucccguu

SEQ ID NO: 3330 - RNA, 22 nt, Human Herpes Virus 4 (Epstein Barr virus)
uuuauucaaguuuuggccacgu

SEQ ID NO: 3331 - RNA, 22 nt, Human Herpes Virus 4 (Epstein Barr virus)
acaccauagucuggaugaaguu

SEQ ID NO: 3332 - RNA, 19 nt, Human Herpes Virus 4 (Epstein Barr virus)
uauuuucugcauucgcccu

SEQ ID NO: 3333 - RNA, 22 nt, Human Herpes Virus 4 (Epstein Barr virus)
uauuuucugcauucgcccuugc

SEQ ID NO: 3334 - RNA, 22 nt, Human Herpes Virus 4 (Epstein Barr virus)
ugucccucguaggucuuggugu

SEQ ID NO: 3335 - RNA, 20 nt, Human Herpes Virus 4 (Epstein Barr virus)
caccagggggcgcgaguagc

SEQ ID NO: 3336 - RNA, 22 nt, Human Herpes Virus 4 (Epstein Barr virus)
caggccagccggagggaccccg

SEQ ID NO: 3337 - RNA, 22 nt, Human Herpes Virus 4 (Epstein Barr virus)
gccuucccucuccccuggccuc

SEQ ID NO: 3338 - RNA, 22 nt, Human Herpes Virus 4 (Epstein Barr virus)
caggccagccggagggaccccg

SEQ ID NO: 3339 - RNA, 22 nt, Human Herpes Virus 4 (Epstein Barr virus)
gccuucccucuccccuggccuc

SEQ ID NO: 3340 - RNA, 22 nt, Human Herpes Virus 4 (Epstein Barr virus)
caggccagccggagggaccccg

SEQ ID NO: 3341 - RNA, 22 nt, Human Herpes Virus 4 (Epstein Barr virus)
gccuucccucuccccuggccuc

SEQ ID NO: 3342 - RNA, 22 nt, Human Herpes Virus 4 (Epstein Barr virus)
caggccagccggagggaccccg

SEQ ID NO: 3343 - RNA, 22 nt, Human Herpes Virus 4 (Epstein Barr virus)
gccuucccucuccccuggccuc

SEQ ID NO: 3344 - RNA, 22 nt, Human Herpes Virus 4 (Epstein Barr virus)
caggccagccggagggaccccg

SEQ ID NO: 3345 - RNA, 22 nt, Human Herpes Virus 4 (Epstein Barr virus)
gccuucccucuccccuggccuc

SEQ ID NO: 3346 - RNA, 22 nt, Human Herpes Virus 4 (Epstein Barr virus)
caggccagccggagggaccccg

SEQ ID NO: 3347 - RNA, 22 nt, Human Herpes Virus 4 (Epstein Barr virus)
gccuucccucuccccuggccuc

SEQ ID NO: 3348 - RNA, 22 nt, Human Herpes Virus 4 (Epstein Barr virus)
gugcuagacccuggaguugaac

SEQ ID NO: 3349 - RNA, 22 nt, Human Herpes Virus 4 (Epstein Barr virus)
uacaaagucauggucuaguagu

SEQ ID NO: 3350 - RNA, 22 nt, Human Herpes Virus 4 (Epstein Barr virus)
ucauuuagaaaccuugccuacg

SEQ ID NO: 3351 - RNA, 20 nt, Human Herpes Virus 4 (Epstein Barr virus)
ugggcaaggagcuguuuggc

SEQ ID NO: 3352 - RNA, 22 nt, Human Herpes Virus 4 (Epstein Barr virus)
gcggucuacauacacgcgcguc

SEQ ID NO: 3353 - RNA, 22 nt, Human Herpes Virus 4 (Epstein Barr virus)
accgcguuguagcacugguaga

SEQ ID NO: 3354 - RNA, 22 nt, Human Herpes Virus 4 (Epstein Barr virus)
uucugcuucugccuggccuccg

SEQ ID NO: 3355 - RNA, 22 nt, Human Herpes Virus 4 (Epstein Barr virus)
gcgagcugaacagccagaggcc

SEQ ID NO: 3356 - RNA, 22 nt, Human Herpes Virus 4 (Epstein Barr virus)
aggucuccccugacgcuguggc

SEQ ID NO: 3357 - RNA, 21 nt, Human Herpes Virus 4 (Epstein Barr virus)
agagcccagaggaggccccgg

SEQ ID NO: 3358 - RNA, 22 nt, Human Herpes Virus 4 (Epstein Barr virus)
gcgcuagucguggucaaggucg

SEQ ID NO: 3359 - RNA, 22 nt, Human Herpes Virus 4 (Epstein Barr virus)
aggacccgaugccgacggugau

SEQ ID NO: 3360 - RNA, 22 nt, Human Herpes Virus 4 (Epstein Barr virus)
uuguaggcgggguuaagcgugc

SEQ ID NO: 3361 - RNA, 22 nt, Human Herpes Virus 4 (Epstein Barr virus)
cguuaagccccguuuaggugga

SEQ ID NO: 3362 - RNA, 22 nt, Human Herpes Virus 4 (Epstein Barr virus)
cggagaccaggagggcgccugg

SEQ ID NO: 3363 - RNA, 16 nt, Human Herpes Virus 4 (Epstein Barr virus)
gugcccgaggucccug

SEQ ID NO: 3364 - RNA, 22 nt, Human Herpes Virus 4 (Epstein Barr virus)
cggagaccaggagggcgccugg

SEQ ID NO: 3365 - RNA, 16 nt, Human Herpes Virus 4 (Epstein Barr virus)
gugcccgaggucccug

SEQ ID NO: 3366 - RNA, 22 nt, Human Herpes Virus 4 (Epstein Barr virus)
uaagaggacgcaggcauacaag

SEQ ID NO: 3367 - RNA, 22 nt, Human Herpes Virus 4 (Epstein Barr virus)
uguaugccugguguccccuuag

SEQ ID NO: 3368 - RNA, 22 nt, Human Herpes Virus 4 (Epstein Barr virus)
gggauccgggccacucgggucu

SEQ ID NO: 3369 - RNA, 22 nt, Human Herpes Virus 4 (Epstein Barr virus)
acuugagggcccaaagaggccc

SEQ ID NO: 3370 - RNA, 22 nt, Human Herpes Virus 4 (Epstein Barr virus)
gggauccgggccacucgggucu

SEQ ID NO: 3371 - RNA, 22 nt, Human Herpes Virus 4 (Epstein Barr virus)
acuugagggcccaaagaggccc

SEQ ID NO: 3372 - RNA, 22 nt, Human Herpes Virus 4 (Epstein Barr virus)
ugcgaauugcgcuggccuggaa

SEQ ID NO: 3373 - RNA, 22 nt, Human Herpes Virus 4 (Epstein Barr virus)
uauaggucaggccuugcaaaua

SEQ ID NO: 3374 - RNA, 22 nt, Human Herpes Virus 4 (Epstein Barr virus)
cgaauaucuggaggucuucucu

SEQ ID NO: 3375 - RNA, 22 nt, Human Herpes Virus 4 (Epstein Barr virus)
ggaauucuuccagaugcaccgg

SEQ ID NO: 3376 - RNA, 22 nt, Human Herpes Virus 4 (Epstein Barr virus)
uggucacugccgugagcuacgg

SEQ ID NO: 3377 - RNA, 22 nt, Human Herpes Virus 4 (Epstein Barr virus)
guuugagcauuucauggcuagg

SEQ ID NO: 3378 - RNA, 22 nt, Human Herpes Virus 4 (Epstein Barr virus)
ggggggcagcggggccgcguag

SEQ ID NO: 3379 - RNA, 22 nt, Human Herpes Virus 4 (Epstein Barr virus)
ucggcgguuuguuguccagguu

SEQ ID NO: 3380 - RNA, 22 nt, Human Herpes Virus 4 (Epstein Barr virus)
cagaugcucuugccuagauaca

SEQ ID NO: 3381 - RNA, 22 nt, Human Herpes Virus 4 (Epstein Barr virus)
ugaggggagguggggugucugc

SEQ ID NO: 3382 - RNA, 22 nt, Human Herpes Virus 4 (Epstein Barr virus)
cgagguccucgauguagauggc

SEQ ID NO: 3383 - RNA, 22 nt, Human Herpes Virus 4 (Epstein Barr virus)
uagagcucgucgaugaucucca

SEQ ID NO: 3384 - RNA, 22 nt, Human Herpes Virus 4 (Epstein Barr virus)
uggguccgcugggccgcugccc

SEQ ID NO: 3385 - RNA, 22 nt, Human Herpes Virus 4 (Epstein Barr virus)
gguggccccgcugggcaccgcu

SEQ ID NO: 3386 - RNA, 22 nt, Human Herpes Virus 4 (Epstein Barr virus)
uggguccgcugggccgcugccc

SEQ ID NO: 3387 - RNA, 22 nt, Human Herpes Virus 4 (Epstein Barr virus)
gguggccccgcugggcaccgcu

SEQ ID NO: 3388 - RNA, 22 nt, Human Herpes Virus 4 (Epstein Barr virus)
ccgcaggggugguggaugugcg

SEQ ID NO: 3389 - RNA, 22 nt, Human Herpes Virus 4 (Epstein Barr virus)
ugcuucuaccaagacucccuga

SEQ ID NO: 3390 - RNA, 22 nt, Human Herpes Virus 4 (Epstein Barr virus)
uggauagaggguggugaucuug

SEQ ID NO: 3391 - RNA, 22 nt, Human Herpes Virus 4 (Epstein Barr virus)
gagcacacacccacucuaucua

SEQ ID NO: 3392 - RNA, 22 nt, Human Herpes Virus 4 (Epstein Barr virus)
gcccuaucugagcccaaguggg

SEQ ID NO: 3393 - RNA, 22 nt, Human Herpes Virus 4 (Epstein Barr virus)
cacuugaggugucugaugggga

SEQ ID NO: 3394 - RNA, 22 nt, Human Herpes Virus 4 (Epstein Barr virus)
uggcggcuggagagaaggaugc

SEQ ID NO: 3395 - RNA, 22 nt, Human Herpes Virus 4 (Epstein Barr virus)
gccuccaucucugccgccaucc

SEQ ID NO: 3396 - RNA, 22 nt, Human Herpes Virus 4 (Epstein Barr virus)
augagguuagcguggacaguuu

SEQ ID NO: 3397 - RNA, 22 nt, Human Herpes Virus 4 (Epstein Barr virus)
uuguuccaggucagaccuacgc

SEQ ID NO: 3398 - RNA, 22 nt, Human Herpes Virus 4 (Epstein Barr virus)
acgcagccuccggguccgugca

SEQ ID NO: 3399 - RNA, 22 nt, Human Herpes Virus 4 (Epstein Barr virus)
ggacagggccgaggagggcugg

SEQ ID NO: 3400 - RNA, 22 nt, Human Herpes Virus 4 (Epstein Barr virus)
uccuccaacagaugacuugccu

SEQ ID NO: 3401 - RNA, 22 nt, Human Herpes Virus 4 (Epstein Barr virus)
ggccgggucaaguggcuggggc

SEQ ID NO: 3402 - RNA, 22 nt, Human Herpes Virus 4 (Epstein Barr virus)
cgcgggccaccguccggggaag

SEQ ID NO: 3403 - RNA, 22 nt, Human Herpes Virus 4 (Epstein Barr virus)
ucuccccaauagugccucgcuu

SEQ ID NO: 3404 - RNA, 22 nt, Human Herpes Virus 4 (Epstein Barr virus)
ugacggggccccuccgaugccu

SEQ ID NO: 3405 - RNA, 22 nt, Human Herpes Virus 4 (Epstein Barr virus)
gcggucggacugcgcccccuca

SEQ ID NO: 3406 - RNA, 22 nt, Human Herpes Virus 4 (Epstein Barr virus)
cgggccgccuguguggucuccu

SEQ ID NO: 3407 - RNA, 22 nt, Human Herpes Virus 4 (Epstein Barr virus)
gagguugccgaggggcucaucu

SEQ ID NO: 3408 - RNA, 22 nt, Human Herpes Virus 4 (Epstein Barr virus)
uuucgugaguccaccuucgagu

SEQ ID NO: 3409 - RNA, 22 nt, Human Herpes Virus 4 (Epstein Barr virus)
ugaagcugaccgugcgugaccu

SEQ ID NO: 3410 - RNA, 22 nt, Human Herpes Virus 4 (Epstein Barr virus)
ggcagggagguggcaugcaaaa

SEQ ID NO: 3411 - RNA, 22 nt, Human Herpes Virus 4 (Epstein Barr virus)
uugcugcagacaccacccaguc

SEQ ID NO: 3412 - RNA, 22 nt, Human Herpes Virus 4 (Epstein Barr virus)
uuucucagugucacauugcacg

SEQ ID NO: 3413 - RNA, 22 nt, Human Herpes Virus 4 (Epstein Barr virus)
gcgcaagggucacauuggggau

SEQ ID NO: 3414 - RNA, 22 nt, Human Herpes Virus 4 (Epstein Barr virus)
uccccucccucucccucguccu

SEQ ID NO: 3415 - RNA, 22 nt, Human Herpes Virus 4 (Epstein Barr virus)
aggagaaggagaauggggagga

SEQ ID NO: 3416 - RNA, 22 nt, Human Herpes Virus 4 (Epstein Barr virus)
caggccagccggagggaccccg

SEQ ID NO: 3417 - RNA, 22 nt, Human Herpes Virus 4 (Epstein Barr virus)
gccuucccucuccccuggccuc

SEQ ID NO: 3418 - RNA, 22 nt, Human Herpes Virus 4 (Epstein Barr virus)
uccgagagggcgccggacgggc

SEQ ID NO: 3419 - RNA, 22 nt, Human Herpes Virus 4 (Epstein Barr virus)
gccggccggggcaccuccgggc

SEQ ID NO: 3420 - RNA, 22 nt, Human Herpes Virus 4 (Epstein Barr virus)
cuggagcucgggggcggccggg

SEQ ID NO: 3421 - RNA, 22 nt, Human Herpes Virus 4 (Epstein Barr virus)
uggguccgcugccccgcuccgg

SEQ ID NO: 3422 - RNA, 22 nt, Human Herpes Virus 4 (Epstein Barr virus)
agaccuccgugaaggcaggguc

SEQ ID NO: 3423 - RNA, 22 nt, Human Herpes Virus 4 (Epstein Barr virus)
agcucugcuuuucaacggagcu

SEQ ID NO: 3424 - RNA, 22 nt, Human Herpes Virus 4 (Epstein Barr virus)
cggggguuuugccuccuucucg

SEQ ID NO: 3425 - RNA, 21 nt, Human Herpes Virus 4 (Epstein Barr virus)
gguaggggaguaaggccgcug

SEQ ID NO: 3426 - RNA, 22 nt, Human Herpes Virus 4 (Epstein Barr virus)
caccagcaacacagaggugcag

SEQ ID NO: 3427 - RNA, 22 nt, Human Herpes Virus 4 (Epstein Barr virus)
uggcacugacguguuucuggag

SEQ ID NO: 3428 - RNA, 22 nt, Human Herpes Virus 4 (Epstein Barr virus)
ucacccucggggaccccuggac

SEQ ID NO: 3429 - RNA, 22 nt, Human Herpes Virus 4 (Epstein Barr virus)
uugggggcgcccgggggucggg

SEQ ID NO: 3430 - RNA, 22 nt, Human Herpes Virus 4 (Epstein Barr virus)
ucacccucggggaccccuggac

SEQ ID NO: 3431 - RNA, 22 nt, Human Herpes Virus 4 (Epstein Barr virus)
uugggggcgcccgggggucggg

SEQ ID NO: 3432 - RNA, 22 nt, Human Herpes Virus 4 (Epstein Barr virus)
uggagcucguccggaagacggc

SEQ ID NO: 3433 - RNA, 22 nt, Human Herpes Virus 4 (Epstein Barr virus)
acgcugccggcgcgugcucgac

SEQ ID NO: 3434 - RNA, 22 nt, Human Herpes Virus 4 (Epstein Barr virus)
gccguccacugccuucuucccu

SEQ ID NO: 3435 - RNA, 21 nt, Human Herpes Virus 4 (Epstein Barr virus)
ggggggcuuacaggggagggc

SEQ ID NO: 3436 - RNA, 22 nt, Human Herpes Virus 4 (Epstein Barr virus)
ggguccagccgggugcacacgc

SEQ ID NO: 3437 - RNA, 22 nt, Human Herpes Virus 4 (Epstein Barr virus)
cguacaccuggcuguacgccgc

SEQ ID NO: 3438 - RNA, 22 nt, Human Herpes Virus 4 (Epstein Barr virus)
gaguuugagcgcgaguacuauc

SEQ ID NO: 3439 - RNA, 22 nt, Human Herpes Virus 4 (Epstein Barr virus)
gcaaguuuugugggcgggucuc

SEQ ID NO: 3440 - RNA, 22 nt, Human Herpes Virus 4 (Epstein Barr virus)
uccuccccauucuccuucuccu

SEQ ID NO: 3441 - RNA, 22 nt, Human Herpes Virus 4 (Epstein Barr virus)
gacgagggagagggaggggagg

SEQ ID NO: 3442 - RNA, 22 nt, Human Herpes Virus 4 (Epstein Barr virus)
ugcgaccgggcccuccagcggg

SEQ ID NO: 3443 - RNA, 19 nt, Human Herpes Virus 4 (Epstein Barr virus)
cugaagggccucgggggcg

SEQ ID NO: 3444 - RNA, 22 nt, Human Herpes Virus 4 (Epstein Barr virus)
aaccuaguguuaguguugugcu

SEQ ID NO: 3445 - RNA, 22 nt, Human Herpes Virus 4 (Epstein Barr virus)
cgcaccacuagucaccaggugu

SEQ ID NO: 3446 - RNA, 22 nt, Human Herpes Virus 4 (Epstein Barr virus)
uaggcauagagagugaugagcc

SEQ ID NO: 3447 - RNA, 22 nt, Human Herpes Virus 4 (Epstein Barr virus)
guucaugaucagcuacugccug

SEQ ID NO: 3448 - RNA, 22 nt, Human Herpes Virus 4 (Epstein Barr virus)
uccguauugucuggcagcaggg

SEQ ID NO: 3449 - RNA, 22 nt, Human Herpes Virus 4 (Epstein Barr virus)
uccagucaucgggcgaaguggg

SEQ ID NO: 3450 - RNA, 22 nt, Human Herpes Virus 4 (Epstein Barr virus)
ggggucccuccggccggccuga

SEQ ID NO: 3451 - RNA, 22 nt, Human Herpes Virus 4 (Epstein Barr virus)
gcaagcugagggggcucgggug

SEQ ID NO: 3452 - RNA, 22 nt, Human Herpes Virus 4 (Epstein Barr virus)
cggccccgacuaucgacccugc

SEQ ID NO: 3453 - RNA, 22 nt, Human Herpes Virus 4 (Epstein Barr virus)
ugacggggauggugagggccgc

SEQ ID NO: 3454 - RNA, 22 nt, Human Herpes Virus 4 (Epstein Barr virus)
gguggagccuagagguagguau

SEQ ID NO: 3455 - RNA, 22 nt, Human Herpes Virus 4 (Epstein Barr virus)
ggagguauccuaagcuccgccc

SEQ ID NO: 3456 - RNA, 22 nt, Human Herpes Virus 4 (Epstein Barr virus)
acauuccccgcaaacaugacau

SEQ ID NO: 3457 - RNA, 22 nt, Human Herpes Virus 4 (Epstein Barr virus)
uguuuuguuugcuugggaaugc

SEQ ID NO: 3458 - RNA, 22 nt, Human Herpes Virus 4 (Epstein Barr virus)
ucaagauguucaaggacgugga

SEQ ID NO: 3459 - RNA, 22 nt, Human Herpes Virus 4 (Epstein Barr virus)
uccaguuuaugaacagcauggc

SEQ ID NO: 3460 - RNA, 22 nt, Human Herpes Virus 4 (Epstein Barr virus)
cagucagccuggugugcguugc

SEQ ID NO: 3461 - RNA, 22 nt, Human Herpes Virus 4 (Epstein Barr virus)
aacuagcgcaccaaacugucug

SEQ ID NO: 3462 - RNA, 22 nt, Human Herpes Virus 4 (Epstein Barr virus)
uaagauaaagauggcugccucu

SEQ ID NO: 3463 - RNA, 22 nt, Human Herpes Virus 4 (Epstein Barr virus)
gaagcucagcaguuguuuuugu

SEQ ID NO: 3464 - RNA, 22 nt, Human Herpes Virus 4 (Epstein Barr virus)
gagcccgagaugccgcacgggg

SEQ ID NO: 3465 - RNA, 22 nt, Human Herpes Virus 4 (Epstein Barr virus)
ccgucguuaucuuggagaaugu

SEQ ID NO: 3466 - RNA, 22 nt, Human Herpes Virus 4 (Epstein Barr virus)
ucccuggacacuggacuaugau

SEQ ID NO: 3467 - RNA, 22 nt, Human Herpes Virus 4 (Epstein Barr virus)
uuucauagucaagguccaggau

SEQ ID NO: 3468 - RNA, 22 nt, Human Herpes Virus 4 (Epstein Barr virus)
aaggaccuggaauguggggaug

SEQ ID NO: 3469 - RNA, 22 nt, Human Herpes Virus 4 (Epstein Barr virus)
aucaacuauacccagcucauuu

SEQ ID NO: 3470 - RNA, 22 nt, Human Herpes Virus 4 (Epstein Barr virus)
ugaauuuggacgcagcuacuug

SEQ ID NO: 3471 - RNA, 22 nt, Human Herpes Virus 4 (Epstein Barr virus)
agugcugcguccacuuuguguu

SEQ ID NO: 3472 - RNA, 22 nt, Human Herpes Virus 4 (Epstein Barr virus)
uuggucgcacgccgccuccugg

SEQ ID NO: 3473 - RNA, 22 nt, Human Herpes Virus 4 (Epstein Barr virus)
gagagagggcgugccgcccugg

SEQ ID NO: 3474 - RNA, 22 nt, Human Herpes Virus 4 (Epstein Barr virus)
aauuugccuaacauggaggauu

SEQ ID NO: 3475 - RNA, 22 nt, Human Herpes Virus 4 (Epstein Barr virus)
uuuaauucucuucuguuugcau

SEQ ID NO: 3476 - RNA, 22 nt, Human Herpes Virus 4 (Epstein Barr virus)
cguuugcuugacccccgugaua

SEQ ID NO: 3477 - RNA, 22 nt, Human Herpes Virus 4 (Epstein Barr virus)
ucagaggggucgcaaaagcggg

SEQ ID NO: 3478 - RNA, 22 nt, Human Herpes Virus 4 (Epstein Barr virus)
augugccucaggagggucagga

SEQ ID NO: 3479 - RNA, 22 nt, Human Herpes Virus 4 (Epstein Barr virus)
uagauuaaccugaugcuuacac

SEQ ID NO: 3480 - RNA, 22 nt, Human Herpes Virus 4 (Epstein Barr virus)
cuaugcuacccagauauagauu

SEQ ID NO: 3481 - RNA, 22 nt, Human Herpes Virus 4 (Epstein Barr virus)
cagauauuuggguaguauaugc

SEQ ID NO: 3482 - RNA, 22 nt, Human Herpes Virus 4 (Epstein Barr virus)
uaugacguugcucucuucgugg

SEQ ID NO: 3483 - RNA, 21 nt, Human Herpes Virus 4 (Epstein Barr virus)
acaaagagggccaggucagag

SEQ ID NO: 3484 - RNA, 22 nt, Human Herpes Virus 4 (Epstein Barr virus)
ucaaguaccacgaccuggagga

SEQ ID NO: 3485 - RNA, 17 nt, Human Herpes Virus 4 (Epstein Barr virus)
gggccguggaaugaggg

SEQ ID NO: 3486 - RNA, 22 nt, Human Herpes Virus 4 (Epstein Barr virus)
ugccaccucucugccaggggcg

SEQ ID NO: 3487 - RNA, 22 nt, Human Herpes Virus 4 (Epstein Barr virus)
cugauggcggagggcaggcgcg

SEQ ID NO: 3488 - RNA, 22 nt, Human Herpes Virus 4 (Epstein Barr virus)
acacagggggcuggauuuggca

SEQ ID NO: 3489 - RNA, 22 nt, Human Herpes Virus 4 (Epstein Barr virus)
uguugauuuuuacccguguauc

SEQ ID NO: 3490 - RNA, 22 nt, Human Herpes Virus 4 (Epstein Barr virus)
ucaauuucugccgcaaaagaua

SEQ ID NO: 3491 - RNA, 22 nt, Human Herpes Virus 4 (Epstein Barr virus)
ucugcugcaacagaauuuaaaa

SEQ ID NO: 3492 - RNA, 22 nt, Human Herpes Virus 4 (Epstein Barr virus)
ucagucaggcaagccuaugaca

SEQ ID NO: 3493 - RNA, 22 nt, Human Herpes Virus 4 (Epstein Barr virus)
ucauaguagcuuagcugaacug

SEQ ID NO: 3494 - RNA, 22 nt, Human Herpes Virus 4 (Epstein Barr virus)
gccgaccggccccgcgccuggc

SEQ ID NO: 3495 - RNA, 22 nt, Human Herpes Virus 4 (Epstein Barr virus)
cagccgccgggguugguucugc

SEQ ID NO: 3496 - RNA, 22 nt, Human Herpes Virus 4 (Epstein Barr virus)
gccgaccggccccgcgccuggc

SEQ ID NO: 3497 - RNA, 22 nt, Human Herpes Virus 4 (Epstein Barr virus)
cagccgccgggguugguucugc

SEQ ID NO: 3498 - RNA, 22 nt, Human Herpes Virus 4 (Epstein Barr virus)
agcgcgccccauccgaagcccg

SEQ ID NO: 3499 - RNA, 20 nt, Human Herpes Virus 4 (Epstein Barr virus)
ucggggaagauggggugccu

SEQ ID NO: 3500 - RNA, 22 nt, Human Herpes Virus 4 (Epstein Barr virus)
ucaaccucuucaggcccggggu

SEQ ID NO: 3501 - RNA, 22 nt, Human Herpes Virus 4 (Epstein Barr virus)
cuccggggcugaucagguuaau

SEQ ID NO: 3502 - RNA, 22 nt, Human Herpes Virus 4 (Epstein Barr virus)
ucgagcacgcgccggcagcgug

SEQ ID NO: 3503 - RNA, 22 nt, Human Herpes Virus 4 (Epstein Barr virus)
ccgucuuccggacgagcuccac

SEQ ID NO: 3504 - RNA, 22 nt, Human Herpes Virus 4 (Epstein Barr virus)
ucugaccuggcccucuuugugg

SEQ ID NO: 3505 - RNA, 21 nt, Human Herpes Virus 4 (Epstein Barr virus)
acgaagagagcaacgucauag

SEQ ID NO: 3506 - RNA, 22 nt, Human Herpes Virus 4 (Epstein Barr virus)
ggcuaucccugaggcccuucuu

SEQ ID NO: 3507 - RNA, 22 nt, Human Herpes Virus 4 (Epstein Barr virus)
aaaggugggcuuugaggggugg

SEQ ID NO: 3508 - RNA, 22 nt, Human Herpes Virus 4 (Epstein Barr virus)
gccuccucucaggacccacccu

SEQ ID NO: 3509 - RNA, 17 nt, Human Herpes Virus 4 (Epstein Barr virus)
gggggccgggaagaagc

SEQ ID NO: 3510 - RNA, 22 nt, Human Herpes Virus 4 (Epstein Barr virus)
ucguucaguaaaaccgucaguc

SEQ ID NO: 3511 - RNA, 17 nt, Human Herpes Virus 4 (Epstein Barr virus)
gcugacgguacuuauag

SEQ ID NO: 3512 - RNA, 22 nt, Human Herpes Virus 4 (Epstein Barr virus)
caccccugggcaccauggucuc

SEQ ID NO: 3513 - RNA, 22 nt, Human Herpes Virus 4 (Epstein Barr virus)
guccaugggaucccagggcacc

SEQ ID NO: 3514 - RNA, 22 nt, Human Herpes Virus 4 (Epstein Barr virus)
uaaauucuguugcagcagauag

SEQ ID NO: 3515 - RNA, 22 nt, Human Herpes Virus 4 (Epstein Barr virus)
uaucuuuugcggcagaaauuga

SEQ ID NO: 3516 - RNA, 22 nt, Human Herpes Virus 4 (Epstein Barr virus)
gcccccgaggcccuucagcagc

SEQ ID NO: 3517 - RNA, 16 nt, Human Herpes Virus 4 (Epstein Barr virus)
uggagggcccggucgc

SEQ ID NO: 3518 - RNA, 22 nt, Human Herpes Virus 4 (Epstein Barr virus)
agggccaacuccgccagcucau

SEQ ID NO: 3519 - RNA, 22 nt, Human Herpes Virus 4 (Epstein Barr virus)
auagcaugguggccuggccccc

SEQ ID NO: 3520 - RNA, 22 nt, Human Herpes Virus 4 (Epstein Barr virus)
cccgacccccgggcgcccccaa

SEQ ID NO: 3521 - RNA, 22 nt, Human Herpes Virus 4 (Epstein Barr virus)
agggguccccgagggugaggcc

SEQ ID NO: 3522 - RNA, 22 nt, Human Herpes Virus 4 (Epstein Barr virus)
cccgacccccgggcgcccccaa

SEQ ID NO: 3523 - RNA, 22 nt, Human Herpes Virus 4 (Epstein Barr virus)
agggguccccgagggugaggcc

SEQ ID NO: 3524 - RNA, 22 nt, Human Herpes Virus 4 (Epstein Barr virus)
uguagcaggcaugucuucauuc

SEQ ID NO: 3525 - RNA, 22 nt, Human Herpes Virus 4 (Epstein Barr virus)
ugaaggcacagccuguuaccau

SEQ ID NO: 3526 - RNA, 22 nt, Human Herpes Virus 4 (Epstein Barr virus)
ucauccccugcuugggacccga

SEQ ID NO: 3527 - RNA, 22 nt, Human Herpes Virus 4 (Epstein Barr virus)
cggugguccugcggggggugac

SEQ ID NO: 3528 - RNA, 22 nt, Human Herpes Virus 4 (Epstein Barr virus)
ugggcccgggagccguggacgg

SEQ ID NO: 3529 - RNA, 22 nt, Human Herpes Virus 4 (Epstein Barr virus)
ugcacaggagacugggccucag

SEQ ID NO: 3530 - RNA, 22 nt, Human Herpes Virus 4 (Epstein Barr virus)
ugggcccgggagccguggacgg

SEQ ID NO: 3531 - RNA, 22 nt, Human Herpes Virus 4 (Epstein Barr virus)
ugcacaggagacugggccucag

SEQ ID NO: 3532 - RNA, 22 nt, Human Herpes Virus 4 (Epstein Barr virus)
ugggcccgggagccguggacgg

SEQ ID NO: 3533 - RNA, 22 nt, Human Herpes Virus 4 (Epstein Barr virus)
ugcacaggagacugggccucag

SEQ ID NO: 3534 - RNA, 22 nt, Human Herpes Virus 4 (Epstein Barr virus)
gggcgaggcauggaagggaaga

SEQ ID NO: 3535 - RNA, 17 nt, Human Herpes Virus 4 (Epstein Barr virus)
cuuucagagucuuggcc

SEQ ID NO: 3536 - RNA, 22 nt, Human Herpes Virus 4 (Epstein Barr virus)
ucacccucggggaccccuggac

SEQ ID NO: 3537 - RNA, 22 nt, Human Herpes Virus 4 (Epstein Barr virus)
uugggggcgcccgggggucggg

SEQ ID NO: 3538 - RNA, 22 nt, Human Herpes Virus 4 (Epstein Barr virus)
ucacccucggggaccccuggac

SEQ ID NO: 3539 - RNA, 22 nt, Human Herpes Virus 4 (Epstein Barr virus)
uugggggcgcccgggggucggg

SEQ ID NO: 3540 - RNA, 22 nt, Human Herpes Virus 4 (Epstein Barr virus)
ucacccucggggaccccuggac

SEQ ID NO: 3541 - RNA, 22 nt, Human Herpes Virus 4 (Epstein Barr virus)
uugggggcgcccgggggucggg

SEQ ID NO: 3542 - RNA, 22 nt, Human Herpes Virus 4 (Epstein Barr virus)
ucacccucggggaccccuggac

SEQ ID NO: 3543 - RNA, 22 nt, Human Herpes Virus 4 (Epstein Barr virus)
uugggggcgcccgggggucggg

SEQ ID NO: 3544 - RNA, 22 nt, Human Herpes Virus 4 (Epstein Barr virus)
ugauuccuagaggcgaugagac

SEQ ID NO: 3545 - RNA, 22 nt, Human Herpes Virus 4 (Epstein Barr virus)
ugucauggccacaaugggguug

SEQ ID NO: 3546 - RNA, 22 nt, Human Herpes Virus 4 (Epstein Barr virus)
gcgggcgcagccaugcgugacc

SEQ ID NO: 3547 - RNA, 22 nt, Human Herpes Virus 4 (Epstein Barr virus)
ucgcagggggugugucuggugg

SEQ ID NO: 3548 - RNA, 22 nt, Human Herpes Virus 4 (Epstein Barr virus)
ccgauccgacccgcucuacuuu

SEQ ID NO: 3549 - RNA, 18 nt, Human Herpes Virus 4 (Epstein Barr virus)
agguggugcuguuggagg

SEQ ID NO: 3550 - RNA, 22 nt, Human Herpes Virus 4 (Epstein Barr virus)
ggggagacaggggaggggguuu

SEQ ID NO: 3551 - RNA, 22 nt, Human Herpes Virus 4 (Epstein Barr virus)
acaccuucauaucccuuguuuu

SEQ ID NO: 3552 - RNA, 22 nt, Human Herpes Virus 4 (Epstein Barr virus)
ggggugggcaccucgggcucaa

SEQ ID NO: 3553 - RNA, 22 nt, Human Herpes Virus 4 (Epstein Barr virus)
ggcugagggggcggucaccgau

SEQ ID NO: 3554 - RNA, 22 nt, Human Herpes Virus 4 (Epstein Barr virus)
ucgccuauggaguugacucguc

SEQ ID NO: 3555 - RNA, 22 nt, Human Herpes Virus 4 (Epstein Barr virus)
gagggcacccauggcgcggugu

SEQ ID NO: 3556 - RNA, 22 nt, Human Herpes Virus 4 (Epstein Barr virus)
uauucuaaaguuccucaacagg

SEQ ID NO: 3557 - RNA, 22 nt, Human Herpes Virus 4 (Epstein Barr virus)
ccuugggggagcugggggugca

SEQ ID NO: 3558 - RNA, 22 nt, Human Herpes Virus 4 (Epstein Barr virus)
uguuguguacgacgaugauguc

SEQ ID NO: 3559 - RNA, 21 nt, Human Herpes Virus 4 (Epstein Barr virus)
ucaucgucagugucacagcca

SEQ ID NO: 3560 - RNA, 22 nt, Human Herpes Virus 4 (Epstein Barr virus)
uuacgguuuccuagauuguaca

SEQ ID NO: 3561 - RNA, 22 nt, Human Herpes Virus 4 (Epstein Barr virus)
ucacaaucuauggggucguaga

SEQ ID NO: 3562 - RNA, 22 nt, Human Herpes Virus 4 (Epstein Barr virus)
agucucugccuccaggcaaggg

SEQ ID NO: 3563 - RNA, 19 nt, Human Herpes Virus 4 (Epstein Barr virus)
ccagccugaggcccagucu

SEQ ID NO: 3564 - RNA, 22 nt, Human Herpes Virus 4 (Epstein Barr virus)
agucucugccuccaggcaaggg

SEQ ID NO: 3565 - RNA, 19 nt, Human Herpes Virus 4 (Epstein Barr virus)
ccagccugaggcccagucu

SEQ ID NO: 3566 - RNA, 22 nt, Human Herpes Virus 4 (Epstein Barr virus)
agucucugccuccaggcaaggg

SEQ ID NO: 3567 - RNA, 19 nt, Human Herpes Virus 4 (Epstein Barr virus)
ccagccugaggcccagucu

SEQ ID NO: 3568 - RNA, 22 nt, Human Herpes Virus 4 (Epstein Barr virus)
agucucugccuccaggcaaggg

SEQ ID NO: 3569 - RNA, 19 nt, Human Herpes Virus 4 (Epstein Barr virus)
ccagccugaggcccagucu

SEQ ID NO: 3570 - RNA, 22 nt, Human Herpes Virus 4 (Epstein Barr virus)
ucaaggugaauauagcugccca

SEQ ID NO: 3571 - RNA, 22 nt, Human Herpes Virus 4 (Epstein Barr virus)
gugggccgcuguucaccuaaag

SEQ ID NO: 3572 - RNA, 22 nt, Human Herpes Virus 4 (Epstein Barr virus)
uacgcccgccgccgcccccgcc

SEQ ID NO: 3573 - RNA, 22 nt, Human Herpes Virus 4 (Epstein Barr virus)
ggugugggggcggcggcggacc

SEQ ID NO: 3574 - RNA, 22 nt, Human Herpes Virus 4 (Epstein Barr virus)
ugguguuuggugugguuuuggg

SEQ ID NO: 3575 - RNA, 22 nt, Human Herpes Virus 4 (Epstein Barr virus)
cguuggaaugcuuuggagccga

SEQ ID NO: 3576 - RNA, 22 nt, Human Herpes Virus 4 (Epstein Barr virus)
ggcugccgggagccggaacugg

SEQ ID NO: 3577 - RNA, 22 nt, Human Herpes Virus 4 (Epstein Barr virus)
auguuugagguuucuguggccu

SEQ ID NO: 3578 - RNA, 22 nt, Human Herpes Virus 4 (Epstein Barr virus)
uaacccuaauucgauagcauau

SEQ ID NO: 3579 - RNA, 22 nt, Human Herpes Virus 4 (Epstein Barr virus)
uaugcuauugaauuaggguuag

SEQ ID NO: 3580 - RNA, 22 nt, Human Herpes Virus 4 (Epstein Barr virus)
agcaggccuacuucuacgccag

SEQ ID NO: 3581 - RNA, 18 nt, Human Herpes Virus 4 (Epstein Barr virus)
uggacguggaguuugcag

SEQ ID NO: 3582 - RNA, 22 nt, Human Herpes Virus 4 (Epstein Barr virus)
ggugcugggaccucgggugccc

SEQ ID NO: 3583 - RNA, 22 nt, Human Herpes Virus 4 (Epstein Barr virus)
gccccuggacuggucucucaau

SEQ ID NO: 3584 - RNA, 22 nt, Human Herpes Virus 4 (Epstein Barr virus)
ggugcugggaccucgggugccc

SEQ ID NO: 3585 - RNA, 22 nt, Human Herpes Virus 4 (Epstein Barr virus)
gccccuggacuggucucucaau

SEQ ID NO: 3586 - RNA, 22 nt, Human Herpes Virus 4 (Epstein Barr virus)
aagaccgaggacuggacuuagu

SEQ ID NO: 3587 - RNA, 22 nt, Human Herpes Virus 4 (Epstein Barr virus)
uggagguguuuggcucuggucu

SEQ ID NO: 3588 - RNA, 22 nt, Human Herpes Virus 4 (Epstein Barr virus)
guggucaaggagguuccaaccc

SEQ ID NO: 3589 - RNA, 22 nt, Human Herpes Virus 4 (Epstein Barr virus)
uuuaagagcucuccuggcuagg

SEQ ID NO: 3590 - RNA, 22 nt, Human Herpes Virus 4 (Epstein Barr virus)
uaagguugguccaauccauagg

SEQ ID NO: 3591 - RNA, 22 nt, Human Herpes Virus 4 (Epstein Barr virus)
cggggaucggacuagccuuaga

SEQ ID NO: 3592 - RNA, 22 nt, Human Herpes Virus 4 (Epstein Barr virus)
ccccggcagcuggccccgagga

SEQ ID NO: 3593 - RNA, 19 nt, Human Herpes Virus 4 (Epstein Barr virus)
gggccggucggcugggcug

SEQ ID NO: 3594 - RNA, 22 nt, Human Herpes Virus 4 (Epstein Barr virus)
ccccggcagcuggccccgagga

SEQ ID NO: 3595 - RNA, 19 nt, Human Herpes Virus 4 (Epstein Barr virus)
gggccggucggcugggcug

SEQ ID NO: 3596 - RNA, 22 nt, Human Herpes Virus 4 (Epstein Barr virus)
auccuggaccuugacuaugaaa

SEQ ID NO: 3597 - RNA, 22 nt, Human Herpes Virus 4 (Epstein Barr virus)
auaguccaguguccagggacag

SEQ ID NO: 3598 - RNA, 22 nt, Human Herpes Virus 4 (Epstein Barr virus)
uccuugacccugaggugcagga

SEQ ID NO: 3599 - RNA, 22 nt, Human Herpes Virus 4 (Epstein Barr virus)
cuggaccccauggucucagagg

SEQ ID NO: 3600 - RNA, 22 nt, Human Herpes Virus 4 (Epstein Barr virus)
ccgguuggcccacggggauccg

SEQ ID NO: 3601 - RNA, 22 nt, Human Herpes Virus 4 (Epstein Barr virus)
ugauccucuuuggcugacacac

SEQ ID NO: 3602 - RNA, 22 nt, Human Herpes Virus 4 (Epstein Barr virus)
uggguccgcugggccgcugccc

SEQ ID NO: 3603 - RNA, 22 nt, Human Herpes Virus 4 (Epstein Barr virus)
gguggccccgcugggcaccgcu

SEQ ID NO: 3604 - RNA, 22 nt, Human Herpes Virus 4 (Epstein Barr virus)
uggguccgcugggccgcugccc

SEQ ID NO: 3605 - RNA, 22 nt, Human Herpes Virus 4 (Epstein Barr virus)
gguggccccgcugggcaccgcu

SEQ ID NO: 3606 - RNA, 22 nt, Human Herpes Virus 4 (Epstein Barr virus)
ucagccaccauuuuaccaggga

SEQ ID NO: 3607 - RNA, 22 nt, Human Herpes Virus 4 (Epstein Barr virus)
uuuggagaaugggacgcucagg

SEQ ID NO: 3608 - RNA, 22 nt, Human Herpes Virus 4 (Epstein Barr virus)
cgacccccgggcgcccccaaac

SEQ ID NO: 3609 - RNA, 20 nt, Human Herpes Virus 4 (Epstein Barr virus)
cagggguccccgagggugag

SEQ ID NO: 3610 - RNA, 22 nt, Human Herpes Virus 4 (Epstein Barr virus)
cgacccccgggcgcccccaaac

SEQ ID NO: 3611 - RNA, 20 nt, Human Herpes Virus 4 (Epstein Barr virus)
cagggguccccgagggugag

SEQ ID NO: 3612 - RNA, 22 nt, Human Herpes Virus 4 (Epstein Barr virus)
cgacccccgggcgcccccaaac

SEQ ID NO: 3613 - RNA, 20 nt, Human Herpes Virus 4 (Epstein Barr virus)
cagggguccccgagggugag

SEQ ID NO: 3614 - RNA, 22 nt, Human Herpes Virus 4 (Epstein Barr virus)
acauugcggaggccauccucga

SEQ ID NO: 3615 - RNA, 22 nt, Human Herpes Virus 4 (Epstein Barr virus)
ugacgagggcuuccgccuguuu

SEQ ID NO: 3616 - RNA, 22 nt, Human Herpes Virus 4 (Epstein Barr virus)
ucaaguucgcacuuccuauaca

SEQ ID NO: 3617 - RNA, 22 nt, Human Herpes Virus 4 (Epstein Barr virus)
uaucggaaguuugggcuucguc

SEQ ID NO: 3618 - RNA, 22 nt, Human Herpes Virus 4 (Epstein Barr virus)
gugggcgaauuaacugagcuug

SEQ ID NO: 3619 - RNA, 22 nt, Human Herpes Virus 4 (Epstein Barr virus)
aggcguaauuaaucccgcccgu

SEQ ID NO: 3620 - RNA, 22 nt, Human Herpes Virus 4 (Epstein Barr virus)
ucacccucggggaccccuggac

SEQ ID NO: 3621 - RNA, 22 nt, Human Herpes Virus 4 (Epstein Barr virus)
uugggggcgcccgggggucggg

SEQ ID NO: 3622 - RNA, 22 nt, Human Herpes Virus 4 (Epstein Barr virus)
ucacccucggggaccccuggac

SEQ ID NO: 3623 - RNA, 22 nt, Human Herpes Virus 4 (Epstein Barr virus)
uugggggcgcccgggggucggg

SEQ ID NO: 3624 - RNA, 22 nt, Human Herpes Virus 4 (Epstein Barr virus)
ugguuguguuggugcucagaau

SEQ ID NO: 3625 - RNA, 22 nt, Human Herpes Virus 4 (Epstein Barr virus)
uaggggcgcuagucguggucaa

SEQ ID NO: 3626 - RNA, 22 nt, Human Herpes Virus 4 (Epstein Barr virus)
uauugggacuugaagguggagg

SEQ ID NO: 3627 - RNA, 21 nt, Human Herpes Virus 4 (Epstein Barr virus)
ucuaaguacaggucgcguagg

SEQ ID NO: 3628 - RNA, 22 nt, Human Herpes Virus 4 (Epstein Barr virus)
gagguggcggagcucucggagc

SEQ ID NO: 3629 - RNA, 21 nt, Human Herpes Virus 4 (Epstein Barr virus)
ucuggcggccaugcuaucggu

SEQ ID NO: 3630 - RNA, 22 nt, Human Herpes Virus 4 (Epstein Barr virus)
ugcugggaccucgggugcccgc

SEQ ID NO: 3631 - RNA, 22 nt, Human Herpes Virus 4 (Epstein Barr virus)
ggccccuggacuggucucucaa

SEQ ID NO: 3632 - RNA, 22 nt, Human Herpes Virus 4 (Epstein Barr virus)
uaaggcuaguccgauccccggg

SEQ ID NO: 3633 - RNA, 22 nt, Human Herpes Virus 4 (Epstein Barr virus)
cuauggauuggaccaaccuuaa

SEQ ID NO: 3634 - RNA, 22 nt, Human Herpes Virus 4 (Epstein Barr virus)
uaggcacccgggcccgcgucga

SEQ ID NO: 3635 - RNA, 21 nt, Human Herpes Virus 4 (Epstein Barr virus)
ucugcgggccacgguggccuc

SEQ ID NO: 3636 - RNA, 22 nt, Human Herpes Virus 4 (Epstein Barr virus)
ugauguucugugcaguaaccuu

SEQ ID NO: 3637 - RNA, 20 nt, Human Herpes Virus 4 (Epstein Barr virus)
guggaugcguuggaaguugu

SEQ ID NO: 3638 - RNA, 22 nt, Human Herpes Virus 4 (Epstein Barr virus)
uuuuuggggugucucuggaucu

SEQ ID NO: 3639 - RNA, 20 nt, Human Herpes Virus 4 (Epstein Barr virus)
ucacagggagacuuuauacu

SEQ ID NO: 3640 - RNA, 22 nt, Human Herpes Virus 4 (Epstein Barr virus)
uauuuucugcauucgcccuugc

SEQ ID NO: 3641 - RNA, 22 nt, Human Herpes Virus 4 (Epstein Barr virus)
aaauucuguugcagcagauagc

SEQ ID NO: 3642 - RNA, 23 nt, Human Herpes Virus 4 (Epstein Barr virus)
uaucuuuugcggcagaaauugaa

SEQ ID NO: 3643 - RNA, 21 nt, Human Herpes Virus 4 (Epstein Barr virus)
ucuuaguggaagugacgugcu

SEQ ID NO: 3644 - RNA, 22 nt, Human Herpes Virus 4 (Epstein Barr virus)
uaaccugaucagccccggaguu

SEQ ID NO: 3645 - RNA, 23 nt, Human Herpes Virus 4 (Epstein Barr virus)
uaacgggaaguguguaagcacac

SEQ ID NO: 3646 - RNA, 22 nt, Human Hepatitis B Virus
uccggccgaccacggggcgcac

SEQ ID NO: 3647 - RNA, 19 nt, Human Hepatitis B Virus
ugccuucucaucugccgga

SEQ ID NO: 3648 - RNA, 22 nt, Human Hepatitis B Virus
augaugugguauugggggccaa

SEQ ID NO: 3649 - RNA, 22 nt, Human Hepatitis B Virus
gagucccuuuuuaccucuauua

SEQ ID NO: 3650 - RNA, 22 nt, Human Hepatitis B Virus
ccugagugcuguauggugaggu

SEQ ID NO: 3651 - RNA, 22 nt, Human Hepatitis B Virus
cucccgauacagagcagaggcg

SEQ ID NO: 3652 - RNA, 22 nt, Human Hepatitis C Virus
uucuaucuaucccggccauaua

SEQ ID NO: 3653 - RNA, 22 nt, Human Hepatitis C Virus
uggcaugggauaugaugaugaa

SEQ ID NO: 3654 - RNA, 22 nt, Human Hepatitis C Virus
uccuggcugcucuggccgcgua

SEQ ID NO: 3655 - RNA, 22 nt, Human Hepatitis C Virus
cguggucauagugggcaggauu

SEQ ID NO: 3656 - RNA, 22 nt, Human Hepatitis C Virus
uggagcccuuguagucggugug

SEQ ID NO: 3657 - RNA, 22 nt, Human Hepatitis C Virus
cugcgccggcacguuggcccgg

SEQ ID NO: 3658 - RNA, 22 nt, Human Hepatitis C Virus
ugccccgcgggacacgccgugg

SEQ ID NO: 3659 - RNA, 22 nt, Human Hepatitis C Virus
cggugugcacccguggaguggc

SEQ ID NO: 3660 - RNA, 22 nt, Human Hepatitis C Virus
gaggguagugccagcaguaggg

SEQ ID NO: 3661 - RNA, 22 nt, Human Hepatitis C Virus
cuuccguuggcauaacugauag

SEQ ID NO: 3662 - RNA, 22 nt, Human Hepatitis C Virus
uccugcacacuccggggugugu

SEQ ID NO: 3663 - RNA, 22 nt, Human Hepatitis C Virus
guaacgccucgagguguugggu

SEQ ID NO: 3664 - RNA, 22 nt, Human Hepatitis C Virus
uugugucaucggaggggugggc

SEQ ID NO: 3665 - RNA, 22 nt, Human Hepatitis C Virus
ugccccacugauuguuuccgca

SEQ ID NO: 3666 - RNA, 22 nt, Human Hepatitis C Virus
uauggcaaugaggguugcgggu

SEQ ID NO: 3667 - RNA, 22 nt, Human Hepatitis C Virus
cuccccguggcucucggccuag

SEQ ID NO: 3668 - RNA, 22 nt, Human Hepatitis C Virus
gccauggcuagacgcuuucugc

SEQ ID NO: 3669 - RNA, 22 nt, Human Hepatitis C Virus
acaggggagugauucauggugg

SEQ ID NO: 3670 - RNA, 22 nt, Human Hepatitis C Virus
uaccacuccaugcuccgguucc

SEQ ID NO: 3671 - RNA, 19 nt, Human Hepatitis C Virus
gacuggauaugcgaggugc

SEQ ID NO: 3672 - RNA, 22 nt, Human Hepatitis C Virus
acggcaaacuccccacaacgca

SEQ ID NO: 3673 - RNA, 22 nt, Human Hepatitis C Virus
cugcuugucgggagcgccaccc

SEQ ID NO: 3674 - RNA, 22 nt, Human Hepatitis C Virus
cggccgggagaagguuggcgag

SEQ ID NO: 3675 - RNA, 22 nt, Human Hepatitis C Virus
uauggccagcuccucggccagc

SEQ ID NO: 3676 - RNA, 22 nt, Human Hepatitis C Virus
gaguugcucagugcguugaugg

SEQ ID NO: 3677 - RNA, 22 nt, Human Hepatitis C Virus
gcagcgcacggggugacgagug

SEQ ID NO: 3678 - RNA, 22 nt, Human Hepatitis C Virus
ucguguggcggcguuguucuug

SEQ ID NO: 3679 - RNA, 22 nt, Human Hepatitis C Virus
ugacucugucgccauauuacaa

SEQ ID NO: 3680 - RNA, 22 nt, Human Hepatitis C Virus
cagcccacaaggucuuggucca

SEQ ID NO: 3681 - RNA, 22 nt, Human Hepatitis C Virus
gaugacaggacccuugggugau

SEQ ID NO: 3682 - RNA, 22 nt, Human Hepatitis C Virus
ccaccuccguguccagugcgua

SEQ ID NO: 3683 - RNA, 22 nt, Human Hepatitis C Virus
cgccagcaggagcaggaggaga

SEQ ID NO: 3684 - RNA, 22 nt, Human Hepatitis C Virus
uucaucaucauaucccaugcca

SEQ ID NO: 3685 - RNA, 21 nt, Human Hepatitis C Virus
uauggccgggauagauagaac

SEQ ID NO: 3686 - RNA, 22 nt, Human Hepatitis C Virus
gccacuccacgggugcacaccg

SEQ ID NO: 3687 - RNA, 22 nt, Human Hepatitis C Virus
cggcgugucccgcggggcacaa

SEQ ID NO: 3688 - RNA, 22 nt, Human Hepatitis C Virus
uggacuuccacgcuugcacgag

SEQ ID NO: 3689 - RNA, 22 nt, Human Hepatitis C Virus
cuggugaguauuggaauccgua

SEQ ID NO: 3690 - RNA, 22 nt, Human Hepatitis C Virus
uggcgcucccgacaagcagauc

SEQ ID NO: 3691 - RNA, 22 nt, Human Hepatitis C Virus
cugcguuguggggaguuugccg

SEQ ID NO: 3692 - RNA, 22 nt, Human Hepatitis C Virus
gaguuuacuuguugccgcgcag

SEQ ID NO: 3693 - RNA, 22 nt, Human Hepatitis C Virus
ugcgcgcgacgaggaagacuuc

SEQ ID NO: 3694 - RNA, 22 nt, Human Hepatitis C Virus
uuccgcagaccacuauggcucu

SEQ ID NO: 3695 - RNA, 20 nt, Human Hepatitis C Virus
gguccuggaggcugcacgac

SEQ ID NO: 3696 - RNA, 22 nt, Human Hepatitis C Virus
ggaauugccaggacgaccgggu

SEQ ID NO: 3697 - RNA, 22 nt, Human Hepatitis C Virus
cgcucaaugccuggagauuugg

SEQ ID NO: 3698 - RNA, 22 nt, Human Hepatitis C Virus
ugagauccggauccccaggcuc

SEQ ID NO: 3699 - RNA, 22 nt, Human Hepatitis C Virus
cauggaagaauaggacucaacg

SEQ ID NO: 3700 - RNA, 22 nt, Human Hepatitis C Virus
gacgacugguuccacagccacg

SEQ ID NO: 3701 - RNA, 19 nt, Human Hepatitis C Virus
ccguugugcgcccagucuc

SEQ ID NO: 3702 - RNA, 22 nt, Human Hepatitis C Virus
cacgagcauggugcaguccugg

SEQ ID NO: 3703 - RNA, 22 nt, Human Hepatitis C Virus
cgacaggcugcccgggccuuga

SEQ ID NO: 3704 - RNA, 22 nt, Human Hepatitis C Virus
uugaguccuauucuuccaugcc

SEQ ID NO: 3705 - RNA, 22 nt, Human Hepatitis C Virus
ccuggggauccggaucucagcg

SEQ ID NO: 3706 - RNA, 22 nt, Human Hepatitis C Virus
uucuguccagaggaggcagggc

SEQ ID NO: 3707 - RNA, 22 nt, Human Hepatitis C Virus
uaccucuucaacugggcaguaa

SEQ ID NO: 3708 - RNA, 22 nt, Human Hepatitis C Virus
uggacaugaucgcuggugcuca

SEQ ID NO: 3709 - RNA, 22 nt, Human Hepatitis C Virus
ggcauagcguauuucuccaugg

SEQ ID NO: 3710 - RNA, 22 nt, Human Hepatitis C Virus
uguauuuggugauugggugcgu

SEQ ID NO: 3711 - RNA, 22 nt, Human Hepatitis C Virus
aacagcgcccagucuguauagc

SEQ ID NO: 3712 - RNA, 22 nt, Human Hepatitis C Virus
ccuaccaagugcgcaauuccuc

SEQ ID NO: 3713 - RNA, 22 nt, Human Hepatitis C Virus
aguauuguguacgaggcggccg

SEQ ID NO: 3714 - RNA, 22 nt, Human Hepatitis C Virus
aauagcggccgcuggccggcug

SEQ ID NO: 3715 - RNA, 22 nt, Human Hepatitis C Virus
uugguucacggcuggcuacagc

SEQ ID NO: 3716 - RNA, 22 nt, Human Hepatitis C Virus (HCV-N)
ugguggaguccaaguggcgagc

SEQ ID NO: 3717 - RNA, 22 nt, Human Hepatitis C Virus (HCV-N)
caaagcacauguggaauuucau

SEQ ID NO: 3718 - RNA, 22 nt, Human Hepatitis C Virus (HCV-N)
ggcuaagcguagguuggccagg

SEQ ID NO: 3719 - RNA, 22 nt, Human Hepatitis C Virus (HCV-N)
uggccagcucuucagcuagcca

SEQ ID NO: 3720 - RNA, 22 nt, Human Hepatitis C Virus (HCV-N)
ccugcacgccuuccccggcgcc

SEQ ID NO: 3721 - RNA, 22 nt, Human Hepatitis C Virus (HCV-N)
cgcuguggcggguggcugcuga

SEQ ID NO: 3722 - RNA, 22 nt, Human Hepatitis C Virus (HCV-N)
uaucgcgggguucccaggcagg

SEQ ID NO: 3723 - RNA, 20 nt, Human Hepatitis C Virus (HCV-N)
aguacuguaucccgcugaug

SEQ ID NO: 3724 - RNA, 22 nt, Human Hepatitis C Virus (HCV-N)
uccucgcagcucuggccgcaua

SEQ ID NO: 3725 - RNA, 22 nt, Human Hepatitis C Virus (HCV-N)
ugugguuaucguggguaggauc

SEQ ID NO: 3726 - RNA, 22 nt, Human Hepatitis C Virus (HCV-N)
cagggguggcuggcgcgcucgu

SEQ ID NO: 3727 - RNA, 22 nt, Human Hepatitis C Virus (HCV-N)
ugagcggcgaggcgcccucugc

SEQ ID NO: 3728 - RNA, 22 nt, Human Hepatitis C Virus (HCV-N)
ucagggcaguccuguugaugug

SEQ ID NO: 3729 - RNA, 22 nt, Human Hepatitis C Virus (HCV-N)
uguuuauaagcuggauucucug

SEQ ID NO: 3730 - RNA, 22 nt, Human Hepatitis C Virus (HCV-N)
ucgaggagguggcccugucgaa

SEQ ID NO: 3731 - RNA, 19 nt, Human Hepatitis C Virus (HCV-N)
gcaaagccauccccaucga

SEQ ID NO: 3732 - RNA, 22 nt, Human Hepatitis C Virus (HCV-N)
accccaaguccuguugucgugg

SEQ ID NO: 3733 - RNA, 22 nt, Human Hepatitis C Virus (HCV-N)
cuacguacagcuggggggagaa

SEQ ID NO: 3734 - RNA, 22 nt, Human Hepatitis C Virus (HCV-N)
ugcggaaagucgcuggggguca

SEQ ID NO: 3735 - RNA, 22 nt, Human Hepatitis C Virus (HCV-N)
ccuucaugagacugggcgcgcu

SEQ ID NO: 3736 - RNA, 22 nt, Human Hepatitis C Virus (HCV-N)
uugagcuuggucuuuacugccc

SEQ ID NO: 3737 - RNA, 22 nt, Human Hepatitis C Virus (HCV-N)
ugggacaguaguuuagcgcgga

SEQ ID NO: 3738 - RNA, 22 nt, Human Hepatitis C Virus (HCV-N)
gccauggcuagacgcuuucugc

SEQ ID NO: 3739 - RNA, 22 nt, Human Hepatitis C Virus (HCV-N)
acaggggagugaucuauggugg

SEQ ID NO: 3740 - RNA, 22 nt, Human Hepatitis C Virus (HCV-N)
caguccucauuaauccacuggu

SEQ ID NO: 3741 - RNA, 22 nt, Human Hepatitis C Virus (HCV-N)
cagcugggugaugguaaggcug

SEQ ID NO: 3742 - RNA, 22 nt, Human Hepatitis C Virus (HCV-N)
uuaugguggcuccaucuuagcc

SEQ ID NO: 3743 - RNA, 21 nt, Human Hepatitis C Virus (HCV-N)
aaagguccgugagccgcauga

SEQ ID NO: 3744 - RNA, 22 nt, Human Hepatitis C Virus (HCV-N)
uacugucccagggggggagggc

SEQ ID NO: 3745 - RNA, 17 nt, Human Hepatitis C Virus (HCV-N)
ucuucaacugggcagua

SEQ ID NO: 3746 - RNA, 22 nt, Human Hepatitis C Virus (HCV-N)
uguauuugguuauggggugugu

SEQ ID NO: 3747 - RNA, 22 nt, Human Hepatitis C Virus (HCV-N)
uuuuggacggccccuagccuau

SEQ ID NO: 3748 - RNA, 22 nt, Human Hepatitis C Virus (HCV-N)
uaccccugcacugucaacuucu

SEQ ID NO: 3749 - RNA, 22 nt, Human Hepatitis C Virus (HCV-N)
gauguauguggggggcguggag

SEQ ID NO: 3750 - RNA, 22 nt, Human Hepatitis C Virus (HCV-N)
ugcaggggcccgugguguacgc

SEQ ID NO: 3751 - RNA, 22 nt, Human Hepatitis C Virus (HCV-N)
uuccaugccacguguugcugca

SEQ ID NO: 3752 - RNA, 22 nt, Human Hepatitis C Virus (HCV-N)
ggggggggcggaguaccuaguc

SEQ ID NO: 3753 - RNA, 22 nt, Human Hepatitis C Virus (HCV-N)
cucguaggcucgccgcauccuc

SEQ ID NO: 3754 - RNA, 22 nt, Human Hepatitis C Virus (HCV-N)
gcgcccgugguaaugguccuua

SEQ ID NO: 3755 - RNA, 16 nt, Human Hepatitis C Virus (HCV-N)
ggucgguaccaugugc

SEQ ID NO: 3756 - RNA, 22 nt, Human Hepatitis C Virus (HCV-N)
ccaacgaucugaccaccgcccg

SEQ ID NO: 3757 - RNA, 22 nt, Human Hepatitis C Virus (HCV-N)
gcggcgguugguguuacguuug

SEQ ID NO: 3758 - RNA, 22 nt, Human Hepatitis C Virus (HCV-N)
agcagccgccccaacgagcaaa

SEQ ID NO: 3759 - RNA, 22 nt, Human Hepatitis C Virus (HCV-N)
uugucguaguggggaugguagc

SEQ ID NO: 3760 - RNA, 22 nt, Human Hepatitis C Virus (HCV-N)
ggcaaugagggcaugggguggg

SEQ ID NO: 3761 - RNA, 20 nt, Human Hepatitis C Virus (HCV-N)
ucaccccgcggcucccggcc

SEQ ID NO: 3762 - RNA, 22 nt, Human Hepatitis C Virus (HCV-N)
gaguuuaccuguugccgcgcag

SEQ ID NO: 3763 - RNA, 22 nt, Human Hepatitis C Virus (HCV-N)
ugcgcgcgaucaggaagacuuc

SEQ ID NO: 3764 - RNA, 22 nt, Human Hepatitis C Virus (HCV-N)
uuccgcagaccacuauggcucu

SEQ ID NO: 3765 - RNA, 20 nt, Human Hepatitis C Virus (HCV-N)
gguccuggaggcugcacgac

SEQ ID NO: 3766 - RNA, 22 nt, Human Hepatitis C Virus (HCV-N)
cggcagagggcgccucgccgcu

SEQ ID NO: 3767 - RNA, 22 nt, Human Hepatitis C Virus (HCV-N)
gcgcgccagccaccccugcccc

SEQ ID NO: 3768 - RNA, 22 nt, Human Hepatitis C Virus (HCV-N)
ggaauugccaggacgaccgggu

SEQ ID NO: 3769 - RNA, 22 nt, Human Hepatitis C Virus (HCV-N)
cgcucaaugccuggagauuugg

SEQ ID NO: 3770 - RNA, 22 nt, Human Hepatitis C Virus (HCV-N)
ucaucaucaugucccaggccau

SEQ ID NO: 3771 - RNA, 19 nt, Human Hepatitis C Virus (HCV-N)
cguggccgggguagaucga

SEQ ID NO: 3772 - RNA, 22 nt, Human Hepatitis C Virus (HCV-N)
cauuuugaguacguggccucgg

SEQ ID NO: 3773 - RNA, 22 nt, Human Hepatitis C Virus (HCV-N)
uccguggggcaggucaaggugu

SEQ ID NO: 3774 - RNA, 22 nt, Human Hepatitis C Virus (HCV-N)
ucuacgccguguuccggcucgu

SEQ ID NO: 3775 - RNA, 22 nt, Human Hepatitis C Virus (HCV-N)
ugggacugggugugcacggugu

SEQ ID NO: 3776 - RNA, 22 nt, Human Hepatitis C Virus (HCV-N)
ggggcgucaggcggcaggcuuc

SEQ ID NO: 3777 - RNA, 22 nt, Human Hepatitis C Virus (HCV-N)
agccuugacuguggacgccuuu

SEQ ID NO: 3778 - RNA, 22 nt, Human Hepatitis C Virus (HCV-N)
ucaucgacaugguggcgggggc

SEQ ID NO: 3779 - RNA, 20 nt, Human Hepatitis C Virus (HCV-N)
gggccuugccuacuauucca

SEQ ID NO: 3780 - RNA, 22 nt, Human Hepatitis C Virus (HCV-N)
uggaggcguagcgguggcgagc

SEQ ID NO: 3781 - RNA, 22 nt, Human Hepatitis C Virus (HCV-N)
uccagccgucuccgcuuggucc

SEQ ID NO: 3782 - RNA, 22 nt, Human Hepatitis C Virus (M1LE)
ugguggaguccaaguggcgcgc

SEQ ID NO: 3783 - RNA, 22 nt, Human Hepatitis C Virus (M1LE)
cgaagcacauguggaauuucau

SEQ ID NO: 3784 - RNA, 22 nt, Human Hepatitis C Virus (M1LE)
ucgccgcugugagcgcgauacc

SEQ ID NO: 3785 - RNA, 22 nt, Human Hepatitis C Virus (M1LE)
ucgucguuucaauggugaaggu

SEQ ID NO: 3786 - RNA, 22 nt, Human Hepatitis C Virus (M1LE)
ugaugauguccgcugccucaua

SEQ ID NO: 3787 - RNA, 22 nt, Human Hepatitis C Virus (M1LE)
uggagcagucguucgugacaug

SEQ ID NO: 3788 - RNA, 22 nt, Human Hepatitis C Virus (M1LE)
uggaggcguagcgguggcgagc

SEQ ID NO: 3789 - RNA, 22 nt, Human Hepatitis C Virus (M1LE)
uccagccgucuccgcuugaucc

SEQ ID NO: 3790 - RNA, 22 nt, Human Hepatitis C Virus (M1LE)
ggccaagcguagguuggccagg

SEQ ID NO: 3791 - RNA, 22 nt, Human Hepatitis C Virus (M1LE)
uggccagcucuucagcuagcca

SEQ ID NO: 3792 - RNA, 22 nt, Human Hepatitis C Virus (M1LE)
uggugcccugguugucgggguc

SEQ ID NO: 3793 - RNA, 22 nt, Human Hepatitis C Virus (M1LE)
gcgccggcacgugggcccagga

SEQ ID NO: 3794 - RNA, 22 nt, Human Hepatitis C Virus (M1LE)
acguugagucauacuccuccau

SEQ ID NO: 3795 - RNA, 22 nt, Human Hepatitis C Virus (M1LE)
gggacccugaucuuagcgacgg

SEQ ID NO: 3796 - RNA, 22 nt, Human Hepatitis C Virus (M1LE)
cagacccccggcguaggucgcg

SEQ ID NO: 3797 - RNA, 22 nt, Human Hepatitis C Virus (M1LE)
ugcggcuucgccgaccucaugg

SEQ ID NO: 3798 - RNA, 22 nt, Human Hepatitis C Virus (M1LE)
gcccaggagagggggcugugca

SEQ ID NO: 3799 - RNA, 22 nt, Human Hepatitis C Virus (M1LE)
auagcguucgcuucucggggua

SEQ ID NO: 3800 - RNA, 22 nt, Human Hepatitis C Virus (M1LE)
uggugacgagggcauggggugg

SEQ ID NO: 3801 - RNA, 22 nt, Human Hepatitis C Virus (M1LE)
accccguggcucucggccuaau

SEQ ID NO: 3802 - RNA, 22 nt, Human Hepatitis C Virus (M1LE)
ugcggaaagccgccggggguca

SEQ ID NO: 3803 - RNA, 22 nt, Human Hepatitis C Virus (M1LE)
ccuucgugaagcuggccgcacu

SEQ ID NO: 3804 - RNA, 22 nt, Human Hepatitis C Virus (M1LE)
gccauggcuagacgcuuucugc

SEQ ID NO: 3805 - RNA, 22 nt, Human Hepatitis C Virus (M1LE)
acaggggagugaucuauggugg

SEQ ID NO: 3806 - RNA, 22 nt, Human Hepatitis C Virus (M1LE)
gguggagggcaucucgccgcuc

SEQ ID NO: 3807 - RNA, 20 nt, Human Hepatitis C Virus (M1LE)
cuacgagugcgccagccacc

SEQ ID NO: 3808 - RNA, 22 nt, Human Hepatitis C Virus (M1LE)
aaaguguuccucgcuaggcuca

SEQ ID NO: 3809 - RNA, 22 nt, Human Hepatitis C Virus (M1LE)
accagagccgaggcgcacuugc

SEQ ID NO: 3810 - RNA, 22 nt, Human Hepatitis C Virus (M1LE)
cgggccggcgagccuuggggau

SEQ ID NO: 3811 - RNA, 22 nt, Human Hepatitis C Virus (M1LE)
uccacgagguugcgaccgcucg

SEQ ID NO: 3812 - RNA, 22 nt, Human Hepatitis C Virus (M1LE)
uggcacuacccaccccgaccgu

SEQ ID NO: 3813 - RNA, 22 nt, Human Hepatitis C Virus (M1LE)
guuggaggugugugguccagug

SEQ ID NO: 3814 - RNA, 22 nt, Human Hepatitis C Virus (M1LE)
ugaugcuaucgcgggguuccca

SEQ ID NO: 3815 - RNA, 20 nt, Human Hepatitis C Virus (M1LE)
ucccgcugaugaaauuccac

SEQ ID NO: 3816 - RNA, 22 nt, Human Hepatitis C Virus (M1LE)
aaccuauccagcagggccguca

SEQ ID NO: 3817 - RNA, 22 nt, Human Hepatitis C Virus (M1LE)
ggaggacuugcuggaagacacu

SEQ ID NO: 3818 - RNA, 22 nt, Human Hepatitis C Virus (M1LE)
ggcacuuuagugcucuugccgc

SEQ ID NO: 3819 - RNA, 22 nt, Human Hepatitis C Virus (M1LE)
gugcagaugagccacuugaaau

SEQ ID NO: 3820 - RNA, 22 nt, Human Hepatitis C Virus (M1LE)
cgugacagggggggugcaagcc

SEQ ID NO: 3821 - RNA, 22 nt, Human Hepatitis C Virus (M1LE)
gcuugcaucccucuuuaacguu

SEQ ID NO: 3822 - RNA, 22 nt, Human Hepatitis C Virus (M1LE)
ccagguugagggggagguucaa

SEQ ID NO: 3823 - RNA, 22 nt, Human Hepatitis C Virus (M1LE)
caaucuuuccuggcgaccugca

SEQ ID NO: 3824 - RNA, 22 nt, Human Hepatitis C Virus (M1LE)
ccaacgaucugaccaccgcccg

SEQ ID NO: 3825 - RNA, 22 nt, Human Hepatitis C Virus (M1LE)
gcggcgguugguguuacguuug

SEQ ID NO: 3826 - RNA, 22 nt, Human Hepatitis C Virus (M1LE)
ucgguccugugugagugcuaug

SEQ ID NO: 3827 - RNA, 22 nt, Human Hepatitis C Virus (M1LE)
guacgagcucacgcccgccgag

SEQ ID NO: 3828 - RNA, 22 nt, Human Hepatitis C Virus (M1LE)
gaaggccauuuggacauaauga

SEQ ID NO: 3829 - RNA, 22 nt, Human Hepatitis C Virus (M1LE)
ugcaugcacgaaugagcccuug

SEQ ID NO: 3830 - RNA, 22 nt, Human Hepatitis C Virus (M1LE)
gcagccgucccaacgagcaagu

SEQ ID NO: 3831 - RNA, 22 nt, Human Hepatitis C Virus (M1LE)
uauugucguaguggggacgcug

SEQ ID NO: 3832 - RNA, 22 nt, Human Hepatitis C Virus (M1LE)
gaguuuaccuguugccgcgcag

SEQ ID NO: 3833 - RNA, 22 nt, Human Hepatitis C Virus (M1LE)
ugcgcgcgacuaggaagacuuc

SEQ ID NO: 3834 - RNA, 22 nt, Human Hepatitis C Virus (M1LE)
uuccgcagaccacuauggcucu

SEQ ID NO: 3835 - RNA, 20 nt, Human Hepatitis C Virus (M1LE)
gguccuggaggcugcacgac

SEQ ID NO: 3836 - RNA, 22 nt, Human Hepatitis C Virus (M1LE)
gacggcuccuagccuauacagc

SEQ ID NO: 3837 - RNA, 22 nt, Human Hepatitis C Virus (M1LE)
caguguagguuuuagccgugug

SEQ ID NO: 3838 - RNA, 22 nt, Human Hepatitis C Virus (M1LE)
ggaauugccaggacgaccgggu

SEQ ID NO: 3839 - RNA, 22 nt, Human Hepatitis C Virus (M1LE)
cgcucaaugccuggagauuugg

SEQ ID NO: 3840 - RNA, 22 nt, Human Hepatitis C Virus (M1LE)
ggggcgucaguuugcaggcuuc

SEQ ID NO: 3841 - RNA, 22 nt, Human Hepatitis C Virus (M1LE)
agccuuaacuguggacgccuuc

SEQ ID NO: 3842 - RNA, 22 nt, Human Hepatitis C Virus (M1LE)
cgcugcuucugcuccuguuggc

SEQ ID NO: 3843 - RNA, 22 nt, Human Hepatitis C Virus (M1LE)
gccauggaccgggagauggcug

SEQ ID NO: 3844 - RNA, 22 nt, Human Hepatitis C Virus (M1LE)
uggauaugguggcgggggccca

SEQ ID NO: 3845 - RNA, 22 nt, Human Hepatitis C Virus (M1LE)
ggccuugccuacuauuccaugg

SEQ ID NO: 3846 - RNA, 22 nt, Human Hepatitis C Virus (M1LE)
ugcaggggcccgugguguacgc

SEQ ID NO: 3847 - RNA, 22 nt, Human Hepatitis C Virus (M1LE)
uuccaugccacguguugcugca

SEQ ID NO: 3848 - RNA, 22 nt, Human Hepatitis C Virus (M1LE)
cagaacugcgguuaucgccggu

SEQ ID NO: 3849 - RNA, 22 nt, Human Hepatitis C Virus (M1LE)
ugacgacuagcugcgguaauac

SEQ ID NO: 3850 - RNA, 22 nt, Human Hepatitis C Virus (M1LE)
uacugucccagggggggagggc

SEQ ID NO: 3851 - RNA, 22 nt, Human Hepatitis C Virus (M1LE)
uaccucuucaacugggcaguaa

SEQ ID NO: 3852 - RNA, 64 nt, Human
ucguucuccuuacaaucaaguucuugacccuauucggccuuauacaucuggucuuacaaagacc

SEQ ID NO: 3853 - RNA, 64 nt, Human
aagcccagugcccuccuggagugagacaagggcucggccuuaaggagcugaagagucuggguag

SEQ ID NO: 3854 - RNA, 64 nt, Human
aagacauaacaguaacacgauguacauuuacaagcggccuuauguacauuucccaacaaucuuu

SEQ ID NO: 3855 - RNA, 64 nt, Human
aagugcugggauuacaggcaugagccauugcgcccggccuuaaauguuuuuuuuaaucaucaaa

SEQ ID NO: 3856 - RNA, 64 nt, Human
cuuugugugugucccgauguuccugccugugagucggccuuacuccguuuccuuagcgcccaug

SEQ ID NO: 3857 - RNA, 64 nt, Human
cuacaucgcugcugucguccacgcccugcuggaccggccuuaggggugaaggugggggcacagg

SEQ ID NO: 3858 - RNA, 64 nt, Human
gaacugcuugaaaacuaggacgauugggcaauaucggccuuaacuccaccugauggcaggugac

SEQ ID NO: 3859 - RNA, 64 nt, Human
uccacauauccuaaaauuucagcuugccuuuuugcggccuuauauuuugauguaaagauuaaaa

SEQ ID NO: 3860 - RNA, 64 nt, Human
aaauaugaucuuggacauaucucuuaaccuccaucggccuuaguuuuugcauccaaaaagaagu

SEQ ID NO: 3861 - RNA, 64 nt, Human
ccguccucccaccgccgggcccugccccgcaucccggccuuaugcacugccccucccacccggc

SEQ ID NO: 3862 - RNA, 64 nt, Human
uccaguuggaggccaggguaccacaugucacaggcggccuuacaugugugccgugaaaagguuc

SEQ ID NO: 3863 - RNA, 64 nt, Human
ucuguuccaaaugauuccauccaccuuucccaaucggccuuacuucucacuaauuuguaggaaa

SEQ ID NO: 3864 - RNA, 64 nt, Human
aguuugggucacacaggcaagaggaauuuucccucggccuuacugacaaggacaccaaccuagg

SEQ ID NO: 3865 - RNA, 64 nt, Human
aaauaagucacggcccaugaccuugaagagcuuacggccuuauaaagagguucacuguaauugu

SEQ ID NO: 3866 - RNA, 64 nt, Human
aaccuagaggcuuugcaguuggcaagcuaacucgcggccuuauuucugccuuuaaucucccaca

SEQ ID NO: 3867 - RNA, 64 nt, Human
guuagacgcguugugggucggggagaggggcggacggcggcacccccucccucggguugcuucu

SEQ ID NO: 3868 - RNA, 64 nt, Human
uaacagagccccucuaggagaagccacgggaucccggcggcaaggagaacagaacacugaagac

SEQ ID NO: 3869 - RNA, 64 nt, Human
cagcccacaccugugggaccgcgggucuuagucacggcggcaggggcuuucuggcccccuccca

SEQ ID NO: 3870 - RNA, 64 nt, Human
cauguucaggcccugaacauuuccggugcugacucggccuuaaacguuugugccauaauggaaa

SEQ ID NO: 3871 - RNA, 64 nt, Human
accucgggcccagcgcugagggucacccaaccgccggccuuagugaccccaucuaugcugcuga

SEQ ID NO: 3872 - RNA, 64 nt, Human
cccacgcuccuucccuguggccaaccugugggcccggccuuaggguggaggcuuuaguguacag

SEQ ID NO: 3873 - RNA, 64 nt, Human
cccgcccacgugcuagcuccgugggcccaccgugcggccuuagagguuucccuccuuccuuucc

SEQ ID NO: 3874 - RNA, 64 nt, Human
uugggacccugcuuacacagccuggggguucugucggccuuaauucauaaacacuaugaauuuc

SEQ ID NO: 3875 - RNA, 64 nt, Human
uuauuguuguuguuguuucucauuuucacucgcacggccuuauucucauaauuaaaaucuaauu

SEQ ID NO: 3876 - RNA, 64 nt, Human
agaguacuguuuuuagaugugaaauauaagccugcggccuuaacucuguauuaaaaaaaauguu

SEQ ID NO: 3877 - RNA, 64 nt, Human
agugucucaguucugcuuuuggcauuagugaugguggugguacaguuggaauuagugccauguc

SEQ ID NO: 3878 - RNA, 64 nt, Human
gaugauagccguuacuuuuuauuaacccuggcuuuggugguaagggaaacuuccagaaaugcuu

SEQ ID NO: 3879 - RNA, 64 nt, Human
uacuggaagauugggaauuagucuaaacaggaaauggugguacacagaggcuaggagaggcugg

SEQ ID NO: 3880 - RNA, 64 nt, Human
ucuuucuuuucauuacaagucuuucacagaaguuuggugguaauauugaaagaacuagcauugg

SEQ ID NO: 3881 - RNA, 64 nt, Human
gagacagcuuuuagaggggcagagaauuagaggauggugguaguaaugaaaaugaugcauucag

SEQ ID NO: 3882 - RNA, 64 nt, Human
uugagacuguaggaacuguguugguugguauugguggugguauuuucaacaaacagggaauaac

SEQ ID NO: 3883 - RNA, 64 nt, Human
ccuccacuggcaacagugggacaauugcccccgacggcggcaccggggcucuguggaaucccga

SEQ ID NO: 3884 - RNA, 64 nt, Human
uuggcuggacauggccaagacacaaggcauuccacggcggcaagcugaccgcacagcagucugg

SEQ ID NO: 3885 - RNA, 64 nt, Human
caggcccggaggcggccgcgggcacccuggaacccggcggcauuuugcacauccacuccucacc

SEQ ID NO: 3886 - RNA, 64 nt, Human
uaaaaccauggacugagucacagcagacacucgauggugguaaaugugaugggugcuuacacac

SEQ ID NO: 3887 - RNA, 64 nt, Human
aaauguggaacauaauguuuaauuagaauugugguggugguaguggaaggggauaauuguaaau

SEQ ID NO: 3888 - RNA, 64 nt, Human
ccaguggaccaggcauuucuuauauaaauaaaauuggugguacuaauguguauccagagacauu

SEQ ID NO: 3889 - RNA, 64 nt, Human
uuaacauaaauauuacacgucaauacacuguacauggugguaauagacucuaagcaauugccaa

SEQ ID NO: 3890 - RNA, 64 nt, Human
cgucucuacuagaaauacaaaaauuagcuggauauggugguaugugccuguaaucccagcuacu

SEQ ID NO: 3891 - RNA, 64 nt, Human
aaucccucucccccaggagcccugcugcuuugcuuggugguagggcaggagagcaaacaaacag

SEQ ID NO: 3892 - RNA, 64 nt, Human
ugguguugggcccugaaaaauuaguccgauuuuguggugguaaugggagaaggacaucccagga

SEQ ID NO: 3893 - RNA, 64 nt, Human
gauuuuuuuuuucccuuuuuuugugggggaggguuggugguauauuuuuccccucuuuuuuccu

SEQ ID NO: 3894 - RNA, 64 nt, Human
uuuguauaucucaacagaauuaaaaugucuagcuuggugguauuuuuauagccauaaaagaaaa

SEQ ID NO: 3895 - RNA, 64 nt, Human
cacagacuggggaaugcucaagaugugaugggccuggugguacaggugugacauuuguuaccac

SEQ ID NO: 3896 - RNA, 64 nt, Human
ucuguuuaaaauaugcuauaguauuucauuaguuuggugguagcuuauuuuuauuguguaauga

SEQ ID NO: 3897 - RNA, 64 nt, Human
uuugaaguuugggcuguccugaaagucuggacuuuggugguacccuccucccccagcccaucug

SEQ ID NO: 3898 - RNA, 64 nt, Human
aagacugggucagccuagucaugccucccaacuguggugguauauguguacacacauacacagg

SEQ ID NO: 3899 - RNA, 64 nt, Human
uaggcagaagcucacucuuuuccagggacagaaguggugguagauggaaggaucccuggauguu

SEQ ID NO: 3900 - RNA, 64 nt, Human
uuucaaaaggucauuucuuuuaucugaaugaaaauggugguacuaagacugugaaaauuaugug

SEQ ID NO: 3901 - RNA, 64 nt, Human
uggaucuuuugcauauaauauaaauguauagacauggugguaggaauagcaacuaauacaaaug

SEQ ID NO: 3902 - RNA, 64 nt, Human
ccgugaacugcaggccacguacccaugacguaaacggcggcacuggagcaagcuggggcggggg

SEQ ID NO: 3903 - RNA, 64 nt, Human; identical to SEQ ID NO: 3867

SEQ ID NO: 3904 - RNA, 64 nt, Human; identical to SEQ ID NO: 3868

SEQ ID NO: 3905 - RNA, 64 nt, Human
cacacccccucaacauguagacuaaugcagccauuggugguacauuuauuuuagccacggauaa

SEQ ID NO: 3906 - RNA, 64 nt, Human
uccuugcagguuggaggcggggcugcaucuggcuuggugguagcauuuaaucuauugcauuggu

SEQ ID NO: 3907 - RNA, 64 nt, Human
uguuuugugcuguacuuuaugacuuguuucccuauggugguaaagaaugaugccauagucaguu

SEQ ID NO: 3908 - RNA, 64 nt, Human
ccaucucuacuaaaaauacaaaacuagccggguauggugguacaugccuguaaucccagcuacu

SEQ ID NO: 3909 - RNA, 64 nt, Human
cgucucuacuaaaaauacaaaaauuagcugagcauggugguacgugccuguacugucagcuacu

SEQ ID NO: 3910 - RNA, 64 nt, Human
aaagaggguuuaauuuuucuuguauuugguuuccuggugguaucauaguguaauuuuaguauuu

SEQ ID NO: 3911 - RNA, 64 nt, Human
gacaccggaucuacaaaaaaauaaaaagccagacuggugguauguaucugugucccagcuaauu

SEQ ID NO: 3912 - RNA, 64 nt, Human
guuuuauuggcagugggcacaaggaggugagaaguggugguaaaaggagcggagugcugaagca

SEQ ID NO: 3913 - RNA, 64 nt, Human
uaaaggaccuguuaacucagauuucuggauauuuuggugguagcuucuagucccagaaucugug

SEQ ID NO: 3914 - RNA, 64 nt, Human
ccauuuguggaauuuggaaacguguguugacuccuggugguaaauuaaauaguuuuuuucauca

SEQ ID NO: 3915 - RNA, 64 nt, Human
uuauuuggauugcaaaagggagucccaccaucgcuggugguaucccagggucccugcucaaguu

SEQ ID NO: 3916 - RNA, 64 nt, Human
aguuccuuucaaugguuugcaaggaagccacagcuggugguaucugaguugacuugacagaaca

SEQ ID NO: 3917 - RNA, 64 nt, Human
ccacuaccgaaugugucuucagauagcccuguccuggugguauuuagccacuaaccuuugccug

SEQ ID NO: 3918 - RNA, 64 nt, Human
uuauuagcaaguuacuauuuuguuuuuuugucauuggugguaggacuaagaaggaaacagauau

SEQ ID NO: 3919 - RNA, 64 nt, Human
uucugcuuguuuacaacuaugaucuucuaugaaauggugguaccaaggggcgcccaacagcuuu

SEQ ID NO: 3920 - RNA, 64 nt, Human
ccauaaggacugcaauagagagggcaauuuacccuggugguacacggaaccuagauucacuccu

SEQ ID NO: 3921 - RNA, 64 nt, Human; identical to SEQ ID NO: 3869

SEQ ID NO: 3922 - RNA, 64 nt, Human; identical to SEQ ID NO: 3883

SEQ ID NO: 3923 - RNA, 64 nt, Human; identical to SEQ ID NO: 3884

SEQ ID NO: 3924 - RNA, 64 nt, Human
acaguauguucaucauauaucaucaucauuauuauggugguaaagauagaaucuuuuuucuuuu

SEQ ID NO: 3925 - RNA, 64 nt, Human
ucccccuccaaagucuugauagcaagcguuauuuuggugguagaaacggugaaaucucuagccu

SEQ ID NO: 3926 - RNA, 64 nt, Human
augagauauauauagauauauauucuagguuggguggugguagauccuugagggucaguaguuu

SEQ ID NO: 3927 - RNA, 64 nt, Human
uucugaacucccagaucugagaaggaacuaguguuggugguauguaacaagaguuacguaucca

SEQ ID NO: 3928 - RNA, 64 nt, Human
aacaacaguggcuguaucugcaucgugggguugcuggugguagaacacuuugguguuaggaaag

SEQ ID NO: 3929 - RNA, 64 nt, Human
auuuauggaccuuaauuauuaaauguuuauaagguggugguaaccaccucaaguuucugaugaa

SEQ ID NO: 3930 - RNA, 64 nt, Human
aaaaacaaaauggguuacuugauuggugauuagguggugguagagaagcaaguaaaaaggcuaa

SEQ ID NO: 3931 - RNA, 64 nt, Human
uauuauauuuggaggcagcuucagacuguuuuauuggugguagcugcuugcugaggucuuuuag

SEQ ID NO: 3932 - RNA, 64 nt, Human
uuguucuuuaagaauuacagguugagguaguugauggugguaaacauucucucaggagacaaua

SEQ ID NO: 3933 - RNA, 64 nt, Human
uucugagaggccaccugcuuuugccuuuguugacuggugguagaacuccaguucuguggcaagg

SEQ ID NO: 3934 - RNA, 64 nt, Human
gggcaacagauuuucacagcucauccacaaggaguggugguacagccagccgcagcagugacua

SEQ ID NO: 3935 - RNA, 64 nt, Human
ucaaugaugcuucauucauguacuauguaugcauuggugguaaauggaugugagggcaaguaca

SEQ ID NO: 3936 - RNA, 64 nt, Human
agaaacauuguaaauauuuacucuuugcaaacccuggugguauuuuauuuuggcuucauuucaa

SEQ ID NO: 3937 - RNA, 64 nt, Human
acuagaaacaaguuuacuuuaucugcuuugccucuggugguacaagguuuuuaacauggauggu

SEQ ID NO: 3938 - RNA, 64 nt, Human
uuucuuuuguaugacucguuuguucuuuauuaguuggugguauggguuggaucauuuguuuuua

SEQ ID NO: 3939 - RNA, 64 nt, Human
gccauaggcagauaaagauuugguuucacccugguggugguaggcaucgugugugacuuuuuuu

SEQ ID NO: 3940 - RNA, 64 nt, Human; identical to SEQ ID NO: 3885

SEQ ID NO: 3941 - RNA, 64 nt, Human
cagagcugggauuccaugcgacagcuugaaugcugaccuucagacaugagacauagggauuugg

SEQ ID NO: 3942 - RNA, 64 nt, Human
uuuacagcguuuauugucuugucucuugucaguagaccuucaguacacaguaugugggauaugu

SEQ ID NO: 3943 - RNA, 64 nt, Human
cacuagguucuucccagcauaugagugagaauauuggugguauuuugggcuccucuacugcaca

SEQ ID NO: 3944 - RNA, 64 nt, Human
ucaguaucucuggcaacagaaacaaggauugaaauggugguaguuaagagugcagacacaucug

SEQ ID NO: 3945 - RNA, 64 nt, Human
ccacuguuuguuaggccuuaaacaacauucacuguggugguaucaggcacacugcuaugugcau

SEQ ID NO: 3946 - RNA, 64 nt, Human
ccauccauauaggagucacguucuuuaagacagauggugguaguuauuuuuguggcaugguuag

SEQ ID NO: 3947 - RNA, 64 nt, Human
auguuuaacaccaucuuacuaaccauuauugcuauggugguauacacugccuaugucuuuauuc

SEQ ID NO: 3948 - RNA, 64 nt, Human
gugaaaguugagcucaaaguagaggaaaaguuacuggugguaccuugcugccugcucugcuggu

SEQ ID NO: 3949 - RNA, 64 nt, Human
aaccaauucacagggaaacuagagacuacggcuguggugguaaccugcagauauacacauuccc

SEQ ID NO: 3950 - RNA, 64 nt, Human
caauguuuuggaauuacuuuaauugauggaguaguggugguagagagaaauuaauaacaaaaag

SEQ ID NO: 3951 - RNA, 64 nt, Human
acugcagccgcugccgucgcgacacagggcuugguggugguagcauuugggucugagaucggcc

SEQ ID NO: 3952 - RNA, 64 nt, Human
auacuucagucaguccaaucauaguacagugauguggugguagaugcuaugaauuucuucauug

SEQ ID NO: 3953 - RNA, 64 nt, Human
agacggcuaaugguaggaauguuaauguaaauaguggugguaauguaaaaucauuucauuuauc

SEQ ID NO: 3954 - RNA, 64 nt, Human
gagcuccccagcucucagcaacuucauauaagcauggugguaucuuaaaauggugguuugcaga

SEQ ID NO: 3955 - RNA, 64 nt, Human
gaauggcgauugaaauguuacaacagagauuucuuggugguagcuauuuggguaaagguauaug

SEQ ID NO: 3956 - RNA, 64 nt, Human
cuuugaaguuauaacugugaucugaaaauguguguggugguaugacagcauaccauuaaauaca

SEQ ID NO: 3957 - RNA, 64 nt, Human
ugcccaggacacaaguaaaacauuugugagauaguggugguaagugaugcacucguguuaaguc

SEQ ID NO: 3958 - RNA, 64 nt, Human
uccuccucccuuacugaaccacucucccaccuccuggugguaccauuauuauagaagcccucua

SEQ ID NO: 3959 - RNA, 64 nt, Human
uagaacccuagcccagggacuggagcaggaaagggaccuucaaagugaagacugccuugucccg

SEQ ID NO: 3960 - RNA, 64 nt, Human
auucgaucagugugccugaaaccuuacuacaagggaccuucaggcuuucucuuuaaaaaaaaaa

SEQ ID NO: 3961 - RNA, 64 nt, Human
cuagacacacucaggaggacuacugaggcucugcgaccuucaggagcugagccugccucucucc

SEQ ID NO: 3962 - RNA, 64 nt, Human
auggaaauccacugauuuuuuuuuuuuuuucaaauggugguacuugcaaucuguuuuauaauua

SEQ ID NO: 3963 - RNA, 64 nt, Human
aggaaaaaaaaaagcaugaucugaaaaauacuuuuggugguauguugguuacccuccuagcuuu

SEQ ID NO: 3964 - RNA, 64 nt, Human
acugaggaaaaagcaauauggguucggcagaugguggugguaaaaugaaucuuaaggagugugg

SEQ ID NO: 3965 - RNA, 64 nt, Human
ugguauuuccucuguuauugcuaauaaaugaaaauggugguaugaaagaaaugguggucauuuc

SEQ ID NO: 3966 - RNA, 64 nt, Human
ugguuggguucguuuuuaauucaguccuacaaaauggugguaagccccagucucaggggucacc

SEQ ID NO: 3967 - RNA, 64 nt, Human
cccccauugcccagcacugucucauagaaggcucuggugguaccucugggccccaggagcauca

SEQ ID NO: 3968 - RNA, 64 nt, Human
caaaccaaggaugagcgucuggucucugcuaugauggugguauccgaggccuuucccugcccag

SEQ ID NO: 3969 - RNA, 64 nt, Human
cuuguagcacaagggcuacacaugggcgccaagauggugguagauacaccuuggugcacuuuuu

SEQ ID NO: 3970 - RNA, 64 nt, Human
aaugaucuagaguauguugaagaagauggacauguggugguacgaaaacaauuccccuguggcc

SEQ ID NO: 3971 - RNA, 64 nt, Human
ccugugaaacuaacaucuuauugagauuugaaacuggugguaguuucccaggaaggcacaggug

SEQ ID NO: 3972 - RNA, 64 nt, Human
cagauggcuuuuucuuuuugacuggacuuuuggguggugguagauuuuuaaacaaaugaaauua

SEQ ID NO: 3973 - RNA, 64 nt, Human
ugucucuacuaaaaauacaaaaauuagccgggcauggugguaggggccuguaacccagcuacuc

SEQ ID NO: 3974 - RNA, 64 nt, Human
ggaagaagguguaagucaagcucuugaauauaacuggugguauugugggcagagaucuuuaguu

SEQ ID NO: 3975 - RNA, 64 nt, Human
acuuagugguucuguuuucuugagacauuuaaucuggugguaacugugguaacauugcagcccu

SEQ ID NO: 3976 - RNA, 64 nt, Human
uauaaaagacaacugggaauguugaauguggaucuggugguaggugauauuguuagugauguga

SEQ ID NO: 3977 - RNA, 64 nt, Human
uugccuguucuaacuguugcuaccagauuauaucuggugguaauuguuaauguuucagcagggc

SEQ ID NO: 3978 - RNA, 64 nt, Human
accagccccugagaggaccaggaggagcauccuugaccuucauuuaacuuggcucacuucucuu

SEQ ID NO: 3979 - RNA, 64 nt, Human
cucgugggagucccaugcgugagugugguggugugaccuucaggcugcacagaggcaaggaccc

SEQ ID NO: 3980 - RNA, 64 nt, Human
gucauauauuuggaacaguuauugucugugccaugaccuucaugauaccagugagaagccaggc

SEQ ID NO: 3981 - RNA, 64 nt, Human
ggauaugguaauagauauauuucagaauagcaaguggugguauaucuuauccauaucuuuaggc

SEQ ID NO: 3982 - RNA, 64 nt, Human
gauauggguuaaauuccucauuuuacuuuuaaacuggugguaaaguggaaauugcaaaaaaaaa

SEQ ID NO: 3983 - RNA, 64 nt, Human
auuaucugaagguaaacugucucuugaaguucuguggugguaugagauccagcugugugaauau

SEQ ID NO: 3984 - RNA, 64 nt, Human
cgcaaggggauguggauacuuggcccaaaguaacuggugguaggaaucuuagaaacaagaccac

SEQ ID NO: 3985 - RNA, 64 nt, Human
uuuugugcaucuguggcaauaaaugagaucucaguggugguauggauuugacugaucucuguaa

SEQ ID NO: 3986 - RNA, 64 nt, Human
agaggacauaaugggguccuggccaucccacaaguggugguaacccuggugguugcuguuuucc

SEQ ID NO: 3987 - RNA, 64 nt, Human
aguuaaagacaggguauuauaaauuuagagugauuggugguauauuacggaaauacggaaccuu

SEQ ID NO: 3988 - RNA, 64 nt, Human
aaaccccaucucuacaaaaaaaauuagcuggguguggugguacauaccuguagucccagcuacu

SEQ ID NO: 3989 - RNA, 64 nt, Human
ugucucugcaaaaaauacaaaaauuagcuggguauggugguaagugccuguaguccuagcuacu

SEQ ID NO: 3990 - RNA, 64 nt, Human
gaggagauacuuaaaacaugcacauauaccagguuggugguaaguuggucgcaugugaaaaccu

SEQ ID NO: 3991 - RNA, 64 nt, Human
gugagaauuuuuucacauuauaguagcaaggaauuggugguauuauggaccgaacugaaaauuu

SEQ ID NO: 3992 - RNA, 64 nt, Human
aaacauaaguuggugaccaucuguaaucaugauguggugguaaaucuuggacgcuaccuuacaa

SEQ ID NO: 3993 - RNA, 64 nt, Human
gcauacaaguauagagaccuaggagguggucuuguggugguacauuugguuaacccauugcugg

SEQ ID NO: 3994 - RNA, 64 nt, Human
acaugaaguccaagcauuuagauguauagguugauggugguauguuuucaggcuagauguaugu

SEQ ID NO: 3995 - RNA, 64 nt, Human
guuaucugaaucauuggcauuuauccgauuccacuggugguaguuugcuagugcuucuaaaagu

SEQ ID NO: 3996 - RNA, 64 nt, Human
acagcucuuaaaagccaggccaguacugacuguguggugguaaaugcuauucauuauuuucuuu

SEQ ID NO: 3997 - RNA, 64 nt, Human
cccaucccaccuggcaaaauccuccuggaaggaggaccuucaagagcgcaucaccugaaugucg

SEQ ID NO: 3998 - RNA, 64 nt, Human
aaugcugggacuaugggcaugagccccugcgccugaccuucaacagcucuuuuaagugaguucu

SEQ ID NO: 3999 - RNA, 64 nt, Human
uauguaagucaccugaaauaggaauccggcagaagaccuucauuaauuaagaagcaaacaaaaa

SEQ ID NO: 4000 - RNA, 64 nt, Human
augcaccaccacgcccggcuaauuuuguauuuuuggucgagacgggguuuugccauguuaguca

SEQ ID NO: 4001 - RNA, 64 nt, Human
cuucaccuccagcucugcugcuccucuacucuugggucgagaucccuuuggagccacagcgagg

SEQ ID NO: 4002 - RNA, 64 nt, Human
aggagcuccugggaagcccugggugcaggacacuggucgagagccaaaggucccuccccagaca

SEQ ID NO: 4003 - RNA, 64 nt, Human
ggccugugggaggggcugggaaaauaaaguccaaggucgagaccagacagcugccagccucuac

SEQ ID NO: 4004 - RNA, 64 nt, Human
ugcaccaccaugccuggcuuuuuuuuuuuuuuuuggucgagauggggugucccuguguugccca

SEQ ID NO: 4005 - RNA, 64 nt, Human
gggaggccgaagcaggcggaucacgaggucaggaggucgagaucauccuggcuaacacagugaa

SEQ ID NO: 4006 - RNA, 64 nt, Human
uauauuuuuuguauauguuugcuagcucuaaaaaggucgagaugcaauaacacuucguaagcaa

SEQ ID NO: 4007 - RNA, 64 nt, Human
uuagcgguggcuucuucguugcuguaauugaacgggucgagaugccgacgugagugaguggggg

SEQ ID NO: 4008 - RNA, 64 nt, Human
aaguuauacuucuuuuauaaccuuuugggcaucuggucgagagaagacaagauuuucucuauuu

SEQ ID NO: 4009 - RNA, 64 nt, Human
uucucuguaaaaugucuguucuacuucacacaguggucgagaggcuaaaauaaaaugaaaagca

SEQ ID NO: 4010 - RNA, 64 nt, Human
gaggaaaaggaggccuagaaagguuaaguaacuuggucgagaccacucagccuugagaucaaga

SEQ ID NO: 4011 - RNA, 64 nt, Human
cugaucucaggagaacaccugggcuagggaauguggucgagaaagggcagcccauugcccagaa

SEQ ID NO: 4012 - RNA, 64 nt, Human
uacuuucuugcacacgcgcugccuugcgggagggggucgagaaagaggaacgaggagcuguaaa

SEQ ID NO: 4013 - RNA, 64 nt, Human
gguccugaugugaacaaccuaugggaaaaggaaaggucgagagaaucuuguccaggacacugaa

SEQ ID NO: 4014 - RNA, 64 nt, Human
aaggccagggcagguggaucgcuugaucccaggaggucgagaccagccuggggaacacauccug

SEQ ID NO: 4015 - RNA, 64 nt, Human
aagcaggcaccauccuggaagucuaccccuagguggucgagagaccuguucuuucacagaugug

SEQ ID NO: 4016 - RNA, 64 nt, Human
uacgcaugaacaaagccauauccuuuugcaguggggucgagagagaaaguagcacgcccgcccc

SEQ ID NO: 4017 - RNA, 64 nt, Human
ggcugcucuacugcuucaggaaggacauggacaaggucgagacauuccugcgcauggugcagug

SEQ ID NO: 4018 - RNA, 64 nt, Human
ggcugcucuacugcuucaggaaggacauggacaaggucgagacauuccugcgcaucgugcagug

SEQ ID NO: 4019 - RNA, 64 nt, Human; identical to SEQ ID NO: 4017

SEQ ID NO: 4020 - RNA, 64 nt, Human; identical to SEQ ID NO: 4018

SEQ ID NO: 4021 - RNA, 64 nt, Human
gucacauugacugacggggaccagggcuugugugggucgagagcgcccucauggugcuggugcu

SEQ ID NO: 4022 - RNA, 64 nt, Human
ggaggaaaugcucagagcuccgaggugcggcuguggucgagaaccgggugcugggccgggcgcg

SEQ ID NO: 4023 - RNA, 64 nt, Human
ccaaccccuuugcaccggucccacuaaggggcagggucgagagaggaggggggauagggggagc

SEQ ID NO: 4024 - RNA, 64 nt, Human
ccccggaucgaggacaagugagagagcaagugggggucgagacuuuggggagacgguguugcag

SEQ ID NO: 4025 - RNA, 64 nt, Human
gcuaauucuacucacagugcuuuuaagugaaaauggucgagaaagaggcaccaggaagccgucc

SEQ ID NO: 4026 - RNA, 64 nt, Human
auaaauggccuccuuggguguggccaucuucuauggucgagacuguagggaugaaauaaacccc

SEQ ID NO: 4027 - RNA, 64 nt, Human
ugacccuauuugaauuaauauccuuuguuagaguggucgagauuucaaacccaauuauguacag

SEQ ID NO: 4028 - RNA, 64 nt, Human
gcccugcauggguuuguuuguuuuuuuacugcucacucccaaccuuuuguaaugccauuuucua

SEQ ID NO: 4029 - RNA, 64 nt, Human
ucuccuccucuugcagggcauggggccaggcuccacucccaaaugagacuggcccccuccaugg

SEQ ID NO: 4030 - RNA, 63 nt, Human
auugaugugauaaggaaaaaaguccuauuuuuauacucccaacaagccuguguccugugguuc

SEQ ID NO: 4031 - RNA, 64 nt, Human
augccacucaucagcuugggaaugauggcugccaacucccaaucucccaggaaggcagggggca

SEQ ID NO: 4032 - RNA, 64 nt, Human
agugcuaguuaaauggauucauaugaagugcuuuacucccaaccauugaguuauuuauaaugua

SEQ ID NO: 4033 - RNA, 64 nt, Human
uccucguuccuuucuccuguuuauucccaucuuuacucccaagacuucauugucccucuucacu

SEQ ID NO: 4034 - RNA, 64 nt, Human; identical to SEQ ID NO: 4033

SEQ ID NO: 4035 - RNA, 64 nt, Human
uaauuuuuacaaacuccaagcaaaucugacccaaacucccaaauugucaaguccugcuuaacuu

SEQ ID NO: 4036 - RNA, 64 nt, Human
aaaaggaauauaguccauuuccaaaggagcaggaacucccaaccuuaaguuaauuucacugaag

SEQ ID NO: 4037 - RNA, 64 nt, Human
ccagccugcccugugacccuugccucuuccugauacucccaagagcaggccccaggggucugug

SEQ ID NO: 4038 - RNA, 64 nt, Human
auguggccccucccccuccuucucacccuuaaggacucccaaacccauuaauaguucagacaca

SEQ ID NO: 4039 - RNA, 64 nt, Human
ggaacggcugaauuccagcugauauuagcccacgacucccaacuugccuuuuucuggacuuuug

SEQ ID NO: 4040 - RNA, 64 nt, Human
auuuccuuucaaaccucccaguaucuauaugaucacucccaacgggagguuuaagugcaacacc

SEQ ID NO: 4041 - RNA, 64 nt, Human
agagacugaagagggacaacuuuuuccuaugaggacucccaaucugccauuuguguguggcuag

SEQ ID NO: 4042 - RNA, 63 nt, Human
ccuggaaauuauagagaaaauaaacauaaucuauacucccaacaccacaaaguaacaccugcc

SEQ ID NO: 4043 - RNA, 64 nt, Human
ccuguaggggacagcaugccgucuugcuguggccacucccaagugugcccucuucccucuuuac

SEQ ID NO: 4044 - RNA, 64 nt, Human
ccccaaaucccugagccagaaguggggugcuuauacucccaaaccuugaguguccagccuuccc

SEQ ID NO: 4045 - RNA, 64 nt, Human
uuuauugauguugaaguaaggauuagaaacauagacucccaaguuuuaaacaccuaaaugugaa

SEQ ID NO: 4046 - RNA, 64 nt, Human
aauugucuagaaugaaagcuaauauaggaacaagacucccaaauccaugaaaacgcuuagugaa

SEQ ID NO: 4047 - RNA, 64 nt, Human
acacaagucuuugagugugcacuaaaagugucacacucccaaaaaacucacaaaacauuuugcu

SEQ ID NO: 4048 - RNA, 64 nt, Human
ggggagaauuugacauuuauucacuauaggacacacucccaagggaacuggugcuugcugggaa

SEQ ID NO: 4049 - RNA, 64 nt, Human
uuugguugaacagagggacagaagaauaaguaacacucccaaacacagacauacuuuuguagaa

SEQ ID NO: 4050 - RNA, 64 nt, Human
caggguuuccccauguugguuaggcuggucucgaacucccaaccucaggugauccgcccaccuc

SEQ ID NO: 4051 - RNA, 64 nt, Human
uugaucuccugacaucgugaucugucugccucggacucccaaagugcugggauuacagguguga

SEQ ID NO: 4052 - RNA, 64 nt, Human
cacuuagaguugcuuucaguaacauuuuaccccuacucccaaagguagcuuaaauagacagauu

SEQ ID NO: 4053 - RNA, 64 nt, Human
agaaccaguagucguaagauuaguugauaguuucacucccaagcaaugaauugcuucugugugu

SEQ ID NO: 4054 - RNA, 64 nt, Human
agaacauaucagaaauauauaggucccagguaauacucccaaacaucccacuuuuuacuguuuc

SEQ ID NO: 4055 - RNA, 64 nt, Human
aagacuccgcagugggugagaaugaaaacuugagacucccaaguucugggccagcccauugcuc

SEQ ID NO: 4056 - RNA, 64 nt, Human
ucaucaucauuugguaauaugaaaacuccagugaacucccaaggacauuuacaacauuuauauu

SEQ ID NO: 4057 - RNA, 64 nt, Human
aagacaauuuuguggugucauuucauccaagaacacucccaauuccuauuagaaugguagcuuu

SEQ ID NO: 4058 - RNA, 64 nt, Human
cuuggguuggaugcuaugggaauuacaacccaucacucccaaugccucccuuuccuggaggagc

SEQ ID NO: 4059 - RNA, 64 nt, Human
cuaggcagaccccagccagacccccgccagacagacucccaaccagacugaccccuuacuauuc

SEQ ID NO: 4060 - RNA, 64 nt, Human
ugaguuuuugccauguugcccagacuggucuugaacucccaaccucaagcaauccuccugccuc

SEQ ID NO: 4061 - RNA, 64 nt, Human
ugucacucacagcaaacuuggaaagaaggcuaugacucccaagaggcagugaaccauugccuua

SEQ ID NO: 4062 - RNA, 64 nt, Human
cacucucccacuucuguggucaacucccugcagaacucccaaacugccguucuuuucgauagcu

SEQ ID NO: 4063 - RNA, 64 nt, Human
agacuuguuuauaccuuccagauuugauuguuuuacucccaaugacugcacuauauguaugcau

SEQ ID NO: 4064 - RNA, 64 nt, Human
ccuuauguaagaauauuuccauauuucagugggcacucccaaccucagcacuuguccguagggu

SEQ ID NO: 4065 - RNA, 64 nt, Human
guauuaauagcuucauuucauauaaacauaaguaacucccaaacacuuauguagaggacuaaaa

SEQ ID NO: 4066 - RNA, 64 nt, Human
uuguacagaagaguacuguauuuuugaauagccuacucccaaguaagagcaaaucuguaugaua

SEQ ID NO: 4067 - RNA, 64 nt, Human
aaacucugaagccacaaagacccagagcaaacccacucccaaaugaaaaccccagucauggcuu

SEQ ID NO: 4068 - RNA, 51 nt, Human
ugguuuuugucaaggucuaagacucccaaagggccccguuugccucuccaa

SEQ ID NO: 4069 - RNA, 64 nt, Human
auaguugagaccaccuacccacaaugcagccuauacucccaagacuacaaaguuaccaucgcaa

SEQ ID NO: 4070 - RNA, 64 nt, Human
gaauuuuauauuuucagaguuuaaaauuauugcuacucccaauuuagaaaaauggggagaaagc

SEQ ID NO: 4071 - RNA, 64 nt, Human
aagugacgugacuaccagagauuucuggaaaagcacucccaaaaguaaugagauguguauggca

SEQ ID NO: 4072 - RNA, 64 nt, Human
ucccaagccaccaucuuccagcugaccagacuaaacucccaaccccagaccagggcaggggaca

SEQ ID NO: 4073 - RNA, 64 nt, Human
gucucgcuuuguuggcgcaauccucccaccucagacucccaaagugcuggaauuacaguuggga

SEQ ID NO: 4074 - RNA, 64 nt, Human
cuucuugaugccaaggggcuaauuaauauuaacaacucccaaagaaacaggcauagaaucugcc

SEQ ID NO: 4075 - RNA, 64 nt, Human
ucucuggccaggccuccaguggaagugcacaggcacucccaauguuguuaaugcucugucuucc

SEQ ID NO: 4076 - RNA, 64 nt, Human
gcuggcaggccccagagcugguggagggcaucucacucccaagugcccccccuuucugugacuc

SEQ ID NO: 4077 - RNA, 64 nt, Human
cugggcuucuagaaccaggcaacuugggaacuagacucccaagcuggacuauggcucuacuuuc

SEQ ID NO: 4078 - RNA, 64 nt, Human
ugcaccugagggggaaaaaacaguucaacugcuuacucccaaaacagccuuuuuguaauuuauu

SEQ ID NO: 4079 - RNA, 64 nt, Human
gaugugcuggcuuagacuccaaaaggauuauaaaacucccaaaguaccaguuuuccagaaaacc

SEQ ID NO: 4080 - RNA, 64 nt, Human
ucacagaugcauauagacacacauacauaaugguacucccaaacugacaauuuuaccuauucug

SEQ ID NO: 4081 - RNA, 64 nt, Human
cauaucugaggagggaggaggcuccaauacgacuacucccaauucacaggguuugugguucugg

SEQ ID NO: 4082 - RNA, 64 nt, Human
acagaagugucucagugacaaguuggaugacacuacucccaacuuuuuaaauuuggagaaaacc

SEQ ID NO: 4083 - RNA, 64 nt, Human
ccaucuuugauucacuucucuuuccuuucuauuuacucccaaaauggagucauucauccugaug

SEQ ID NO: 4084 - RNA, 64 nt, Human
cugcccuuccacccggaggccaaaggccaacuguacucccaaaggcaugggagaagguuggcga

SEQ ID NO: 4085 - RNA, 64 nt, Human
aagaggcugguucuuacgauggcacccagugagcacucccaagucuacagagugauagccuucc

SEQ ID NO: 4086 - RNA, 64 nt, Human
ccugggacuuccaugccuuaaaccuaccucccacacucccaagguuggagcccagggcaucuug

SEQ ID NO: 4087 - RNA, 64 nt, Human
uagugauagcucacacaucacaucccagaaucccacucccaaugcauuauuuccugaggcaaga

SEQ ID NO: 4088 - RNA, 64 nt, Human
aaagcuaaauaacuuuccuauguaaaaugugcugacucccaaaagaggagaaaugcaauggcuu

SEQ ID NO: 4089 - RNA, 64 nt, Human
uaucauccaagacuacucuacccugcaacauugaacucccaagagcaaauccacauuccucuug

SEQ ID NO: 4090 - RNA, 64 nt, Human
aaugccaaccuucagguucuagaagauugguugcacucccaaaccuuuauucuauuauauuacu

SEQ ID NO: 4091 - RNA, 64 nt, Human
gcacauaacuuuauauguuaguucuuuuuuccaaacucccaacucuuaaaaguauuguagucug

SEQ ID NO: 4092 - RNA, 64 nt, Human
caucauugaagcgcaaauuuucuugaauucaaauacucccaaugagcuuguauacuuccaaaca

SEQ ID NO: 4093 - RNA, 64 nt, Human
guuaacuuuugaacauguguaacuuaaccuaaauacucccaaacuuuaccucuaaauuuuuguu

SEQ ID NO: 4094 - RNA, 64 nt, Human
cuuuaacccaaaggaggaaaggacugcuucagaaacucccaauuccaaaaagcugagucugggu

SEQ ID NO: 4095 - RNA, 64 nt, Human
cgccauuagcgcaucggaaccccacacaguugcaacucccaaccccgaaucuuugcagccguuc

SEQ ID NO: 4096 - RNA, 64 nt, Human
caggguuucuccauguuggucaggcuggucuugaacucccaaccucaggugauccacccuccuc

SEQ ID NO: 4097 - RNA, 64 nt, Human
aaaauuggucuaaaauugaacauccuagauucacacucccaagucacuuaaggugauuugaugg

SEQ ID NO: 4098 - RNA, 64 nt, Human
gggcggcugccaguagaacagggcagaugccuggacucccaacucaguaggccuucuguuacac

SEQ ID NO: 4099 - RNA, 64 nt, Human
gaaucccuccugagcugugccauuuacucaggggacucccaaacagccagcugccagugcaggu

SEQ ID NO: 4100 - RNA, 64 nt, Human
gaagggaugggaaaaguggacucucauuguagugacucccaaccuaccuaauaauuuguuaacu

SEQ ID NO: 4101 - RNA, 64 nt, Human
aggccaucaauuauugggggagggagggacaaacacucccaaucauccaccagucagacugaau

SEQ ID NO: 4102 - RNA, 64 nt, Human
ccucccuucaucccaggguauccaccugcaccccacucccaaguagcuugaaaaagggaggaca

SEQ ID NO: 4103 - RNA, 64 nt, Human
ucacuggcacgcaugagcaccacccgccuccccgacucccaagagugcaccugcugcggccaca

SEQ ID NO: 4104 - RNA, 64 nt, Human
ucccugggccggcauuuguauugggguugcaaugacucccaagggccaaaagaguuaaaggcac

SEQ ID NO: 4105 - RNA, 63 nt, Human
cuucuuaaucuagguauuagaaggcaaagcaaaacucccaauggauaaaucagugccuggugu

SEQ ID NO: 4106 - RNA, 64 nt, Human
uuuuccugccucaauaucuugauauguuauguuuacucccaaucucccauuuuuaccacuaaaa

SEQ ID NO: 4107 - RNA, 64 nt, Human
uccacaaguccuccaggacagagcccucaaagcaacucccaacgaguucucaggauucaggcuc

SEQ ID NO: 4108 - RNA, 64 nt, Human
aagcccuggccuuaaagaauguuacuuaguagcuacucccaaauugucagccuucuuaccuggc

SEQ ID NO: 4109 - RNA, 64 nt, Human
uccagaaacgucuucuuaauccccaccuuuucuuacucccaaaaaagaaugaacaccccugacu

SEQ ID NO: 4110 - RNA, 64 nt, Human
auaucccaaacuucggaaacaaguuauucucuucacucccaauaacuaaugcuaagaaaugcug

SEQ ID NO: 4111 - RNA, 64 nt, Human
ccucaagcugggcucugugugaggccuggcccccacucccaaccuuggcucuagacuguuacuc

SEQ ID NO: 4112 - RNA, 64 nt, Human
ucuccgugggccacaaugccucuagcuauggugcacucccaacaugguauccuguccuuucccu

SEQ ID NO: 4113 - RNA, 64 nt, Human
ccauuuuuuucccagaucaagaugacaugacaucacucccaauucucuccaaaccccagagaaa

SEQ ID NO: 4114 - RNA, 64 nt, Human
uucuccacguccuugugaugauucugagccuggcacucccaaaucugggaagcauaguuuauuu

SEQ ID NO: 4115 - RNA, 64 nt, Human
uuaggaaaaccaaucagguuauugcauugacuucacucccaagagguagaugcaaacugcccuu

SEQ ID NO: 4116 - RNA, 64 nt, Human
gccagccuucuuccuugcucugcgcugggaucauacucccaaaucacauuacuaaaugccaaca

SEQ ID NO: 4117 - RNA, 64 nt, Human
acugcacacccugcccgcuggccccaggaccugcacucccaauccugcugucuucuccuucccu

SEQ ID NO: 4118 - RNA, 64 nt, Human
gucaaugcccaguuuugacuuuuguuagccugacacucccaaacaguuguagaauccgauagau

SEQ ID NO: 4119 - RNA, 64 nt, Human
ugguggaucaggucuuacaagcaaagaaccucacacucccaacugguaagccagaagccucuug

SEQ ID NO: 4120 - RNA, 64 nt, Human
caggguuucuccauguuggucagucuggucucaaacucccaaccucaggugauaugcccgccuc

SEQ ID NO: 4121 - RNA, 64 nt, Human
caggguuucuccauguuggucaggcuggucucaaacucccaaccucaggugaucugcccuccuu

SEQ ID NO: 4122 - RNA, 64 nt, Human
ggccucugugggcccuugucaagagcuggaggccacucccaagagccucuccuauggcagcugg

SEQ ID NO: 4123 - RNA, 64 nt, Human
aaucugucucaagucaggagguccucauucugcgacucccaaccaggguggagugggcacagac

SEQ ID NO: 4124 - RNA, 64 nt, Human
ccauguuuguccuuuucuaccucguuuuuucaccacucccaaacauaaccucccaaucuuuuuu

SEQ ID NO: 4125 - RNA, 64 nt, Human
cuaauguccucaacuguuaccaaauacccuguugacucccaaaccuaagauuuuagccucaacu

SEQ ID NO: 4126 - RNA, 64 nt, Human
uaaaaauaaguuuucagucagucaggaugacaucacucccaauguuaugcagacauacagacgg

SEQ ID NO: 4127 - RNA, 55 nt, Human
ccccagcuggagaagaaugaaaagaacucccaagaaaccaggcaggcagaagcuc

SEQ ID NO: 4128 - RNA, 64 nt, Human
ggggauaagugauuuaauauccacaaacguccccacucccaaaaguaacuauauucuggauuuc

SEQ ID NO: 4129 - RNA, 64 nt, Human
gacuccuuuccaauagaaagaaacuaaacagaaaacucccaauacaaagaugacuggucccuca

SEQ ID NO: 4130 - RNA, 64 nt, Human
gguacuucugguucccagugcccaggaaugguccacucccaagaaauucaggaaagaaagacug

SEQ ID NO: 4131 - RNA, 64 nt, Human
gcccaggggggugccagggcuuugcuuggaggcuacucccaagccuacgggacugucugccacu

SEQ ID NO: 4132 - RNA, 64 nt, Human
aucauuccaaggccaaacugcaacugagccacccacucccaaacaggaaacccuggugaagguu

SEQ ID NO: 4133 - RNA, 64 nt, Human
gaauuccuggacucaagcagucugcccaccucagacucccaaagcgguggaauuagaggcguga

SEQ ID NO: 4134 - RNA, 64 nt, Human
uggaucauaugaaacucuauuuaacccuugagggacucccaaacuguuuuccaauguggugaca

SEQ ID NO: 4135 - RNA, 64 nt, Human
uaagauagcaccauuguuuaaauaccgccuauguacucccaaaugaauaaaacauaauucuugu

SEQ ID NO: 4136 - RNA, 64 nt, Human
aaugagugagagauguuaauuucacagaagcacaacucccaacccaacccuuaggaaaagcccu

SEQ ID NO: 4137 - RNA, 64 nt, Human
cuuccauucugaucucaggguuuucacucuucaaacucccaaacacaugacuucuucccagcag

SEQ ID NO: 4138 - RNA, 64 nt, Human
uguauuagcaugagcagcguggcccuggccccacacucccaaaucugccacuccauagacccac

SEQ ID NO: 4139 - RNA, 64 nt, Human
uacauuuuauauuuucugaauuuauaaucugugcacucccaauuuuaaugacacuaaaauauua

SEQ ID NO: 4140 - RNA, 64 nt, Human
ccaaaaauaacuuuaggaaccaccauauuauaucacucccaauagcacugaccuggugaucaaa

SEQ ID NO: 4141 - RNA, 64 nt, Human
aagaagggauugacaauggaccaucuuccuaggaacucccaaguaaacuauuucaggacaugua

SEQ ID NO: 4142 - RNA, 64 nt, Human
aaggcucccuucccaagcucagugcaaaccucucacucccaaguuucuuugaggccacuugccc

SEQ ID NO: 4143 - RNA, 64 nt, Human
cuggccuugagcauccacugacuguccaagggccacucccaagaagcccccuucacgauccacc

SEQ ID NO: 4144 - RNA, 64 nt, Human
ccaggggcuuggccccaccccagcgaagccaugaacucccaagccccggccucagccuaaccag

SEQ ID NO: 4145 - RNA, 64 nt, Human
gcaacaagccaauauucaaauccagaugauuuuuacucccaaggacaauaaauccaacucaaua

SEQ ID NO: 4146 - RNA, 64 nt, Human
uuucuucccucccccaaagaauucuguuugccuaacucccaaacuguuggggugguacauuccu

SEQ ID NO: 4147 - RNA, 64 nt, Human
accuccucccccgccccaauuccaagcuccagaaacucccaacucgucugccguccagaaagcu

SEQ ID NO: 4148 - RNA, 64 nt, Human
uaaagacugcggcuuguugaggugcaauacccugacucccaaaguuaguuacaguggguuuuau

SEQ ID NO: 4149 - RNA, 64 nt, Human
accacuacugcagucgguacagaacaguuccuucacucccaauagcucucuuaugcugucccuu

SEQ ID NO: 4150 - RNA, 64 nt, Human
ccaggcgugguggcgggcacuuguaaucccagcuacucccaaggcugaggcaggagaauugcuu

SEQ ID NO: 4151 - RNA, 64 nt, Human
accaaaacuugggauuaaacacuuccuacuucccacucccaacuccugaaaugaagucuugcua

SEQ ID NO: 4152 - RNA, 64 nt, Human
aaguaugauugcuguuacauaacaccccaaauuaacucccaaauuaaaacacaguugugcuguc

SEQ ID NO: 4153 - RNA, 64 nt, Human
ccugcaaccaacuacaaccaagcucucugcaucuacucccaaguaugggguucaagagaguaau

SEQ ID NO: 4154 - RNA, 64 nt, Human
auacagucuaucaaauuugcccccuggcuuuauuacucccaauugaauuaucuaccucauuuug

SEQ ID NO: 4155 - RNA, 64 nt, Human
cugcuuaucuuguggucugaacaugacucuucaaacucccaaaacaauugaaauauuucuuuuu

SEQ ID NO: 4156 - RNA, 64 nt, Human
uguaaacaguacacaugucauuuugugauauaggacucccaaauaaaaguaucagaauaaacac

SEQ ID NO: 4157 - RNA, 64 nt, Human
agccccccagguguuucagaacaaggccucgggcacucccaagucugccucuuggcucccaccc

SEQ ID NO: 4158 - RNA, 64 nt, Human
gcacaaagugcuuugaugguugccugcuugagucacucccaaucccuuccugaagcccuuucuu

SEQ ID NO: 4159 - RNA, 64 nt, Human
uacaaccccccacccuucuccgccauucuucccuacucccaacccacucugccuucuuuuucag

SEQ ID NO: 4160 - RNA, 64 nt, Human
acuaauauuugagaaguacuguauuaaauggcaaacucccaaaacacugcagccuccugcaucu

SEQ ID NO: 4161 - RNA, 64 nt, Human
ugucugugagcucaaccuggcuaaaggcagagucacucccaaaugggucucuuuagaacuugau

SEQ ID NO: 4162 - RNA, 64 nt, Human
cuuacagcccuaaguggcugccuucuuuccaucaacucccaacuucuuccugugaaguuuaauu

SEQ ID NO: 4163 - RNA, 64 nt, Human
uugccccugcccugcucaccacccugucacagccacucccaagcccacacccacaggggcucac

SEQ ID NO: 4164 - RNA, 64 nt, Human
gcuaggguugcccuggcuggggcccggugccgagacucccaagcggcucugugcagaagagcug

SEQ ID NO: 4165 - RNA, 64 nt, Human
caggacagaagcuggguuuucugucuaggucaccacucccaauccuggggauuggagaggccug

SEQ ID NO: 4166 - RNA, 64 nt, Human
cacaugcauaguggcaucagcagcuuccuggccuacucccaaucacacugugcccugcaccucc

SEQ ID NO: 4167 - RNA, 64 nt, Human
cucccuaacccugaaaugcugugagcuugacuugacucccaacccuaccaugcuccaucauacu

SEQ ID NO: 4168 - RNA, 64 nt, Human
gagcccccacaccuggccgagccagcgcuucucaacucccaagguuugcaagcucccugcccca

SEQ ID NO: 4169 - RNA, 64 nt, Human
cagagugacaggagugaggggagagagcgaacccacucccaagauaacggccugaguccacgca

SEQ ID NO: 4170 - RNA, 64 nt, Human
uuuuguagauggcgauguguuauagacggugcucacucccaagggacagcaagugagcagagau

SEQ ID NO: 4171 - RNA, 64 nt, Human
ugcgcugucugcuguuuagaacuuuguggacugcacucccaagaagugguguuagaaucuuuca

SEQ ID NO: 4172 - RNA, 63 nt, Human
guccgauaccuggaaauuagcuuaguacacaagacucccaauuacuauuuucuuccuucccag

SEQ ID NO: 4173 - RNA, 64 nt, Human
uuuauuuuuaguuaaaucucuuaauacacagagaacucccaaucuugcucaucuaaauaaggaa

SEQ ID NO: 4174 - RNA, 64 nt, Human
acaaguagccucugggaucugccaacacacguccacucccaagccacuagcccacuccccaguu

SEQ ID NO: 4175 - RNA, 64 nt, Human
cuuuaaagccugagaacuauacaaccuuucccagacucccaagaagagaagagauuggcaaaug

SEQ ID NO: 4176 - RNA, 64 nt, Human
cucuucagaagcagcaacagggcuaguuaauucaacucccaauuguucugaaaguuuuuuuacc

SEQ ID NO: 4177 - RNA, 64 nt, Human
ucagggccuccaggcauugauuuguacagugguaacucccaaugaggcuucuguuaucauuugg

SEQ ID NO: 4178 - RNA, 64 nt, Human
cugaacacacaugccauugcgcuguccgugcccgacucccaacgccucucguucugggaggcuu

SEQ ID NO: 4179 - RNA, 64 nt, Human
uaaaauugaauucauucugaugcuugacccccauacucccaaccuuguccaguggagcccaacu

SEQ ID NO: 4180 - RNA, 64 nt, Human
cggacccgcagugacggccaguaaaguggacuuaacucccaagugugucgcgccggacaccggg

SEQ ID NO: 4181 - RNA, 64 nt, Human
acucauagucuccaaaugacuuuguauuuacaucacucccaacaaauguugauucuuaauauuu

SEQ ID NO: 4182 - RNA, 64 nt, Human
agaacuuuuuaccagauuuucaaagacaucugugacucccaaaaguuaacaaucacugaugugg

SEQ ID NO: 4183 - RNA, 64 nt, Human
guuauagcugcuuucagauuguuccauuaucuguacucccaacaacccugccggauauauuugu

SEQ ID NO: 4184 - RNA, 64 nt, Human
cucucagucauucaucaauguggccagcuuaucuacucccaauuauguuguugauacaucucca

SEQ ID NO: 4185 - RNA, 64 nt, Human
aaguuuuagugugaaagucacuaaacuuuuacacacucccaaacgucuuuuuaaaaauugcuug

SEQ ID NO: 4186 - RNA, 64 nt, Human
uuuuuaauguggguuuucuguuuccuuuuggccuacucccaagaagauauugguaagcuauuga

SEQ ID NO: 4187 - RNA, 64 nt, Human
gguacccccaaagauguucccuguaggucacggcacucccaaaagcacacaagcacauacagac

SEQ ID NO: 4188 - RNA, 64 nt, Human
aagauaguauuuccaaacuguuauauacccaucuacucccaacauggauauaaguuuuuuaaaa

SEQ ID NO: 4189 - RNA, 64 nt, Human
uugaacuuugcagaucucuguucucucaagcagaacucccaaccagauccauucuugaccagug

SEQ ID NO: 4190 - RNA, 64 nt, Human
uaaacgaauacaccaaaaggaggcgcucuuaauaacucccaauguaaaaaguuuuguuuuaaua

SEQ ID NO: 4191 - RNA, 64 nt, Human
auguuuuaacuuuuuaaucagacuauacauuuacacucccaaauugcaggcuuuauuuaaagga

SEQ ID NO: 4192 - RNA, 64 nt, Human
ccucugugccccucaugcugaucuucuagaugccacucccaaauccccuucauacccaccagga

SEQ ID NO: 4193 - RNA, 64 nt, Human
ggucaauauuaauaacacugaaacaggaaaucuaacucccaauauuggaauuuugguacuuuuu

SEQ ID NO: 4194 - RNA, 64 nt, Human
ggcaacaacuuugaaaaacuugcucucuuucaauacucccaaugaagauacauuucacucaccc

SEQ ID NO: 4195 - RNA, 64 nt, Human
guucucuuguauaccugcucagucaguuccuuucacucccaauuguuggcagccauugauagga

SEQ ID NO: 4196 - RNA, 58 nt, Human
gagccgccucuccaaaauaaccggccacacucccaaacuccaagacagccauacuucc

SEQ ID NO: 4197 - RNA, 64 nt, Human
agacauuagacuggccauagaaaaguaagcuugaacucccaauugaugugaccacacucuucuu

SEQ ID NO: 4198 - RNA, 64 nt, Human
aggaaggggauaacucagaggaacagacacucaaacucccaaagcgcaugauugcugggaaaca

SEQ ID NO: 4199 - RNA, 64 nt, Human
gacagggcaaacuaaaugcaucccuucuuaccuaacucccaaccccugcccugggcugaggcau

SEQ ID NO: 4200 - RNA, 64 nt, Human
agauugugucaagucaggugugcaaauugaccacacucccaaagaaucauuuaaaaguaaagug

SEQ ID NO: 4201 - RNA, 64 nt, Human
ugaggcucagauaaguccaaaugaaaugaaaucaacucccaagcccuaaagagaaccuucucac

SEQ ID NO: 4202 - RNA, 64 nt, Human
uccaguuccuuuagaaaaaauggaugcccagaggacucccaacccuggcuuggggucaagaaac

SEQ ID NO: 4203 - RNA, 64 nt, Human
cgccugucagugaccauccuaaugccucucgcucacucccaagccaccauuugagagggagggg

SEQ ID NO: 4204 - RNA, 64 nt, Human
gugcugcugugcccacagcacaaagccaggcuucacucccaaaagugcagccaggcccuggagg

SEQ ID NO: 4205 - RNA, 64 nt, Human
cugggccgugccugcccuccaccuugagugccauacucccaacagcuccagguacccaccgggg

SEQ ID NO: 4206 - RNA, 64 nt, Human
gugaucuggccacuggggacccccacccgaccccacucccaaugaugaggggcauuuucauugc

SEQ ID NO: 4207 - RNA, 64 nt, Human
gaaagguuucuucccuuccaguucgaauuuggaaacucccaaaguucucaaugguuuguuguga

SEQ ID NO: 4208 - RNA, 64 nt, Human
uauuauaaugugaaaagguaucuacucuauuuacacucccaaauagcgccauacaugcuaaacc

SEQ ID NO: 4209 - RNA, 64 nt, Human
auuuccacaccggguccgugcagaggaaacagaaacucccaacuguccuuacccaccgacauca

SEQ ID NO: 4210 - RNA, 64 nt, Human
ucugagaccagcgucuuccaucucucagagccuuacucccaaaguaccugcucacuguuccgug

SEQ ID NO: 4211 - RNA, 64 nt, Human
caggucugugagaacuccugacgucugaagcuugacucccaaguuuccauagcaacaggaaaaa

SEQ ID NO: 4212 - RNA, 64 nt, Human
caucuuccacuuuauuggcaguugacauucccuuacucccaaucaacacucuuaaauauuugua

SEQ ID NO: 4213 - RNA, 64 nt, Human
cauccccacccauagggcuggcucacauccagucacucccaacagcguccagcacacaaauaaa

SEQ ID NO: 4214 - RNA, 64 nt, Human
ggaaggcagggcgcagugguugaaacaucaggacacucccaaggccccggcucugaacaagacc

SEQ ID NO: 4215 - RNA, 64 nt, Human
gagaaagucaccgaaaugggugccgccggcccccacucccaauucauucccuaaccugcaaacc

SEQ ID NO: 4216 - RNA, 64 nt, Human
ccaccccuuucacuccauccccugcuccaggcucacucccaaaacagacccaggcagccccacc

SEQ ID NO: 4217 - RNA, 64 nt, Human
gccccucuacucauccaacucccucuucacugguacucccaaucaaucaaagaaccucaaaauu

SEQ ID NO: 4218 - RNA, 64 nt, Human
gaggacccuuacgugagaaauagcugaaaagggcacucccaacccugggcuggggaggaggaga

SEQ ID NO: 4219 - RNA, 64 nt, Human
gugccaaacuggguagguggauuugagcggaaagacucccaaaaugugccaagaauuucccagu

SEQ ID NO: 4220 - RNA, 64 nt, Human
uguuauuauauaauuacauauuugcauauguaugacucccaaauuuucacauaaaauagauuuu

SEQ ID NO: 4221 - RNA, 64 nt, Human
uuguggcauuuuagacucguugaguuucuugggcacucccaagggcguuggggucauaaggaga

SEQ ID NO: 4222 - RNA, 64 nt, Human
agcagauggaguaauggucacgagguccagacccacucccaaagcucagacuugccaggcuccc

SEQ ID NO: 4223 - RNA, 53 nt, Human
gccagccuucuugcugcuaaucaacucccaagagaacuaccauccucacacaa

SEQ ID NO: 4224 - RNA, 64 nt, Human
agaauucagcugcccccgcucaugggccccucugacucccaaagagcugccuaagaggcaauga

SEQ ID NO: 4225 - RNA, 64 nt, Human
agaggcaaugaguguguuggcuugugaucugggaacucccaagaacagcaggcccaccuaccuu

SEQ ID NO: 4226 - RNA, 64 nt, Human
ccaauaauauuuccaccggggaugcaucauuuuuacucccaauauucuguagagagggagucag

SEQ ID NO: 4227 - RNA, 64 nt, Human
gguccaacucagacuugaaagacugcaauagaaaacucccaaacccagcacuccagacucgagg

SEQ ID NO: 4228 - RNA, 64 nt, Human
aggagggggccaccauugccgcaucuacuucuagacucccaaaggagcccaggcucaggcaggc

SEQ ID NO: 4229 - RNA, 64 nt, Human
aagacagccuuuuccaguggccauccuaaggggaacucccaaauggguguugcugguggacaca

SEQ ID NO: 4230 - RNA, 64 nt, Human
accacaacccaccacggccaggcagagaagggcaacucccaagagccacugcacuguguaacca

SEQ ID NO: 4231 - RNA, 64 nt, Human
auuauccauaucaucucagugaaccuacugguggacucccaauugacaagauugagcaauagaa

SEQ ID NO: 4232 - RNA, 64 nt, Human
uagacacuggaauaacagcacagaaaaaucuaugacucccaauaucuucuagaauaaagaauuu

SEQ ID NO: 4233 - RNA, 64 nt, Human
gccacugguguucagcuccuucucuucccccaacacucccaaagauacccacaggaaguccagc

SEQ ID NO: 4234 - RNA, 64 nt, Human
gaauguuucacccugaucuuaugggaggaaucaaacucccaaaauaguguguauauauguaaua

SEQ ID NO: 4235 - RNA, 64 nt, Human
ucgcuauauucaagauaaugaaccuaucuaucauacucccaaauuccuucuugcaucuuuguaa

SEQ ID NO: 4236 - RNA, 64 nt, Human
uuuagaacucuucauguuaaagacgugguuuaguacucccaaugcuguguaucaugacacuauc

SEQ ID NO: 4237 - RNA, 64 nt, Human
uguauauucauauauuuuggauacgcaccccccaacucccaauacuggcucugucugaguaaga

SEQ ID NO: 4238 - RNA, 64 nt, Human
cacaccgagggcgaccccgucacagccucaagucacucccaagcccccuccuugucugugcauc

SEQ ID NO: 4239 - RNA, 64 nt, Human
uccucacagaaguaccugaaacuaggucuggggcacucccaaugcagcgccuugucagccaagg

SEQ ID NO: 4240 - RNA, 64 nt, Human
ggugguaaagacacuuguggggugagucaucccuacucccaacaucuggaggggaaaggugagu

SEQ ID NO: 4241 - RNA, 64 nt, Human
uuuucccgaccucuccuuuucauuggucccucucacucccaaaugacuccuccccuucguuggc

SEQ ID NO: 4242 - RNA, 64 nt, Human
ggcuggggcccccacccauucccccucccuccaaacucccaacccccagucaguguuugagccu

SEQ ID NO: 4243 - RNA, 64 nt, Human
caaacuccugaccucaagugauccacccaccuugacucccaaagugcugaaauuacaggcauga

SEQ ID NO: 4244 - RNA, 64 nt, Human
ggguggguggggaugccuguuuacacuagcgcugacucccaacggugacggcucccuuccccac

SEQ ID NO: 4245 - RNA, 64 nt, Human
accuugcuucacaucacaaggcaaggugaacucaacucccaauaaacugcuugcuggagccucc

SEQ ID NO: 4246 - RNA, 64 nt, Human
uucacauguggcacugaccgcgucacauccacgcacucccaaaggccagaaguaucugaccgac

SEQ ID NO: 4247 - RNA, 64 nt, Human
auuucugaguucuaagaccaagucuccaucugagacucccaaauugcuccccaccucccauccc

SEQ ID NO: 4248 - RNA, 64 nt, Human
cccccagccugagcccugguggcccuggccccccacucccaaugagcagcccaggccugggcaa

SEQ ID NO: 4249 - RNA, 64 nt, Human
cagagguacagcugcugaaagugucggagaugaaacucccaaaggugccagagauggcugugcc

SEQ ID NO: 4250 - RNA, 64 nt, Human
cagagguagagcugcccaaagugucagagaugaaacucccaaaggugccagagauggcugugcc

SEQ ID NO: 4251 - RNA, 64 nt, Human
cagagguggagcuccccaaggugucagagaugaaacucccaaaggugccagagauggcugugcc

SEQ ID NO: 4252 - RNA, 64 nt, Human
uggcccaggagcucaggaucccuggggcuggggaacucccaacuucgugcccuagauccugcac

SEQ ID NO: 4253 - RNA, 64 nt, Human
gucugggucucuggcgcccccaugugguugcgacacucccaaagccguaagggccgacccaggc

SEQ ID NO: 4254 - RNA, 64 nt, Human
ucugucucugugacuguaaauccugcccugccccacucccaauaaaagcuuugguguauaggcu

SEQ ID NO: 4255 - RNA, 64 nt, Human
gagcucuaaucucugugauuacaugguccuucaaacucccaaccaaagugagaaaagcggcaug

SEQ ID NO: 4256 - RNA, 64 nt, Human
cagugcccggcacgagcugaaccucauguguuccacucccaauaaaagguugacaggggcuucu

SEQ ID NO: 4257 - RNA, 64 nt, Human
agcagcugcuaacccuugcaccagcccuugugggacucccaacacaagacaaagcucaggaugc

SEQ ID NO: 4258 - RNA, 64 nt, Human
cugccgcaauggcugugggaagguguccugugucacucccaauuucugagguaagugaacggga

SEQ ID NO: 4259 - RNA, 64 nt, Human
uuuugcagugcuugccaauuucucuaguguaauaacucccaaccugaccaauuucacacugcca

SEQ ID NO: 4260 - RNA, 64 nt, Human
uugagguucucuauugccucuugaauacaaaugcacucccaaagugguuuuaagaaaauaaaaa

SEQ ID NO: 4261 - RNA, 64 nt, Human
gaagagagaaauguuucacgcaagcagucccccaacucccaacacacacucccuuucauuccga

SEQ ID NO: 4262 - RNA, 64 nt, Human
cugugucucuccaucccuuaguaaaaauacagcaacucccaacucaaagucaagggucaauagu

SEQ ID NO: 4263 - RNA, 64 nt, Human
ucaucaccacucgggggcaccgggccgcccacccacucccaaaauccgucaguauucacuggac

SEQ ID NO: 4264 - RNA, 64 nt, Human
uucugaucaccugacagggcaccccaaacccccaacucccaauaaaagccgugacguucggaca

SEQ ID NO: 4265 - RNA, 64 nt, Human
acagcuggccuucaguuucuccuucuugcauuugacucccaagccuacaggauuucauuuugcc

SEQ ID NO: 4266 - RNA, 64 nt, Human
ggcucccucgacucuggggcacggaaccccgcccacucccaauccccgcgccccgcccucuccc

SEQ ID NO: 4267 - RNA, 64 nt, Human
cuucagggguccuucuaagcaucauccuguuggaacucccaaaagucaucccagugccauucug

SEQ ID NO: 4268 - RNA, 64 nt, Human
uuuauuuucagcaaugaaacugaaauuuagccuuacucccaaguuauaaaugcuggcaacaaau

SEQ ID NO: 4269 - RNA, 64 nt, Human
gucugaaggaccauaucuuacagaaggugcacauacucccaagggccacucuugcccuggagau

SEQ ID NO: 4270 - RNA, 64 nt, Human
cccagaggcaccccaugaagcuuuuuucucguucacucccaaacccaaguguccaaggcuccag

SEQ ID NO: 4271 - RNA, 64 nt, Human
uucugaccuugugaacaucagaagguauuuuuuaacucccaagcaguagcaggacgaugauagg

SEQ ID NO: 4272 - RNA, 64 nt, Human
gauuguggugggguggggauccuugggaagaauuacucccaagaguaacucucauuaucuccuc

SEQ ID NO: 4273 - RNA, 64 nt, Human
cuaagcugucccucucccaaucucuggauauuugacucccaaccuucccccuaccuccuggccc

SEQ ID NO: 4274 - RNA, 64 nt, Human
aggcaccccacuuccagugaagaaguccuccgcaacucccaaacaagccucgcuugcuggccgc

SEQ ID NO: 4275 - RNA, 64 nt, Human
gacuuuucuguuaagccuaucagaagaaagagcaacucccaaauagguuuuauuuucuuaagag

SEQ ID NO: 4276 - RNA, 64 nt, Human
uaucucagauauuugcacccccaaucugcccccaacucccaaaagcuagaacacugccaacuga

SEQ ID NO: 4277 - RNA, 64 nt, Human
gaggcagaagccagacuaauuuucaugccuccugacucccaaucaguuucacaaagggauucaa

SEQ ID NO: 4278 - RNA, 64 nt, Human
uuuuaaugugagguuuucuguuucuuuuuugccuacucccaagaagauauugguaagcuauaga

SEQ ID NO: 4279 - RNA, 64 nt, Human
gccagcaccagccucgggagcugcugagccaccaacucccaaagccagccugccuccagcuuua

SEQ ID NO: 4280 - RNA, 64 nt, Human
uagugcagcagggcaguagcgguaccaaugcagaacucccaagacccgagcugggaccaguacc

SEQ ID NO: 4281 - RNA, 64 nt, Human
gucuacagcucccccagcuccccccaccucccccacucccaaccacguugggacagggaggugu

SEQ ID NO: 4282 - RNA, 64 nt, Human
cuggcgcccggcggcagcugcccagaaacuuccugggagaaagagcccucgggcugccuucccc

SEQ ID NO: 4283 - RNA, 64 nt, Human
cagguaugaaagaaaacaggcaaggaggcacugagggagaaagacacagacuuuaucgcucugu

SEQ ID NO: 4284 - RNA, 64 nt, Human
gggcucugcuccaaguucccuagcgggccccucagggagaaauagccucacgugcaaucugggu

SEQ ID NO: 4285 - RNA, 64 nt, Human
ugcuccucuccaucugguguggaaacacugcccagggagaaaggaggaagcucacuguggacag

SEQ ID NO: 4286 - RNA, 64 nt, Human
agucuuugcagagaaccucagaucaggugcaccugggagaaagacuuuguccccacuuacagau

SEQ ID NO: 4287 - RNA, 64 nt, Human
ggaguuggauaaugugaaaauuuuaaguaccuaggggagaaagagccauguaaauaucuguaau

SEQ ID NO: 4288 - RNA, 64 nt, Human
gcucagggaaugccagccaccuuguaaaacugcugggagaaaagcaugauucccacaaggacua

SEQ ID NO: 4289 - RNA, 64 nt, Human
cagcugggaauggcagccacagaggguccccucugggagaaacagcuucaccccagccucaggg

SEQ ID NO: 4290 - RNA, 64 nt, Human
ugggguggaagggugauggggagcuaaugaacuagggagaaaaacuuuccaugugugcgguauc

SEQ ID NO: 4291 - RNA, 64 nt, Human
cgguauauuccagaggugggaggugggaggggaagggagaaauccaaaacaaaguguucuugcu

SEQ ID NO: 4292 - RNA, 64 nt, Human
aaaagcaauggcaagugcucuccaauaaaguagggggagaaagcaaacccaaaaacccgcuucu

SEQ ID NO: 4293 - RNA, 64 nt, Human
augaaaauuguguaaaauuacauuuuuuuuccaggggagaaaaaaacaucaaacaaaaacaucu

SEQ ID NO: 4294 - RNA, 64 nt, Human
acuuaagcugccucaaggaauuuuuuuaacuuaagggagaaaaaaagggaucuggggauggggu

SEQ ID NO: 4295 - RNA, 64 nt, Human
uugcuccacagggcccuguugaauuuuguucucugggagaaaaucaucaagaagggcugcauga

SEQ ID NO: 4296 - RNA, 64 nt, Human
guaggcauaauucagcaacaaacaaucuuccuuugggagaaaccuguucauuccaaucuucuaa

SEQ ID NO: 4297 - RNA, 64 nt, Human
cccagcgcaguuacaacuucacuaucagcggaaggggagaaaaaccgauucaaaucaacuugua

SEQ ID NO: 4298 - RNA, 64 nt, Human
uaaauuucuuauugccaaaagaacguguuuuauggggagaaacaaacucuuugaagccaguuau

SEQ ID NO: 4299 - RNA, 64 nt, Human
uuaggaugaguaaaaacaagaaaauuuggggagggggagaaagaagaaagggauugcugucucc

SEQ ID NO: 4300 - RNA, 64 nt, Human
gcuaaacguuggugaaaguuauaaccuccugccugggagaaaauauacaucaccuaaaaugaac

SEQ ID NO: 4301 - RNA, 64 nt, Human
gaauaaauaauuccuucuuauuaagaagaaguaagggagaaaguuuuuagaaagugauuuuuau

SEQ ID NO: 4302 - RNA, 64 nt, Human
auauucccuuuuaacuuaaaaaaauuguaaaugugggagaaaaaacccugcaggauggaaacaa

SEQ ID NO: 4303 - RNA, 64 nt, Human
cugacaccucacaccuuaucuaagucugaagcuggggagaaagggguucauuuagacuucauac

SEQ ID NO: 4304 - RNA, 64 nt, Human
auggacggauggggugggggaaggaaggaaaggagggagaaaggagggaauacuggcuccaucu

SEQ ID NO: 4305 - RNA, 64 nt, Human
ucaucucucccuucuguuuuaugugauuuguuuggggagaaagcuaaaaaaaccugaaaccaga

SEQ ID NO: 4306 - RNA, 64 nt, Human
cagcaguguucuuccccucagagugacuuggggagggagaaauaggaggagacguccagcucug

SEQ ID NO: 4307 - RNA, 64 nt, Human
gucggggagcuuggggccugguguuccauggagagggagaaaggaacaagcuugaccaauucau

SEQ ID NO: 4308 - RNA, 62 nt, Human
gugacagccucguggacuaaaguucccagugugggagaaaggagcuaguuugcaauaaaaac

SEQ ID NO: 4309 - RNA, 64 nt, Human
uaacauaaaagaguggaacuauccaaaagagacagggagaaauaaauaaauugccucccuuccu

SEQ ID NO: 4310 - RNA, 64 nt, Human
uccucucgccguguugugagggcaaaggagagaagggagaaaaaaaaaaaaaaaccacacacac

SEQ ID NO: 4311 - RNA, 64 nt, Human
uugucucuauaauagaauucuguuuauagaauaagggagaaaauaauccagucuucacuggguu

SEQ ID NO: 4312 - RNA, 64 nt, Human
agaacagucuguaguauuugaaggguuugggggagggagaaaauauuaaugggaaaggcauuca

SEQ ID NO: 4313 - RNA, 64 nt, Human
cuuccuguuuccuuauugcuaccaaggaccagcagggagaaaugucuucucccagcagugaauu

SEQ ID NO: 4314 - RNA, 64 nt, Human
gaaaaggauggaagcaugagggagggagggaggagggagaaaaacagaauccagccgcuuaggc

SEQ ID NO: 4315 - RNA, 64 nt, Human
aggggcguauuaacgguccuuugcuuccccgcaggggagaaaaagcuugacgaacuucacagaa

SEQ ID NO: 4316 - RNA, 64 nt, Human
ucuuugacgccacagugggacuagccaggaaugagggagaaaugcccuuucuggcaauuguugg

SEQ ID NO: 4317 - RNA, 64 nt, Human
agauaccaaauacaagauuuuaaaagcaaccauggggagaaaaagaucagugaaagcaagacag

SEQ ID NO: 4318 - RNA, 64 nt, Human
gaaauauaugcuauaucaguuuuuacuuucucuagggagaaaaauuaauuuacuagaaaggcau

SEQ ID NO: 4319 - RNA, 64 nt, Human
aauugcauggaucaaguaagcauaguuuuauccagggagaaaaauaaaaggaagccauagaauu

SEQ ID NO: 4320 - RNA, 64 nt, Human
ccugaugcugcugccaugguggcuuggggcagcggggagaaaggaguguccuugaggccuagga

SEQ ID NO: 4321 - RNA, 64 nt, Human
uaagcaagagaagaguuggacuuccaggcugaaggggagaaagugacucuguucucuuagcaac

SEQ ID NO: 4322 - RNA, 64 nt, Human
guuaacgcuggcuguggaaaccccaguucuuggggggagaaacaggacuuuuuacauaaaauag

SEQ ID NO: 4323 - RNA, 64 nt, Human
aaagcgagccuccaggcccagcaaugagggacuugggagaaaucugagaagaauggguuguucu

SEQ ID NO: 4324 - RNA, 64 nt, Human
gcagguucugcuugcaaagaggccucaguccagugggagaaacagaccugggcgcaaacaacuc

SEQ ID NO: 4325 - RNA, 64 nt, Human
uccagacuguaagauguuguuuuaggggcuaaaggggagaaacugaaaguguuuuacucuuuuu

SEQ ID NO: 4326 - RNA, 64 nt, Human
acagaguggcagacagcauggcucucacagcacagggagaaaaacugagguacacagagguacc

SEQ ID NO: 4327 - RNA, 64 nt, Human
ccuucuuugaugccaaccccaacagacccguagggggagaaaagggaggaaaaaaguaauuuua

SEQ ID NO: 4328 - RNA, 64 nt, Human
ucaucagacacaggcugugcucucagucuagugagggagaaaagacacacaguagcagaagaga

SEQ ID NO: 4329 - RNA, 64 nt, Human
uugagaagugcugcuguaauuccccuuaaaggacgggagaaagggccccggccaucuugcagca

SEQ ID NO: 4330 - RNA, 64 nt, Human
uuagcacacucagcgcugugagucgugaagacacgggagaaaauccaccauaauaaaacugaca

SEQ ID NO: 4331 - RNA, 64 nt, Human
auuaauuuucaaggggaaaaaaccugagaagaaagggagaaaagaccaugaaauuuaccagaua

SEQ ID NO: 4332 - RNA, 64 nt, Human
uggacagagcagcccuuggguuuguaucugguaggggagaaagcagcaggacaguggaggugug

SEQ ID NO: 4333 - RNA, 64 nt, Human
cccagaggcuggcagagggaaagggguacacugagggagaaaggaaaaggaaacuucaaacaau

SEQ ID NO: 4334 - RNA, 64 nt, Human
gggaagccagccaugguaagggcuggugagguuggggagaaaggaagagcuuuauguuucucug

SEQ ID NO: 4335 - RNA, 64 nt, Human
ccucaagcccaggugacucugugaggucugcagagggagaaaagaacccacaagggaagaggug

SEQ ID NO: 4336 - RNA, 64 nt, Human
uacauacggggaaacugaagccaggagaagaagagggagaaacuguccagggccucacagggag

SEQ ID NO: 4337 - RNA, 64 nt, Human
ucuaccugucuccuacccaccuguaucucuuguugggagaaaagcugaguguugggagaagcug

SEQ ID NO: 4338 - RNA, 64 nt, Human
gaacagauuacuaaggccaucuccucaucucuaagggagaaaaauagucuguagaugaauaaug

SEQ ID NO: 4339 - RNA, 64 nt, Human
gaauucaggcuguuggccagguaauugcugcagagggagaaauaagacagacagauacagucau

SEQ ID NO: 4340 - RNA, 64 nt, Human
auuaaguuaaacacuuagaguugaguauauucaggggagaaaagugaaugaaaugacucauaau

SEQ ID NO: 4341 - RNA, 64 nt, Human
gcagauuugucaaagccagugacuagagaaggaagggagaaaggcuggcuguuggcuugcucug

SEQ ID NO: 4342 - RNA, 64 nt, Human
aucauugauauucccaguggugcccguggaaagagggagaaagagaagcugaacaggagaaaga

SEQ ID NO: 4343 - RNA, 64 nt, Human
aaagugcaaaggacaaacaucucaauuguaugaagggagaaaggagaauugaaagaagaacugg

SEQ ID NO: 4344 - RNA, 64 nt, Human
uggaggaaaaacauguuggcuuuucucuugacgugggagaaauugaaaagaaggggaaggggaa

SEQ ID NO: 4345 - RNA, 64 nt, Human
agaauagaacuauuggggugaggauaaggggugggggagaaaaaaucacuguuuguuuuuaaaa

SEQ ID NO: 4346 - RNA, 64 nt, Human
ugcacaccuuccccauaaaauuuggagguggggugggagaaagagcuaaaaucaggcucaguuc

SEQ ID NO: 4347 - RNA, 64 nt, Human
accugagggagacaacggcagagggagugagcaggggagaaauagcagaggggcuuggaggguc

SEQ ID NO: 4348 - RNA, 64 nt, Human
acucuccuuuuauguggucucuuuggggccgauugggagaaagagaaaucaauagugcaacugu

SEQ ID NO: 4349 - RNA, 64 nt, Human
uucuauaguucuccuggcagagccuuugagaauggggagaaacagccugggcuggggcuacagg

SEQ ID NO: 4350 - RNA, 64 nt, Human
gcccuuucugggcaccggggccucggacuuagcugggagaaagagagagcuucuguugcugccu

SEQ ID NO: 4351 - RNA, 64 nt, Human
cuucccuacugacaaguucuuugguauuucaaaagggagaaaccacuauaaaagacaagaggaa

SEQ ID NO: 4352 - RNA, 64 nt, Human
gaacaugaaaaccuccacagcaacaucgaaaccagggagaaagugauccuugcucccugcagaa

SEQ ID NO: 4353 - RNA, 64 nt, Human
gcauuuuauuuauaaaaauacagacagaaaauuagggagaaaccucuaguuuugccaauagaaa

SEQ ID NO: 4354 - RNA, 64 nt, Human
auaacugaacuacagcaaaaggcagagaauuacagggagaaaaaacuuguacuuaccagcccaa

SEQ ID NO: 4355 - RNA, 64 nt, Human
gcuggaugguauauucugugucauuuuucuucaugggagaaacagcccacagagcucaccaaca

SEQ ID NO: 4356 - RNA, 64 nt, Human
auaaauaauugaaaaaaauuuucuuuugggaagagggagaaaaugaaauaaauaucauuaaaga

SEQ ID NO: 4357 - RNA, 64 nt, Human
uagagggaacacucccacagccaaaagaaugagugggagaaauggaggggacaaucuccuggga

SEQ ID NO: 4358 - RNA, 64 nt, Human
guuguuucuacuuuucucugccuagcacaaaauugggagaaaacuggagccuccauccgcaguc

SEQ ID NO: 4359 - RNA, 64 nt, Human
uaguaggaacaugagaugugacauucuaaaucuugggagaaaaaauaauguuaggaaaaaaaua

SEQ ID NO: 4360 - RNA, 64 nt, Human
caacuaguaacucaaugaaaaaguugaugcccaagggagaaaugagaauuagcuuaauugcugc

SEQ ID NO: 4361 - RNA, 64 nt, Human
aaauucuuccauugugggguagguggucggggaugggagaaagggaaaagucagggaaggggag

SEQ ID NO: 4362 - RNA, 64 nt, Human
uuucuuuccuuugaaacugguaagguuaaaauaggggagaaauccuacauguuggaaugauagc

SEQ ID NO: 4363 - RNA, 64 nt, Human
agggaauucagagaauuugguagcacaguguauugggagaaagggaaauuucgggugacagauu

SEQ ID NO: 4364 - RNA, 64 nt, Human
uuuuuuuuuuuuuuuuuuuuuuuuuuuuuuuggagggagaaaacugaugucuucuaugcauccg

SEQ ID NO: 4365 - RNA, 64 nt, Human
gaggauuuugaaaacaucagauuugcugugguaugggagaaaaggcuauguacuuauuauuuua

SEQ ID NO: 4366 - RNA, 64 nt, Human
agccccguuuccagggcauccgcagcccaggguagggagaaauauucucuccacuuugggggag

SEQ ID NO: 4367 - RNA, 64 nt, Human
ccuguaacuucuaucuguucuuuuuugaggcucagggagaaacuagcauuuuuuuuuuuccaaa

SEQ ID NO: 4368 - RNA, 64 nt, Human
uaagcccauauacucugcacuguguaaaggaaaagggagaaauguauuauacuugagacauugc

SEQ ID NO: 4369 - RNA, 64 nt, Human
gguguugggaagaaaaauuggucagcuuggcucggggagaaaccugguaacauaaaagcaguuc

SEQ ID NO: 4370 - RNA, 64 nt, Human
gauuucugcucacuggcaggagacugcgaugacugggagaaaaccugcacucgguggcaccuac

SEQ ID NO: 4371 - RNA, 64 nt, Human
cacaaauuuucaacaaucauuguagaaacuaagggggagaaaguaaucucaguuguuuuagaaa

SEQ ID NO: 4372 - RNA, 64 nt, Human
uaugguauggaaugacuuggaauguaagcugucagggagaaaauguuguuacacuuuugcuaag

SEQ ID NO: 4373 - RNA, 64 nt, Human
cuuuguaugagagaggucaaaggguugguuuccugggagaaauuaguuuugcauuaaaguagga

SEQ ID NO: 4374 - RNA, 64 nt, Human
ccaccccagaggccaccuuuugcuccacggaggugggagaaaaucugggcacauggggcccccu

SEQ ID NO: 4375 - RNA, 64 nt, Human
cauuucuuaugauuuuuaaaaguugcuaguacuggggagaaauaauuguugauuaauuugagaa

SEQ ID NO: 4376 - RNA, 64 nt, Human
auguuuuuauuuugcugagcaaaauaaagccaaugggagaaagacuauuuuacccuuugcuuuu

SEQ ID NO: 4377 - RNA, 64 nt, Human
uuaacuuaauuugggggauuaacacuuuugcugagggagaaaaagaaaacauacauuaugaagc

SEQ ID NO: 4378 - RNA, 64 nt, Human
acuguucaaacgcacuguuuacuuuaagcgcacggggagaaacgaauaaggaggacguggugau

SEQ ID NO: 4379 - RNA, 64 nt, Human
cauaaugaucaguaugcugugccagcuucauuuggggagaaauaacuaguagaaaguucugggu

SEQ ID NO: 4380 - RNA, 64 nt, Human
acuaccaucagagugaacaggcaaccuacaaaaugggagaaaauuuucgcaaccuacucaucug

SEQ ID NO: 4381 - RNA, 64 nt, Human
caagaaguaauaauuuguuuacuuguaaauugaugggagaaaugaggaaaagaaaaucuuuuua

SEQ ID NO: 4382 - RNA, 64 nt, Human
uucacgggaaggguuggugugcuggcuuuagacggggagaaacaucuggaaggaugcucgagag

SEQ ID NO: 4383 - RNA, 64 nt, Human
caagcuucuuuuggauuagagggggauuuuugaugggagaaagcuggagaucugaacccagccc

SEQ ID NO: 4384 - RNA, 64 nt, Human
uuuccccagaacauuguagauggggguuggcagagggagaaauaagccagccacggcagucgcu

SEQ ID NO: 4385 - RNA, 64 nt, Human
aguagacuccaagugcugcgguugauuccagugagggagaaagugaucugcagggagguggaca

SEQ ID NO: 4386 - RNA, 64 nt, Human
uggaggaacgaaggcgagguuccuccuugcuuuggggagaaaaguauucaggaagugggugugu

SEQ ID NO: 4387 - RNA, 64 nt, Human
auaaagcaccuggcaaagcauuuuaccuguuagggggagaaaaaugcaauaauauguuaaauau

SEQ ID NO: 4388 - RNA, 64 nt, Human
cauacuuacguguugucacuggauuaucauaaaagggagaaauuaaauauuacuguacucuuag

SEQ ID NO: 4389 - RNA, 64 nt, Human
guacagguauugauuaaagacggcuguuccaaaugggagaaauuggccaaaauaaagggguuac

SEQ ID NO: 4390 - RNA, 64 nt, Human
agccacaaagccgguaaaugccucaauacguucugggagaaaacuuagcaaauccaucagcagg

SEQ ID NO: 4391 - RNA, 64 nt, Human
gugagugaguguauguguuuaaaggaaacaaaaugggagaaauaaguuuuaaaaaaauccucau

SEQ ID NO: 4392 - RNA, 64 nt, Human
auuaggaugucgcuggccuuugcucaccucagaggggagaaaaggcuaaagauuugcaguuuga

SEQ ID NO: 4393 - RNA, 64 nt, Human
uuaaaauuauugcuacucccaauuuagaaaaauggggagaaagcuggaagaacaaaugacaugc

SEQ ID NO: 4394 - RNA, 64 nt, Human
ggacaaugacguugaaacgcagcauuuuugaaaagggagaaagacucggacaggugcuaucgaa

SEQ ID NO: 4395 - RNA, 64 nt, Human
gcaccgccgccgucgucucccggccccucgcugggggagaaagcaucugcuccaaggagggagg

SEQ ID NO: 4396 - RNA, 64 nt, Human
ugcacuuuucuuuuuuauaaaaaaagagagaugggggagaaaaaagacaagagggaaaguauuu

SEQ ID NO: 4397 - RNA, 64 nt, Human
ugauagaauuuuagcuccugagauauuuacaacugggagaaaugucuauuuagguguuuacauu

SEQ ID NO: 4398 - RNA, 64 nt, Human
gaaaguauaaaugaaugggccaugaguguucagagggagaaaagaaagguuuaauauacuccuu

SEQ ID NO: 4399 - RNA, 64 nt, Human
gucaugugugcaucaugucucuuugccaagggaggggagaaaggaacuuuuaaacugcaguuuu

SEQ ID NO: 4400 - RNA, 64 nt, Human
cacuauugggguuucccaggauggauuggucagggggagaaaggaaaaggcaaaacacuccagg

SEQ ID NO: 4401 - RNA, 64 nt, Human
cacagggacgugacagagcuaucauuaugcacuugggagaaaauuaagggccgauuuaauuaaa

SEQ ID NO: 4402 - RNA, 64 nt, Human
cuggcugugagucagagagagagaggauggacgugggagaaagcaagcaaaagcuacccuaggg

SEQ ID NO: 4403 - RNA, 64 nt, Human
ucuggagggacagucaucauguuuugauuuaucugggagaaaacuguggugcacagcuugugag

SEQ ID NO: 4404 - RNA, 64 nt, Human
uccccugauauccaaccgugauuuuggaucacaugggagaaaaagucauccaguuuuucauguu

SEQ ID NO: 4405 - RNA, 64 nt, Human
uguuuucugugucuagugccaauuagcuaaaucagggagaaagaaaugaucacaugacuuuuag

SEQ ID NO: 4406 - RNA, 64 nt, Human
acugucuaaguuuauguugcauuuuuagucaaaagggagaaaucuuauuccuucuugaaaauuu

SEQ ID NO: 4407 - RNA, 64 nt, Human
cuuucugugaaacagaugcuauuuuaaauucacugggagaaauauccuauuuaaaguaaucuau

SEQ ID NO: 4408 - RNA, 64 nt, Human
auguggggugaaaugggaguagggggguggacaggggagaaacgaaaaccacaaaaagaaaacc

SEQ ID NO: 4409 - RNA, 64 nt, Human
uacaggguggugucagucaaggucuuucaggugggggagaaauugguuagggcucccacugcca

SEQ ID NO: 4410 - RNA, 64 nt, Human
gguuuguacuuugacagugccuuucucucccagagggagaaauaacuuuaggaacugaauugua

SEQ ID NO: 4411 - RNA, 64 nt, Human
cuguggacauagggcaauuuggggcucaaagugagggagaaaaccuggguguguccuuucccag

SEQ ID NO: 4412 - RNA, 64 nt, Human
aaguucccugugcucauggagcuuacauucuacagggagaaagagauagccaauacauaggaau

SEQ ID NO: 4413 - RNA, 64 nt, Human
ucuugguaaaaggagggagccugcugagccaggagggagaaaagaagauugaccagcuugcuag

SEQ ID NO: 4414 - RNA, 64 nt, Human
guauuaggccauuaugauuagagauaagcagccugggagaaacauacaagaccuguggcuacug

SEQ ID NO: 4415 - RNA, 64 nt, Human
cauucugauaagcugugaggccacugccaagggagggagaaauggucacuuucugguggugguu

SEQ ID NO: 4416 - RNA, 64 nt, Human
aaauguguuuaaaacaggucuuugucuugcuauggggagaaaagacaugaauaugauuaguaaa

SEQ ID NO: 4417 - RNA, 64 nt, Human
ggagggugggagugaggaaguuaaaaucacuauagggagaaaaaacuuuuuucaagauuuccaa

SEQ ID NO: 4418 - RNA, 64 nt, Human
gauauauauauauauauauaugucugcaacuucagggagaaauaagauuguguuugaauauugu

SEQ ID NO: 4419 - RNA, 64 nt, Human
gggggagaagaacagaccgauuugaaagauucaagggagaaagauuaaggaucaggauugcaug

SEQ ID NO: 4420 - RNA, 64 nt, Human
guugcccuuuccuuuuaaaaggcccuguggucuggggagaaaucccucagaucccacuaaagug

SEQ ID NO: 4421 - RNA, 64 nt, Human
ccagaggaaacuugcauacagagacagauauacugggagaaaugacuuugaaaaccuggcucua

SEQ ID NO: 4422 - RNA, 64 nt, Human
ugcaacuuauaauaaagaauggguugggggaagggggagaaauaaaagccaagaagaggaaaca

SEQ ID NO: 4423 - RNA, 64 nt, Human
cuuugaagauaggaauaucuaaauuauaucucuagggagaaaauguuguaaaaaauuaaaagua

SEQ ID NO: 4424 - RNA, 64 nt, Human
aaucggccuauuggcucaaugggaagagaggagagggagaaaaauaaaaugaaaggaaaaaaaa

SEQ ID NO: 4425 - RNA, 64 nt, Human
cuuucuauugugugccccguugcagacagggccagggagaaauuagccagugcagggggaaaau

SEQ ID NO: 4426 - RNA, 64 nt, Human
ucuaagaauuucaggagugauguaugucuuaagagggagaaaaaaauauuucuuauuacuuuuu

SEQ ID NO: 4427 - RNA, 64 nt, Human
cacacaugugagggccggacagcgaacuggaggggggagaaauuuucaaagaaaaacgagggaa

SEQ ID NO: 4428 - RNA, 64 nt, Human
acgggcagcugguugcucauaggguccuucucuagggagaaaccauuguuaauucaaauaagcu

SEQ ID NO: 4429 - RNA, 64 nt, Human
ucagcaaagugaacugugagaucuccaggacagagggagaaagaucugauccaaaugagaacag

SEQ ID NO: 4430 - RNA, 61 nt, Human
agcugugugaggugugguagaccuggaucaggggagaaauggccagcugucaccagaccug

SEQ ID NO: 4431 - RNA, 64 nt, Human
uuuguuuuuguuuuuuugaggcucaaaaaaugcugggagaaaugaaaaugcugugggauagggc

SEQ ID NO: 4432 - RNA, 64 nt, Human
uuauaugguauaaauuaaaguucaggcauuuauggggagaaaaggcccuccccaccgacccgcc

SEQ ID NO: 4433 - RNA, 64 nt, Human
ccuaucaagaaggugaaaagauaaccugcagaaugggagaaaauauuugcgagucauauauaug

SEQ ID NO: 4434 - RNA, 64 nt, Human
uauguguuuuccuuugucuuaaucgaucugguaggggagaaauggcgaaugucauacacaugag

SEQ ID NO: 4435 - RNA, 64 nt, Human
agugaugaaagauggguuuaaaauauacagaaaugggagaaaauuaauuagagaaaaugugagg

SEQ ID NO: 4436 - RNA, 64 nt, Human
aggugaacuggcauggcccgaucacuguccauaagggagaaaguggcucauuccugguagaagu

SEQ ID NO: 4437 - RNA, 64 nt, Human
accccagacauuggaaauaggugacccaaguagggggagaaaguauuauuguugauagcuucug

SEQ ID NO: 4438 - RNA, 64 nt, Human
cuugggguguguagaaugauuuugcgggggaguggggagaaagaugaaagaggucuuauuugua

SEQ ID NO: 4439 - RNA, 64 nt, Human
uaaauguuaaagcgcuuuuggggguggcuuaugggggagaaaagggaaaaugcugucaguagau

SEQ ID NO: 4440 - RNA, 64 nt, Human
aagaauauuggaugacauuuccugacaugugggagggagaaacucccuaacuuuuuuuuucugc

SEQ ID NO: 4441 - RNA, 64 nt, Human
gguggugucaggugagaaggcguccacaaaagaggggagaaaaggcgacgaaucaggacacagu

SEQ ID NO: 4442 - RNA, 64 nt, Human
cugagacacauggagaguuggucaggcugcugcugggagaaauggacgcccacugggccucaac

SEQ ID NO: 4443 - RNA, 64 nt, Human
ggcagccaugaacaaucuauuuugagccacuuuagggagaaaacuuuguauuuuuaaaacuugc

SEQ ID NO: 4444 - RNA, 64 nt, Human
cuggacuagaaccuaaggguccugaaagaguguggggagaaauaagaauggaaagguggcuuga

SEQ ID NO: 4445 - RNA, 64 nt, Human
ucucuguuccucuggggugguccaguucuagagugggagaaagggagucaggcgcauugggaau

SEQ ID NO: 4446 - RNA, 64 nt, Human
ccccccuucugagcguuucugacagcucccagcugggagaaaccaacaugacgaaaagacaaag

SEQ ID NO: 4447 - RNA, 64 nt, Human
uuuuuuuuuuaaugggauuuuuaggucagcccaggggagaaagauaacugcuaaaauuccccug

SEQ ID NO: 4448 - RNA, 64 nt, Human
ugagaaugaaaaauuccaaaagugcugagcuuuggggagaaauaaucuuagaaagaaauuguag

SEQ ID NO: 4449 - RNA, 64 nt, Human
ucaaaagagcaaaaaugccucugguuuuguguuugggagaaaaguaucuuggacgcacuguuuu

SEQ ID NO: 4450 - RNA, 64 nt, Human
gguuuuguggaugauuuuuuuucuuuugaguuuugggagaaauauuuguuuaguaacuucuaau

SEQ ID NO: 4451 - RNA, 64 nt, Human
uaggaaaaaaagauuuccaagaaaguaaagaaaggggagaaauaaacauaagacguauguaaac

SEQ ID NO: 4452 - RNA, 64 nt, Human
uggugaugauaagaaggauugggucaggaagagugggagaaagaaauuccucuuuacguagaua

SEQ ID NO: 4453 - RNA, 64 nt, Human
uuuucuuuacgagagggucucacccaaauuuauggggagaaaucuauuucucaaaaaaaaaaau

SEQ ID NO: 4454 - RNA, 64 nt, Human
aauguucuacaacgcuagaacuguugaacuucuugggagaaaaggagaaucuuuguuuuguugu

SEQ ID NO: 4455 - RNA, 64 nt, Human
acuguuuuccuugcuguuauuuuuccaagucuuggggagaaaacauccuccucugauggccaaa

SEQ ID NO: 4456 - RNA, 64 nt, Human
gcucuguggaucauguuccuaaaagaugcucauggggagaaaauguuuacagacaaauaauuuu

SEQ ID NO: 4457 - RNA, 64 nt, Human
auucuuaacccuaagguaaaaaugcauuugcaaagggagaaaaugaaggccaaacagaagcagg

SEQ ID NO: 4458 - RNA, 64 nt, Human
auugucagggaaucuuagaauucccuacacgagugggagaaagauguccaaauuccuuacgcag

SEQ ID NO: 4459 - RNA, 64 nt, Human
gaauacaguuucuagcauuaaacaaauaaacaaggggagaaaauaaaacucaaggacugaaaau

SEQ ID NO: 4460 - RNA, 64 nt, Human
agaaacgugauaagaauauagaugaucacaaaaagggagaaagaaaacaugaacugaauagauu

SEQ ID NO: 4461 - RNA, 64 nt, Human
aaggcccggcccaggaccacugugagcuggaaaagggagaaaggcagugggaaaagaggugagc

SEQ ID NO: 4462 - RNA, 64 nt, Human
uugaaucaucaaauaaaagaauguggcuauuuuggggagaaaauuaugugugugugugcucaag

SEQ ID NO: 4463 - RNA, 64 nt, Human
gacuucugcgggcggcugacaacgcgagggcgaggggagaaagccaucagguccuagacgugga

SEQ ID NO: 4464 - RNA, 64 nt, Human
ucuguauguguuuuaacuauuacagugcauguuagggagaaauucccugaauuucuuuaguuuu

SEQ ID NO: 4465 - RNA, 64 nt, Human
ugaaguggagguuaaaguaaauuacaggaaauaagggagaaaucuugcaguuaccauguucaga

SEQ ID NO: 4466 - RNA, 64 nt, Human
uacuucacuuccauuugucugacauggagauugagggagaaauguauuuguguguucauuuuaa

SEQ ID NO: 4467 - RNA, 64 nt, Human
cacccagggccuccacugccaccuuggcuggcaagggagaaauguguuguguugucuuagcuuu

SEQ ID NO: 4468 - RNA, 64 nt, Human
uugggcccaauuccccuaaaagaauugaggauuagggagaaaggagacaacucaaagucauccc

SEQ ID NO: 4469 - RNA, 64 nt, Human
cauugaaacaauuuaggggaaugaggggcaaaaggggagaaauacugcuaaagaacaugagcau

SEQ ID NO: 4470 - RNA, 64 nt, Human
uaaaagcacagccuucuaacaucgcuuccaguaagggagaaacugaagaggaaagacugucuug

SEQ ID NO: 4471 - RNA, 64 nt, Human
acuggaacacgauccucuuucugggcauuccuaggggagaaaauaaaauuuguaauguucuaga

SEQ ID NO: 4472 - RNA, 64 nt, Human
auuugcuaaagggaaaggggaaagaaagggaaaagggagaaaaagaaacacaagagacuuaaag

SEQ ID NO: 4473 - RNA, 64 nt, Human
ucccucccucuugaguuggcucugauuugaaaucgggagaaacagagcugcugccaaugggauc

SEQ ID NO: 4474 - RNA, 64 nt, Human
aggcccuggggaucaaaggucaaugaguuagguggggagaaagaucccugggggcuccuguaug

SEQ ID NO: 4475 - RNA, 64 nt, Human
gcugcaaggcuuucuuaagguuucgaguguugcugggagaaaucugcugcauguuguggguuaa

SEQ ID NO: 4476 - RNA, 64 nt, Human
ugaaaagacaguugugugcauggaugugugcguggggagaaagaacguggguaagaugucccuu

SEQ ID NO: 4477 - RNA, 64 nt, Human
cagucccacuccugucaccccacgcucugcacuggggagaaaacgggaggugcucgugcuggcc

SEQ ID NO: 4478 - RNA, 64 nt, Human
gucccaggcgucacaacccauccucccaggcugggggagaaaggaccuccuggaacugacuucu

SEQ ID NO: 4479 - RNA, 64 nt, Human
ggcggugggcaagaagccagcauggaagaaagaagggagaaaacuuuggugacugccuuagagg

SEQ ID NO: 4480 - RNA, 64 nt, Human
uaaacauugaaugagggugagggcaucccugcuggggagaaaccucugucccuaggaagagucc

SEQ ID NO: 4481 - RNA, 64 nt, Human
uacuugguggaauuguaaguggauuugcaggccagggagaaaauguccaaguaacaggugaagu

SEQ ID NO: 4482 - RNA, 64 nt, Human
aggcaagcaggaaugccucuugugggggagggcagggagaaauaacuaguucaaaccaacuauc

SEQ ID NO: 4483 - RNA, 64 nt, Human
cugaagcacaaucucuuauacuagugggacaaaagggagaaaaaggaagcaagauaaaugggua

SEQ ID NO: 4484 - RNA, 64 nt, Human
uuucugccacaucucgcccuucuggaccugcacugggagaaauucaggacaggagugaacucaa

SEQ ID NO: 4485 - RNA, 64 nt, Human
agcauuaaaguuccuaagacccagugacaguacugggagaaaccaaggcugaagagucagguug

SEQ ID NO: 4486 - RNA, 64 nt, Human
ucuauagcaagguuguagcguccucuccaguggggggagaaaaggaacugugccuaccaaaggu

SEQ ID NO: 4487 - RNA, 64 nt, Human
gaccuaauguaauaauagaaaaauacucauaauagggagaaaccaagagaaguuuuguuuuugu

SEQ ID NO: 4488 - RNA, 64 nt, Human
accugucuccuuucucagccacaaaauaaauguugggagaaaugauauauaccacuuucccaga

SEQ ID NO: 4489 - RNA, 64 nt, Human
uaaaacuuuguagaaagcaaacaaaauuguucuugggagaaaaucaacuuuuagauuaaaaaaa

SEQ ID NO: 4490 - RNA, 64 nt, Human
cugcagcucucagcuggcugcaguaacauuuugugggagaaagaggagcuggaguuacagaaau

SEQ ID NO: 4491 - RNA, 64 nt, Human
agagacucaguuacuacccaguuugugguuuuuugggagaaauguaacuggacaguuagcuuuu

SEQ ID NO: 4492 - RNA, 64 nt, Human
ucccagaggauucugauuuugcauauguuuguaugggagaaaggguguuguguuuuuuuuuugu

SEQ ID NO: 4493 - RNA, 64 nt, Human
gauaugauggggcuucugugcuauugcugggauugggagaaauaaaacaugcaauuuaagugga

SEQ ID NO: 4494 - RNA, 64 nt, Human
gucugcuccacgucaggcacugugcuuugcaccggggagaaaauggugauggagggcaacaagg

SEQ ID NO: 4495 - RNA, 64 nt, Human
caccaggccagaacuauagucauacucacacaaagggagaaauuuaaacucgaaccaagcaaaa

SEQ ID NO: 4496 - RNA, 64 nt, Human
uaauuaggcaauuuaugucugugauaauucuuacgggagaaagaggauuugauuggaaagcagu

SEQ ID NO: 4497 - RNA, 64 nt, Human
auuaaggguuaaaucagagauuauucaacagagagggagaaaggaggagacagagggaggaccu

SEQ ID NO: 4498 - RNA, 64 nt, Human
guuugugucugacucaggcgccuggcacauuucagggagaaacuccaaaguccacacaaagauu

SEQ ID NO: 4499 - RNA, 64 nt, Human
uguuuugcuguaccagcccagauguuuuacgucugggagaaauugacagaucaagcugugagac

SEQ ID NO: 4500 - RNA, 64 nt, Human
uguuuucagugcccugaaucaaacuauaaauguggggagaaaucaccuccaucaaacaguugca

SEQ ID NO: 4501 - RNA, 64 nt, Human
ucagaggaagaggucccaaauuuggaguaaagaugggagaaaauaaauaugugcuauuuccuug

SEQ ID NO: 4502 - RNA, 64 nt, Human
cuuuccuuccuccaaagaauuaauaggcaacagugggagaaaaaaaaggcauaauggcaaaucc

SEQ ID NO: 4503 - RNA, 64 nt, Human
cuucucaggauggggucagauggagagaccucuagggagaaagacauccccauugugugagugg

SEQ ID NO: 4504 - RNA, 64 nt, Human
ggauaugaguagccccaacccaaaccuggagauggggagaaaccuacagaauacuagccagagc

SEQ ID NO: 4505 - RNA, 64 nt, Human
ccacccuccucuagccaucccuuggggaaggguggggagaaauauaggauagacacuggacaug

SEQ ID NO: 4506 - RNA, 64 nt, Human
cuucuuggcagcuuaacauugacuucuugguuuggggagaaauaaauuuuguuucagaauuuug

SEQ ID NO: 4507 - RNA, 64 nt, Human
uaggaauccuuugagaaugugauuccuuuugauggggagaaagggcaaauuauuuuaauauuuu

SEQ ID NO: 4508 - RNA, 64 nt, Human
ggccuaguagaugcagaauucaaagaugucgguugggagaaacuagcucugauccuaacaggcc

SEQ ID NO: 4509 - RNA, 64 nt, Human
ucugagugccuucuguggggacuccggcugugcugggagaaauacuugaacuugccucuuuuac

SEQ ID NO: 4510 - RNA, 64 nt, Human
agaggugggucacuguuuaccuuguuucaggggugggagaaacuccuuuccuucagcuggcauu

SEQ ID NO: 4511 - RNA, 64 nt, Human
cgcuccugcccagccugggggaaggagaaaggaggggagaaagcgggcucucacccccucagga

SEQ ID NO: 4512 - RNA, 64 nt, Human
uauacugucuggggaugugugguuauaguucugugggagaaauaauuuugucaguguucaccag

SEQ ID NO: 4513 - RNA, 64 nt, Human
ccauguuugcuuaaagauggauuucccugggaaugggagaaaacagccagcaggaggagcuuca

SEQ ID NO: 4514 - RNA, 64 nt, Human
gaaauaacaauuacaauguguauuauuuaaaaaugggagaaauaguuuguucuaugaaauaaac

SEQ ID NO: 4515 - RNA, 64 nt, Human
auuguccagugaauucaagaccaaauacaauaucgggagaaaauacaaacucccuguguuuaag

SEQ ID NO: 4516 - RNA, 64 nt, Human
gggauacuauuuucuaacaagguauaucuaguaggggagaaagccaccacaauaaauauauuug

SEQ ID NO: 4517 - RNA, 64 nt, Human
uugaagacuccuuccccucgggcauuggcagugggggagaaaaggcuucaaaggaacuuggugg

SEQ ID NO: 4518 - RNA, 64 nt, Human
acagcuuucccccaccccauaucaugggaaaagggggagaaauauagccccuagccuaauaacu

SEQ ID NO: 4519 - RNA, 64 nt, Human
cacuugagaaauguuucuguuugaagaaaauagagggagaaacagaagucuuaagucuguggca

SEQ ID NO: 4520 - RNA, 64 nt, Human
gauuuuaaacacugcuguugacaaguugguuugagggagaaaacuuuaaguguuaaagccaccu

SEQ ID NO: 4521 - RNA, 64 nt, Human
auuggagauuuuaaaacuggaggaugcauuuagagggagaaagcuacuuccagccauuagacua

SEQ ID NO: 4522 - RNA, 64 nt, Human
cuuuaaagugcuuuaaaaaaaaguuuuauaaguagggagaaauuuuuaaauauucuuacuugga

SEQ ID NO: 4523 - RNA, 64 nt, Human
ucaggggguuguuacuugagagcuccagggugaagggagaaagccugugcucuggcuggcuggg

SEQ ID NO: 4524 - RNA, 64 nt, Human
uucugagacuguuguuuuuuuagagcuugauugugggagaaaagcuugugugaaauucccucuu

SEQ ID NO: 4525 - RNA, 64 nt, Human
gaaccuggggaggggcccagagcaaagggcaucagggagaaagucccgaggaaaugugaccagu

SEQ ID NO: 4526 - RNA, 64 nt, Human
aaggaagaaaggaaggaaagaagggagggaaacagggagaaagggaaaaagaagaaaaagagaa

SEQ ID NO: 4527 - RNA, 64 nt, Human
ggaguauggaaagggaaacauaguaacuuuacaggggagaaaaaugacaaaugacgucuucacc

SEQ ID NO: 4528 - RNA, 64 nt, Human
agggaaaacagaagcaaaggagagcuuggggguggggagaaaagacaaaugugcucuauguccu

SEQ ID NO: 4529 - RNA, 64 nt, Human
aauaucacucucauaauaugcuuuccagcuagaggggagaaaacaccaggaaagaggaacccug

SEQ ID NO: 4530 - RNA, 64 nt, Human
auuauuaaacuagucaaaaaugcuaaaauaauuugggagaaaauauuuuuuaaguaguguuaua

SEQ ID NO: 4531 - RNA, 64 nt, Human
cuucuacacaucugccuaacuugggaaugaaugugggagaaaaucgcugcugcugagauggacu

SEQ ID NO: 4532 - RNA, 64 nt, Human
guuuggacuggggcacaguucccuccaucgcuuugggagaaaaucauuaauauggcauacugca

SEQ ID NO: 4533 - RNA, 64 nt, Human
ucauauagguggcugccuccuuagacugaccuuugggagaaaaaaaccccagacuuugaauuag

SEQ ID NO: 4534 - RNA, 64 nt, Human
ugccaauuuucacaucuuccacaaacuccauuuagggagaaauguuuaaaucucugguauaagu

SEQ ID NO: 4535 - RNA, 64 nt, Human
ggcuauagccccuccuucaauauugaccuaacgggggagaaaagauuuagauuguuuauucuuc

SEQ ID NO: 4536 - RNA, 64 nt, Human
uauaggguccuccuucccuggcagccccccaugugggagaaauaccugauucucccaaucugca

SEQ ID NO: 4537 - RNA, 64 nt, Human
aaaaaaaaaauaggauaggcuucccuugugcagagggagaaaugguuuuguuuuuguuuuguuu

SEQ ID NO: 4538 - RNA, 64 nt, Human
ucaauccuuaguacacauaagaaaauucauacuggggagaaaccccacaaauguggagaaugcg

SEQ ID NO: 4539 - RNA, 64 nt, Human
uauacuuaaauuaggauuucuuaaagaaaacauagggagaaaacuuuacaugcaauuaaaaaug

SEQ ID NO: 4540 - RNA, 57 nt, Human
gcagcuguguuauuucauaaauaacuugggagaaacugcauccuaaguggaagaacu

SEQ ID NO: 4541 - RNA, 64 nt, Human
ucaggcuucauucagcaucugagaguucacaccagggagaaaucauguauguacugcauguggu

SEQ ID NO: 4542 - RNA, 64 nt, Human
ugagcccaaauuguauaaucuuuuuuuaauaaaggggagaaaaaucacuuacaagguuauacau

SEQ ID NO: 4543 - RNA, 64 nt, Human
agguuuuuaaaauuauuagcuauucaucaugugugggagaaauaauugugguguguugcagauu

SEQ ID NO: 4544 - RNA, 64 nt, Human
aaggaagcaaaauggaggugaugagaaagguggugggagaaagucagcagaugagagacacaaa

SEQ ID NO: 4545 - RNA, 64 nt, Human
guuuccuggaaguggauuugggccaagaaggagagggagaaaggcccgagccccugccuucccg

SEQ ID NO: 4546 - RNA, 64 nt, Human
aaacauccgggacccucagacacuguuguuuuucgggagaaaaaaccaaaggaggugaugggag

SEQ ID NO: 4547 - RNA, 64 nt, Human
guuacugccugcaaagaauuaacauccgucuagugggagaaacaaacacaccccacucacuaag

SEQ ID NO: 4548 - RNA, 64 nt, Human
ugucuuucuuugcagaccacucugcuucauuuuugggagaaaacuucucacacuauggcagcca

SEQ ID NO: 4549 - RNA, 64 nt, Human
uguaaaacuacaaaauaaaaacucuuagacuuuagggagaaaagaaaaaggcaacuaugaguua

SEQ ID NO: 4550 - RNA, 64 nt, Human
acugaaauaaugaucuuggaauauuugcugugaagggagaaagggagagaaaacucuucugagg

SEQ ID NO: 4551 - RNA, 64 nt, Human
uccauugcccucauggaacagagcauaucauagagggagaaaagucaaacuuguaauugugucu

SEQ ID NO: 4552 - RNA, 64 nt, Human
ggaaaaggacucugaaaaacccuaaaguauucuagggagaaacugucuuccauuucaguuuuga

SEQ ID NO: 4553 - RNA, 64 nt, Human
ggugggggagggaaagggagggaugaccuucccagggagaaacccacgaccuguccugucuuug

SEQ ID NO: 4554 - RNA, 64 nt, Human
acacagcaucgugaucacugagccaucauuuccugggagaaagaccaugcauuuaaaguauucu

SEQ ID NO: 4555 - RNA, 64 nt, Human
aacuaggugcauauuuauaaaaauaaaaaacacugggagaaaugaaaaaauauauaucaaauau

SEQ ID NO: 4556 - RNA, 64 nt, Human
gaagauuaaugcagagaaagagcaaagcccaaaagggagaaaaaaaaaacaaaaaaacaaaaaa

SEQ ID NO: 4557 - RNA, 64 nt, Human
guaagaagaggauguaaggcagcugguguuaauggggagaaaagcucagagagaugcauuuuaa

SEQ ID NO: 4558 - RNA, 64 nt, Human
uguccaggcucuggggucuugugaugagggucuggggagaaagugggcccggggggaccccgga

SEQ ID NO: 4559 - RNA, 64 nt, Human
uaaaugaguuuuuaaagcacuuuagaaaauauaagggagaaaaugauuucuuaagauaucacug

SEQ ID NO: 4560 - RNA, 55 nt, Human
caccuccuaccggaauauaauuaaagggagaaauacacuguaugaaguauauguu

SEQ ID NO: 4561 - RNA, 64 nt, Human
auuacagccuuagaagaaagauugugaaaagcuggggagaaaaugcuuaaggacaugcuagggg

SEQ ID NO: 4562 - RNA, 64 nt, Human
gguuacauugaaagaaaguuaauuuggaaaauuugggagaaaucuaaucaugccuauuaaggau

SEQ ID NO: 4563 - RNA, 64 nt, Human
caaacacccagaggucucaucucccaggccccaggggagaaagaggaguagcaugaacgccaag

SEQ ID NO: 4564 - RNA, 64 nt, Human
acuaucaagagaguaaacagacagcuuacagaaugggagaaaauuguugcaaacuaugcaucug

SEQ ID NO: 4565 - RNA, 64 nt, Human
gaggagucuucauccacagcucuguuaaauaaaugggagaaaucacaucacgaaaauucugugc

SEQ ID NO: 4566 - RNA, 64 nt, Human
cacugguugggaauaaauuaaaaacaguauuugggggagaaacgugcaauagcguaaugguggu

SEQ ID NO: 4567 - RNA, 64 nt, Human
ugcauuuggugaugaauauuuuauacccgucuaagggagaaagcuaauguuuuccacaagacug

SEQ ID NO: 4568 - RNA, 64 nt, Human
uucuccuguccucuuccaguuuagaauaagacaggggagaaaaaggcuuuucgagugugggaca

SEQ ID NO: 4569 - RNA, 64 nt, Human
cuuuuuucuguuccccuccgcuuucugaagccuggggagaaaucagugacagagguguuuuggu

SEQ ID NO: 4570 - RNA, 64 nt, Human
gcuggcuuaauuagggaugcugucauuaaggagagggagaaauguagaguguuaccuccaacuc

SEQ ID NO: 4571 - RNA, 64 nt, Human
gcguugucuuuguggaaauggaacaucuccucaugggagaaacucugguaaaugugcucauuug

SEQ ID NO: 4572 - RNA, 64 nt, Human
aaaaaaaauacauuuaguauagcggggggugggggggagaaauaauguuauuuccuaugcgaau

SEQ ID NO: 4573 - RNA, 64 nt, Human
uggucaaguguguaauaaacuugagcauucgaaugggagaaaaagcaaaucgcacaaugacaua

SEQ ID NO: 4574 - RNA, 64 nt, Human
aauguauguauagguuuugaaauuuuuuuaaaaggggagaaagacuguuaagaggaggcuauuu

SEQ ID NO: 4575 - RNA, 64 nt, Human
aaagaaagucuucugggauuuauagaucaauuuagggagaaaugacauuuuaacaauucugagu

SEQ ID NO: 4576 - RNA, 64 nt, Human
uguucuuauuuaugguguguauguaaagagauaggggagaaaaaccucacccaaguucuuauac

SEQ ID NO: 4577 - RNA, 64 nt, Human
uucccucuuaggccucagggcaguuugaucuguggggagaaagagcagccaucgcugagccugc

SEQ ID NO: 4578 - RNA, 64 nt, Human
gucaaaaaugacuaaaaauauaacuagugacggagggagaaauccucccucugugggaggcacu

SEQ ID NO: 4579 - RNA, 64 nt, Human
aauuuuuaugaaauacugcgugugauaagcaaacgggagaaauuuauaucagauucuuggcugc

SEQ ID NO: 4580 - RNA, 64 nt, Human
acaauauucauuugguuguggagacugauuugcugggagaaaucuguccuguuacuuucugguc

SEQ ID NO: 4581 - RNA, 64 nt, Human
ugugauguucccuguuaaccuucuguuacucccugggagaaaggcgcugagcguggcaugcagg

SEQ ID NO: 4582 - RNA, 64 nt, Human
ggauuuucuguuccucccuggagugggugagggugggagaaaguuacauauuuaaagaaaaaua

SEQ ID NO: 4583 - RNA, 64 nt, Human
uauucuguuccccagcaacucuggccuccaaaaugggagaaaacgccaguguguuuaaauugau

SEQ ID NO: 4584 - RNA, 64 nt, Human
acuacuguuugacuugaucuucuucuggggguuagggagaaaucugucuccauauugcugguuc

SEQ ID NO: 4585 - RNA, 64 nt, Human
uauuuuccuucugaagucugagcccauuucuggggggagaaaaaaaaagcaaaucagaaaaccc

SEQ ID NO: 4586 - RNA, 64 nt, Human
uaggcaauuuuuaauuuuuaaaaauuauuaucaggggagaaaaauuggcaaaacuauuauaugu

SEQ ID NO: 4587 - RNA, 64 nt, Human
uguuguauuuuuguuuugcuuuucaccgguuagugggagaaaaacauuuuagauauguauuacu

SEQ ID NO: 4588 - RNA, 64 nt, Human
acuucagagauaagucauggagaggacauuggaggggagaaaugcaguugcugacugggaauuu

SEQ ID NO: 4589 - RNA, 64 nt, Human
gauuaaugaugucaugcauaauuuuaagagacaagggagaaaacacaauguauagccagagaag

SEQ ID NO: 4590 - RNA, 64 nt, Human
caaaugccugaggggcucaucgacgccugugacagggagaaaggauacuucugaacaaggagcc

SEQ ID NO: 4591 - RNA, 64 nt, Human
agaagcacucaccuagagcugucugugccucucugggagaaaggagagaggauaagaagggaaa

SEQ ID NO: 4592 - RNA, 64 nt, Human
gcacucauuuaaaucugcauucagugaauguauugggagaaaaauaggucuugcagguuuccuu

SEQ ID NO: 4593 - RNA, 64 nt, Human
ugauacagguuugaggggcuggggagugggaggggggagaaaaggaauguauuuaaacaauuuc

SEQ ID NO: 4594 - RNA, 64 nt, Human
caggacucacccuccacaaagcaaaggcagucccgggagaaaagacggauggcaggauccaagg

SEQ ID NO: 4595 - RNA, 64 nt, Human
aauguuuaauuacauaugguaacccuaaggccuggggagaaaagcuuuuaaaucuugccuucuu

SEQ ID NO: 4596 - RNA, 64 nt, Human
cccauucuuucauguuaaauacuuggggugggaggggagaaagggaaccuuuucuuaaaaugaa

SEQ ID NO: 4597 - RNA, 64 nt, Human
uuucuuucccaagcuccuagccaacacuauccuugggagaaagaaauuugcagaaacugcuaag

SEQ ID NO: 4598 - RNA, 64 nt, Human
gaaccuugcuguugcucugaggagauauaauucugggagaaagaaucuuuuauaagaacaguac

SEQ ID NO: 4599 - RNA, 64 nt, Human
auggccacucugcccucuggaccugucuuucaucgggagaaaccacucagagauggaucccauu

SEQ ID NO: 4600 - RNA, 64 nt, Human
caagugcucuggggaugaggcauggguauaggaagggagaaaggaguuggagacaagauccucu

SEQ ID NO: 4601 - RNA, 64 nt, Human
uuuuuuuuuuuuucuggcggugagccagagggucgggagaaacgcugcucgccccacaccccgu

SEQ ID NO: 4602 - RNA, 64 nt, Human
caggcagcacaugcgguggcucugggacauuggugggagaaaguccuuuuggauaggcaaguau

SEQ ID NO: 4603 - RNA, 64 nt, Human
uaagcauagguuugauguugaaaacuuguuuugagggagaaaaucccuuuguuuuaaaguaaag

SEQ ID NO: 4604 - RNA, 64 nt, Human
uuuaaauauggggagggguauugagcauuuuuuagggagaaaaauaaauauaugcuguaguggc

SEQ ID NO: 4605 - RNA, 64 nt, Human
cccggccucagccuaaccaggaaaggggcucggagggagaaaggcccagggcaguggggacggg

SEQ ID NO: 4606 - RNA, 64 nt, Human
ugcccuaugaaccugagaauuaccccuaccaauugggagaaauaucuucccuucccugucccgg

SEQ ID NO: 4607 - RNA, 64 nt, Human
ugaggcccagcuuggggaaggccaggaccaugcagggagaaaaagcagacuuccucuggccacc

SEQ ID NO: 4608 - RNA, 64 nt, Human
ugguuucuaagacaaccgugggaaccacugugacgggagaaaccgcuugugcuucgcgcaugcg

SEQ ID NO: 4609 - RNA, 64 nt, Human
ccaacggaaccauuuuccaguuugauacagaauggggagaaaagaaagcguuugaaauuauugc

SEQ ID NO: 4610 - RNA, 64 nt, Human
cuucuuaggccucaggugcuguauugggggagaagggagaaagcauaugcaaugaauuguaaag

SEQ ID NO: 4611 - RNA, 64 nt, Human
acaccugcaccuguuaacuguguucgacauugaagggagaaaggcaagaugugcacucuggacu

SEQ ID NO: 4612 - RNA, 64 nt, Human
ucaaacugcagaaaaaaucaaaagaucaauaauugggagaaaaagagacaaauuuaacuguuac

SEQ ID NO: 4613 - RNA, 64 nt, Human
aggcaugaaggaugccaagaaguuuaaggaauaugggagaaauaguguggaaauuaagaagaaa

SEQ ID NO: 4614 - RNA, 64 nt, Human
cucuuauguugguuuauucuuaagcuguacaauugggagaaauuuuauaauuuuuuauugguaa

SEQ ID NO: 4615 - RNA, 64 nt, Human
aaaggggaacagggaugauuccuagucagagauugggagaaauacaagaugagccugaaucauc

SEQ ID NO: 4616 - RNA, 64 nt, Human
aaugaucauuugcacagaauggguuuccuucacagggagaaacuugccucugaaagcuauuuuc

SEQ ID NO: 4617 - RNA, 64 nt, Human
auuuauuuacuuccaauauuuuacuguaaaaguagggagaaauauuauguugauaguuguuuca

SEQ ID NO: 4618 - RNA, 64 nt, Human
uaagucagcuagggauucuugcagucucagcugagggagaaagguagggcugugccuucuaaag

SEQ ID NO: 4619 - RNA, 64 nt, Human
cuauguagagaauauucugcuagguggaaaaguugggagaaaggggaauaugcaucuuuauucu

SEQ ID NO: 4620 - RNA, 64 nt, Human
aauuauugagauauaaagcagccauugggaaauugggagaaaugauaaacaaauggaaaaagaa

SEQ ID NO: 4621 - RNA, 64 nt, Human
agacuaagauauucaagaucucuuuauuggggaugggagaaauagggaaagaaauguguauaag

SEQ ID NO: 4622 - RNA, 64 nt, Human
cuugggacugggguuucggauugaguugcaagcagggagaaaaccugaaggucggugccccuau

SEQ ID NO: 4623 - RNA, 64 nt, Human
ccccuucauaaauagcaggcaaaugccuagcuuugggagaaaagggcauucuuagcugauugaa

SEQ ID NO: 4624 - RNA, 64 nt, Human
ucaagcauaaggcaauaaauaccugcagcaacgugggagaaagaaguugcuggaccaggagaaa

SEQ ID NO: 4625 - RNA, 64 nt, Human
ccaucccagagcuuuaugauucuguaauaaucaagggagaaacccauuacauaguggacaauuu

SEQ ID NO: 4626 - RNA, 64 nt, Human
guacagguauuggguaaauacagccauuccaaaugggagaaauuggccaacacaaaaggguaac

SEQ ID NO: 4627 - RNA, 64 nt, Human
ugccaaguauccuacguuacaacaauaauaucaugggagaaauagaaauagccuaguuugcuuc

SEQ ID NO: 4628 - RNA, 64 nt, Human
ggaccacuguccuacagagucaggaaauauuguagggagaaaaaaauaacaacaacaaaggccu

SEQ ID NO: 4629 - RNA, 64 nt, Human
uuuaggaauuuguuucaagaggaacaagggaugagggagaaaaauccguuuuauccaucagagu

SEQ ID NO: 4630 - RNA, 64 nt, Human
agcaaauacauagagagauucuguacauuuauuugggagaaaauuuuaucauauuuuaggcuuu

SEQ ID NO: 4631 - RNA, 64 nt, Human
gucaggaaaggaaucauuucuauuucuccuccaugggagaaaauagauaagaguagaaacugca

SEQ ID NO: 4632 - RNA, 64 nt, Human
aaugaaaugugaaauuacuugucugaaccccguggggagaaauaaauaauuuucccaaaguuca

SEQ ID NO: 4633 - RNA, 64 nt, Human
aauuaugguugguuuuucuuaauacauucucagagggagaaaugaaacauuacuauaauugugg

SEQ ID NO: 4634 - RNA, 64 nt, Human
agcuuuggcccuggucaugagcagaggagggagggggagaaagggaggaagccuggugauugug

SEQ ID NO: 4635 - RNA, 64 nt, Human
uagaagggucagauauccccacauggaguugagugggagaaagagauucacuagagaauaacuc

SEQ ID NO: 4636 - RNA, 64 nt, Human
cuggugcuuugcauauguccaaauccaugcaagugggagaaaguuccagugcacacuucccaug

SEQ ID NO: 4637 - RNA, 64 nt, Human
ucagugauccuuuuacucuccuugucacuuauuugggagaaauaggggcacgugagauaagaag

SEQ ID NO: 4638 - RNA, 64 nt, Human
ugagagcccugugggagggggacaagaauguauagggagaaaucuugggccugagucaauggau

SEQ ID NO: 4639 - RNA, 64 nt, Human
ucuguccgacaggaagcugcuggguggggguggggggagaaaaggcagauaauuaaaccaucuc

SEQ ID NO: 4640 - RNA, 64 nt, Human
uguaauuaacuggugcuuugaaaaucuuuuuuaagggagaaaaaucucaaccaaaguuaugcuc

SEQ ID NO: 4641 - RNA, 64 nt, Human
aaccgccaaauuguuucagagcagaaaagaaaaagggagaaaaccucuuagcaaagcccuguga

SEQ ID NO: 4642 - RNA, 64 nt, Human
ccugccuguccugugcccaccacgcagcagucaggggagaaaaugguggcuaucccuucugcuu

SEQ ID NO: 4643 - RNA, 64 nt, Human
ccaucgaccagcaagcccagccccagggcgcuuagggagaaaugacccagccuccucagacccc

SEQ ID NO: 4644 - RNA, 64 nt, Human
uuugcuaauaggaaaaucacauuacuacaaaauggggagaaaacuguuugccugugguagacac

SEQ ID NO: 4645 - RNA, 64 nt, Human
uugacaacuggcaggcaggcucccagggacaccugggagaaaucuggcuucuggccaggaagcu

SEQ ID NO: 4646 - RNA, 64 nt, Human
ccgucuuggccaugucuaguaauugcuauguguugggagaaacuuugugaaugcaccauuuuga

SEQ ID NO: 4647 - RNA, 64 nt, Human
agccaguguguugggguaugugcugcacuucccagggagaaaaccugucagaacuuuccauacg

SEQ ID NO: 4648 - RNA, 64 nt, Human
gcugaguggcgcaaggccgagcguucccagcagggggagaaacccuucacaccccaggcccuuc

SEQ ID NO: 4649 - RNA, 64 nt, Human
uuccuguuaagaucgucuccauuuuuaugcuuuugggagaaaaaacuuaaaauucguuuaguuu

SEQ ID NO: 4650 - RNA, 64 nt, Human
acugugagaugcaaaguauacagaaucuguggcugggagaaaauuucaucaaauagacaaguaa

SEQ ID NO: 4651 - RNA, 64 nt, Human
agugaccucugaaucaguuucagagaagggaugggggagaaaaugccuucuagguuuugaacuu

SEQ ID NO: 4652 - RNA, 64 nt, Human
aaaaugguuacaacagccucuaccugucgccccagggagaaagggguagugauacaagucucau

SEQ ID NO: 4653 - RNA, 64 nt, Human
aagcaaacugcauuuuuaaaaaucuuucugagaugggagaaaauguauucuccuuuccuauacc

SEQ ID NO: 4654 - RNA, 64 nt, Human
ggcagcucugaccaccucuggccccaggcccucagggagaaaggagcaacacacugccccuagg

SEQ ID NO: 4655 - RNA, 64 nt, Human
gggccauccugggauggggcaccacagggagggagggagaaaagagguggguaggguuacagau

SEQ ID NO: 4656 - RNA, 64 nt, Human
ugcaagcauuuguugaugcccuugcaggcccacugggagaaagaugccucaggcaggucucagc

SEQ ID NO: 4657 - RNA, 64 nt, Human
ccaaccaauucaguauuuuucuccccauuuuccagggagaaaucuaaggcgucagaauguaagg

SEQ ID NO: 4658 - RNA, 64 nt, Human
uuucccacaccgaucaagucaacucaguacucacgggagaaaaauagacuuuauuuacaaguaa

SEQ ID NO: 4659 - RNA, 64 nt, Human
auuuaaagcuuauuuucuugcccucucccuaacggggagaaaucgagccacccaacuggaauca

SEQ ID NO: 4660 - RNA, 64 nt, Human
aggcccugucucugcgcacagcaaccauggacaugggagaaagggaugggagccacagugcccu

SEQ ID NO: 4661 - RNA, 64 nt, Human
uuucacaaucucagccagccugcggugugaccuggggagaaaguugagugucaggggacaugau

SEQ ID NO: 4662 - RNA, 64 nt, Human
uguugcucacugaccugugaccagguccaauguggggagaaauaugaaggagguagcagcccug

SEQ ID NO: 4663 - RNA, 64 nt, Human
uuggacucgauuuccuuauaucuaauauauaucugggagaaaaggcugcuugaaaauaucuuuu

SEQ ID NO: 4664 - RNA, 64 nt, Human
uucuagccuggcuauguccuaauaauaucccacugggagaaaggaguuuugcaaagugcaagga

SEQ ID NO: 4665 - RNA, 64 nt, Human
aguuacugcuaauggagaagaaaacagggggucugggagaaaauagagaacaugauagcaaaau

SEQ ID NO: 4666 - RNA, 64 nt, Human
gaaguggcgagcccaagcccuggggacagguguagggagaaaagcagccccaggccucagacuc

SEQ ID NO: 4667 - RNA, 64 nt, Human
auguuaacauuuauaggaggaaaaaaaucacuuugggagaaaauaaaauucaacucaagcauaa

SEQ ID NO: 4668 - RNA, 64 nt, Human
ggauaugaagaacuauugacuucuuaagaaaaaagggagaaauauuaaucagaaaguugauucu

SEQ ID NO: 4669 - RNA, 64 nt, Human
gccagugcugccacugagccugugcaggguacuugggagaaaggcccuguuucccuggaacugc

SEQ ID NO: 4670 - RNA, 64 nt, Human
cuggggggcacagccagaaacugaacuggccgcugggagaaaagccagaugacagggagcuggg

SEQ ID NO: 4671 - RNA, 64 nt, Human
uugguagcgugcacgguguugaacugggacacuggggagaaaggggcuuucaugucguuuccuu

SEQ ID NO: 4672 - RNA, 64 nt, Human
auacuuuuccugcauuauuugaaauugugggcuggggagaaacaguagucaaagcuuucugaau

SEQ ID NO: 4673 - RNA, 64 nt, Human
gggugggauuugagcugugaguugguaacuagcagggagaaauauuaacuuuuuuaacccuuua

SEQ ID NO: 4674 - RNA, 64 nt, Human
auggauaugagcucaguaggaaacuaagguuugagggagaaagaguuugucacuuagaccucuu

SEQ ID NO: 4675 - RNA, 64 nt, Human
cccauguuaagcuucuauuuuuuacuuguuuucggggagaaauaagaauuagacaucuucagau

SEQ ID NO: 4676 - RNA, 64 nt, Human
gaggccuuauagaugugcuugggggaaaaugaaggggagaaaguagccauacaggaguucaaag

SEQ ID NO: 4677 - RNA, 64 nt, Human
uacucuguccauaaaagauuuguacuguuuagaugggagaaaccucuagagagaguaaaaauga

SEQ ID NO: 4678 - RNA, 64 nt, Human
gcucagaguaguaaggggugggaaguggguggcagggagaaaagaacaucagggugggugggga

SEQ ID NO: 4679 - RNA, 64 nt, Human
cagggcugccauggcagcuaucaggggaauagaagggagaaagagaauaucauggggagaacau

SEQ ID NO: 4680 - RNA, 64 nt, Human
agaugaagagauucuagaaucugugcccugggaagggagaaacagcagggaagaggggcaauac

SEQ ID NO: 4681 - RNA, 64 nt, Human
aaaggggacaaggaaggaaaagaaagaagagaaggggagaaacccuaaaaagagaagaaucuua

SEQ ID NO: 4682 - RNA, 64 nt, Human
aucccacgguggccuucccccugcacgcucugcggggagaaaaggaggggccugccuggcuagc

SEQ ID NO: 4683 - RNA, 64 nt, Human
cauuuugugaaacucucaagggaaggugaugcaggggagaaaaugugaauuaaauuacauagau

SEQ ID NO: 4684 - RNA, 64 nt, Human
caagcacuugauuaacacaacacugcaaacagaagggagaaagugucagugacacaguuuccuc

SEQ ID NO: 4685 - RNA, 64 nt, Human
uaaaucauaccucaaaggauggagugcaucaauugggagaaaaggagacauagcccaaacccug

SEQ ID NO: 4686 - RNA, 64 nt, Human
cucaauugauauuuuuugcugcuuccucggcccagggagaaagcaugucaggacagagcuguug

SEQ ID NO: 4687 - RNA, 64 nt, Human
uccuuguuccccucuguuuccucuacucaguugggggagaaacucacagcuccuccgggauaca

SEQ ID NO: 4688 - RNA, 64 nt, Human
ugaggggauucucuacugccaagccccugcccuggggagaaaguaguuggcuaguacuuugaug

SEQ ID NO: 4689 - RNA, 64 nt, Human
cuucccagcuccuggccucacauggguggucacagggagaaacaaguacuguagcagaucuuug

SEQ ID NO: 4690 - RNA, 64 nt, Human
uguuaaugguagcuuugauaacaucaaauucuaagggagaaaaaaacaauauuaaaccgcccaa

SEQ ID NO: 4691 - RNA, 51 nt, Human
auagugaaacacauuguuaaggggagaaaaaaagccacuucugcuucugug

SEQ ID NO: 4692 - RNA, 64 nt, Human
acgaucaccaaaaugaaaagguggacuguagauugggagaaaauauuugcaaaccguuaucugg

SEQ ID NO: 4693 - RNA, 64 nt, Human
ccagcuucagggcugccuguggucccaagguucugggagaaacaggggacccccucaccuccug

SEQ ID NO: 4694 - RNA, 64 nt, Human
guaggaguccugaccccagaugcccaagucuugggggagaaaggaaugggagcccagacagcca

SEQ ID NO: 4695 - RNA, 64 nt, Human
caccucugccacucuuaacacuaagugagaguuggggagaaacugaagccguguuuuuggcccc

SEQ ID NO: 4696 - RNA, 64 nt, Human
cucagcuuuacuugcucccccgcccuuagccuuggggagaaauggcccguggugggcugacccc

SEQ ID NO: 4697 - RNA, 64 nt, Human
ucuugucuuaccacaguguuuuauaggagagauugggagaaaucauccuguuuucucugugacc

SEQ ID NO: 4698 - RNA, 64 nt, Human
gggcuccugggcccuguucuuaggaucaguggcagggagaaacggguaucucuuuucucucuuc

SEQ ID NO: 4699 - RNA, 64 nt, Human
ggugggguggggugggggaggggggggugggguggggagaaaucacauaaccuuaaaaaggacu

SEQ ID NO: 4700 - RNA, 64 nt, Human
ucuuuagugcuuucuugucaguggcguugggagggggagaaaaggaaaagaaaaaaaaaagaag

SEQ ID NO: 4701 - RNA, 64 nt, Human
auuugucauggaggcagacauacaccagaaaugggggagaaacaguacauaucuuucugucuuu

SEQ ID NO: 4702 - RNA, 64 nt, Human
ccacagccccaucaaagaacagagaggaggaggagggagaaauggccaccacaucaccccagag

SEQ ID NO: 4703 - RNA, 64 nt, Human
gaaugaugucucugaaagcuguccuuucagaugagggagaaaugaaggauuucacacuucagaa

SEQ ID NO: 4704 - RNA, 64 nt, Human
gaugcuggagagguuaaggugcaauaagaauuuagggagaaauguuguucauuauuggagggua

SEQ ID NO: 4705 - RNA, 64 nt, Human
aagaacagagaauggucuuucccagggacacaaagggagaaaugggacauggauucuugaucuu

SEQ ID NO: 4706 - RNA, 64 nt, Human
uccaauuaaugaugucugacaugcuauuuuuguagggagaaaauaugugcuaaugauauuuuga

SEQ ID NO: 4707 - RNA, 64 nt, Human
ugccaacuggcaguuagaagcgaaagauggcauugggagaaauuuuagagagcuuucaaacucu

SEQ ID NO: 4708 - RNA, 64 nt, Human
gaaaagcauugccaguucagucuuuucaaaaugagggagaaacauuugccugccuuguaauaac

SEQ ID NO: 4709 - RNA, 64 nt, Human
gcauuuagccuucaacccuaccugucuugcugaagggagaaaaauguuuuaguacauuauaggc

SEQ ID NO: 4710 - RNA, 64 nt, Human
aagaggggaaaaugaguuuuuauggggcugaacggggagaaaaggucaucaucgauucuacuuu

SEQ ID NO: 4711 - RNA, 64 nt, Human
cugcagaacguauugguccagcuugcucuucagugggagaaaacacuuguaaguugcuaaacga

SEQ ID NO: 4712 - RNA, 64 nt, Human
gaugccgacuggaagggagggagagggagggggagggagaaaauggggcuaugccuggcuuagg

SEQ ID NO: 4713 - RNA, 64 nt, Human
uaugaacugauguucucgugaaauguugaggguggggagaaaagacuuuaagggaggagagcca

SEQ ID NO: 4714 - RNA, 64 nt, Human
ccauccagccaggccacccacaacccgagaaucagggagaaagucccuccccagcagcccccuc

SEQ ID NO: 4715 - RNA, 64 nt, Human
auagagaaaccaaccugauacacacuuucaugaugggagaaaaaugugggagugaaaugguauu

SEQ ID NO: 4716 - RNA, 64 nt, Human
auuaagugccauauauaauuaguucucagaagaagggagaaaugaucauaggacugggaauugu

SEQ ID NO: 4717 - RNA, 64 nt, Human
aauauuugaagaaagaauuuaacaggcacugauggggagaaagcuagcuguagguaaugugagc

SEQ ID NO: 4718 - RNA, 64 nt, Human
uuuccuuugaugggcuuaaaagaaauuauccaaagggagaaagagcaguaugccacuucuuaaa

SEQ ID NO: 4719 - RNA, 64 nt, Human
cuuucugccagacugagggugcuuuuuggggggugggagaaaugaacugacagauaaacaguaa

SEQ ID NO: 4720 - RNA, 64 nt, Human
acuuguuaaaaaucaaaaucuuacugauuguacagggagaaauuaagcauucuguuuuaaaaau

SEQ ID NO: 4721 - RNA, 64 nt, Human
cuugcucuacagcacaaccucuugaggguggacagggagaaagaugauggugucagaggucaaa

SEQ ID NO: 4722 - RNA, 64 nt, Human
uuuacuugaaaaacucuugaucaagaauuugggugggagaaaagaaaguggguuaucaagggug

SEQ ID NO: 4723 - RNA, 64 nt, Human
aguuuugaucccaaaagcuuuuuuguuacaaaucgggagaaaaauccauuuuaguucuauggau

SEQ ID NO: 4724 - RNA, 64 nt, Human
cauccucaagaauccacugcuuuucaggcaaggagggagaaauccugcugcacacuggcuuugu

SEQ ID NO: 4725 - RNA, 64 nt, Human
ucaccaauauuuaaacaucaguacuaguuguccugggagaaagggaaaggaguuuuauguugcg

SEQ ID NO: 4726 - RNA, 64 nt, Human
aaugauaauaagaaacauuguuacagauggugaagggagaaagugguauuuauuaauauaaugu

SEQ ID NO: 4727 - RNA, 64 nt, Human
cagaaaaaacugagacuauggacauucaaaucaugggagaaaauaauuuuguagauuauguucc

SEQ ID NO: 4728 - RNA, 64 nt, Human
aagcaacuauuguacaaauuaaaaauaaccauaagggagaaaccagaagaauuccucugaccac

SEQ ID NO: 4729 - RNA, 64 nt, Human
gguaauauuuggagcuuuauagccuguauuccuugggagaaaaaaaugggaauuggaguaaaaa

SEQ ID NO: 4730 - RNA, 64 nt, Human
accuuauguuuuuauguaaucagucauuacacuagggagaaauuuaucagcuuuaguucuaaau

SEQ ID NO: 4731 - RNA, 64 nt, Human
ugugaggaggaaaaggaaaaaaagcaaaaagcaagggagaaaagagaaaccgggagaaggcaug

SEQ ID NO: 4732 - RNA, 64 nt, Human
aauauuuaaacaucaucucacccacccccacaaggggagaaaaaguaggggaagcggauggaga

SEQ ID NO: 4733 - RNA, 64 nt, Human
acuauguguuuggucuauuuccaaaaaccugagggggagaaaauacuuugcuuuugccuuaaca

SEQ ID NO: 4734 - RNA, 64 nt, Human
ccacugguugacauggcagcaguuacuggcaagagggagaaaggacgcugccgccuaagagugc

SEQ ID NO: 4735 - RNA, 64 nt, Human
gguauuguugggaaaggaacaggcuuggagggaagggagaaaguaggccgcugaugauauauuc

SEQ ID NO: 4736 - RNA, 64 nt, Human
uguauguaaaaaaagaaaucguguuuccugauaugggagaaauuaaauaaaaaccaaacgcuuc

SEQ ID NO: 4737 - RNA, 64 nt, Human
uccugaagaacuucgagaagcucaagaagcccaggggagaaacaaagggaaugaucuauugaga

SEQ ID NO: 4738 - RNA, 64 nt, Human
cuuuuuccuuccuucuuuccucccuuuaauauaagggagaaauacaugguuuuuguggaaauca

SEQ ID NO: 4739 - RNA, 64 nt, Human
ugcuauugaaaaacuuucuggaaaggaaauaaaugggagaaaaauaaaauuaauugaaggcagc

SEQ ID NO: 4740 - RNA, 64 nt, Human
uuccagccccaguccaaaauaguucauagggcuagggagaaaggaagauggacucuuggcuucc

SEQ ID NO: 4741 - RNA, 64 nt, Human
uuggauggcuuuuuuuuuuuccuccagggagaaggggagaaauguacuuggaaauuaauguaug

SEQ ID NO: 4742 - RNA, 64 nt, Human
ccuucugagccucaguuuccucaucuguaaaguggggagaaaagucuguuugccucaggagugu

SEQ ID NO: 4743 - RNA, 64 nt, Human
uggucaugaaagcgugguucuguaagaaaucagagggagaaagggagagaagggggagggagac

SEQ ID NO: 4744 - RNA, 64 nt, Human
gcuuuggggugcaauuaauaaacugauuuuauuugggagaaacaaggaagggugcacuuaacua

SEQ ID NO: 4745 - RNA, 64 nt, Human
gcuccaguaauuggugacccaacccuaggaaguagggagaaaugaaggaagggcauaggaaaau

SEQ ID NO: 4746 - RNA, 64 nt, Human
caauugaauaugccuuuuucugcgggaguagguggggagaaacuuaaagguucacuuguaaaac

SEQ ID NO: 4747 - RNA, 64 nt, Human
ugaaaagagcaccuguacuuuucaagccacuggagggagaaauggaaaacaugaaaacagcaau

SEQ ID NO: 4748 - RNA, 64 nt, Human
ucuaaaaauuaucccauuuucugaugauuugaaggggagaaaagccaguguauguaaagaaaau

SEQ ID NO: 4749 - RNA, 64 nt, Human
uccucuacaucaauuaacaucgugggucacuacagggagaaaauccaggucaugcaguuccugg

SEQ ID NO: 4750 - RNA, 64 nt, Human
agccuugauccagaagccagaggauggacuaagugggagaaauuagaaaacaaaacgaacucug

SEQ ID NO: 4751 - RNA, 64 nt, Human
cauggucaaguggugcuaacccaagacuguaacagggagaaaugcccagaaucaucaaaauagu

SEQ ID NO: 4752 - RNA, 64 nt, Human
uauauguauguacuuuaucacaaaguggccuuuggggagaaagucauguauuuguucgcaauua

SEQ ID NO: 4753 - RNA, 64 nt, Human
cugcaaguaagacucaacagaccuaauuuggauggggagaaaaacucucaucccugacccuucc

SEQ ID NO: 4754 - RNA, 64 nt, Human
aaaucagauuguuuucacaguuaugauucccagugggagaaaaaugccucaauauauuuguaac

SEQ ID NO: 4755 - RNA, 64 nt, Human
ccuggcugugucccuggacggguggacuuagcuagggagaaagucgaggcagcagcccucgagg

SEQ ID NO: 4756 - RNA, 64 nt, Human
aucugcggcuuaaacucaucucgcuugaagggcagggagaaacccaugaaucucaggcacgguu

SEQ ID NO: 4757 - RNA, 64 nt, Human
guauauauuuaaauggaagagaaaauauuuuuaugggagaaaaauacauuugaaccaugaaauu

SEQ ID NO: 4758 - RNA, 64 nt, Human
aggauaauggggaacaguggggcugggaccgggugggagaaagaguucucagugguuccuuucu

SEQ ID NO: 4759 - RNA, 64 nt, Human
auuguguaacaaguacugcucccagcagcaauuagggagaaaacuagucuaaauuauuucaacu

SEQ ID NO: 4760 - RNA, 64 nt, Human
uuggcaggaaaaaugcagcuuucaaaucauuggggggagaaaaaggaugucuuucaggauuauu

SEQ ID NO: 4761 - RNA, 64 nt, Human
uugagaaucaaucaauaaagaaagauggaaggaagggagaaauuggaauguuuuaacugcagcc

SEQ ID NO: 4762 - RNA, 64 nt, Human
agagcgagcagcguggagcucagugacagcagcagggagaaauccacugaaggaaaaaacccaa

SEQ ID NO: 4763 - RNA, 64 nt, Human
uggucacagcuaguuucugucagcugggcucucugggagaaagcuggcuguuguccaaugccuu

SEQ ID NO: 4764 - RNA, 64 nt, Human
guacaagaaggaaaaauagagcaaaaauccaagggggagaaacucauuaaaaugagcucucauu

SEQ ID NO: 4765 - RNA, 64 nt, Human
cuguuuaaauaguguuuaauauugauuggggguggggagaaagaaaaaguguauuacuuaaaga

SEQ ID NO: 4766 - RNA, 64 nt, Human
gcuacaagagaaaaagcagaggccaagaguuugagggagaaauagucggugaagaaaccguauc

SEQ ID NO: 4767 - RNA, 64 nt, Human
aaaccagguaauugaaugaagaaaggucacuaaagggagaaaugacauguuuucuauuuucuuu

SEQ ID NO: 4768 - RNA, 64 nt, Human
gccaucuuaaucacagaccucaggggcuccaacagggagaaaaaacaaucacuggucuugucua

SEQ ID NO: 4769 - RNA, 64 nt, Human
acagaauguuugaagaagagaauagugacaaguggggagaaagccacuuuguuucucauuucuu

SEQ ID NO: 4770 - RNA, 64 nt, Human
ugugcccuggggagccucagaagccugcgaccuugggagaaaagggccagggcccugagggccu

SEQ ID NO: 4771 - RNA, 64 nt, Human
auauauauauauauauauuuauauuuuugggggugggagaaauccaaaauaaaguaaaugcuug

SEQ ID NO: 4772 - RNA, 64 nt, Human
ccagcgacacagaaggggguggggcgggucuauggggagaaagggagcgaggucagaggagggc

SEQ ID NO: 4773 - RNA, 64 nt, Human
gcugccaaaggggcagagggugguggagaggagagggagaaagggaagucccagggcccggggu

SEQ ID NO: 4774 - RNA, 64 nt, Human
ccuguggucagagcccaagcagcacucaggagaggggagaaaggaggugcaccuggcagcccac

SEQ ID NO: 4775 - RNA, 64 nt, Human
uuacuuccgccccuggcagggacuucuggguuaugggagaaaccagagaugggaaugaggaaaa

SEQ ID NO: 4776 - RNA, 64 nt, Human
cuaaaugacaaaaccauaaaaaccuuccaauguggggagaaaggaagcuuuccgaggccugagu

SEQ ID NO: 4777 - RNA, 64 nt, Human
ccccauucugccugcccaggccccugccacccuggggagaaaguacuucuuuuuuuuuauuuuu

SEQ ID NO: 4778 - RNA, 64 nt, Human
gagagaggcugggaugggccugcuuccugucuuugggagaaaacgucuugcuugggaaggggcc

SEQ ID NO: 4779 - RNA, 64 nt, Human
cagcaguuuucaagucaaauuaauaaucuuauuagggagaaaauucaauuguaaauugaaucag

SEQ ID NO: 4780 - RNA, 64 nt, Human
aaggagcaccaguucccucuucauucuugaagcagggagaaauugaccuuugccuugucgccca

SEQ ID NO: 4781 - RNA, 64 nt, Human
acuuauaaaauguuuaaaaaaauguucaaagcuugggagaaaagcuuucuucauuagucaaggu

SEQ ID NO: 4782 - RNA, 64 nt, Human
gcagcaguguaccagugucacucuggaguacagcgggagaaacacaaaauaguauaacugaaaa

SEQ ID NO: 4783 - RNA, 64 nt, Human
cgggaucccgagggccuuccugcccacaugccccgggagaaaccgaggccccucccuccuccug

SEQ ID NO: 4784 - RNA, 64 nt, Human
ugauggggcacacccuuggccucucguccacgaggggagaaaccuaaacccuguuucacaaucu

SEQ ID NO: 4785 - RNA, 64 nt, Human
caaggagaagcuauuauauuuuguuaagaaaguggggagaaaaaaaccaagaggccaccgugcc

SEQ ID NO: 4786 - RNA, 64 nt, Human
ugggagggguuggaaaccaaguugucuccugggggggagaaaacagguuuuauuuuuguggcug

SEQ ID NO: 4787 - RNA, 64 nt, Human
aaccggucccuggcaauucuguuuacaugaaauggggagaaagucaccgaaaugggugccgccg

SEQ ID NO: 4788 - RNA, 64 nt, Human
uaccgauuugccucccuggcugugucuuucuugagggagaaaucgguaacaguugccgaaccag

SEQ ID NO: 4789 - RNA, 64 nt, Human
uuccuguuuuggagacugccuauaaguuaauauugggagaaaugacuugugcccuaaacaaccu

SEQ ID NO: 4790 - RNA, 64 nt, Human; identical to SEQ ID NO: 4789

SEQ ID NO: 4791 - RNA, 64 nt, Human
gauuuaugucaccaguggggaucagugcgggugggggagaaaaacgucgggcgauccgggaaua

SEQ ID NO: 4792 - RNA, 64 nt, Human
uaagcaaauuacuuacuguauuuuuauggcaggagggagaaaaaguguuacaacgguuucuaau

SEQ ID NO: 4793 - RNA, 64 nt, Human
guccuguggaaaggccaagcagugaccaggaagagggagaaacuucugcucagguaaaacccgc

SEQ ID NO: 4794 - RNA, 64 nt, Human
gcugcuccuuugcuucggaccuccgccucugcccgggagaaagcccaggccagccugcuggaca

SEQ ID NO: 4795 - RNA, 64 nt, Human
aggagcuaaaugacaaaacacagcaguguuuugagggagaaaggaccaucauuuauaaugcucu

SEQ ID NO: 4796 - RNA, 64 nt, Human
cgccggccucagcuacuagcccaccagcccaccagggagaaaagaagccaugagaggcagcgcc

SEQ ID NO: 4797 - RNA, 64 nt, Human
ggcaaagguuccuaaaugguaaucuggccggccugggagaaagacucacgagaaaagccagugg

SEQ ID NO: 4798 - RNA, 64 nt, Human
aaaacggggggguucucccccuccugauuaaaaagggagaaagaaaacugcgauuuuauagcug

SEQ ID NO: 4799 - RNA, 64 nt, Human
gcccacccaaaggacaaauggggagcucuagagugggagaaagaaugauggaagaagaguccag

SEQ ID NO: 4800 - RNA, 64 nt, Human
agucccuguaaaauguuaggucacccaaggaaaggggagaaauagcaaugguuguuccuaaggu

SEQ ID NO: 4801 - RNA, 64 nt, Human
augugaugacuccaaagggguucauuucacuauagggagaaauugauucgucugacuuccuauu

SEQ ID NO: 4802 - RNA, 64 nt, Human
agaaaggagccuugaaugguggagggaggcaguggggagaaaggucucaccggacagguuggga

SEQ ID NO: 4803 - RNA, 64 nt, Human
cggagggcggcuccuagcuccguggacuaggcgggggagaaaggaagccuuucugagagcgggc

SEQ ID NO: 4804 - RNA, 64 nt, Human
caaagcgggagcccugaaaaauuaggggggaaaugggagaaaauaaugugacauuucaaaaaca

SEQ ID NO: 4805 - RNA, 64 nt, Human
cuagcugcggugcuccuugcugguuuuuaacuuggggagaaacaccggguuucagcuuucuuga

SEQ ID NO: 4806 - RNA, 64 nt, Human
gucccaagagccauaagggggugggaauuggggagggagaaaggguaguucaaagagucugucu

SEQ ID NO: 4807 - RNA, 64 nt, Human
cccugccuuccucugaggacaggcucuagagagagggagaaacaaguggaccucgucccaucuu

SEQ ID NO: 4808 - RNA, 64 nt, Human
ggcccaaguuugggcauuuuggcaguagcuguaugggagaaaaagaguaagaggaaauauuccc

SEQ ID NO: 4809 - RNA, 64 nt, Human
gguucaacugugaauguagaagugggggggaggggggagaaaaagaaaacucuggcguuagagg

SEQ ID NO: 4810 - RNA, 64 nt, Human
agguacaauacggaaugaagaagaggggaaaauggggagaaagaugguuaaaauacauaauaau

SEQ ID NO: 4811 - RNA, 64 nt, Human
ggugcagcugagguucccgacaccagaagcuguugggagaaagcaauacguuugugcagaaucu

SEQ ID NO: 4812 - RNA, 64 nt, Human
uuaaauuuggugccgauguugaacuuuuuuuaaggggagaaaauuaaaagaaauauacaguuug

SEQ ID NO: 4813 - RNA, 64 nt, Human
guccuaacagagaaauagaggugaugcugcuaaagggagaaaugccaggcggacaaaguucagu

SEQ ID NO: 4814 - RNA, 64 nt, Human
caggccuggcuuauuccaagaggcugagccaauggggagaaagauggaggacucacugcacagc

SEQ ID NO: 4815 - RNA, 64 nt, Human
cugccuggcacccacgcuggcucucuccugccgcgggagaaagcaccagcagguucugagcccu

SEQ ID NO: 4816 - RNA, 64 nt, Human
cccuuccugcuuccuguuaccugucuugcuccuggggagaaagaggggccugaugagacuccac

SEQ ID NO: 4817 - RNA, 64 nt, Human
ucccgcaggcugagcaagucuguaaacugauucugggagaaaccaagcugcuggccauagggug

SEQ ID NO: 4818 - RNA, 64 nt, Human
ccacccagggccuuccacccucggcuccugugcugggagaaacuuccaggcguggacagcccag

SEQ ID NO: 4819 - RNA, 64 nt, Human
aggagggcuuguuuggagaagggaggcuggcugggggagaaacccggaucccgcugcaucuccg

SEQ ID NO: 4820 - RNA, 64 nt, Human
ugauaaaaguagacuggauccccugggguauuuggggagaaaguaacuacuuuggcucuacccc

SEQ ID NO: 4821 - RNA, 64 nt, Human
uugcugauucucaguuuggucacugcuuuucuuggggagaaaacagagaagaggcaauuucgug

SEQ ID NO: 4822 - RNA, 64 nt, Human
ccauccugggcacaguuacacccucccaugcagugggagaaacacagacccucguacccaaagg

SEQ ID NO: 4823 - RNA, 64 nt, Human
uuggggaggaggaaggggcgauuugagggagaaggggagaaagcuuauggcugggucugguuuc

SEQ ID NO: 4824 - RNA, 64 nt, Human
ccaugaucaggggauguggcgggggguggcuagagggagaaaaaggaaaugucuuguguuguuu

SEQ ID NO: 4825 - RNA, 64 nt, Human
cuuuuguacgcuuuucaccccacccccaaguccugggagaaaugcaggcaacacugagacaugg

SEQ ID NO: 4826 - RNA, 64 nt, Human
cuaggaccucucgaaagucucugugggggcaugagggagaaaaggccauugggagaauuacugc

SEQ ID NO: 4827 - RNA, 64 nt, Human
acugcugugaacucacuuugaggggguaggaggagggagaaacagccuguguuuuuuaugcaau

SEQ ID NO: 4828 - RNA, 64 nt, Human
ugguguauuauuugggggagggagggauggggaggggagaaagggagauggguagcaucauuuu

SEQ ID NO: 4829 - RNA, 64 nt, Human
gaaggaagagagagggagcaggcggagcgagagagggagaaacaggcgcggggucucagguugg

SEQ ID NO: 4830 - RNA, 64 nt, Human
uaaaugaaaggaguuuaaaaacauuuuuuaaggagggagaaaggagaaauuuugguuuuucaac

SEQ ID NO: 4831 - RNA, 64 nt, Human
ugccacccuucccagucccaggacgggcccuggagggagaaaggagccugugcccccugauggc

SEQ ID NO: 4832 - RNA, 56 nt, Human
uugcuacagcuuccaguugaaugccggggagaaaccuguccaauuuuagcagguuu

SEQ ID NO: 4833 - RNA, 64 nt, Human
aauauugaauccaaggaagagagcccaaggguaggggagaaaccccccacaacugaccccugcc

SEQ ID NO: 4834 - RNA, 64 nt, Human
auuccagggccagcaaagccggcguucagaaggagggagaaaaccgugagaggauguguguggc

SEQ ID NO: 4835 - RNA, 64 nt, Human
ggugcccagcgagcugagcaccagugggugaccggggagaaacagggcagacuggguaagggag

SEQ ID NO: 4836 - RNA, 64 nt, Human
acaugauaggcuuacuucugcuccauaauaaagugggagaaaaaagccagaauauaacuuaaga

SEQ ID NO: 4837 - RNA, 64 nt, Human
ccaugaagaaaacgucaugaucugccucggaguggggagaaacaggcccuccuuguccuugugc

SEQ ID NO: 4838 - RNA, 64 nt, Human
cgcccccucccggccccucccugcccuccauucagggagaaaccucuccuucccgugugagaag

SEQ ID NO: 4839 - RNA, 64 nt, Human
aaagguucaauuccuaccaaauaguuucuaaugugggagaaaaacuuggcacaaaauuucuuca

SEQ ID NO: 4840 - RNA, 64 nt, Human
cuuuauugauucaucgaggagaacuugguagauggggagaaaacacaguugguuuuuuuuucca

SEQ ID NO: 4841 - RNA, 64 nt, Human
aagggaaacacccucaauuaggaaacauuccaaggggagaaaagcugcaaauugcucaacuggc

SEQ ID NO: 4842 - RNA, 64 nt, Human
uguugggguuuuucagacugacaggacugcaagagggagaaaggaauuuugucaaucaaaauua

SEQ ID NO: 4843 - RNA, 64 nt, Human
uuguauugaaucuguuuguguuauuaacagaagagggagaaaugucaugagacguuggacaggc

SEQ ID NO: 4844 - RNA, 64 nt, Human
aagggagaugaccugugauuagacugggcggcuggggagaaacaguucagugcauuguuguugu

SEQ ID NO: 4845 - RNA, 64 nt, Human
cuuccuuucuccugaaaccuaauaaucucuccgagggagaaagggguucucugcgguauuccag

SEQ ID NO: 4846 - RNA, 64 nt, Human
uuuuuuauuuuuuauuuucuuuuugguuuggggagggagaaaaguucuuagcacaaauguuuua

SEQ ID NO: 4847 - RNA, 64 nt, Human
aaauacucaaccaaaagacagucgagaagccagggggagaaagaacucagggcacaaaauauug

SEQ ID NO: 4848 - RNA, 64 nt, Human
gaucaaguugucauuuuagaacagagggaacuuugggagaaagcagcccaaguagguuauuugu

SEQ ID NO: 4849 - RNA, 64 nt, Human
auuuuuauuuuuuaguaauuuaggggagggaggagggagaaagggauaaugaugcccuuggcau

SEQ ID NO: 4850 - RNA, 64 nt, Human
uuggucguuccugagugugggccaagcuaacuuugggagaaauuuacuuuauagguuaaauuau

SEQ ID NO: 4851 - RNA, 64 nt, Human
gagaguaauacacuauugaaaguuaucuuggauggggagaaaaaaaaauagugguuuuccuugu

SEQ ID NO: 4852 - RNA, 64 nt, Human
agcuaccuacaugcugucauugaacagagauguggggagaaauguaaacaaucagcucacaggc

SEQ ID NO: 4853 - RNA, 64 nt, Human
agaagucagcgcaggaagagccugcuuuggacacgggagaaaagaagccauugcuaacuacuuc

SEQ ID NO: 4854 - RNA, 64 nt, Human
uaagcuguaaaaacagaacaaugacauaaaucaagggagaaagaaaaugggcacuuuaugucuc

SEQ ID NO: 4855 - RNA, 64 nt, Human
agguccuaacaggagucacuggcucaggaccccagggagaaacgcucuccccacccacgccaug

SEQ ID NO: 4856 - RNA, 64 nt, Human
ccaguucuuuucaauaucaugaaagaacacacuagggagaaacccuaucaauguaagcaaugug

SEQ ID NO: 4857 - RNA, 64 nt, Human
aguucuuuucaauaucaugaaaggacucacacuggggagaaaccguaucaauguaagcaaugug

SEQ ID NO: 4858 - RNA, 64 nt, Human
gguggugcuggaauccccuaggagccuucagucugggagaaacagagccagacauagacaguuc

SEQ ID NO: 4859 - RNA, 64 nt, Human
acuaccaucagagucaacaggcaaccuacaaaaugggagaaaauuuucgcaaccuacucaucug

SEQ ID NO: 4860 - RNA, 64 nt, Human
gcguuuuuuuauaguagauuuuuaacaaaaaacggggagaaauaaugcauuucuguggauacag

SEQ ID NO: 4861 - RNA, 64 nt, Human
ucaucccucacucuucaugugagaagucacacaggggagaaacccuaugaauguaauaaaugug

SEQ ID NO: 4862 - RNA, 64 nt, Human
acuggaauuugaaaagccaaacugugaaaccauugggagaaaauagaugauauugucuaugacg

SEQ ID NO: 4863 - RNA, 64 nt, Human
cagaaccaugaacaggaauagaacucguauuuaggggagaaauagggcugguggcucucuuggu

SEQ ID NO: 4864 - RNA, 64 nt, Human
caggacaucaaacagccuccgggccuggaugggagggagaaaaaaaugaggaaccagucauuaa

SEQ ID NO: 4865 - RNA, 64 nt, Human
uuucucuccugcagaaggaaagccacgcaaguuggggagaaaacccccaaggaugaaucugcca

SEQ ID NO: 4866 - RNA, 64 nt, Human
ccauuuuuuuuaccccuuggaggaaauaagaugagggagaaaggagaaggggaggaaacuucuc

SEQ ID NO: 4867 - RNA, 64 nt, Human
ucguuuaggauuaguugaguuccagcuggguuuugggagaaaggagaugcuaccaagucuugga

SEQ ID NO: 4868 - RNA, 64 nt, Human
aggauccuccuauguuguugaaggagggacuagggggagaaacugaaagcugauuaauuacagg

SEQ ID NO: 4869 - RNA, 64 nt, Human
cacagcaaaagaagcuauuugcagacuacagaaugggagaaaauguuuacaaacugcaucugac

SEQ ID NO: 4870 - RNA, 64 nt, Human
aaucccucaaguugaaaaaaaaaucaauuuaaaggggagaaaacuucagcacgucucaacagaa

SEQ ID NO: 4871 - RNA, 64 nt, Human
ggagaaauggccucccgucuugugaacuucaauggggagaaauaauuagaaugagcaauagaaa

SEQ ID NO: 4872 - RNA, 64 nt, Human
ucuguccaugucugucuaaaaggggaggagaugagggagaaaaaagggaaucuacucagagccu

SEQ ID NO: 4873 - RNA, 64 nt, Human
uaucagcagggauucaugugacagcucacacuaagggagaaaaccugugaaggucucagaaggc

SEQ ID NO: 4874 - RNA, 64 nt, Human
ucccuguucucucugaagacaugaaaacucacuggggagaaacccuaugaauguaaaaaugugg

SEQ ID NO: 4875 - RNA, 64 nt, Human
ucaugccuaaguaugcaugaaagaauucacacuggggagaaauacuaugaauguaaggauauga

SEQ ID NO: 4876 - RNA, 64 nt, Human
agaauggaacauugaagagcaguacaaaaaccaggggagaaaucucaggugagucacacucaga

SEQ ID NO: 4877 - RNA, 64 nt, Human
auuggauuucaaagacaugaaaggacucacacuagggagaaaaucuauaaauguaaauguggga

SEQ ID NO: 4878 - RNA, 64 nt, Human
aguucuuaucuaagacaugaaagaacacguacuggggagaaacuguaugaauguaagcaguguu

SEQ ID NO: 4879 - RNA, 64 nt, Human
uaucacucuaaaauuugucaaacaccuuuaaaaggggagaaaaaaugaccacugaacuuacauu

SEQ ID NO: 4880 - RNA, 64 nt, Human
gcacaucuaaugagacaucagagaauucacaguggggagaaacccuaugaauguaaugaaugug

SEQ ID NO: 4881 - RNA, 64 nt, Human
gccccuccacucuucucuuccucucuuuuuuggggggagaaaccucggaauuucuaugagaccu

SEQ ID NO: 4882 - RNA, 64 nt, Human
auggguccccugggguagaugcauuguggguggggggagaaagcuuguggcuccuguccgaggg

SEQ ID NO: 4883 - RNA, 64 nt, Human
ccccauccucccagaccugggcaggagcugugcugggagaaaggguggcagccgggagccucag

SEQ ID NO: 4884 - RNA, 64 nt, Human
uguaaauguauuugcugaaagagagcacaaaaaugggagaaaaugcaaacaugagcagaaaaua

SEQ ID NO: 4885 - RNA, 64 nt, Human
ccgcgacccccacuaaauuucuagauuggggauagggagaaagggaggcccaggaaggucuccc

SEQ ID NO: 4886 - RNA, 64 nt, Human
ucagacaggcugggggccucacucuguuuuccaggggagaaaccugagucucagagcaggggag

SEQ ID NO: 4887 - RNA, 64 nt, Human
auggaggucagagccacaagggaaaggggagagggggagaaaacuguacucuguccagacauga

SEQ ID NO: 4888 - RNA, 64 nt, Human
cagaucauaauugucaaaaaugcugggaaagguugggagaaauuuuauuucuaacacauuccag

SEQ ID NO: 4889 - RNA, 64 nt, Human
cugaacugagccaaaccuucagugccuuccagaagggagaaaggcagaagccuguguggagugu

SEQ ID NO: 4890 - RNA, 64 nt, Human
auggcgcaacaggagucagucucuuucuguacaagggagaaaagcuguacgcguuugucucgug

SEQ ID NO: 4891 - RNA, 64 nt, Human
aacccuagaacuugaauaggugccuguucuuguagggagaaaugagaaaucgcauuuggaucca

SEQ ID NO: 4892 - RNA, 64 nt, Human
uguuaaaaguagggacucugccuuuuuguugguagggagaaaaaacgcuauugcuuugucuuac

SEQ ID NO: 4893 - RNA, 64 nt, Human
cucccacaggccucucuuucuuucuagguugcuggggagaaauggguacccuaugaucccccuc

SEQ ID NO: 4894 - RNA, 64 nt, Human
uucugauuguuagacuguaaugcuauuccucuaugggagaaaaaaauuaauauaaagaaaaaca

SEQ ID NO: 4895 - RNA, 64 nt, Human
cccauaugucagaagcucccagcaccuccuacuugggagaaaagugagccaucugcuggucagg

SEQ ID NO: 4896 - RNA, 64 nt, Human
cugggagggcaugggagcagugagcaggcccauggggagaaauuggccaauuuaauucagaggg

SEQ ID NO: 4897 - RNA, 64 nt, Human
auuguaucugacccuucuuuaaguuauguguguggggagaaauagaauggugcucuuaucuuuc

SEQ ID NO: 4898 - RNA, 64 nt, Human
agggcugcccccaccacacacacccccgcgucucgggagaaacccacccucuucagagccugca

SEQ ID NO: 4899 - RNA, 64 nt, Human
agagcagccucuugaaugcuuaaaugaucaaggagggagaaaggcaaaccaauuuguucugugc

SEQ ID NO: 4900 - RNA, 51 nt, Human
gacaccagaggacacacugacgggagaaaccuguguaugcaggggucauga

SEQ ID NO: 4901 - RNA, 64 nt, Human
agccaccuaugugaucuuuaaauccaaccccaaugggagaaaagggcaagaacagucugugccc

SEQ ID NO: 4902 - RNA, 64 nt, Human
ggaggucauggaaccccucuguggaacccacaaggggagaaaugggugauaaagaauccaguuc

SEQ ID NO: 4903 - RNA, 64 nt, Human
gauacucugacaggccacugcaucucagauucaggggagaaaauaaguugucaccuccccuuca

SEQ ID NO: 4904 - RNA, 64 nt, Human
ggggagagguuuggccuaaaaagcauguagaugggggagaaauggguggggggagaggaacagc

SEQ ID NO: 4905 - RNA, 64 nt, Human
caccauuuacugaugaggaaacuaaggcuccuaggggagaaaucacuugcccacaguuccacag

SEQ ID NO: 4906 - RNA, 64 nt, Human
auuuuaaaugguaggaauuuaaggugugacuucagggagaaacaaacuugcaaaaaaaaaaaau

SEQ ID NO: 4907 - RNA, 64 nt, Human
gcagugaaucgggacacaaaccacccaccccauugggagaaaaacccagacgccaggaaaagaa

SEQ ID NO: 4908 - RNA, 64 nt, Human
aauguuaagggauuuauaugcagugggcuuuucugggagaaaguuauucagcucuugagcaagu

SEQ ID NO: 4909 - RNA, 62 nt, Human
cagcuagcaaacagucuuaggaaucgugcagggggagaaauccuugagccagggcugccaua

SEQ ID NO: 4910 - RNA, 64 nt, Human
auggaaacuucucuugugucuguugagacuuuaagggagaaaugucggaauuucagagucgccu

SEQ ID NO: 4911 - RNA, 64 nt, Human
cgccuuguuccugcucuucccaguucagcuuggugggagaaagucauucgcguggcucgggacg

SEQ ID NO: 4912 - RNA, 53 nt, Human
gguucaaaaugucccccugauaagggagaaaggcaccaagcuaacaucugacg

SEQ ID NO: 4913 - RNA, 64 nt, Human
agggaaugaugugauucaagcuggaaagaggguugggagaaacagcuuguccagguggagcuau

SEQ ID NO: 4914 - RNA, 64 nt, Human
cacuucaaaugacaaguucauauauagaauuuacgggagaaacuugagaccauuuacggggaga

SEQ ID NO: 4915 - RNA, 64 nt, Human
uagaauuuacgggagaaacuugagaccauuuacggggagaaacuugauucugggaagauagcag

SEQ ID NO: 4916 - RNA, 64 nt, Human
auaguggaucagaauaaagguuauucuaacuguggggagaaaaaaaaaauuguaucaaguucca

SEQ ID NO: 4917 - RNA, 64 nt, Human
aagaccuguuuuacuuuaccucacuaacaauggggggagaaaggaguacaaauaggaucuuuga

SEQ ID NO: 4918 - RNA, 64 nt, Human
cugguccucugcguuguagugcuaccucaaucucgggagaaacagcccuauauucuaacaaguu

SEQ ID NO: 4919 - RNA, 64 nt, Human
auaugggcuuuuaaguaaagcuuagaacccuggggggagaaaagcagucaggugagguuugaga

SEQ ID NO: 4920 - RNA, 64 nt, Human
guguucuaggcccgcccaccccaaccuucugguggggagaaauaaacgguuuagagacuaggag

SEQ ID NO: 4921 - RNA, 54 nt, Human
aggccgccaaggggaaguaaggcagggagaaaggaacauccggaacagccaaag

SEQ ID NO: 4922 - RNA, 64 nt, Human
uaugcacugaugaggaaagacauacugugugauagggagaaaaagcagcuuauaaaauaaugua

SEQ ID NO: 4923 - RNA, 64 nt, Human
uugggacuuaacacuucagggaagucagcugccggggagaaacuugcuccuaaaugaacacaua

SEQ ID NO: 4924 - RNA, 64 nt, Human
ugguauggcugaacaaggagcggcagacaacucagggagaaacucaggagugcaguaccaggga

SEQ ID NO: 4925 - RNA, 64 nt, Human
cuagggcuaguacuuaguuucacacccgggagcugggagaaaaaaccuguacaguugucuuucu

SEQ ID NO: 4926 - RNA, 64 nt, Human
uuguaauuuuaaaacuuuaaaauaaauuggaaaagggagaaacugagcgguguauuuuuccuca

SEQ ID NO: 4927 - RNA, 64 nt, Human
ggaacccccagucuaggacuugggcauuuuaacagggagaaaguaguggcuucccuuuucucuc

SEQ ID NO: 4928 - RNA, 64 nt, Human
cauuucccagaaucuagaagaauaaaugccaagagggagaaaguugaauuaaacccaggaaaau

SEQ ID NO: 4929 - RNA, 64 nt, Human
ccuccaccugccccccugcuucuuaagaagaugggggagaaaacuuccaaauguuuauaaagaa

SEQ ID NO: 4930 - RNA, 64 nt, Human
cgcucuacuucguaaaagcauuauacaaagucacgggagaaaaauaugggacauuucuugauug

SEQ ID NO: 4931 - RNA, 64 nt, Human
ugcuuuuuaauaauuaugcuucccaucauaacuggggagaaagggaagucaggguucuaggggu

SEQ ID NO: 4932 - RNA, 64 nt, Human
acagagucauauuucucuucuuucaaaagcaaaugggagaaauaucgcugaauucuuuuucuca

SEQ ID NO: 4933 - RNA, 64 nt, Human
aucuccuuccuuucucucccugcuuugcugugaagggagaaauuagccugggccucuacccccu

SEQ ID NO: 4934 - RNA, 64 nt, Human
auagcaccuauagccauuuuaauuuagucauguugggagaaaaauagauggguuacaaauacau

SEQ ID NO: 4935 - RNA, 64 nt, Human
cugccacggucccuccugucauucucacgacuccgggagaaacugugcuguaugauacagaucu

SEQ ID NO: 4936 - RNA, 64 nt, Human
caggaacucuuccccugguuguucuggggaucuugggagaaacacagcccugacagcucguccg

SEQ ID NO: 4937 - RNA, 64 nt, Human
augcugucaguucccaauugacaagucacagacugggagaaaauauuugcaaaucguguaucug

SEQ ID NO: 4938 - RNA, 64 nt, Human
uguccccuuuccuaaagcuccucugcacauagaggggagaaaaagagaauuuaggcaacuccac

SEQ ID NO: 4939 - RNA, 64 nt, Human
ugguaauugggaacugaaauccuugagaguuccggggagaaacccagagaugccugauuucauu

SEQ ID NO: 4940 - RNA, 64 nt, Human
accuuacgcaaccgcgcugcaggggugaggaguggggagaaaccagaaugcuucugaaacuccc

SEQ ID NO: 4941 - RNA, 64 nt, Human
aaagaagcuauuuaggagauaugauaugcuacuugggagaaaacucucacuaacugucucaccg

SEQ ID NO: 4942 - RNA, 64 nt, Human
aacuagauaauuucaagaaacugaguaggacaaagggagaaagaaauacauguucuuuuuccug

SEQ ID NO: 4943 - RNA, 64 nt, Human
cuacaucaaacagaauuuuaaggaaaaaugcagagggagaaauaaggcacaugacugcuucuug

SEQ ID NO: 4944 - RNA, 64 nt, Human
gacaauuuauuaaucaauugacuuagaaaauagggggagaaaucauucauuggagcuucuuucu

SEQ ID NO: 4945 - RNA, 64 nt, Human
uagucuagacuuuaaauuuaaaguuuucuacaaggggagaaaaguguuaaaauuuuuaaaauau

SEQ ID NO: 4946 - RNA, 64 nt, Human
cccugacacuuuuggggucugccugggggaggaggggagaaagcaccaugagugcucacuaaaa

SEQ ID NO: 4947 - RNA, 64 nt, Human
uccaaaaaaaaaaagaaauaaaagacgaagaauagggagaaaaacuucucucauaucauuuauu

SEQ ID NO: 4948 - RNA, 64 nt, Human
uaaauuagagacaugcacacacaaagaaucaguagggagaaacaaaaauacaagucccguucug

SEQ ID NO: 4949 - RNA, 64 nt, Human
guagcugauuaaauuuuucccaacaaccucacuggggagaaaguguguucauguuuuguccagc

SEQ ID NO: 4950 - RNA, 64 nt, Human
ucagggaaaaaggagaggaggaaacagugaggcagggagaaaggcuuuccaaauaagaguucau

SEQ ID NO: 4951 - RNA, 64 nt, Human
aagcagaaagagagaguggccggauggggcugaggggagaaagaauuauuaaacaauaaauacu

SEQ ID NO: 4952 - RNA, 64 nt, Human
cuucuuuucaucucagucauaacccaaaagcuacgggagaaaaagcagaaguguaaucucugua

SEQ ID NO: 4953 - RNA, 64 nt, Human
gcagcaacaaauacuugauagauuuauccuacuugggagaaauauuuuguagcagaguauuuag

SEQ ID NO: 4954 - RNA, 64 nt, Human
guuuguuguccagcaccaauucuggcugucaauggggagaaauaaaccaacaacuuauaauugu

SEQ ID NO: 4955 - RNA, 64 nt, Human
uccacuaguuuuuguuccaaaaauucaaguuuaugggagaaaucucaauuagccaccuuuucac

SEQ ID NO: 4956 - RNA, 64 nt, Human
augaccugcagccaagcccagccccguggggaaggggagaaagugggggauggcuaagaaagcu

SEQ ID NO: 4957 - RNA, 64 nt, Human
uuucuccccuuuugcuugagcaggguucccaggagggagaaagagaagacaagagccugaugcc

SEQ ID NO: 4958 - RNA, 64 nt, Human
gucuuguuaguuugcaguuagccaaggagugaaugggagaaacauaguaucgggugaggccagc

SEQ ID NO: 4959 - RNA, 64 nt, Human; identical to SEQ ID NO: 4943

SEQ ID NO: 4960 - RNA, 64 nt, Human
cugagccgguuuaagucuguggaaaaggaagcacgggagaaauccacguaaccuuugcuuucuu

SEQ ID NO: 4961 - RNA, 64 nt, Human
aacuggaauccuuucacccgcuccuacagcuaacccucacaagcaugaagugcuguggcuguuc

SEQ ID NO: 4962 - RNA, 64 nt, Human
aauggccuucuuuuuaaaagcaaaaaacacaaaaccucacaacugccuggcaagcccaguauca

SEQ ID NO: 4963 - RNA, 64 nt, Human
auuggugccaaguccaguggaugagaauccagccccucacaagcugugggauggggcuugggag

SEQ ID NO: 4964 - RNA, 64 nt, Human
gaggaagcucaggaucugacauguucuuccuuuuccucacaagucaucaugauuuuuuauuuua

SEQ ID NO: 4965 - RNA, 64 nt, Human
accccagaccucaccuccaucccccucugucugcccucacaauuaggcuucauugcacugaucu

SEQ ID NO: 4966 - RNA, 64 nt, Human
aaagaaugacagaacaaucaucuuagcacccuuuccucacaauaauauaaaaauauuaaaagaa

SEQ ID NO: 4967 - RNA, 64 nt, Human
gguauauuaaguccaaaagaugguccgggcugccccucacaaaagcuucugcauccacguggua

SEQ ID NO: 4968 - RNA, 64 nt, Human
ggcagcagaauauugugccccaugcuucuuuaccccucacaauccuugccacaguguggggcag

SEQ ID NO: 4969 - RNA, 64 nt, Human
uccucucaaaggcugaaggcagggccuuuccaguccucacaaccuguccuucaccuagucccuc

SEQ ID NO: 4970 - RNA, 64 nt, Human
auucaguaguggaaaugagugaacuacagcuauaccucacaauaagaaugaaucucagaaaaua

SEQ ID NO: 4971 - RNA, 64 nt, Human
ggccacccugaccuacacauaccgccacugcuggccucacaagccccugguuacugguaaguac

SEQ ID NO: 4972 - RNA, 64 nt, Human
auaccccgaguggggagcaggguucuccucaaagccucacaaccauaggaucauaggaaagggg

SEQ ID NO: 4973 - RNA, 64 nt, Human
ccagaccccaggccggggcauugccagggaggacccucacaaccacguacaugacccuuucucc

SEQ ID NO: 4974 - RNA, 64 nt, Human
ucagagcaccuucacucacauaaugucauuugaaccucacaauguucuugggauggagucaguu

SEQ ID NO: 4975 - RNA, 62 nt, Human
ugaacuagauguaugugaauaaaaauuauuugguccucacaaaaaccucaggaggcgguuac

SEQ ID NO: 4976 - RNA, 64 nt, Human
gaaugaacuuuuuacauuagggcauuuguauuucccucacaauacuugccacauuacuuggcau

SEQ ID NO: 4977 - RNA, 64 nt, Human
aaggaccccucuuuucccuaucugccuaacagugccucacaaggcuugggggcuggacucccuc

SEQ ID NO: 4978 - RNA, 64 nt, Human
ccucugagaccaaaauuuugucccaucucuacccccucacaacugcuuacagaauggaucaugu

SEQ ID NO: 4979 - RNA, 64 nt, Human
cucacauggacccaagauaaaagaauggccaaacccucacaaccccugauguuugaagaguucc

SEQ ID NO: 4980 - RNA, 64 nt, Human
uuaauggacucacaguuccauguggcuggggaggccucacaaucaugguggaaggugaaaggca

SEQ ID NO: 4981 - RNA, 64 nt, Human
guucauuaacagcaucuuuaaaacuguguagcuaccucacaaccaguccugucuguuuauagug

SEQ ID NO: 4982 - RNA, 64 nt, Human
guucccacaacaauggcccuuucacaagcucuugccucacaaccccugcagaaguccuucaaca

SEQ ID NO: 4983 - RNA, 64 nt, Human
ugacucucgugcuuauugcagaugcugugguuggccucacaagcaacgccuuaugcugaugugc

SEQ ID NO: 4984 - RNA, 64 nt, Human
cucuuguugaauugaagauuauucauugcuuuggccucacaaaguuuugauuucaacuaucaua

SEQ ID NO: 4985 - RNA, 64 nt, Human
ucuuggggcugagggagcaccaugcagcuucaccccucacaaagccaugcacgcugggggcucu

SEQ ID NO: 4986 - RNA, 64 nt, Human
ggcaucaugcugggcauuuuauauaugauuuuauccucacaauaauucuguagccaagcagaau

SEQ ID NO: 4987 - RNA, 64 nt, Human
uaaaaucacugugcauauuauagaguuguagccaccucacaaugaaguacuacagccugugcug

SEQ ID NO: 4988 - RNA, 64 nt, Human
cuuggcagagaagcagacguccauagcuccucucccucacaagcgcucccagccugcccuccag

SEQ ID NO: 4989 - RNA, 64 nt, Human
aaauccgcaagcugggugugcuuugagugugcagccucacaaacauggccuuuucucucucccc

SEQ ID NO: 4990 - RNA, 64 nt, Human
cuacaguaauuaauaugcagcuaacuccuguugcccucacaagagcaucagccuucuagaaucg

SEQ ID NO: 4991 - RNA, 64 nt, Human
gacugaaaauucauugcaauuagggaacgcacagccucacaaaaagugguugugauugcaagga

SEQ ID NO: 4992 - RNA, 64 nt, Human
aagaugguggaagacauaggcuaaauuucuccagccucacaauggucuucacuuggucugacuu

SEQ ID NO: 4993 - RNA, 64 nt, Human
agaaaacauuuucuucuguuugcuaaucuuugucccucacaauuuuugaaauccaucucaucac

SEQ ID NO: 4994 - RNA, 64 nt, Human
uuaacggacuuacaguuccacaugacuaaggaggccucacaaucaugguggaaggcaaagagga

SEQ ID NO: 4995 - RNA, 64 nt, Human
aguagggaacauggcagagaguggugcuucccagccucacaaugugggaauuugacauaggaug

SEQ ID NO: 4996 - RNA, 64 nt, Human
aggccauucuccuucucuuccauggagaauccagccucacaaaaggauucuuucaacuucuuua

SEQ ID NO: 4997 - RNA, 64 nt, Human
cccgugcuaagcguuuuauguggacuuauucauuccucacaaugaggcuaugaggaaacugagu

SEQ ID NO: 4998 - RNA, 64 nt, Human
gccgcauuccugcacucagaagucugcagcggugccucacaaacuugauugugcauaaaaauca

SEQ ID NO: 4999 - RNA, 64 nt, Human
agauauugaucaaauauagaaaguugauauucaaccucacaagggcucucaaaguauaaucuuu

SEQ ID NO: 5000 - RNA, 64 nt, Human
caguaaggaccugaagugacuuugagaaauucacccucacaaaccuuccuucaggagcaggcau

SEQ ID NO: 5001 - RNA, 64 nt, Human
gacuggaugugccgugggcagugccuuccuccagccucacaaccuuucugcuggggcugaaguu

SEQ ID NO: 5002 - RNA, 64 nt, Human
ugugcuuuagaccggagauaauacagugacuuuaccucacaaaucauauucugucaacacaaau

SEQ ID NO: 5003 - RNA, 64 nt, Human
aauuucugcuggcuggacugaacugaagaucaauccucacaauucagacugaggguugagacaa

SEQ ID NO: 5004 - RNA, 64 nt, Human
acuagucgucacuacccuuuuuggauucagggcuccucacaauuaaaaugaguguaaugaaaca

SEQ ID NO: 5005 - RNA, 64 nt, Human
cgugccaguaccucaccgcacgaccucacugaguccucacaacaaauccaggcugcagauuuuu

SEQ ID NO: 5006 - RNA, 64 nt, Human
ucucuucuaaacaauuuacauguaaugucucauuccucacaauaacccuuguaaagugggcaug

SEQ ID NO: 5007 - RNA, 64 nt, Human
ucuacaagcuuuuguucacagcuugaaauagaugccucacaauucagacaguuuaauucaggaa

SEQ ID NO: 5008 - RNA, 64 nt, Human
uuuaagucaaaagguauucugaauauaauaaaagccucacaaauuauuuguaaaauuuaguagu

SEQ ID NO: 5009 - RNA, 64 nt, Human
auaguacuuugaauaauguauauuuuaaauuggaccucacaaaucuuguauuaaaguagguaga

SEQ ID NO: 5010 - RNA, 64 nt, Human
uacuuuuuaacuuauaugugaaaugauucauguaccucacaaaaucaugcaaucuugcagugaa

SEQ ID NO: 5011 - RNA, 64 nt, Human
uauguguuuuaaguauaugagugccccaaccccaccucacaaucuucacaaaguagaacuuagg

SEQ ID NO: 5012 - RNA, 64 nt, Human
uagcuuuuuuucugacuuauguugugguugcaccccucacaaauggcagaacaguauguaaagc

SEQ ID NO: 5013 - RNA, 64 nt, Human
caauguauuucaacaaagaucaucaaugcuaacaccucacaauguguguauuuuuacaguagcu

SEQ ID NO: 5014 - RNA, 64 nt, Human
gaacuccugaccucaggugaucugccugccucggccucacaaagugcuaggauuacaggcauga

SEQ ID NO: 5015 - RNA, 64 nt, Human
ccugugccaaggguacguauauugugaaguaaagccucacaaagcuaaauaaauucucuuccau

SEQ ID NO: 5016 - RNA, 64 nt, Human
aacauagauagugagcauaguccccaccuccaccccucacaauuuauuugaauacuucaauugu

SEQ ID NO: 5017 - RNA, 64 nt, Human
uacccacaggacucugaaucauguuacccacuccccucacaauguuguccacuuagugaguugc

SEQ ID NO: 5018 - RNA, 64 nt, Human
caaagaguuauaguauuuacuacuuugagguuucccucacaacuucuggcuccauaccuagccc

SEQ ID NO: 5019 - RNA, 64 nt, Human
gggagaauugguuauuugagaugugguacugcuuccucacaagucucccacaggccauguaaag

SEQ ID NO: 5020 - RNA, 64 nt, Human
agaaacaugaacaggauaguucucccuuaagcaaccucacaaacaagccgcuucuguuagguac

SEQ ID NO: 5021 - RNA, 64 nt, Human
cuggcucuacacaucaaucacaucuugauucaaaccucacaaggcaauauucugaauuguuaac

SEQ ID NO: 5022 - RNA, 64 nt, Human
cugguauuccuuuauguaucuaauuucauucaaaccucacaacagucuugugaggcccuuauau

SEQ ID NO: 5023 - RNA, 64 nt, Human
uguuauaagcuuugguggaugucacuccuuuaauccucacaacacccugucggguagucauauu

SEQ ID NO: 5024 - RNA, 64 nt, Human
guuuaauggacucaguuccacauggcuggggacgccucacaaucaugguggaaggcaaggagga

SEQ ID NO: 5025 - RNA, 64 nt, Human
cuuggauauuucccaagaaccccccacauacaccccucacaagccaccccuccugagaggcagg

SEQ ID NO: 5026 - RNA, 64 nt, Human
acuccuuucugagacuuugcuuaauacuuggugaccucacaaucacgucgguaugauugggcac

SEQ ID NO: 5027 - RNA, 64 nt, Human
gccacccccgcugaugacuccuugcauucccuccccucacaacaaagaacuccacuguggggau

SEQ ID NO: 5028 - RNA, 64 nt, Human
uuuaguauuuagauugugccucaaaguuguaguaccucacaauaccuccacugguuuccuguug

SEQ ID NO: 5029 - RNA, 61 nt, Human
aauauaaacaaagaauaugacaucuguugggccucacaaggaccagggccuucuggaggag

SEQ ID NO: 5030 - RNA, 64 nt, Human
cauucacccuucuucccaaucaucuggcuggcauccucacaauugaguugaagcuguuccuccu

SEQ ID NO: 5031 - RNA, 64 nt, Human
gaacuccuggcuucaagcgauccuccugucucggccucacaaaguguugagacuacaggcauga

SEQ ID NO: 5032 - RNA, 64 nt, Human
cuuucuugcuguuuuaauguggugcacacuauagccucacaaaccuguuauuccaguguaaucu

SEQ ID NO: 5033 - RNA, 64 nt, Human
acauuuuuuguuuccauuaguaauauucuagguaccucacaaaauguauuauggugccauggcu

SEQ ID NO: 5034 - RNA, 64 nt, Human
ucauuaaucuuccguuaggccaauaaaagaagggccucacaagacaaaacaggagccagaagua

SEQ ID NO: 5035 - RNA, 64 nt, Human
caacuccugaccucaggugauccaccugccucgaccucacaaagugcugggauuacaggcauga

SEQ ID NO: 5036 - RNA, 64 nt, Human
gggugagagcugcucuggaaaaugugacccagauccucacaaccaccuaaucaggcugaggugu

SEQ ID NO: 5037 - RNA, 64 nt, Human
ccacaugcugcugaauuuaccagggauccucauaccucacaaugcaaaccacuuacuaccaggc

SEQ ID NO: 5038 - RNA, 64 nt, Human
caccauuagccauguggcaaccuuuacuucuaugccucacaagugccuuucagagagccccaau

SEQ ID NO: 5039 - RNA, 64 nt, Human
ucggggggaaaagugugaaaugaagcuacauggaccucacaaaaaccuguuccgacucuuucug

SEQ ID NO: 5040 - RNA, 64 nt, Human
guauuuaacugaauaaaugaguagacauuguggaccucacaagauuauuuaauucuuaagaugu

SEQ ID NO: 5041 - RNA, 64 nt, Human
aaaauuuuuaagaacuugauccauuguaucaguaccucacaaucagaguuggcaaaugauggau

SEQ ID NO: 5042 - RNA, 64 nt, Human; identical to SEQ ID NO: 5035

SEQ ID NO: 5043 - RNA, 64 nt, Human
ccuccucccucccagcguccacuggcuccaggcuccucacaacagcagcucauagacacggggc

SEQ ID NO: 5044 - RNA, 64 nt, Human
caguccccggcagugagcuauggacuuucuucccccucacaaggcugggggccuccugcucucg

SEQ ID NO: 5045 - RNA, 64 nt, Human
cuagggauacuuccaaugcuuuaacucacuuaauccucacaacccgagauagguacuguuacca

SEQ ID NO: 5046 - RNA, 64 nt, Human
guuagccaucuaccacccaugucccuuauuugguccucacaauaacacuuuaggagagauauca

SEQ ID NO: 5047 - RNA, 64 nt, Human
accuagaugaugauucuuccuguagcaucuggccccucacaaugucagaggauuuaauuguguc

SEQ ID NO: 5048 - RNA, 64 nt, Human
aagaaaacgaaaacaguuuaaaucucuaccacagccucacaagcaaaugcuaaggggaacauac

SEQ ID NO: 5049 - RNA, 64 nt, Human
cagccuggucaccuccugaggaauaaaugcugaaccucacaagccccaucauucauuucuucuc

SEQ ID NO: 5050 - RNA, 64 nt, Human
uaugaacuuguuucaaaugcaugaucaaaugcaaccucacaaccuuggcugagucuugagacug

SEQ ID NO: 5051 - RNA, 64 nt, Human
aaccagugcaugcaccugguuggaagaugcucagccucacaaaagcuccaagcccuuugggagc

SEQ ID NO: 5052 - RNA, 64 nt, Human
cuucccugaaauccugcagucccucacuggcugcccucacaagccaccugaggaguggcaugag

SEQ ID NO: 5053 - RNA, 64 nt, Human
uccuguuuucuguaagauccuagucagacagagcccucacaacuggauagaccuuucucaaggg

SEQ ID NO: 5054 - RNA, 64 nt, Human
ugaauugaugguuuuugagaaguaggccagguauccucacaaagaaguuuuagaauaggguuuc

SEQ ID NO: 5055 - RNA, 64 nt, Human
aauagcauuagaaauaagugauuaaaggccucugccucacaacauggcaaguacaguacuuuga

SEQ ID NO: 5056 - RNA, 64 nt, Human
cucuuuuucauacauugcauguaaguuguuaguaccucacaagcuacagaaguucagccaugag

SEQ ID NO: 5057 - RNA, 64 nt, Human
cugcuuauaacuggaaauggccauugagcuguuuccucacaauuggcgagaucccauggaugag

SEQ ID NO: 5058 - RNA, 64 nt, Human
cccuagucccccaccuuugacuuaagaucccacaccucacaaaccuacagcccagaaaccagaa

SEQ ID NO: 5059 - RNA, 64 nt, Human
auccccugguggcuucagcaguccuuaucaccagccucacaaucccacaggcccacccccagug

SEQ ID NO: 5060 - RNA, 64 nt, Human
aaaaaacugucucaaaaaaaaaaaaaucuuacaaccucacaaauaaccuaguucaaaaaugggc

SEQ ID NO: 5061 - RNA, 64 nt, Human
ccacaguuguuaagaauaauccucuauguuucuuccucacaaaaccauaucucauuuauaucca

SEQ ID NO: 5062 - RNA, 64 nt, Human
cugugcuaagccugccacgggcguauccuugcagccucacaacagugggaggucuguauccuga

SEQ ID NO: 5063 - RNA, 64 nt, Human
gaaagucucaagccucuauucaccccuucucaauccucacaaaauaggggguuguucaauauug

SEQ ID NO: 5064 - RNA, 64 nt, Human
acuugggguugaacuaaaacaccuguccugccuaccucacaaggucacucugaggauugaaacu

SEQ ID NO: 5065 - RNA, 64 nt, Human
ggcaucuggcugugcaaggaagacccggcuuugcccucacaagucuuaugggcaccacagggaa

SEQ ID NO: 5066 - RNA, 64 nt, Human
uuaauuaguccaaaauuaaguuuuaaagauuuuuccucacaauuuaaauccauagacaacagaa

SEQ ID NO: 5067 - RNA, 64 nt, Human
uuaagaacuuaaacaaagguaauaauuaaaauaaccucacaagaaguuuaaugaguagagagaa

SEQ ID NO: 5068 - RNA, 64 nt, Human
cgaugcaggccagaguucaaggcucuggggcuggccucacaagaggcuucuuccacggggcuug

SEQ ID NO: 5069 - RNA, 64 nt, Human
uuaagaauuuuuuaagaaguaauaauuaaaauaaccucacaagaaguuguaaugaguacagaga

SEQ ID NO: 5070 - RNA, 64 nt, Human
ucgaaggcgccugaagcacuuuauaaacacaaauccucacaauaccucugugagguagguaaau

SEQ ID NO: 5071 - RNA, 64 nt, Human
ggagucaugggccucggccucggcggcuccucacccucacaauuuauuuccuccucccgugcca

SEQ ID NO: 5072 - RNA, 64 nt, Human
uuggcaauucuccucucuguagucacccugacauccucacaagaaaacaaaucuagccauugcc

SEQ ID NO: 5073 - RNA, 64 nt, Human
agagcgggucuucuccccccucccucuccaguccccucacaaucccagauggguucuaaugcag

SEQ ID NO: 5074 - RNA, 64 nt, Human
gugaggaagagggagggauggacaagucugaaaaccucacaacuccuuaccaaggcuccagguu

SEQ ID NO: 5075 - RNA, 64 nt, Human
acucgcuggcgacccgauggaagguuuucaggcuccucacaaaggagagagggaagaaaagauc

SEQ ID NO: 5076 - RNA, 64 nt, Human
gugaggacccauggaaccguccuggugcccaggcccucacaaguaccaaagccagcaccaaagg

SEQ ID NO: 5077 - RNA, 64 nt, Human
agcacaggaguagcagcagcaggacaggcaagagccucacaagugggacucugggccucugacc

SEQ ID NO: 5078 - RNA, 64 nt, Human
ucccucaucuauaaaauggggauaauauuaucuaccucacaagcuuaugaaaacuaaacaugau

SEQ ID NO: 5079 - RNA, 64 nt, Human
gaccacuuuggucauugguaagggggugcauucuccucacaaagggguuuuauggacuuccuca

SEQ ID NO: 5080 - RNA, 64 nt, Human
ugaaccugcuuauaccuaagggcaggagcaagccccucacaaugcagcugcauggguuuuuagu

SEQ ID NO: 5081 - RNA, 64 nt, Human
cuccguuguagggguuacagaacagucguucccgccucacaaccugguaaggauccaucucuuc

SEQ ID NO: 5082 - RNA, 64 nt, Human
uuccuaauuaugcauuaucuuucuuuucuccaguccucacaaauacagaaacaauaacugaaau

SEQ ID NO: 5083 - RNA, 64 nt, Human
acaaaacguaaguuucauuugggcaaaaauugagccucacaauaaacacccugaagacacaacu

SEQ ID NO: 5084 - RNA, 64 nt, Human
ccggagggccugcucccggccccccugcacucugccucacaaaggucuauauuauauaaaucua

SEQ ID NO: 5085 - RNA, 64 nt, Human
ugagcugcugcugucacuccuccaccgagggaggccucacaaaccacaggacgcugcaacgggu

SEQ ID NO: 5086 - RNA, 64 nt, Human
aaaggcaaugauucacgcuuuuguuuucauaauaccucacaaccguacaguuucugcuugggag

SEQ ID NO: 5087 - RNA, 64 nt, Human
aacaucccaaccaaaaccaaccaaacaaaaacauccucacaacuccccaggaacauggcuguga

SEQ ID NO: 5088 - RNA, 64 nt, Human
gcuguagggaaagugcguuacagaugucugcugaccucacaagagugaaaagauaaacugugca

SEQ ID NO: 5089 - RNA, 64 nt, Human
uaaagaaaaaaaaaaguaaaaaccaaacacaacaccucacaaguuguaacucuugguccuucuc

SEQ ID NO: 5090 - RNA, 64 nt, Human
agucucgacuccgccauugccuucuccucggcguccucacaacucuuaauugggccuagugaaa

SEQ ID NO: 5091 - RNA, 64 nt, Human
ccgauauugcuaacugaucacagauucuuucccaccucacaauccuuccgaaugugcuccaggc

SEQ ID NO: 5092 - RNA, 64 nt, Human
cauguaccaaauaacauguuucagcucauuccauccucacaacagcccccugaaaguggguacu

SEQ ID NO: 5093 - RNA, 64 nt, Human
cuauuugggcuaaccauagaauuucauuuauuuuccucacaauauuuuccuagaccaacucccc

SEQ ID NO: 5094 - RNA, 64 nt, Human
aguacacagauccuuaucucuccccauccccuagccucacaaaacacaguugagagucuuuuaa

SEQ ID NO: 5095 - RNA, 64 nt, Human
caguucugcucuguggaucaucccauggaaguuuccucacaaagucagcuccucucccaccaca

SEQ ID NO: 5096 - RNA, 64 nt, Human
uuggcucaaaaaccaguuccauuucuaauguuguccucacaagaaggcuaauugguggugagac

SEQ ID NO: 5097 - RNA, 64 nt, Human
caguaauuuuucuucuuuauugacgaauuccuccccucacaaaacuguucuuucccaccucucu

SEQ ID NO: 5098 - RNA, 64 nt, Human
caagaaaaugaagccaaaucaagugaauuaaauuccucacaauuauuuucuuucccugagguuu

SEQ ID NO: 5099 - RNA, 64 nt, Human
uauuggccccccgaccuuguagaaaaaccccuacccucacaauaccuuauuuaaguaacuuuaa

SEQ ID NO: 5100 - RNA, 64 nt, Human
gugcuuuugaguuacuuguuuuuauuaaaaauuuccucacaaaagagaguccucaaguuguggc

SEQ ID NO: 5101 - RNA, 64 nt, Human
auauauaggucuuaaguggugcuuuaaaaagaacccucacaaguuaaaaauuaagaguuguuuc

SEQ ID NO: 5102 - RNA, 64 nt, Human
cuacugucacagaagaucauagucuuugaugcuaccucacaacacaaacagguaguucguuggg

SEQ ID NO: 5103 - RNA, 64 nt, Human
acaaacacuugauuuugggaauugcacauauuaaccucacaauauuacuagcucauuuuuaaau

SEQ ID NO: 5104 - RNA, 64 nt, Human
auuauuacauccuuuacauucaguuaagaucaaaccucacaaagagaaauagaauguuugaaag

SEQ ID NO: 5105 - RNA, 64 nt, Human
auguacgcugcgugccaugaguccauguccuaugccucacaaaugcugugguucacugcacugu

SEQ ID NO: 5106 - RNA, 64 nt, Human
aaauggaacauuguuuugagaucaaacuccccacccucacaaaaauggccacguugcaauaaaa

SEQ ID NO: 5107 - RNA, 64 nt, Human
ggaaacaugucuauacaaucacagaguuauauuuccucacaaacuucuuugugaagagugaaau

SEQ ID NO: 5108 - RNA, 64 nt, Human
uuaaccugugcuugcauccuccuuuccuccuccuccucacaauccaucucuucuuaaguugaua

SEQ ID NO: 5109 - RNA, 64 nt, Human
gaccucccgaccucaggugauccgccuaucugggccucacaaaguccugggauuauaggcauga

SEQ ID NO: 5110 - RNA, 64 nt, Human
cagaucugcacuugguaaugacuuaggggggcuuccucacaaugcaggauccucuuugcugacu

SEQ ID NO: 5111 - RNA, 64 nt, Human
gcuuauagguggccucuccuuguggccugggccuccucacaacauggugucuggauucccagga

SEQ ID NO: 5112 - RNA, 64 nt, Human; identical to SEQ ID NO: 5107

SEQ ID NO: 5113 - RNA, 64 nt, Human
ggaaacaugucuauacgaucgcagaguuguauuuccucacaaacuucuuuacgaagagugaaau

SEQ ID NO: 5114 - RNA, 64 nt, Human
agucugaggauauacuucagggacucugugaaccccucacaauuguaugccaacuuugugugcu

SEQ ID NO: 5115 - RNA, 64 nt, Human
cuccuguaaacauccaggggugugccaggcccacccucacaacugcuuguucagguaucgugau

SEQ ID NO: 5116 - RNA, 64 nt, Human
agaaaccuauuaagucaucaucuccaaacuaaacccucacaaguaacaguugaagaaaaaaugg

SEQ ID NO: 5117 - RNA, 64 nt, Human
gggccagcuggccugcccugauccucugcuuccuccucacaaccccaagagcccccagcccggu

SEQ ID NO: 5118 - RNA, 64 nt, Human
caugcagaggcuccuggaucugggaagcccgcccccucacaaaugcugagccguucuugcucug

SEQ ID NO: 5119 - RNA, 64 nt, Human
cuucuuaacagauggcauuuucugugacucuaggccucacaaaagagccagaguucuggaccca

SEQ ID NO: 5120 - RNA, 64 nt, Human
uagcacacuuugaugagguuccuggacgugagacccucacaaagaccaaccauuccucuaauag

SEQ ID NO: 5121 - RNA, 64 nt, Human
ugucaucagaccuuuggcaaugggguggucacuaccucacaaggcaaaguguuguaugauuaga

SEQ ID NO: 5122 - RNA, 64 nt, Human
guaugauguucccccaacguggacacacucaguuccucacaaagccaagcccacugcagcugcc

SEQ ID NO: 5123 - RNA, 64 nt, Human
guucccacuaggaugcagagaugaccucucgcugccucacaagcagugacaccucggguccuuu

SEQ ID NO: 5124 - RNA, 64 nt, Human
ugcuugaaaaucucucuugacagggagcucacuaccucacaaggcaggucauuucauuguggga

SEQ ID NO: 5125 - RNA, 64 nt, Human
acagucgguccccgcagaggucacuguggcaaagccucacaaagcccccucuccuaguucauuc

SEQ ID NO: 5126 - RNA, 64 nt, Human
accuuuacuggugugaagauaauuaugcacaaacccucacaauacgcguuaacauugaaaccug

SEQ ID NO: 5127 - RNA, 64 nt, Human
uacauacaguaggugaauuuucaggacaauauugccucacaacccugcuuacauugaaaagucu

SEQ ID NO: 5128 - RNA, 64 nt, Human
acacggcugguuuucauugugaaagauagcuacaccucacaaggaaauggacugccucucuuga

SEQ ID NO: 5129 - RNA, 64 nt, Human
ugguuaaggguagcaaaucucuaaagcacgaagcccucacaaaucuuugccauuucccaaacac

SEQ ID NO: 5130 - RNA, 64 nt, Human
gcuuugcuuuggugaacuuguccuaguaugcuugccucacaaacguuuuagccauugugaauuu

SEQ ID NO: 5131 - RNA, 64 nt, Human
uuuucuuaaagaggaaccucguauaagcuucaagccucacaaaccuucuagccucugcccuugg

SEQ ID NO: 5132 - RNA, 64 nt, Human
cuccccugagaacugaaagggaaucaugucuuauccucacaacaaaaguauugcgcuguaaugu

SEQ ID NO: 5133 - RNA, 64 nt, Human
aucaccaucgcccuagggaccaagacugaauccuccucacaaacuggggggaaaccgaagguug

SEQ ID NO: 5134 - RNA, 64 nt, Human
ccugaaaauugcaauacauuucaauuauacuaaaccucacaaaguagaggaauccauguaaauu

SEQ ID NO: 5135 - RNA, 64 nt, Human
uuguuacugagccacagauaauacaagagcguccccucacaaauaaauuaaagcguaaaaggag

SEQ ID NO: 5136 - RNA, 64 nt, Human
gugcgggggaacugcccuguggaugcagccaccaccucacaaagccaugaauucccaaagcauc

SEQ ID NO: 5137 - RNA, 64 nt, Human
gagggugccggcucuggcugucccugugccggucccucacaaaccucucccccuuugaaacuca

SEQ ID NO: 5138 - RNA, 64 nt, Human
auggugcacugguuuaauuguguuggugucggccccucacaaaugcagccaagucauguaauua

SEQ ID NO: 5139 - RNA, 64 nt, Human
acacagaccugauacaguaugucuuucugcaccaccucacaauuuuccugaaccccaaagggag

SEQ ID NO: 5140 - RNA, 64 nt, Human
uuccccucccccuccccucugaggagccugccugccucacaacucacccucacuucacugaaug

SEQ ID NO: 5141 - RNA, 64 nt, Human
gcaguuuuuguggaacuaaaacuaauaauguuacccucacaaaggaaauguucuuuuacuaagu

SEQ ID NO: 5142 - RNA, 64 nt, Human
cgcagccgaaggacaagugaagcagcccccugagccucacaaggaccuccuggcuggugaggag

SEQ ID NO: 5143 - RNA, 64 nt, Human
agaacccguguucaucucauccgagagcggaguuccucacaagcacuccccagcagcccuuggc

SEQ ID NO: 5144 - RNA, 64 nt, Human
acugagcaacgcuauuccagcuguccccccacucccucacaaguggguacccccaggaccagaa

SEQ ID NO: 5145 - RNA, 64 nt, Human
aguucuugucucucugccagugccacccagauagccucacaaaacuuugacccagccacuguua

SEQ ID NO: 5146 - RNA, 64 nt, Human
cacagcugugccaagcccggccccacugguguguccucacaaugugaccccagaaaugccagca

SEQ ID NO: 5147 - RNA, 64 nt, Human
ucgaagacacaugacaaugcacacuggagauggaccucacaaaaugcaagauaugugggaaagc

SEQ ID NO: 5148 - RNA, 54 nt, Human
gccccacugacaagcacugacagaccucacaaucaagccagccugggcuccacc

SEQ ID NO: 5149 - RNA, 64 nt, Human
cauggacccugacaccugccaacagccccucugcccucacaaccucagccuggccuucaugacu

SEQ ID NO: 5150 - RNA, 64 nt, Human
agccaagugauugggagaccacacagcagagaagccucacaagaguggagacauauggacugca

SEQ ID NO: 5151 - RNA, 64 nt, Human
ugcaaaacauaggagaauuuauacaggagagaaaccucacaagugugaugauuguggcaaagcc

SEQ ID NO: 5152 - RNA, 64 nt, Human
ugcaaaacauaggaggauucauacaggagagaaaccucacaagugugaugauuguggcaaagcg

SEQ ID NO: 5153 - RNA, 64 nt, Human
auuaaauuauuuuuaaauuauguuuuauuguagaccucacaauucuuuuuuuuucuuuuucacu

SEQ ID NO: 5154 - RNA, 64 nt, Human
auucuuccucucaugacugaccaaacacauggaaccucacaaaguccauuuuaagagcuuuauc

SEQ ID NO: 5155 - RNA, 64 nt, Human
ccuugucccugggcucuggccaacccucagaaacccucacaauaaaccagaccagaaggauguc

SEQ ID NO: 5156 - RNA, 64 nt, Human
ucagaaugcuuuuaucucgagugugcccuucggcccucacaagagccccuggggaguagguggu

SEQ ID NO: 5157 - RNA, 64 nt, Human
cugugaagguccccgugggguggagcauggugccccucacaagccgcagcggcuggugcccggg

SEQ ID NO: 5158 - RNA, 64 nt, Human
ggaugacuuaugacacuugcacagcauggcucugccucacaaugaugcagucagccaccuggug

SEQ ID NO: 5159 - RNA, 64 nt, Human
aaaaaaugcagaauuuuaugugacugcuuuuuugccucacaauuaugcugugaauuuuacaaaa

SEQ ID NO: 5160 - RNA, 64 nt, Human
gccagaauucacuaggaggucaucaaccgaugguccucacaagccucuucugaagauggaaggc

SEQ ID NO: 5161 - RNA, 64 nt, Human
uuagaugauaaaauguacacccccccaucaccaaccucacaacuuagaaaaucuaaguuguuug

SEQ ID NO: 5162 - RNA, 64 nt, Human
gaauauugacagcuuacugcaguuuuacaguauuccucacaaagggcuucagguagauuaucag

SEQ ID NO: 5163 - RNA, 64 nt, Human
gugugcgaguguguguguguggagauguuaagagccucacaaggaaacuggguuauuggaggcc

SEQ ID NO: 5164 - RNA, 64 nt, Human
ucuuucacuggcagcaugaaguuagccaccaaguccucacaagccgugcugcuuaguugcucgg

SEQ ID NO: 5165 - RNA, 64 nt, Human
augcuguggcuucucacagcuguggucuccccugccucacaacgacuccuuucucuuguguggc

SEQ ID NO: 5166 - RNA, 64 nt, Human
gcuguggcugcugugggcccucuggaauugugcuccucacaaaguuuccccaaaagguucuucu

SEQ ID NO: 5167 - RNA, 64 nt, Human
aacaggaaauuggaauuccuuuguccaggagaaaccucacaaaccuucuuuaaggcauaguuuu

SEQ ID NO: 5168 - RNA, 64 nt, Human
cucuccugaccucagggugaucagcccaccucggccucacaaagugcugggauuacaggcguga

SEQ ID NO: 5169 - RNA, 64 nt, Human
ccucaguuuccccauaauacccuuuuccaaccuaccucacaagguuaucagaaagaucaaauua

SEQ ID NO: 5170 - RNA, 64 nt, Human
accugccacugcuggagccauuucaacaaggcauccucacaacaaagaagagaugugauuuggu

SEQ ID NO: 5171 - RNA, 64 nt, Human
uguuguccuugcccucacauagacacucagacacccucacaaacacaguagucuauaguuagga

SEQ ID NO: 5172 - RNA, 64 nt, Human
uccugagacauacaguggacagggucucuacccuccucacaacacccucuucacccuccacgcc

SEQ ID NO: 5173 - RNA, 64 nt, Human
cuacauccuuaccugcauuggaaaauguuugcuaccucacaacaaccauuugccuccuuuaaga

SEQ ID NO: 5174 - RNA, 64 nt, Human
uuaaugggcucacaguuccacaugacugaggaggccucacaauugugguggaaggugaaaggca

SEQ ID NO: 5175 - RNA, 64 nt, Human
aggauucaguuaaccaaacaagaaaaaggcagugccucacaaagaaauuaagaaguuguccguc

SEQ ID NO: 5176 - RNA, 64 nt, Human
ucuccauuacucucaugcuuugcucaugcucuucccucacaaugcuuuuaaaguccuuuuuuuu

SEQ ID NO: 5177 - RNA, 64 nt, Human
aggcauuuucuuaauauuucaauguguauuuaauccucacaacaacccaaugugguagguuauu

SEQ ID NO: 5178 - RNA, 64 nt, Human
ucccugugaucugaagaaagcuuuuggugcuuguccucacaaccaccucaguccucccucccug

SEQ ID NO: 5179 - RNA, 64 nt, Human
ccucugcuacccacuagcccucacucaguuucugccucacaaagcuguaacagaauggguuggg

SEQ ID NO: 5180 - RNA, 64 nt, Human
guuuauuuaagcauauaauugguguccaccagguccucacaacuucucugcacacaagcuucua

SEQ ID NO: 5181 - RNA, 64 nt, Human
gccccuugcccuccccugccccucacaacagucaccucacaaaccugaauggucugaagaagga

SEQ ID NO: 5182 - RNA, 64 nt, Human
gcaccugccacucugccccuugcccuccccugccccucacaacagucaccucacaaaccugaau

SEQ ID NO: 5183 - RNA, 64 nt, Human
uuuuuagcauguuauuuauauuagcucauucauuccucacaauucuacaacauagguaucauuc

SEQ ID NO: 5184 - RNA, 64 nt, Human; identical to SEQ ID NO: 4282

SEQ ID NO: 5185 - RNA, 64 nt, Human; identical to SEQ ID NO: 4283

SEQ ID NO: 5186 - RNA, 64 nt, Human; identical to SEQ ID NO: 4284

SEQ ID NO: 5187 - RNA, 64 nt, Human; identical to SEQ ID NO: 4285

SEQ ID NO: 5188 - RNA, 64 nt, Human; identical to SEQ ID NO: 4286

SEQ ID NO: 5189 - RNA, 64 nt, Human; identical to SEQ ID NO: 4287

SEQ ID NO: 5190 - RNA, 64 nt, Human; identical to SEQ ID NO: 4288

SEQ ID NO: 5191 - RNA, 64 nt, Human; identical to SEQ ID NO: 4289

SEQ ID NO: 5192 - RNA, 64 nt, Human; identical to SEQ ID NO: 4290

SEQ ID NO: 5193 - RNA, 64 nt, Human; identical to SEQ ID NO: 4291

SEQ ID NO: 5194 - RNA, 64 nt, Human; identical to SEQ ID NO: 4292

SEQ ID NO: 5195 - RNA, 64 nt, Human; identical to SEQ ID NO: 4293

SEQ ID NO: 5196 - RNA, 64 nt, Human; identical to SEQ ID NO: 4294

SEQ ID NO: 5197 - RNA, 64 nt, Human; identical to SEQ ID NO: 4295

SEQ ID NO: 5198 - RNA, 64 nt, Human; identical to SEQ ID NO: 4296

SEQ ID NO: 5199 - RNA, 64 nt, Human; identical to SEQ ID NO: 4297

SEQ ID NO: 5200 - RNA, 64 nt, Human; identical to SEQ ID NO: 4298

SEQ ID NO: 5201 - RNA, 64 nt, Human; identical to SEQ ID NO: 4299

SEQ ID NO: 5202 - RNA, 64 nt, Human; identical to SEQ ID NO: 4300

SEQ ID NO: 5203 - RNA, 64 nt, Human; identical to SEQ ID NO: 4301

SEQ ID NO: 5204 - RNA, 64 nt, Human; identical to SEQ ID NO: 4302

SEQ ID NO: 5205 - RNA, 64 nt, Human; identical to SEQ ID NO: 4303

SEQ ID NO: 5206 - RNA, 64 nt, Human; identical to SEQ ID NO: 4304

SEQ ID NO: 5207 - RNA, 64 nt, Human; identical to SEQ ID NO: 4305

SEQ ID NO: 5208 - RNA, 64 nt, Human; identical to SEQ ID NO: 4306

SEQ ID NO: 5209 - RNA, 64 nt, Human; identical to SEQ ID NO: 4307

SEQ ID NO: 5210 - RNA, 62 nt, Human; identical to SEQ ID NO: 4308

SEQ ID NO: 5211 - RNA, 64 nt, Human; identical to SEQ ID NO: 4309

SEQ ID NO: 5212 - RNA, 64 nt, Human; identical to SEQ ID NO: 4310

SEQ ID NO: 5213 - RNA, 64 nt, Human; identical to SEQ ID NO: 4311

SEQ ID NO: 5214 - RNA, 64 nt, Human; identical to SEQ ID NO: 4312

SEQ ID NO: 5215 - RNA, 64 nt, Human; identical to SEQ ID NO: 4313

SEQ ID NO: 5216 - RNA, 64 nt, Human; identical to SEQ ID NO: 4314

SEQ ID NO: 5217 - RNA, 64 nt, Human; identical to SEQ ID NO: 4315

SEQ ID NO: 5218 - RNA, 64 nt, Human; identical to SEQ ID NO: 4316

SEQ ID NO: 5219 - RNA, 64 nt, Human; identical to SEQ ID NO: 4317

SEQ ID NO: 5220 - RNA, 64 nt, Human; identical to SEQ ID NO: 4318

SEQ ID NO: 5221 - RNA, 64 nt, Human; identical to SEQ ID NO: 4319

SEQ ID NO: 5222 - RNA, 64 nt, Human; identical to SEQ ID NO: 4320

SEQ ID NO: 5223 - RNA, 64 nt, Human; identical to SEQ ID NO: 4321

SEQ ID NO: 5224 - RNA, 64 nt, Human; identical to SEQ ID NO: 4322

SEQ ID NO: 5225 - RNA, 64 nt, Human; identical to SEQ ID NO: 4323

SEQ ID NO: 5226 - RNA, 64 nt, Human; identical to SEQ ID NO: 4324

SEQ ID NO: 5227 - RNA, 64 nt, Human; identical to SEQ ID NO: 4325

SEQ ID NO: 5228 - RNA, 64 nt, Human; identical to SEQ ID NO: 4326

SEQ ID NO: 5229 - RNA, 64 nt, Human; identical to SEQ ID NO: 4327

SEQ ID NO: 5230 - RNA, 64 nt, Human; identical to SEQ ID NO: 4328

SEQ ID NO: 5231 - RNA, 64 nt, Human; identical to SEQ ID NO: 4329

SEQ ID NO: 5232 - RNA, 64 nt, Human; identical to SEQ ID NO: 4330

SEQ ID NO: 5233 - RNA, 64 nt, Human; identical to SEQ ID NO: 4331

SEQ ID NO: 5234 - RNA, 64 nt, Human; identical to SEQ ID NO: 4332

SEQ ID NO: 5235 - RNA, 64 nt, Human; identical to SEQ ID NO: 4333

SEQ ID NO: 5236 - RNA, 64 nt, Human; identical to SEQ ID NO: 4334

SEQ ID NO: 5237 - RNA, 64 nt, Human; identical to SEQ ID NO: 4335

SEQ ID NO: 5238 - RNA, 64 nt, Human; identical to SEQ ID NO: 4336

SEQ ID NO: 5239 - RNA, 64 nt, Human; identical to SEQ ID NO: 4337

SEQ ID NO: 5240 - RNA, 64 nt, Human; identical to SEQ ID NO: 4338

SEQ ID NO: 5241 - RNA, 64 nt, Human; identical to SEQ ID NO: 4339

SEQ ID NO: 5242 - RNA, 64 nt, Human; identical to SEQ ID NO: 4340

SEQ ID NO: 5243 - RNA, 64 nt, Human; identical to SEQ ID NO: 4341

SEQ ID NO: 5244 - RNA, 64 nt, Human; identical to SEQ ID NO: 4342

SEQ ID NO: 5245 - RNA, 64 nt, Human; identical to SEQ ID NO: 4343

SEQ ID NO: 5246 - RNA, 64 nt, Human; identical to SEQ ID NO: 4344

SEQ ID NO: 5247 - RNA, 64 nt, Human; identical to SEQ ID NO: 4345

SEQ ID NO: 5248 - RNA, 64 nt, Human; identical to SEQ ID NO: 4346

SEQ ID NO: 5249 - RNA, 64 nt, Human; identical to SEQ ID NO: 4347

SEQ ID NO: 5250 - RNA, 64 nt, Human; identical to SEQ ID NO: 4348

SEQ ID NO: 5251 - RNA, 64 nt, Human; identical to SEQ ID NO: 4349

SEQ ID NO: 5252 - RNA, 64 nt, Human; identical to SEQ ID NO: 4350

SEQ ID NO: 5253 - RNA, 64 nt, Human; identical to SEQ ID NO: 4351

SEQ ID NO: 5254 - RNA, 64 nt, Human; identical to SEQ ID NO: 4352

SEQ ID NO: 5255 - RNA, 64 nt, Human; identical to SEQ ID NO: 4353

SEQ ID NO: 5256 - RNA, 64 nt, Human; identical to SEQ ID NO: 4354

SEQ ID NO: 5257 - RNA, 64 nt, Human; identical to SEQ ID NO: 4355

SEQ ID NO: 5258 - RNA, 64 nt, Human; identical to SEQ ID NO: 4356

SEQ ID NO: 5259 - RNA, 64 nt, Human; identical to SEQ ID NO: 4357

SEQ ID NO: 5260 - RNA, 64 nt, Human; identical to SEQ ID NO: 4358

SEQ ID NO: 5261 - RNA, 64 nt, Human; identical to SEQ ID NO: 4359

SEQ ID NO: 5262 - RNA, 64 nt, Human; identical to SEQ ID NO: 4360

SEQ ID NO: 5263 - RNA, 64 nt, Human; identical to SEQ ID NO: 4361

SEQ ID NO: 5264 - RNA, 64 nt, Human; identical to SEQ ID NO: 4362

SEQ ID NO: 5265 - RNA, 64 nt, Human; identical to SEQ ID NO: 4363

SEQ ID NO: 5266 - RNA, 64 nt, Human; identical to SEQ ID NO: 4364

SEQ ID NO: 5267 - RNA, 64 nt, Human; identical to SEQ ID NO: 4365

SEQ ID NO: 5268 - RNA, 64 nt, Human; identical to SEQ ID NO: 4366

SEQ ID NO: 5269 - RNA, 64 nt, Human; identical to SEQ ID NO: 4367

SEQ ID NO: 5270 - RNA, 64 nt, Human; identical to SEQ ID NO: 4368

SEQ ID NO: 5271 - RNA, 64 nt, Human; identical to SEQ ID NO: 4369

SEQ ID NO: 5272 - RNA, 64 nt, Human; identical to SEQ ID NO: 4370

SEQ ID NO: 5273 - RNA, 64 nt, Human; identical to SEQ ID NO: 4371

SEQ ID NO: 5274 - RNA, 64 nt, Human; identical to SEQ ID NO: 4372

SEQ ID NO: 5275 - RNA, 64 nt, Human; identical to SEQ ID NO: 4373

SEQ ID NO: 5276 - RNA, 64 nt, Human; identical to SEQ ID NO: 4374

SEQ ID NO: 5277 - RNA, 64 nt, Human; identical to SEQ ID NO: 4375

SEQ ID NO: 5278 - RNA, 64 nt, Human; identical to SEQ ID NO: 4376

SEQ ID NO: 5279 - RNA, 64 nt, Human; identical to SEQ ID NO: 4377

SEQ ID NO: 5280 - RNA, 64 nt, Human; identical to SEQ ID NO: 4378

SEQ ID NO: 5281 - RNA, 64 nt, Human; identical to SEQ ID NO: 4379

SEQ ID NO: 5282 - RNA, 64 nt, Human; identical to SEQ ID NO: 4380

SEQ ID NO: 5283 - RNA, 64 nt, Human; identical to SEQ ID NO: 4381

SEQ ID NO: 5284 - RNA, 64 nt, Human; identical to SEQ ID NO: 4382

SEQ ID NO: 5285 - RNA, 64 nt, Human; identical to SEQ ID NO: 4383

SEQ ID NO: 5286 - RNA, 64 nt, Human; identical to SEQ ID NO: 4384

SEQ ID NO: 5287 - RNA, 64 nt, Human; identical to SEQ ID NO: 4385

SEQ ID NO: 5288 - RNA, 64 nt, Human; identical to SEQ ID NO: 4386

SEQ ID NO: 5289 - RNA, 64 nt, Human; identical to SEQ ID NO: 4387

SEQ ID NO: 5290 - RNA, 64 nt, Human; identical to SEQ ID NO: 4388

SEQ ID NO: 5291 - RNA, 64 nt, Human; identical to SEQ ID NO: 4389

SEQ ID NO: 5292 - RNA, 64 nt, Human; identical to SEQ ID NO: 4390

SEQ ID NO: 5293 - RNA, 64 nt, Human; identical to SEQ ID NO: 4391

SEQ ID NO: 5294 - RNA, 64 nt, Human; identical to SEQ ID NO: 4392

SEQ ID NO: 5295 - RNA, 64 nt, Human; identical to SEQ ID NO: 4393

SEQ ID NO: 5296 - RNA, 64 nt, Human; identical to SEQ ID NO: 4394

SEQ ID NO: 5297 - RNA, 64 nt, Human; identical to SEQ ID NO: 4395

SEQ ID NO: 5298 - RNA, 64 nt, Human; identical to SEQ ID NO: 4396

SEQ ID NO: 5299 - RNA, 64 nt, Human; identical to SEQ ID NO: 4397

SEQ ID NO: 5300 - RNA, 64 nt, Human; identical to SEQ ID NO: 4398

SEQ ID NO: 5301 - RNA, 64 nt, Human; identical to SEQ ID NO: 4399

SEQ ID NO: 5302 - RNA, 64 nt, Human; identical to SEQ ID NO: 4400

SEQ ID NO: 5303 - RNA, 64 nt, Human; identical to SEQ ID NO: 4401

SEQ ID NO: 5304 - RNA, 64 nt, Human; identical to SEQ ID NO: 4402

SEQ ID NO: 5305 - RNA, 64 nt, Human; identical to SEQ ID NO: 4403

SEQ ID NO: 5306 - RNA, 64 nt, Human; identical to SEQ ID NO: 4404

SEQ ID NO: 5307 - RNA, 64 nt, Human; identical to SEQ ID NO: 4405

SEQ ID NO: 5308 - RNA, 64 nt, Human; identical to SEQ ID NO: 4406

SEQ ID NO: 5309 - RNA, 64 nt, Human; identical to SEQ ID NO: 4407

SEQ ID NO: 5310 - RNA, 64 nt, Human; identical to SEQ ID NO: 4408

SEQ ID NO: 5311 - RNA, 64 nt, Human; identical to SEQ ID NO: 4409

SEQ ID NO: 5312 - RNA, 64 nt, Human; identical to SEQ ID NO: 4410

SEQ ID NO: 5313 - RNA, 64 nt, Human; identical to SEQ ID NO: 4411

SEQ ID NO: 5314 - RNA, 64 nt, Human; identical to SEQ ID NO: 4412

SEQ ID NO: 5315 - RNA, 64 nt, Human; identical to SEQ ID NO: 4413

SEQ ID NO: 5316 - RNA, 64 nt, Human; identical to SEQ ID NO: 4414

SEQ ID NO: 5317 - RNA, 64 nt, Human; identical to SEQ ID NO: 4415

SEQ ID NO: 5318 - RNA, 64 nt, Human; identical to SEQ ID NO: 4416

SEQ ID NO: 5319 - RNA, 64 nt, Human; identical to SEQ ID NO: 4417

SEQ ID NO: 5320 - RNA, 64 nt, Human; identical to SEQ ID NO: 4418

SEQ ID NO: 5321 - RNA, 64 nt, Human; identical to SEQ ID NO: 4419

SEQ ID NO: 5322 - RNA, 64 nt, Human; identical to SEQ ID NO: 4420

SEQ ID NO: 5323 - RNA, 64 nt, Human; identical to SEQ ID NO: 4421

SEQ ID NO: 5324 - RNA, 64 nt, Human; identical to SEQ ID NO: 4422

SEQ ID NO: 5325 - RNA, 64 nt, Human; identical to SEQ ID NO: 4423

SEQ ID NO: 5326 - RNA, 64 nt, Human; identical to SEQ ID NO: 4424

SEQ ID NO: 5327 - RNA, 64 nt, Human; identical to SEQ ID NO: 4425

SEQ ID NO: 5328 - RNA, 64 nt, Human; identical to SEQ ID NO: 4426

SEQ ID NO: 5329 - RNA, 64 nt, Human; identical to SEQ ID NO: 4427

SEQ ID NO: 5330 - RNA, 64 nt, Human; identical to SEQ ID NO: 4428

SEQ ID NO: 5331 - RNA, 64 nt, Human; identical to SEQ ID NO: 4429

SEQ ID NO: 5332 - RNA, 61 nt, Human; identical to SEQ ID NO: 4430

SEQ ID NO: 5333 - RNA, 64 nt, Human; identical to SEQ ID NO: 4431

SEQ ID NO: 5334 - RNA, 64 nt, Human; identical to SEQ ID NO: 4432

SEQ ID NO: 5335 - RNA, 64 nt, Human; identical to SEQ ID NO: 4433

SEQ ID NO: 5336 - RNA, 64 nt, Human; identical to SEQ ID NO: 4434

SEQ ID NO: 5337 - RNA, 64 nt, Human; identical to SEQ ID NO: 4435

SEQ ID NO: 5338 - RNA, 64 nt, Human; identical to SEQ ID NO: 4436

SEQ ID NO: 5339 - RNA, 64 nt, Human; identical to SEQ ID NO: 4437

SEQ ID NO: 5340 - RNA, 64 nt, Human; identical to SEQ ID NO: 4438

SEQ ID NO: 5341 - RNA, 64 nt, Human; identical to SEQ ID NO: 4439

SEQ ID NO: 5342 - RNA, 64 nt, Human; identical to SEQ ID NO: 4440

SEQ ID NO: 5343 - RNA, 64 nt, Human; identical to SEQ ID NO: 4441

SEQ ID NO: 5344 - RNA, 64 nt, Human; identical to SEQ ID NO: 4442

SEQ ID NO: 5345 - RNA, 64 nt, Human; identical to SEQ ID NO: 4443

SEQ ID NO: 5346 - RNA, 64 nt, Human; identical to SEQ ID NO: 4444

SEQ ID NO: 5347 - RNA, 64 nt, Human; identical to SEQ ID NO: 4445

SEQ ID NO: 5348 - RNA, 64 nt, Human; identical to SEQ ID NO: 4446

SEQ ID NO: 5349 - RNA, 64 nt, Human; identical to SEQ ID NO: 4447

SEQ ID NO: 5350 - RNA, 64 nt, Human; identical to SEQ ID NO: 4448

SEQ ID NO: 5351 - RNA, 64 nt, Human; identical to SEQ ID NO: 4449

SEQ ID NO: 5352 - RNA, 64 nt, Human; identical to SEQ ID NO: 4450

SEQ ID NO: 5353 - RNA, 64 nt, Human; identical to SEQ ID NO: 4451

SEQ ID NO: 5354 - RNA, 64 nt, Human; identical to SEQ ID NO: 4452

SEQ ID NO: 5355 - RNA, 64 nt, Human; identical to SEQ ID NO: 4453

SEQ ID NO: 5356 - RNA, 64 nt, Human; identical to SEQ ID NO: 4454

SEQ ID NO: 5357 - RNA, 64 nt, Human; identical to SEQ ID NO: 4455

SEQ ID NO: 5358 - RNA, 64 nt, Human; identical to SEQ ID NO: 4456

SEQ ID NO: 5359 - RNA, 64 nt, Human; identical to SEQ ID NO: 4457

SEQ ID NO: 5360 - RNA, 64 nt, Human; identical to SEQ ID NO: 4458

SEQ ID NO: 5361 - RNA, 64 nt, Human; identical to SEQ ID NO: 4459

SEQ ID NO: 5362 - RNA, 64 nt, Human; identical to SEQ ID NO: 4460

SEQ ID NO: 5363 - RNA, 64 nt, Human; identical to SEQ ID NO: 4461

SEQ ID NO: 5364 - RNA, 64 nt, Human; identical to SEQ ID NO: 4462

SEQ ID NO: 5365 - RNA, 64 nt, Human; identical to SEQ ID NO: 4463

SEQ ID NO: 5366 - RNA, 64 nt, Human; identical to SEQ ID NO: 4464

SEQ ID NO: 5367 - RNA, 64 nt, Human; identical to SEQ ID NO: 4465

SEQ ID NO: 5368 - RNA, 64 nt, Human; identical to SEQ ID NO: 4466

SEQ ID NO: 5369 - RNA, 64 nt, Human; identical to SEQ ID NO: 4467

SEQ ID NO: 5370 - RNA, 64 nt, Human; identical to SEQ ID NO: 4468

SEQ ID NO: 5371 - RNA, 64 nt, Human; identical to SEQ ID NO: 4469

SEQ ID NO: 5372 - RNA, 64 nt, Human; identical to SEQ ID NO: 4470

SEQ ID NO: 5373 - RNA, 64 nt, Human; identical to SEQ ID NO: 4471

SEQ ID NO: 5374 - RNA, 64 nt, Human; identical to SEQ ID NO: 4472

SEQ ID NO: 5375 - RNA, 64 nt, Human; identical to SEQ ID NO: 4473

SEQ ID NO: 5376 - RNA, 64 nt, Human; identical to SEQ ID NO: 4474

SEQ ID NO: 5377 - RNA, 64 nt, Human; identical to SEQ ID NO: 4475

SEQ ID NO: 5378 - RNA, 64 nt, Human; identical to SEQ ID NO: 4476

SEQ ID NO: 5379 - RNA, 64 nt, Human; identical to SEQ ID NO: 4477

SEQ ID NO: 5380 - RNA, 64 nt, Human; identical to SEQ ID NO: 4478

SEQ ID NO: 5381 - RNA, 64 nt, Human; identical to SEQ ID NO: 4479

SEQ ID NO: 5382 - RNA, 64 nt, Human; identical to SEQ ID NO: 4480

SEQ ID NO: 5383 - RNA, 64 nt, Human; identical to SEQ ID NO: 4481

SEQ ID NO: 5384 - RNA, 64 nt, Human; identical to SEQ ID NO: 4482

SEQ ID NO: 5385 - RNA, 64 nt, Human; identical to SEQ ID NO: 4483

SEQ ID NO: 5386 - RNA, 64 nt, Human; identical to SEQ ID NO: 4484

SEQ ID NO: 5387 - RNA, 64 nt, Human; identical to SEQ ID NO: 4485

SEQ ID NO: 5388 - RNA, 64 nt, Human; identical to SEQ ID NO: 4486

SEQ ID NO: 5389 - RNA, 64 nt, Human; identical to SEQ ID NO: 4487

SEQ ID NO: 5390 - RNA, 64 nt, Human; identical to SEQ ID NO: 4488

SEQ ID NO: 5391 - RNA, 64 nt, Human; identical to SEQ ID NO: 4489

SEQ ID NO: 5392 - RNA, 64 nt, Human; identical to SEQ ID NO: 4490

SEQ ID NO: 5393 - RNA, 64 nt, Human; identical to SEQ ID NO: 4491

SEQ ID NO: 5394 - RNA, 64 nt, Human; identical to SEQ ID NO: 4492

SEQ ID NO: 5395 - RNA, 64 nt, Human; identical to SEQ ID NO: 4493

SEQ ID NO: 5396 - RNA, 64 nt, Human; identical to SEQ ID NO: 4494

SEQ ID NO: 5397 - RNA, 64 nt, Human; identical to SEQ ID NO: 4495

SEQ ID NO: 5398 - RNA, 64 nt, Human; identical to SEQ ID NO: 4496

SEQ ID NO: 5399 - RNA, 64 nt, Human; identical to SEQ ID NO: 4497

SEQ ID NO: 5400 - RNA, 64 nt, Human; identical to SEQ ID NO: 4498

SEQ ID NO: 5401 - RNA, 64 nt, Human; identical to SEQ ID NO: 4499

SEQ ID NO: 5402 - RNA, 64 nt, Human; identical to SEQ ID NO: 4500

SEQ ID NO: 5403 - RNA, 64 nt, Human; identical to SEQ ID NO: 4501

SEQ ID NO: 5404 - RNA, 64 nt, Human; identical to SEQ ID NO: 4502

SEQ ID NO: 5405 - RNA, 64 nt, Human; identical to SEQ ID NO: 4503

SEQ ID NO: 5406 - RNA, 64 nt, Human; identical to SEQ ID NO: 4504

SEQ ID NO: 5407 - RNA, 64 nt, Human; identical to SEQ ID NO: 4505

SEQ ID NO: 5408 - RNA, 64 nt, Human; identical to SEQ ID NO: 4506

SEQ ID NO: 5409 - RNA, 64 nt, Human; identical to SEQ ID NO: 4507

SEQ ID NO: 5410 - RNA, 64 nt, Human; identical to SEQ ID NO: 4508

SEQ ID NO: 5411 - RNA, 64 nt, Human; identical to SEQ ID NO: 4509

SEQ ID NO: 5412 - RNA, 64 nt, Human; identical to SEQ ID NO: 4510

SEQ ID NO: 5413 - RNA, 64 nt, Human; identical to SEQ ID NO: 4511

SEQ ID NO: 5414 - RNA, 64 nt, Human; identical to SEQ ID NO: 4512

SEQ ID NO: 5415 - RNA, 64 nt, Human; identical to SEQ ID NO: 4513

SEQ ID NO: 5416 - RNA, 64 nt, Human; identical to SEQ ID NO: 4514

SEQ ID NO: 5417 - RNA, 64 nt, Human; identical to SEQ ID NO: 4515

SEQ ID NO: 5418 - RNA, 64 nt, Human; identical to SEQ ID NO: 4516

SEQ ID NO: 5419 - RNA, 64 nt, Human; identical to SEQ ID NO: 4517

SEQ ID NO: 5420 - RNA, 64 nt, Human; identical to SEQ ID NO: 4518

SEQ ID NO: 5421 - RNA, 64 nt, Human; identical to SEQ ID NO: 4519

SEQ ID NO: 5422 - RNA, 64 nt, Human; identical to SEQ ID NO: 4520

SEQ ID NO: 5423 - RNA, 64 nt, Human; identical to SEQ ID NO: 4521

SEQ ID NO: 5424 - RNA, 64 nt, Human; identical to SEQ ID NO: 4522

SEQ ID NO: 5425 - RNA, 64 nt, Human; identical to SEQ ID NO: 4523

SEQ ID NO: 5426 - RNA, 64 nt, Human; identical to SEQ ID NO: 4524

SEQ ID NO: 5427 - RNA, 64 nt, Human; identical to SEQ ID NO: 4525

SEQ ID NO: 5428 - RNA, 64 nt, Human; identical to SEQ ID NO: 4526

SEQ ID NO: 5429 - RNA, 64 nt, Human; identical to SEQ ID NO: 4527

SEQ ID NO: 5430 - RNA, 64 nt, Human; identical to SEQ ID NO: 4528

SEQ ID NO: 5431 - RNA, 64 nt, Human; identical to SEQ ID NO: 4529

SEQ ID NO: 5432 - RNA, 64 nt, Human; identical to SEQ ID NO: 4530

SEQ ID NO: 5433 - RNA, 64 nt, Human; identical to SEQ ID NO: 4531

SEQ ID NO: 5434 - RNA, 64 nt, Human; identical to SEQ ID NO: 4532

SEQ ID NO: 5435 - RNA, 64 nt, Human; identical to SEQ ID NO: 4533

SEQ ID NO: 5436 - RNA, 64 nt, Human; identical to SEQ ID NO: 4534

SEQ ID NO: 5437 - RNA, 64 nt, Human; identical to SEQ ID NO: 4535

SEQ ID NO: 5438 - RNA, 64 nt, Human; identical to SEQ ID NO: 4536

SEQ ID NO: 5439 - RNA, 64 nt, Human; identical to SEQ ID NO: 4537

SEQ ID NO: 5440 - RNA, 64 nt, Human; identical to SEQ ID NO: 4538

SEQ ID NO: 5441 - RNA, 64 nt, Human; identical to SEQ ID NO: 4539

SEQ ID NO: 5442 - RNA, 57 nt, Human; identical to SEQ ID NO: 4540

SEQ ID NO: 5443 - RNA, 64 nt, Human; identical to SEQ ID NO: 4541

SEQ ID NO: 5444 - RNA, 64 nt, Human; identical to SEQ ID NO: 4542

SEQ ID NO: 5445 - RNA, 64 nt, Human; identical to SEQ ID NO: 4543

SEQ ID NO: 5446 - RNA, 64 nt, Human; identical to SEQ ID NO: 4544

SEQ ID NO: 5447 - RNA, 64 nt, Human; identical to SEQ ID NO: 4545

SEQ ID NO: 5448 - RNA, 64 nt, Human; identical to SEQ ID NO: 4546

SEQ ID NO: 5449 - RNA, 64 nt, Human; identical to SEQ ID NO: 4547

SEQ ID NO: 5450 - RNA, 64 nt, Human; identical to SEQ ID NO: 4548

SEQ ID NO: 5451 - RNA, 64 nt, Human; identical to SEQ ID NO: 4549

SEQ ID NO: 5452 - RNA, 64 nt, Human; identical to SEQ ID NO: 4550

SEQ ID NO: 5453 - RNA, 64 nt, Human; identical to SEQ ID NO: 4551

SEQ ID NO: 5454 - RNA, 64 nt, Human; identical to SEQ ID NO: 4552

SEQ ID NO: 5455 - RNA, 64 nt, Human; identical to SEQ ID NO: 4553

SEQ ID NO: 5456 - RNA, 64 nt, Human; identical to SEQ ID NO: 4554

SEQ ID NO: 5457 - RNA, 64 nt, Human; identical to SEQ ID NO: 4555

SEQ ID NO: 5458 - RNA, 64 nt, Human; identical to SEQ ID NO: 4556

SEQ ID NO: 5459 - RNA, 64 nt, Human; identical to SEQ ID NO: 4557

SEQ ID NO: 5460 - RNA, 64 nt, Human; identical to SEQ ID NO: 4558

SEQ ID NO: 5461 - RNA, 64 nt, Human; identical to SEQ ID NO: 4559

SEQ ID NO: 5462 - RNA, 55 nt, Human; identical to SEQ ID NO: 4560

SEQ ID NO: 5463 - RNA, 64 nt, Human; identical to SEQ ID NO: 4561

SEQ ID NO: 5464 - RNA, 64 nt, Human; identical to SEQ ID NO: 4562

SEQ ID NO: 5465 - RNA, 64 nt, Human; identical to SEQ ID NO: 4563

SEQ ID NO: 5466 - RNA, 64 nt, Human; identical to SEQ ID NO: 4564

SEQ ID NO: 5467 - RNA, 64 nt, Human; identical to SEQ ID NO: 4565

SEQ ID NO: 5468 - RNA, 64 nt, Human; identical to SEQ ID NO: 4566

SEQ ID NO: 5469 - RNA, 64 nt, Human; identical to SEQ ID NO: 4567

SEQ ID NO: 5470 - RNA, 64 nt, Human; identical to SEQ ID NO: 4568

SEQ ID NO: 5471 - RNA, 64 nt, Human; identical to SEQ ID NO: 4569

SEQ ID NO: 5472 - RNA, 64 nt, Human; identical to SEQ ID NO: 4570

SEQ ID NO: 5473 - RNA, 64 nt, Human; identical to SEQ ID NO: 4571

SEQ ID NO: 5474 - RNA, 64 nt, Human; identical to SEQ ID NO: 4572

SEQ ID NO: 5475 - RNA, 64 nt, Human; identical to SEQ ID NO: 4573

SEQ ID NO: 5476 - RNA, 64 nt, Human; identical to SEQ ID NO: 4574

SEQ ID NO: 5477 - RNA, 64 nt, Human; identical to SEQ ID NO: 4575

SEQ ID NO: 5478 - RNA, 64 nt, Human; identical to SEQ ID NO: 4576

SEQ ID NO: 5479 - RNA, 64 nt, Human; identical to SEQ ID NO: 4577

SEQ ID NO: 5480 - RNA, 64 nt, Human; identical to SEQ ID NO: 4578

SEQ ID NO: 5481 - RNA, 64 nt, Human; identical to SEQ ID NO: 4579

SEQ ID NO: 5482 - RNA, 64 nt, Human; identical to SEQ ID NO: 4580

SEQ ID NO: 5483 - RNA, 64 nt, Human; identical to SEQ ID NO: 4581

SEQ ID NO: 5484 - RNA, 64 nt, Human; identical to SEQ ID NO: 4582

SEQ ID NO: 5485 - RNA, 64 nt, Human; identical to SEQ ID NO: 4583

SEQ ID NO: 5486 - RNA, 64 nt, Human; identical to SEQ ID NO: 4584

SEQ ID NO: 5487 - RNA, 64 nt, Human; identical to SEQ ID NO: 4585

SEQ ID NO: 5488 - RNA, 64 nt, Human; identical to SEQ ID NO: 4586

SEQ ID NO: 5489 - RNA, 64 nt, Human; identical to SEQ ID NO: 4587

SEQ ID NO: 5490 - RNA, 64 nt, Human; identical to SEQ ID NO: 4588

SEQ ID NO: 5491 - RNA, 64 nt, Human; identical to SEQ ID NO: 4589

SEQ ID NO: 5492 - RNA, 64 nt, Human; identical to SEQ ID NO: 4590

SEQ ID NO: 5493 - RNA, 64 nt, Human; identical to SEQ ID NO: 4591

SEQ ID NO: 5494 - RNA, 64 nt, Human; identical to SEQ ID NO: 4592

SEQ ID NO: 5495 - RNA, 64 nt, Human; identical to SEQ ID NO: 4593

SEQ ID NO: 5496 - RNA, 64 nt, Human; identical to SEQ ID NO: 4594

SEQ ID NO: 5497 - RNA, 64 nt, Human; identical to SEQ ID NO: 4595

SEQ ID NO: 5498 - RNA, 64 nt, Human; identical to SEQ ID NO: 4596

SEQ ID NO: 5499 - RNA, 64 nt, Human; identical to SEQ ID NO: 4597

SEQ ID NO: 5500 - RNA, 64 nt, Human; identical to SEQ ID NO: 4598

SEQ ID NO: 5501 - RNA, 64 nt, Human; identical to SEQ ID NO: 4599

SEQ ID NO: 5502 - RNA, 64 nt, Human; identical to SEQ ID NO: 4600

SEQ ID NO: 5503 - RNA, 64 nt, Human; identical to SEQ ID NO: 4601

SEQ ID NO: 5504 - RNA, 64 nt, Human; identical to SEQ ID NO: 4602

SEQ ID NO: 5505 - RNA, 64 nt, Human; identical to SEQ ID NO: 4603

SEQ ID NO: 5506 - RNA, 64 nt, Human; identical to SEQ ID NO: 4604

SEQ ID NO: 5507 - RNA, 64 nt, Human; identical to SEQ ID NO: 4605

SEQ ID NO: 5508 - RNA, 64 nt, Human; identical to SEQ ID NO: 4606

SEQ ID NO: 5509 - RNA, 64 nt, Human; identical to SEQ ID NO: 4607

SEQ ID NO: 5510 - RNA, 64 nt, Human; identical to SEQ ID NO: 4608

SEQ ID NO: 5511 - RNA, 64 nt, Human; identical to SEQ ID NO: 4609

SEQ ID NO: 5512 - RNA, 64 nt, Human; identical to SEQ ID NO: 4610

SEQ ID NO: 5513 - RNA, 64 nt, Human; identical to SEQ ID NO: 4611

SEQ ID NO: 5514 - RNA, 64 nt, Human; identical to SEQ ID NO: 4612

SEQ ID NO: 5515 - RNA, 64 nt, Human; identical to SEQ ID NO: 4613

SEQ ID NO: 5516 - RNA, 64 nt, Human; identical to SEQ ID NO: 4614

SEQ ID NO: 5517 - RNA, 64 nt, Human; identical to SEQ ID NO: 4615

SEQ ID NO: 5518 - RNA, 64 nt, Human; identical to SEQ ID NO: 4616

SEQ ID NO: 5519 - RNA, 64 nt, Human; identical to SEQ ID NO: 4617

SEQ ID NO: 5520 - RNA, 64 nt, Human; identical to SEQ ID NO: 4618

SEQ ID NO: 5521 - RNA, 64 nt, Human; identical to SEQ ID NO: 4619

SEQ ID NO: 5522 - RNA, 64 nt, Human; identical to SEQ ID NO: 4620

SEQ ID NO: 5523 - RNA, 64 nt, Human; identical to SEQ ID NO: 4621

SEQ ID NO: 5524 - RNA, 64 nt, Human; identical to SEQ ID NO: 4622

SEQ ID NO: 5525 - RNA, 64 nt, Human; identical to SEQ ID NO: 4623

SEQ ID NO: 5526 - RNA, 64 nt, Human; identical to SEQ ID NO: 4624

SEQ ID NO: 5527 - RNA, 64 nt, Human; identical to SEQ ID NO: 4625

SEQ ID NO: 5528 - RNA, 64 nt, Human; identical to SEQ ID NO: 4626

SEQ ID NO: 5529 - RNA, 64 nt, Human; identical to SEQ ID NO: 4627

SEQ ID NO: 5530 - RNA, 64 nt, Human; identical to SEQ ID NO: 4628

SEQ ID NO: 5531 - RNA, 64 nt, Human; identical to SEQ ID NO: 4629

SEQ ID NO: 5532 - RNA, 64 nt, Human; identical to SEQ ID NO: 4630

SEQ ID NO: 5533 - RNA, 64 nt, Human; identical to SEQ ID NO: 4631

SEQ ID NO: 5534 - RNA, 64 nt, Human; identical to SEQ ID NO: 4632

SEQ ID NO: 5535 - RNA, 64 nt, Human; identical to SEQ ID NO: 4633

SEQ ID NO: 5536 - RNA, 64 nt, Human; identical to SEQ ID NO: 4634

SEQ ID NO: 5537 - RNA, 64 nt, Human; identical to SEQ ID NO: 4635

SEQ ID NO: 5538 - RNA, 64 nt, Human; identical to SEQ ID NO: 4636

SEQ ID NO: 5539 - RNA, 64 nt, Human; identical to SEQ ID NO: 4637

SEQ ID NO: 5540 - RNA, 64 nt, Human; identical to SEQ ID NO: 4638

SEQ ID NO: 5541 - RNA, 64 nt, Human; identical to SEQ ID NO: 4639

SEQ ID NO: 5542 - RNA, 64 nt, Human; identical to SEQ ID NO: 4640

SEQ ID NO: 5543 - RNA, 64 nt, Human; identical to SEQ ID NO: 4641

SEQ ID NO: 5544 - RNA, 64 nt, Human; identical to SEQ ID NO: 4642

SEQ ID NO: 5545 - RNA, 64 nt, Human; identical to SEQ ID NO: 4643

SEQ ID NO: 5546 - RNA, 64 nt, Human; identical to SEQ ID NO: 4644

SEQ ID NO: 5547 - RNA, 64 nt, Human; identical to SEQ ID NO: 4645

SEQ ID NO: 5548 - RNA, 64 nt, Human; identical to SEQ ID NO: 4646

SEQ ID NO: 5549 - RNA, 64 nt, Human; identical to SEQ ID NO: 4647

SEQ ID NO: 5550 - RNA, 64 nt, Human; identical to SEQ ID NO: 4648

SEQ ID NO: 5551 - RNA, 64 nt, Human; identical to SEQ ID NO: 4649

SEQ ID NO: 5552 - RNA, 64 nt, Human; identical to SEQ ID NO: 4650

SEQ ID NO: 5553 - RNA, 64 nt, Human; identical to SEQ ID NO: 4651

SEQ ID NO: 5554 - RNA, 64 nt, Human; identical to SEQ ID NO: 4652

SEQ ID NO: 5555 - RNA, 64 nt, Human; identical to SEQ ID NO: 4653

SEQ ID NO: 5556 - RNA, 64 nt, Human; identical to SEQ ID NO: 4654

SEQ ID NO: 5557 - RNA, 64 nt, Human; identical to SEQ ID NO: 4655

SEQ ID NO: 5558 - RNA, 64 nt, Human; identical to SEQ ID NO: 4656

SEQ ID NO: 5559 - RNA, 64 nt, Human; identical to SEQ ID NO: 4657

SEQ ID NO: 5560 - RNA, 64 nt, Human; identical to SEQ ID NO: 4658

SEQ ID NO: 5561 - RNA, 64 nt, Human; identical to SEQ ID NO: 4659

SEQ ID NO: 5562 - RNA, 64 nt, Human; identical to SEQ ID NO: 4660

SEQ ID NO: 5563 - RNA, 64 nt, Human; identical to SEQ ID NO: 4661

SEQ ID NO: 5564 - RNA, 64 nt, Human; identical to SEQ ID NO: 4662

SEQ ID NO: 5565 - RNA, 64 nt, Human; identical to SEQ ID NO: 4663

SEQ ID NO: 5566 - RNA, 64 nt, Human; identical to SEQ ID NO: 4664

SEQ ID NO: 5567 - RNA, 64 nt, Human; identical to SEQ ID NO: 4665

SEQ ID NO: 5568 - RNA, 64 nt, Human; identical to SEQ ID NO: 4666

SEQ ID NO: 5569 - RNA, 64 nt, Human; identical to SEQ ID NO: 4667

SEQ ID NO: 5570 - RNA, 64 nt, Human; identical to SEQ ID NO: 4668

SEQ ID NO: 5571 - RNA, 64 nt, Human; identical to SEQ ID NO: 4669

SEQ ID NO: 5572 - RNA, 64 nt, Human; identical to SEQ ID NO: 4670

SEQ ID NO: 5573 - RNA, 64 nt, Human; identical to SEQ ID NO: 4671

SEQ ID NO: 5574 - RNA, 64 nt, Human; identical to SEQ ID NO: 4672

SEQ ID NO: 5575 - RNA, 64 nt, Human; identical to SEQ ID NO: 4673

SEQ ID NO: 5576 - RNA, 64 nt, Human; identical to SEQ ID NO: 4674

SEQ ID NO: 5577 - RNA, 64 nt, Human; identical to SEQ ID NO: 4675

SEQ ID NO: 5578 - RNA, 64 nt, Human; identical to SEQ ID NO: 4676

SEQ ID NO: 5579 - RNA, 64 nt, Human; identical to SEQ ID NO: 4677

SEQ ID NO: 5580 - RNA, 64 nt, Human; identical to SEQ ID NO: 4678

SEQ ID NO: 5581 - RNA, 64 nt, Human; identical to SEQ ID NO: 4679

SEQ ID NO: 5582 - RNA, 64 nt, Human; identical to SEQ ID NO: 4680

SEQ ID NO: 5583 - RNA, 64 nt, Human; identical to SEQ ID NO: 4681

SEQ ID NO: 5584 - RNA, 64 nt, Human; identical to SEQ ID NO: 4682

SEQ ID NO: 5585 - RNA, 64 nt, Human; identical to SEQ ID NO: 4683

SEQ ID NO: 5586 - RNA, 64 nt, Human; identical to SEQ ID NO: 4684

SEQ ID NO: 5587 - RNA, 64 nt, Human; identical to SEQ ID NO: 4685

SEQ ID NO: 5588 - RNA, 64 nt, Human; identical to SEQ ID NO: 4686

SEQ ID NO: 5589 - RNA, 64 nt, Human; identical to SEQ ID NO: 4687

SEQ ID NO: 5590 - RNA, 64 nt, Human; identical to SEQ ID NO: 4688

SEQ ID NO: 5591 - RNA, 64 nt, Human; identical to SEQ ID NO: 4689

SEQ ID NO: 5592 - RNA, 64 nt, Human; identical to SEQ ID NO: 4690

SEQ ID NO: 5593 - RNA, 51 nt, Human; identical to SEQ ID NO: 4691

SEQ ID NO: 5594 - RNA, 64 nt, Human; identical to SEQ ID NO: 4692

SEQ ID NO: 5595 - RNA, 64 nt, Human; identical to SEQ ID NO: 4693

SEQ ID NO: 5596 - RNA, 64 nt, Human; identical to SEQ ID NO: 4694

SEQ ID NO: 5597 - RNA, 64 nt, Human; identical to SEQ ID NO: 4695

SEQ ID NO: 5598 - RNA, 64 nt, Human; identical to SEQ ID NO: 4696

SEQ ID NO: 5599 - RNA, 64 nt, Human; identical to SEQ ID NO: 4697

SEQ ID NO: 5600 - RNA, 64 nt, Human; identical to SEQ ID NO: 4698

SEQ ID NO: 5601 - RNA, 64 nt, Human; identical to SEQ ID NO: 4699

SEQ ID NO: 5602 - RNA, 64 nt, Human; identical to SEQ ID NO: 4700

SEQ ID NO: 5603 - RNA, 64 nt, Human; identical to SEQ ID NO: 4701

SEQ ID NO: 5604 - RNA, 64 nt, Human; identical to SEQ ID NO: 4702

SEQ ID NO: 5605 - RNA, 64 nt, Human; identical to SEQ ID NO: 4703

SEQ ID NO: 5606 - RNA, 64 nt, Human; identical to SEQ ID NO: 4704

SEQ ID NO: 5607 - RNA, 64 nt, Human; identical to SEQ ID NO: 4705

SEQ ID NO: 5608 - RNA, 64 nt, Human; identical to SEQ ID NO: 4706

SEQ ID NO: 5609 - RNA, 64 nt, Human; identical to SEQ ID NO: 4707

SEQ ID NO: 5610 - RNA, 64 nt, Human; identical to SEQ ID NO: 4708

SEQ ID NO: 5611 - RNA, 64 nt, Human; identical to SEQ ID NO: 4709

SEQ ID NO: 5612 - RNA, 64 nt, Human; identical to SEQ ID NO: 4710

SEQ ID NO: 5613 - RNA, 64 nt, Human; identical to SEQ ID NO: 4711

SEQ ID NO: 5614 - RNA, 64 nt, Human; identical to SEQ ID NO: 4712

SEQ ID NO: 5615 - RNA, 64 nt, Human; identical to SEQ ID NO: 4713

SEQ ID NO: 5616 - RNA, 64 nt, Human; identical to SEQ ID NO: 4714

SEQ ID NO: 5617 - RNA, 64 nt, Human; identical to SEQ ID NO: 4715

SEQ ID NO: 5618 - RNA, 64 nt, Human; identical to SEQ ID NO: 4716

SEQ ID NO: 5619 - RNA, 64 nt, Human; identical to SEQ ID NO: 4717

SEQ ID NO: 5620 - RNA, 64 nt, Human; identical to SEQ ID NO: 4718

SEQ ID NO: 5621 - RNA, 64 nt, Human; identical to SEQ ID NO: 4719

SEQ ID NO: 5622 - RNA, 64 nt, Human; identical to SEQ ID NO: 4720

SEQ ID NO: 5623 - RNA, 64 nt, Human; identical to SEQ ID NO: 4721

SEQ ID NO: 5624 - RNA, 64 nt, Human; identical to SEQ ID NO: 4722

SEQ ID NO: 5625 - RNA, 64 nt, Human; identical to SEQ ID NO: 4723

SEQ ID NO: 5626 - RNA, 64 nt, Human; identical to SEQ ID NO: 4724

SEQ ID NO: 5627 - RNA, 64 nt, Human; identical to SEQ ID NO: 4725

SEQ ID NO: 5628 - RNA, 64 nt, Human; identical to SEQ ID NO: 4726

SEQ ID NO: 5629 - RNA, 64 nt, Human; identical to SEQ ID NO: 4727

SEQ ID NO: 5630 - RNA, 64 nt, Human; identical to SEQ ID NO: 4728

SEQ ID NO: 5631 - RNA, 64 nt, Human; identical to SEQ ID NO: 4729

SEQ ID NO: 5632 - RNA, 64 nt, Human; identical to SEQ ID NO: 4730

SEQ ID NO: 5633 - RNA, 64 nt, Human; identical to SEQ ID NO: 4731

SEQ ID NO: 5634 - RNA, 64 nt, Human; identical to SEQ ID NO: 4732

SEQ ID NO: 5635 - RNA, 64 nt, Human; identical to SEQ ID NO: 4733

SEQ ID NO: 5636 - RNA, 64 nt, Human; identical to SEQ ID NO: 4734

SEQ ID NO: 5637 - RNA, 64 nt, Human; identical to SEQ ID NO: 4735

SEQ ID NO: 5638 - RNA, 64 nt, Human; identical to SEQ ID NO: 4736

SEQ ID NO: 5639 - RNA, 64 nt, Human; identical to SEQ ID NO: 4737

SEQ ID NO: 5640 - RNA, 64 nt, Human; identical to SEQ ID NO: 4738

SEQ ID NO: 5641 - RNA, 64 nt, Human; identical to SEQ ID NO: 4739

SEQ ID NO: 5642 - RNA, 64 nt, Human; identical to SEQ ID NO: 4740

SEQ ID NO: 5643 - RNA, 64 nt, Human; identical to SEQ ID NO: 4741

SEQ ID NO: 5644 - RNA, 64 nt, Human; identical to SEQ ID NO: 4742

SEQ ID NO: 5645 - RNA, 64 nt, Human; identical to SEQ ID NO: 4743

SEQ ID NO: 5646 - RNA, 64 nt, Human; identical to SEQ ID NO: 4744

SEQ ID NO: 5647 - RNA, 64 nt, Human; identical to SEQ ID NO: 4745

SEQ ID NO: 5648 - RNA, 64 nt, Human; identical to SEQ ID NO: 4746

SEQ ID NO: 5649 - RNA, 64 nt, Human; identical to SEQ ID NO: 4747

SEQ ID NO: 5650 - RNA, 64 nt, Human; identical to SEQ ID NO: 4748

SEQ ID NO: 5651 - RNA, 64 nt, Human; identical to SEQ ID NO: 4749

SEQ ID NO: 5652 - RNA, 64 nt, Human; identical to SEQ ID NO: 4750

SEQ ID NO: 5653 - RNA, 64 nt, Human; identical to SEQ ID NO: 4751

SEQ ID NO: 5654 - RNA, 64 nt, Human; identical to SEQ ID NO: 4752

SEQ ID NO: 5655 - RNA, 64 nt, Human; identical to SEQ ID NO: 4753

SEQ ID NO: 5656 - RNA, 64 nt, Human; identical to SEQ ID NO: 4754

SEQ ID NO: 5657 - RNA, 64 nt, Human; identical to SEQ ID NO: 4755

SEQ ID NO: 5658 - RNA, 64 nt, Human; identical to SEQ ID NO: 4756

SEQ ID NO: 5659 - RNA, 64 nt, Human; identical to SEQ ID NO: 4757

SEQ ID NO: 5660 - RNA, 64 nt, Human; identical to SEQ ID NO: 4758

SEQ ID NO: 5661 - RNA, 64 nt, Human; identical to SEQ ID NO: 4759

SEQ ID NO: 5662 - RNA, 64 nt, Human; identical to SEQ ID NO: 4760

SEQ ID NO: 5663 - RNA, 64 nt, Human; identical to SEQ ID NO: 4761

SEQ ID NO: 5664 - RNA, 64 nt, Human; identical to SEQ ID NO: 4762

SEQ ID NO: 5665 - RNA, 64 nt, Human; identical to SEQ ID NO: 4763

SEQ ID NO: 5666 - RNA, 64 nt, Human; identical to SEQ ID NO: 4764

SEQ ID NO: 5667 - RNA, 64 nt, Human; identical to SEQ ID NO: 4765

SEQ ID NO: 5668 - RNA, 64 nt, Human; identical to SEQ ID NO: 4766

SEQ ID NO: 5669 - RNA, 64 nt, Human; identical to SEQ ID NO: 4767

SEQ ID NO: 5670 - RNA, 64 nt, Human; identical to SEQ ID NO: 4768

SEQ ID NO: 5671 - RNA, 64 nt, Human; identical to SEQ ID NO: 4769

SEQ ID NO: 5672 - RNA, 64 nt, Human; identical to SEQ ID NO: 4770

SEQ ID NO: 5673 - RNA, 64 nt, Human; identical to SEQ ID NO: 4771

SEQ ID NO: 5674 - RNA, 64 nt, Human; identical to SEQ ID NO: 4772

SEQ ID NO: 5675 - RNA, 64 nt, Human; identical to SEQ ID NO: 4773

SEQ ID NO: 5676 - RNA, 64 nt, Human; identical to SEQ ID NO: 4774

SEQ ID NO: 5677 - RNA, 64 nt, Human; identical to SEQ ID NO: 4775

SEQ ID NO: 5678 - RNA, 64 nt, Human; identical to SEQ ID NO: 4776

SEQ ID NO: 5679 - RNA, 64 nt, Human; identical to SEQ ID NO: 4777

SEQ ID NO: 5680 - RNA, 64 nt, Human; identical to SEQ ID NO: 4778

SEQ ID NO: 5681 - RNA, 64 nt, Human; identical to SEQ ID NO: 4779

SEQ ID NO: 5682 - RNA, 64 nt, Human; identical to SEQ ID NO: 4780

SEQ ID NO: 5683 - RNA, 64 nt, Human; identical to SEQ ID NO: 4781

SEQ ID NO: 5684 - RNA, 64 nt, Human; identical to SEQ ID NO: 4782

SEQ ID NO: 5685 - RNA, 64 nt, Human; identical to SEQ ID NO: 4783

SEQ ID NO: 5686 - RNA, 64 nt, Human; identical to SEQ ID NO: 4784

SEQ ID NO: 5687 - RNA, 64 nt, Human; identical to SEQ ID NO: 4785

SEQ ID NO: 5688 - RNA, 64 nt, Human; identical to SEQ ID NO: 4786

SEQ ID NO: 5689 - RNA, 64 nt, Human; identical to SEQ ID NO: 4787

SEQ ID NO: 5690 - RNA, 64 nt, Human; identical to SEQ ID NO: 4788

SEQ ID NO: 5691 - RNA, 64 nt, Human; identical to SEQ ID NO: 4789

SEQ ID NO: 5692 - RNA, 64 nt, Human; identical to SEQ ID NO: 4789

SEQ ID NO: 5693 - RNA, 64 nt, Human; identical to SEQ ID NO: 4791

SEQ ID NO: 5694 - RNA, 64 nt, Human; identical to SEQ ID NO: 4792

SEQ ID NO: 5695 - RNA, 64 nt, Human; identical to SEQ ID NO: 4793

SEQ ID NO: 5696 - RNA, 64 nt, Human; identical to SEQ ID NO: 4794

SEQ ID NO: 5697 - RNA, 64 nt, Human; identical to SEQ ID NO: 4795

SEQ ID NO: 5698 - RNA, 64 nt, Human; identical to SEQ ID NO: 4796

SEQ ID NO: 5699 - RNA, 64 nt, Human; identical to SEQ ID NO: 4797

SEQ ID NO: 5700 - RNA, 64 nt, Human; identical to SEQ ID NO: 4798

SEQ ID NO: 5701 - RNA, 64 nt, Human; identical to SEQ ID NO: 4799

SEQ ID NO: 5702 - RNA, 64 nt, Human; identical to SEQ ID NO: 4800

SEQ ID NO: 5703 - RNA, 64 nt, Human; identical to SEQ ID NO: 4801

SEQ ID NO: 5704 - RNA, 64 nt, Human; identical to SEQ ID NO: 4802

SEQ ID NO: 5705 - RNA, 64 nt, Human; identical to SEQ ID NO: 4803

SEQ ID NO: 5706 - RNA, 64 nt, Human; identical to SEQ ID NO: 4804

SEQ ID NO: 5707 - RNA, 64 nt, Human; identical to SEQ ID NO: 4805

SEQ ID NO: 5708 - RNA, 64 nt, Human; identical to SEQ ID NO: 4806

SEQ ID NO: 5709 - RNA, 64 nt, Human; identical to SEQ ID NO: 4807

SEQ ID NO: 5710 - RNA, 64 nt, Human; identical to SEQ ID NO: 4808

SEQ ID NO: 5711 - RNA, 64 nt, Human; identical to SEQ ID NO: 4809

SEQ ID NO: 5712 - RNA, 64 nt, Human; identical to SEQ ID NO: 4810

SEQ ID NO: 5713 - RNA, 64 nt, Human; identical to SEQ ID NO: 4811

SEQ ID NO: 5714 - RNA, 64 nt, Human; identical to SEQ ID NO: 4812

SEQ ID NO: 5715 - RNA, 64 nt, Human; identical to SEQ ID NO: 4813

SEQ ID NO: 5716 - RNA, 64 nt, Human; identical to SEQ ID NO: 4814

SEQ ID NO: 5717 - RNA, 64 nt, Human; identical to SEQ ID NO: 4815

SEQ ID NO: 5718 - RNA, 64 nt, Human; identical to SEQ ID NO: 4816

SEQ ID NO: 5719 - RNA, 64 nt, Human; identical to SEQ ID NO: 4817

SEQ ID NO: 5720 - RNA, 64 nt, Human; identical to SEQ ID NO: 4818

SEQ ID NO: 5721 - RNA, 64 nt, Human; identical to SEQ ID NO: 4819

SEQ ID NO: 5722 - RNA, 64 nt, Human; identical to SEQ ID NO: 4820

SEQ ID NO: 5723 - RNA, 64 nt, Human; identical to SEQ ID NO: 4821

SEQ ID NO: 5724 - RNA, 64 nt, Human; identical to SEQ ID NO: 4822

SEQ ID NO: 5725 - RNA, 64 nt, Human; identical to SEQ ID NO: 4823

SEQ ID NO: 5726 - RNA, 64 nt, Human; identical to SEQ ID NO: 4824

SEQ ID NO: 5727 - RNA, 64 nt, Human; identical to SEQ ID NO: 4825

SEQ ID NO: 5728 - RNA, 64 nt, Human; identical to SEQ ID NO: 4826

SEQ ID NO: 5729 - RNA, 64 nt, Human; identical to SEQ ID NO: 4827

SEQ ID NO: 5730 - RNA, 64 nt, Human; identical to SEQ ID NO: 4828

SEQ ID NO: 5731 - RNA, 64 nt, Human; identical to SEQ ID NO: 4829

SEQ ID NO: 5732 - RNA, 64 nt, Human; identical to SEQ ID NO: 4830

SEQ ID NO: 5733 - RNA, 64 nt, Human; identical to SEQ ID NO: 4831

SEQ ID NO: 5734 - RNA, 56 nt, Human; identical to SEQ ID NO: 4832

SEQ ID NO: 5735 - RNA, 64 nt, Human; identical to SEQ ID NO: 4833

SEQ ID NO: 5736 - RNA, 64 nt, Human; identical to SEQ ID NO: 4834

SEQ ID NO: 5737 - RNA, 64 nt, Human; identical to SEQ ID NO: 4835

SEQ ID NO: 5738 - RNA, 64 nt, Human; identical to SEQ ID NO: 4836

SEQ ID NO: 5739 - RNA, 64 nt, Human; identical to SEQ ID NO: 4837

SEQ ID NO: 5740 - RNA, 64 nt, Human; identical to SEQ ID NO: 4838

SEQ ID NO: 5741 - RNA, 64 nt, Human; identical to SEQ ID NO: 4839

SEQ ID NO: 5742 - RNA, 64 nt, Human; identical to SEQ ID NO: 4840

SEQ ID NO: 5743 - RNA, 64 nt, Human; identical to SEQ ID NO: 4841

SEQ ID NO: 5744 - RNA, 64 nt, Human; identical to SEQ ID NO: 4842

SEQ ID NO: 5745 - RNA, 64 nt, Human; identical to SEQ ID NO: 4843

SEQ ID NO: 5746 - RNA, 64 nt, Human; identical to SEQ ID NO: 4844

SEQ ID NO: 5747 - RNA, 64 nt, Human; identical to SEQ ID NO: 4845

SEQ ID NO: 5748 - RNA, 64 nt, Human; identical to SEQ ID NO: 4846

SEQ ID NO: 5749 - RNA, 64 nt, Human; identical to SEQ ID NO: 4847

SEQ ID NO: 5750 - RNA, 64 nt, Human; identical to SEQ ID NO: 4848

SEQ ID NO: 5751 - RNA, 64 nt, Human; identical to SEQ ID NO: 4849

SEQ ID NO: 5752 - RNA, 64 nt, Human; identical to SEQ ID NO: 4850

SEQ ID NO: 5753 - RNA, 64 nt, Human; identical to SEQ ID NO: 4851

SEQ ID NO: 5754 - RNA, 64 nt, Human; identical to SEQ ID NO: 4852

SEQ ID NO: 5755 - RNA, 64 nt, Human; identical to SEQ ID NO: 4853

SEQ ID NO: 5756 - RNA, 64 nt, Human; identical to SEQ ID NO: 4854

SEQ ID NO: 5757 - RNA, 64 nt, Human; identical to SEQ ID NO: 4855

SEQ ID NO: 5758 - RNA, 64 nt, Human; identical to SEQ ID NO: 4856

SEQ ID NO: 5759 - RNA, 64 nt, Human; identical to SEQ ID NO: 4857

SEQ ID NO: 5760 - RNA, 64 nt, Human; identical to SEQ ID NO: 4858

SEQ ID NO: 5761 - RNA, 64 nt, Human; identical to SEQ ID NO: 4859

SEQ ID NO: 5762 - RNA, 64 nt, Human; identical to SEQ ID NO: 4860

SEQ ID NO: 5763 - RNA, 64 nt, Human; identical to SEQ ID NO: 4861

SEQ ID NO: 5764 - RNA, 64 nt, Human; identical to SEQ ID NO: 4862

SEQ ID NO: 5765 - RNA, 64 nt, Human; identical to SEQ ID NO: 4863

SEQ ID NO: 5766 - RNA, 64 nt, Human; identical to SEQ ID NO: 4864

SEQ ID NO: 5767 - RNA, 64 nt, Human; identical to SEQ ID NO: 4865

SEQ ID NO: 5768 - RNA, 64 nt, Human; identical to SEQ ID NO: 4866

SEQ ID NO: 5769 - RNA, 64 nt, Human; identical to SEQ ID NO: 4867

SEQ ID NO: 5770 - RNA, 64 nt, Human; identical to SEQ ID NO: 4868

SEQ ID NO: 5771 - RNA, 64 nt, Human; identical to SEQ ID NO: 4869

SEQ ID NO: 5772 - RNA, 64 nt, Human; identical to SEQ ID NO: 4870

SEQ ID NO: 5773 - RNA, 64 nt, Human; identical to SEQ ID NO: 4871

SEQ ID NO: 5774 - RNA, 64 nt, Human; identical to SEQ ID NO: 4872

SEQ ID NO: 5775 - RNA, 64 nt, Human; identical to SEQ ID NO: 4873

SEQ ID NO: 5776 - RNA, 64 nt, Human; identical to SEQ ID NO: 4874

SEQ ID NO: 5777 - RNA, 64 nt, Human; identical to SEQ ID NO: 4875

SEQ ID NO: 5778 - RNA, 64 nt, Human; identical to SEQ ID NO: 4876

SEQ ID NO: 5779 - RNA, 64 nt, Human; identical to SEQ ID NO: 4877

SEQ ID NO: 5780 - RNA, 64 nt, Human; identical to SEQ ID NO: 4878

SEQ ID NO: 5781 - RNA, 64 nt, Human; identical to SEQ ID NO: 4879

SEQ ID NO: 5782 - RNA, 64 nt, Human; identical to SEQ ID NO: 4880

SEQ ID NO: 5783 - RNA, 64 nt, Human; identical to SEQ ID NO: 4881

SEQ ID NO: 5784 - RNA, 64 nt, Human; identical to SEQ ID NO: 4882

SEQ ID NO: 5785 - RNA, 64 nt, Human; identical to SEQ ID NO: 4883

SEQ ID NO: 5786 - RNA, 64 nt, Human; identical to SEQ ID NO: 4884

SEQ ID NO: 5787 - RNA, 64 nt, Human; identical to SEQ ID NO: 4885

SEQ ID NO: 5788 - RNA, 64 nt, Human; identical to SEQ ID NO: 4886

SEQ ID NO: 5789 - RNA, 64 nt, Human; identical to SEQ ID NO: 4887

SEQ ID NO: 5790 - RNA, 64 nt, Human; identical to SEQ ID NO: 4888

SEQ ID NO: 5791 - RNA, 64 nt, Human; identical to SEQ ID NO: 4889

SEQ ID NO: 5792 - RNA, 64 nt, Human; identical to SEQ ID NO: 4890

SEQ ID NO: 5793 - RNA, 64 nt, Human; identical to SEQ ID NO: 4891

SEQ ID NO: 5794 - RNA, 64 nt, Human; identical to SEQ ID NO: 4892

SEQ ID NO: 5795 - RNA, 64 nt, Human; identical to SEQ ID NO: 4893

SEQ ID NO: 5796 - RNA, 64 nt, Human; identical to SEQ ID NO: 4894

SEQ ID NO: 5797 - RNA, 64 nt, Human; identical to SEQ ID NO: 4895

SEQ ID NO: 5798 - RNA, 64 nt, Human; identical to SEQ ID NO: 4896

SEQ ID NO: 5799 - RNA, 64 nt, Human; identical to SEQ ID NO: 4897

SEQ ID NO: 5800 - RNA, 64 nt, Human; identical to SEQ ID NO: 4898

SEQ ID NO: 5801 - RNA, 64 nt, Human; identical to SEQ ID NO: 4899

SEQ ID NO: 5802 - RNA, 51 nt, Human; identical to SEQ ID NO: 4900

SEQ ID NO: 5803 - RNA, 64 nt, Human; identical to SEQ ID NO: 4901

SEQ ID NO: 5804 - RNA, 64 nt, Human; identical to SEQ ID NO: 4902

SEQ ID NO: 5805 - RNA, 64 nt, Human; identical to SEQ ID NO: 4903

SEQ ID NO: 5806 - RNA, 64 nt, Human; identical to SEQ ID NO: 4904

SEQ ID NO: 5807 - RNA, 64 nt, Human; identical to SEQ ID NO: 4905

SEQ ID NO: 5808 - RNA, 64 nt, Human; identical to SEQ ID NO: 4906

SEQ ID NO: 5809 - RNA, 64 nt, Human; identical to SEQ ID NO: 4907

SEQ ID NO: 5810 - RNA, 64 nt, Human; identical to SEQ ID NO: 4908

SEQ ID NO: 5811 - RNA, 62 nt, Human; identical to SEQ ID NO: 4909

SEQ ID NO: 5812 - RNA, 64 nt, Human; identical to SEQ ID NO: 4910

SEQ ID NO: 5813 - RNA, 64 nt, Human; identical to SEQ ID NO: 4911

SEQ ID NO: 5814 - RNA, 53 nt, Human; identical to SEQ ID NO: 4912

SEQ ID NO: 5815 - RNA, 64 nt, Human; identical to SEQ ID NO: 4913

SEQ ID NO: 5816 - RNA, 64 nt, Human; identical to SEQ ID NO: 4914

SEQ ID NO: 5817 - RNA, 64 nt, Human; identical to SEQ ID NO: 4915

SEQ ID NO: 5818 - RNA, 64 nt, Human; identical to SEQ ID NO: 4916

SEQ ID NO: 5819 - RNA, 64 nt, Human; identical to SEQ ID NO: 4917

SEQ ID NO: 5820 - RNA, 64 nt, Human; identical to SEQ ID NO: 4918

SEQ ID NO: 5821 - RNA, 64 nt, Human; identical to SEQ ID NO: 4919

SEQ ID NO: 5822 - RNA, 64 nt, Human; identical to SEQ ID NO: 4920

SEQ ID NO: 5823 - RNA, 54 nt, Human; identical to SEQ ID NO: 4921

SEQ ID NO: 5824 - RNA, 64 nt, Human; identical to SEQ ID NO: 4922

SEQ ID NO: 5825 - RNA, 64 nt, Human; identical to SEQ ID NO: 4923

SEQ ID NO: 5826 - RNA, 64 nt, Human; identical to SEQ ID NO: 4924

SEQ ID NO: 5827 - RNA, 64 nt, Human; identical to SEQ ID NO: 4925

SEQ ID NO: 5828 - RNA, 64 nt, Human; identical to SEQ ID NO: 4926

SEQ ID NO: 5829 - RNA, 64 nt, Human; identical to SEQ ID NO: 4927

SEQ ID NO: 5830 - RNA, 64 nt, Human; identical to SEQ ID NO: 4928

SEQ ID NO: 5831 - RNA, 64 nt, Human; identical to SEQ ID NO: 4929

SEQ ID NO: 5832 - RNA, 64 nt, Human; identical to SEQ ID NO: 4930

SEQ ID NO: 5833 - RNA, 64 nt, Human; identical to SEQ ID NO: 4931

SEQ ID NO: 5834 - RNA, 64 nt, Human; identical to SEQ ID NO: 4932

SEQ ID NO: 5835 - RNA, 64 nt, Human; identical to SEQ ID NO: 4933

SEQ ID NO: 5836 - RNA, 64 nt, Human; identical to SEQ ID NO: 4934

SEQ ID NO: 5837 - RNA, 64 nt, Human; identical to SEQ ID NO: 4935

SEQ ID NO: 5838 - RNA, 64 nt, Human; identical to SEQ ID NO: 4936

SEQ ID NO: 5839 - RNA, 64 nt, Human; identical to SEQ ID NO: 4937

SEQ ID NO: 5840 - RNA, 64 nt, Human; identical to SEQ ID NO: 4938

SEQ ID NO: 5841 - RNA, 64 nt, Human; identical to SEQ ID NO: 4939

SEQ ID NO: 5842 - RNA, 64 nt, Human; identical to SEQ ID NO: 4940

SEQ ID NO: 5843 - RNA, 64 nt, Human; identical to SEQ ID NO: 4941

SEQ ID NO: 5844 - RNA, 64 nt, Human; identical to SEQ ID NO: 4942

SEQ ID NO: 5845 - RNA, 64 nt, Human; identical to SEQ ID NO: 4943

SEQ ID NO: 5846 - RNA, 64 nt, Human; identical to SEQ ID NO: 4944

SEQ ID NO: 5847 - RNA, 64 nt, Human; identical to SEQ ID NO: 4945

SEQ ID NO: 5848 - RNA, 64 nt, Human; identical to SEQ ID NO: 4946

SEQ ID NO: 5849 - RNA, 64 nt, Human; identical to SEQ ID NO: 4947

SEQ ID NO: 5850 - RNA, 64 nt, Human; identical to SEQ ID NO: 4948

SEQ ID NO: 5851 - RNA, 64 nt, Human; identical to SEQ ID NO: 4949

SEQ ID NO: 5852 - RNA, 64 nt, Human; identical to SEQ ID NO: 4950

SEQ ID NO: 5853 - RNA, 64 nt, Human; identical to SEQ ID NO: 4951

SEQ ID NO: 5854 - RNA, 64 nt, Human; identical to SEQ ID NO: 4952

SEQ ID NO: 5855 - RNA, 64 nt, Human; identical to SEQ ID NO: 4953

SEQ ID NO: 5856 - RNA, 64 nt, Human; identical to SEQ ID NO: 4954

SEQ ID NO: 5857 - RNA, 64 nt, Human; identical to SEQ ID NO: 4955

SEQ ID NO: 5858 - RNA, 64 nt, Human; identical to SEQ ID NO: 4956

SEQ ID NO: 5859 - RNA, 64 nt, Human; identical to SEQ ID NO: 4957

SEQ ID NO: 5860 - RNA, 64 nt, Human; identical to SEQ ID NO: 4958

SEQ ID NO: 5861 - RNA, 64 nt, Human; identical to SEQ ID NO: 4943

SEQ ID NO: 5862 - RNA, 64 nt, Human; identical to SEQ ID NO: 4960

SEQ ID NO: 5863 - RNA, 64 nt, Human; identical to SEQ ID NO: 4961

SEQ ID NO: 5864 - RNA, 64 nt, Human; identical to SEQ ID NO: 4962

SEQ ID NO: 5865 - RNA, 64 nt, Human; identical to SEQ ID NO: 4963

SEQ ID NO: 5866 - RNA, 64 nt, Human; identical to SEQ ID NO: 4964

SEQ ID NO: 5867 - RNA, 64 nt, Human; identical to SEQ ID NO: 4965

SEQ ID NO: 5868 - RNA, 64 nt, Human; identical to SEQ ID NO: 4966

SEQ ID NO: 5869 - RNA, 64 nt, Human; identical to SEQ ID NO: 4967

SEQ ID NO: 5870 - RNA, 64 nt, Human; identical to SEQ ID NO: 4968

SEQ ID NO: 5871 - RNA, 64 nt, Human; identical to SEQ ID NO: 4969

SEQ ID NO: 5872 - RNA, 64 nt, Human; identical to SEQ ID NO: 4970

SEQ ID NO: 5873 - RNA, 64 nt, Human; identical to SEQ ID NO: 4971

SEQ ID NO: 5874 - RNA, 64 nt, Human; identical to SEQ ID NO: 4972

SEQ ID NO: 5875 - RNA, 64 nt, Human; identical to SEQ ID NO: 4973

SEQ ID NO: 5876 - RNA, 64 nt, Human; identical to SEQ ID NO: 4974

SEQ ID NO: 5877 - RNA, 62 nt, Human; identical to SEQ ID NO: 4975

SEQ ID NO: 5878 - RNA, 64 nt, Human; identical to SEQ ID NO: 4976

SEQ ID NO: 5879 - RNA, 64 nt, Human; identical to SEQ ID NO: 4977

SEQ ID NO: 5880 - RNA, 64 nt, Human; identical to SEQ ID NO: 4978

SEQ ID NO: 5881 - RNA, 64 nt, Human; identical to SEQ ID NO: 4979

SEQ ID NO: 5882 - RNA, 64 nt, Human; identical to SEQ ID NO: 4980

SEQ ID NO: 5883 - RNA, 64 nt, Human; identical to SEQ ID NO: 4981

SEQ ID NO: 5884 - RNA, 64 nt, Human; identical to SEQ ID NO: 4982

SEQ ID NO: 5885 - RNA, 64 nt, Human; identical to SEQ ID NO: 4983

SEQ ID NO: 5886 - RNA, 64 nt, Human; identical to SEQ ID NO: 4984

SEQ ID NO: 5887 - RNA, 64 nt, Human; identical to SEQ ID NO: 4985

SEQ ID NO: 5888 - RNA, 64 nt, Human; identical to SEQ ID NO: 4986

SEQ ID NO: 5889 - RNA, 64 nt, Human; identical to SEQ ID NO: 4987

SEQ ID NO: 5890 - RNA, 64 nt, Human; identical to SEQ ID NO: 4988

SEQ ID NO: 5891 - RNA, 64 nt, Human; identical to SEQ ID NO: 4989

SEQ ID NO: 5892 - RNA, 64 nt, Human; identical to SEQ ID NO: 4990

SEQ ID NO: 5893 - RNA, 64 nt, Human; identical to SEQ ID NO: 4991

SEQ ID NO: 5894 - RNA, 64 nt, Human; identical to SEQ ID NO: 4992

SEQ ID NO: 5895 - RNA, 64 nt, Human; identical to SEQ ID NO: 4993

SEQ ID NO: 5896 - RNA, 64 nt, Human; identical to SEQ ID NO: 4994

SEQ ID NO: 5897 - RNA, 64 nt, Human; identical to SEQ ID NO: 4995

SEQ ID NO: 5898 - RNA, 64 nt, Human; identical to SEQ ID NO: 4996

SEQ ID NO: 5899 - RNA, 64 nt, Human; identical to SEQ ID NO: 4997

SEQ ID NO: 5900 - RNA, 64 nt, Human; identical to SEQ ID NO: 4998

SEQ ID NO: 5901 - RNA, 64 nt, Human; identical to SEQ ID NO: 4999

SEQ ID NO: 5902 - RNA, 64 nt, Human; identical to SEQ ID NO: 5000

SEQ ID NO: 5903 - RNA, 64 nt, Human; identical to SEQ ID NO: 5001

SEQ ID NO: 5904 - RNA, 64 nt, Human; identical to SEQ ID NO: 5002

SEQ ID NO: 5905 - RNA, 64 nt, Human; identical to SEQ ID NO: 5003

SEQ ID NO: 5906 - RNA, 64 nt, Human; identical to SEQ ID NO: 5004

SEQ ID NO: 5907 - RNA, 64 nt, Human; identical to SEQ ID NO: 5005

SEQ ID NO: 5908 - RNA, 64 nt, Human; identical to SEQ ID NO: 5006

SEQ ID NO: 5909 - RNA, 64 nt, Human; identical to SEQ ID NO: 5007

SEQ ID NO: 5910 - RNA, 64 nt, Human; identical to SEQ ID NO: 5008

SEQ ID NO: 5911 - RNA, 64 nt, Human; identical to SEQ ID NO: 5009

SEQ ID NO: 5912 - RNA, 64 nt, Human; identical to SEQ ID NO: 5010

SEQ ID NO: 5913 - RNA, 64 nt, Human; identical to SEQ ID NO: 5011

SEQ ID NO: 5914 - RNA, 64 nt, Human; identical to SEQ ID NO: 5012

SEQ ID NO: 5915 - RNA, 64 nt, Human; identical to SEQ ID NO: 5013

SEQ ID NO: 5916 - RNA, 64 nt, Human; identical to SEQ ID NO: 5014

SEQ ID NO: 5917 - RNA, 64 nt, Human; identical to SEQ ID NO: 5015

SEQ ID NO: 5918 - RNA, 64 nt, Human; identical to SEQ ID NO: 5016

SEQ ID NO: 5919 - RNA, 64 nt, Human; identical to SEQ ID NO: 5017

SEQ ID NO: 5920 - RNA, 64 nt, Human; identical to SEQ ID NO: 5018

SEQ ID NO: 5921 - RNA, 64 nt, Human; identical to SEQ ID NO: 5019

SEQ ID NO: 5922 - RNA, 64 nt, Human; identical to SEQ ID NO: 5020

SEQ ID NO: 5923 - RNA, 64 nt, Human; identical to SEQ ID NO: 5021

SEQ ID NO: 5924 - RNA, 64 nt, Human; identical to SEQ ID NO: 5022

SEQ ID NO: 5925 - RNA, 64 nt, Human; identical to SEQ ID NO: 5023

SEQ ID NO: 5926 - RNA, 64 nt, Human; identical to SEQ ID NO: 5024

SEQ ID NO: 5927 - RNA, 64 nt, Human; identical to SEQ ID NO: 5025

SEQ ID NO: 5928 - RNA, 64 nt, Human; identical to SEQ ID NO: 5026

SEQ ID NO: 5929 - RNA, 64 nt, Human; identical to SEQ ID NO: 5027

SEQ ID NO: 5930 - RNA, 64 nt, Human; identical to SEQ ID NO: 5028

SEQ ID NO: 5931 - RNA, 61 nt, Human; identical to SEQ ID NO: 5029

SEQ ID NO: 5932 - RNA, 64 nt, Human; identical to SEQ ID NO: 5030

SEQ ID NO: 5933 - RNA, 64 nt, Human; identical to SEQ ID NO: 5031

SEQ ID NO: 5934 - RNA, 64 nt, Human; identical to SEQ ID NO: 5032

SEQ ID NO: 5935 - RNA, 64 nt, Human; identical to SEQ ID NO: 5033

SEQ ID NO: 5936 - RNA, 64 nt, Human; identical to SEQ ID NO: 5034

SEQ ID NO: 5937 - RNA, 64 nt, Human; identical to SEQ ID NO: 5035

SEQ ID NO: 5938 - RNA, 64 nt, Human; identical to SEQ ID NO: 5036

SEQ ID NO: 5939 - RNA, 64 nt, Human; identical to SEQ ID NO: 5037

SEQ ID NO: 5940 - RNA, 64 nt, Human; identical to SEQ ID NO: 5038

SEQ ID NO: 5941 - RNA, 64 nt, Human; identical to SEQ ID NO: 5039

SEQ ID NO: 5942 - RNA, 64 nt, Human; identical to SEQ ID NO: 5040

SEQ ID NO: 5943 - RNA, 64 nt, Human; identical to SEQ ID NO: 5041

SEQ ID NO: 5944 - RNA, 64 nt, Human; identical to SEQ ID NO: 5035

SEQ ID NO: 5945 - RNA, 64 nt, Human; identical to SEQ ID NO: 5043

SEQ ID NO: 5946 - RNA, 64 nt, Human; identical to SEQ ID NO: 5044

SEQ ID NO: 5947 - RNA, 64 nt, Human; identical to SEQ ID NO: 5045

SEQ ID NO: 5948 - RNA, 64 nt, Human; identical to SEQ ID NO: 5046

SEQ ID NO: 5949 - RNA, 64 nt, Human; identical to SEQ ID NO: 5047

SEQ ID NO: 5950 - RNA, 64 nt, Human; identical to SEQ ID NO: 5048

SEQ ID NO: 5951 - RNA, 64 nt, Human; identical to SEQ ID NO: 5049

SEQ ID NO: 5952 - RNA, 64 nt, Human; identical to SEQ ID NO: 5050

SEQ ID NO: 5953 - RNA, 64 nt, Human; identical to SEQ ID NO: 5051

SEQ ID NO: 5954 - RNA, 64 nt, Human; identical to SEQ ID NO: 5052

SEQ ID NO: 5955 - RNA, 64 nt, Human; identical to SEQ ID NO: 5053

SEQ ID NO: 5956 - RNA, 64 nt, Human; identical to SEQ ID NO: 5054

SEQ ID NO: 5957 - RNA, 64 nt, Human; identical to SEQ ID NO: 5055

SEQ ID NO: 5958 - RNA, 64 nt, Human; identical to SEQ ID NO: 5056

SEQ ID NO: 5959 - RNA, 64 nt, Human; identical to SEQ ID NO: 5057

SEQ ID NO: 5960 - RNA, 64 nt, Human; identical to SEQ ID NO: 5058

SEQ ID NO: 5961 - RNA, 64 nt, Human; identical to SEQ ID NO: 5059

SEQ ID NO: 5962 - RNA, 64 nt, Human; identical to SEQ ID NO: 5060

SEQ ID NO: 5963 - RNA, 64 nt, Human; identical to SEQ ID NO: 5061

SEQ ID NO: 5964 - RNA, 64 nt, Human; identical to SEQ ID NO: 5062

SEQ ID NO: 5965 - RNA, 64 nt, Human; identical to SEQ ID NO: 5063

SEQ ID NO: 5966 - RNA, 64 nt, Human; identical to SEQ ID NO: 5064

SEQ ID NO: 5967 - RNA, 64 nt, Human; identical to SEQ ID NO: 5065

SEQ ID NO: 5968 - RNA, 64 nt, Human; identical to SEQ ID NO: 5066

SEQ ID NO: 5969 - RNA, 64 nt, Human; identical to SEQ ID NO: 5067

SEQ ID NO: 5970 - RNA, 64 nt, Human; identical to SEQ ID NO: 5068

SEQ ID NO: 5971 - RNA, 64 nt, Human; identical to SEQ ID NO: 5069

SEQ ID NO: 5972 - RNA, 64 nt, Human; identical to SEQ ID NO: 5070

SEQ ID NO: 5973 - RNA, 64 nt, Human; identical to SEQ ID NO: 5071

SEQ ID NO: 5974 - RNA, 64 nt, Human; identical to SEQ ID NO: 5072

SEQ ID NO: 5975 - RNA, 64 nt, Human; identical to SEQ ID NO: 5073

SEQ ID NO: 5976 - RNA, 64 nt, Human; identical to SEQ ID NO: 5074

SEQ ID NO: 5977 - RNA, 64 nt, Human; identical to SEQ ID NO: 5075

SEQ ID NO: 5978 - RNA, 64 nt, Human; identical to SEQ ID NO: 5076

SEQ ID NO: 5979 - RNA, 64 nt, Human; identical to SEQ ID NO: 5077

SEQ ID NO: 5980 - RNA, 64 nt, Human; identical to SEQ ID NO: 5078

SEQ ID NO: 5981 - RNA, 64 nt, Human; identical to SEQ ID NO: 5079

SEQ ID NO: 5982 - RNA, 64 nt, Human; identical to SEQ ID NO: 5080

SEQ ID NO: 5983 - RNA, 64 nt, Human; identical to SEQ ID NO: 5081

SEQ ID NO: 5984 - RNA, 64 nt, Human; identical to SEQ ID NO: 5082

SEQ ID NO: 5985 - RNA, 64 nt, Human; identical to SEQ ID NO: 5083

SEQ ID NO: 5986 - RNA, 64 nt, Human; identical to SEQ ID NO: 5084

SEQ ID NO: 5987 - RNA, 64 nt, Human; identical to SEQ ID NO: 5085

SEQ ID NO: 5988 - RNA, 64 nt, Human; identical to SEQ ID NO: 5086

SEQ ID NO: 5989 - RNA, 64 nt, Human; identical to SEQ ID NO: 5087

SEQ ID NO: 5990 - RNA, 64 nt, Human; identical to SEQ ID NO: 5088

SEQ ID NO: 5991 - RNA, 64 nt, Human; identical to SEQ ID NO: 5089

SEQ ID NO: 5992 - RNA, 64 nt, Human; identical to SEQ ID NO: 5090

SEQ ID NO: 5993 - RNA, 64 nt, Human; identical to SEQ ID NO: 5091

SEQ ID NO: 5994 - RNA, 64 nt, Human; identical to SEQ ID NO: 5092

SEQ ID NO: 5995 - RNA, 64 nt, Human; identical to SEQ ID NO: 5093

SEQ ID NO: 5996 - RNA, 64 nt, Human; identical to SEQ ID NO: 5094

SEQ ID NO: 5997 - RNA, 64 nt, Human; identical to SEQ ID NO: 5095

SEQ ID NO: 5998 - RNA, 64 nt, Human; identical to SEQ ID NO: 5096

SEQ ID NO: 5999 - RNA, 64 nt, Human; identical to SEQ ID NO: 5097

SEQ ID NO: 6000 - RNA, 64 nt, Human; identical to SEQ ID NO: 5098

SEQ ID NO: 6001 - RNA, 64 nt, Human; identical to SEQ ID NO: 5099

SEQ ID NO: 6002 - RNA, 64 nt, Human; identical to SEQ ID NO: 5100

SEQ ID NO: 6003 - RNA, 64 nt, Human; identical to SEQ ID NO: 5101

SEQ ID NO: 6004 - RNA, 64 nt, Human; identical to SEQ ID NO: 5102

SEQ ID NO: 6005 - RNA, 64 nt, Human; identical to SEQ ID NO: 5103

SEQ ID NO: 6006 - RNA, 64 nt, Human; identical to SEQ ID NO: 5104

SEQ ID NO: 6007 - RNA, 64 nt, Human; identical to SEQ ID NO: 5105

SEQ ID NO: 6008 - RNA, 64 nt, Human; identical to SEQ ID NO: 5106

SEQ ID NO: 6009 - RNA, 64 nt, Human; identical to SEQ ID NO: 5107

SEQ ID NO: 6010 - RNA, 64 nt, Human; identical to SEQ ID NO: 5108

SEQ ID NO: 6011 - RNA, 64 nt, Human; identical to SEQ ID NO: 5109

SEQ ID NO: 6012 - RNA, 64 nt, Human; identical to SEQ ID NO: 5110

SEQ ID NO: 6013 - RNA, 64 nt, Human; identical to SEQ ID NO: 5111

SEQ ID NO: 6014 - RNA, 64 nt, Human; identical to SEQ ID NO: 5107

SEQ ID NO: 6015 - RNA, 64 nt, Human; identical to SEQ ID NO: 5113

SEQ ID NO: 6016 - RNA, 64 nt, Human; identical to SEQ ID NO: 5114

SEQ ID NO: 6017 - RNA, 64 nt, Human; identical to SEQ ID NO: 5115

SEQ ID NO: 6018 - RNA, 64 nt, Human; identical to SEQ ID NO: 5116

SEQ ID NO: 6019 - RNA, 64 nt, Human; identical to SEQ ID NO: 5117

SEQ ID NO: 6020 - RNA, 64 nt, Human; identical to SEQ ID NO: 5118

SEQ ID NO: 6021 - RNA, 64 nt, Human; identical to SEQ ID NO: 5119

SEQ ID NO: 6022 - RNA, 64 nt, Human; identical to SEQ ID NO: 5120

SEQ ID NO: 6023 - RNA, 64 nt, Human; identical to SEQ ID NO: 5121

SEQ ID NO: 6024 - RNA, 64 nt, Human; identical to SEQ ID NO: 5122

SEQ ID NO: 6025 - RNA, 64 nt, Human; identical to SEQ ID NO: 5123

SEQ ID NO: 6026 - RNA, 64 nt, Human; identical to SEQ ID NO: 5124

SEQ ID NO: 6027 - RNA, 64 nt, Human; identical to SEQ ID NO: 5125

SEQ ID NO: 6028 - RNA, 64 nt, Human; identical to SEQ ID NO: 5126

SEQ ID NO: 6029 - RNA, 64 nt, Human; identical to SEQ ID NO: 5127

SEQ ID NO: 6030 - RNA, 64 nt, Human; identical to SEQ ID NO: 5128

SEQ ID NO: 6031 - RNA, 64 nt, Human; identical to SEQ ID NO: 5129

SEQ ID NO: 6032 - RNA, 64 nt, Human; identical to SEQ ID NO: 5130

SEQ ID NO: 6033 - RNA, 64 nt, Human; identical to SEQ ID NO: 5131

SEQ ID NO: 6034 - RNA, 64 nt, Human; identical to SEQ ID NO: 5132

SEQ ID NO: 6035 - RNA, 64 nt, Human; identical to SEQ ID NO: 5133

SEQ ID NO: 6036 - RNA, 64 nt, Human; identical to SEQ ID NO: 5134

SEQ ID NO: 6037 - RNA, 64 nt, Human; identical to SEQ ID NO: 5135

SEQ ID NO: 6038 - RNA, 64 nt, Human; identical to SEQ ID NO: 5136

SEQ ID NO: 6039 - RNA, 64 nt, Human; identical to SEQ ID NO: 5137

SEQ ID NO: 6040 - RNA, 64 nt, Human; identical to SEQ ID NO: 5138

SEQ ID NO: 6041 - RNA, 64 nt, Human; identical to SEQ ID NO: 5139

SEQ ID NO: 6042 - RNA, 64 nt, Human; identical to SEQ ID NO: 5140

SEQ ID NO: 6043 - RNA, 64 nt, Human; identical to SEQ ID NO: 5141

SEQ ID NO: 6044 - RNA, 64 nt, Human; identical to SEQ ID NO: 5142

SEQ ID NO: 6045 - RNA, 64 nt, Human; identical to SEQ ID NO: 5143

SEQ ID NO: 6046 - RNA, 64 nt, Human; identical to SEQ ID NO: 5144

SEQ ID NO: 6047 - RNA, 64 nt, Human; identical to SEQ ID NO: 5145

SEQ ID NO: 6048 - RNA, 64 nt, Human; identical to SEQ ID NO: 5146

SEQ ID NO: 6049 - RNA, 64 nt, Human; identical to SEQ ID NO: 5147

SEQ ID NO: 6050 - RNA, 54 nt, Human; identical to SEQ ID NO: 5148

SEQ ID NO: 6051 - RNA, 64 nt, Human; identical to SEQ ID NO: 5149

SEQ ID NO: 6052 - RNA, 64 nt, Human; identical to SEQ ID NO: 5150

SEQ ID NO: 6053 - RNA, 64 nt, Human; identical to SEQ ID NO: 5151

SEQ ID NO: 6054 - RNA, 64 nt, Human; identical to SEQ ID NO: 5152

SEQ ID NO: 6055 - RNA, 64 nt, Human; identical to SEQ ID NO: 5153

SEQ ID NO: 6056 - RNA, 64 nt, Human; identical to SEQ ID NO: 5154

SEQ ID NO: 6057 - RNA, 64 nt, Human; identical to SEQ ID NO: 5155

SEQ ID NO: 6058 - RNA, 64 nt, Human; identical to SEQ ID NO: 5156

SEQ ID NO: 6059 - RNA, 64 nt, Human; identical to SEQ ID NO: 5157

SEQ ID NO: 6060 - RNA, 64 nt, Human; identical to SEQ ID NO: 5158

SEQ ID NO: 6061 - RNA, 64 nt, Human; identical to SEQ ID NO: 5159

SEQ ID NO: 6062 - RNA, 64 nt, Human; identical to SEQ ID NO: 5160

SEQ ID NO: 6063 - RNA, 64 nt, Human; identical to SEQ ID NO: 5161

SEQ ID NO: 6064 - RNA, 64 nt, Human; identical to SEQ ID NO: 5162

SEQ ID NO: 6065 - RNA, 64 nt, Human; identical to SEQ ID NO: 5163

SEQ ID NO: 6066 - RNA, 64 nt, Human; identical to SEQ ID NO: 5164

SEQ ID NO: 6067 - RNA, 64 nt, Human; identical to SEQ ID NO: 5165

SEQ ID NO: 6068 - RNA, 64 nt, Human; identical to SEQ ID NO: 5166

SEQ ID NO: 6069 - RNA, 64 nt, Human; identical to SEQ ID NO: 5167

SEQ ID NO: 6070 - RNA, 64 nt, Human; identical to SEQ ID NO: 5168

SEQ ID NO: 6071 - RNA, 64 nt, Human; identical to SEQ ID NO: 5169

SEQ ID NO: 6072 - RNA, 64 nt, Human; identical to SEQ ID NO: 5170

SEQ ID NO: 6073 - RNA, 64 nt, Human; identical to SEQ ID NO: 5171

SEQ ID NO: 6074 - RNA, 64 nt, Human; identical to SEQ ID NO: 5172

SEQ ID NO: 6075 - RNA, 64 nt, Human; identical to SEQ ID NO: 5173

SEQ ID NO: 6076 - RNA, 64 nt, Human; identical to SEQ ID NO: 5174

SEQ ID NO: 6077 - RNA, 64 nt, Human; identical to SEQ ID NO: 5175

SEQ ID NO: 6078 - RNA, 64 nt, Human; identical to SEQ ID NO: 5176

SEQ ID NO: 6079 - RNA, 64 nt, Human; identical to SEQ ID NO: 5177

SEQ ID NO: 6080 - RNA, 64 nt, Human; identical to SEQ ID NO: 5178

SEQ ID NO: 6081 - RNA, 64 nt, Human; identical to SEQ ID NO: 5179

SEQ ID NO: 6082 - RNA, 64 nt, Human; identical to SEQ ID NO: 5180

SEQ ID NO: 6083 - RNA, 64 nt, Human; identical to SEQ ID NO: 5181

SEQ ID NO: 6084 - RNA, 64 nt, Human; identical to SEQ ID NO: 5182

SEQ ID NO: 6085 - RNA, 64 nt, Human; identical to SEQ ID NO: 5183

SEQ ID NO: 6086 - RNA, 64 nt, Human
ucagggugggaaguaguacugcuagucauggucucaccccgagcugaccccucugccugggcuu

SEQ ID NO: 6087 - RNA, 64 nt, Human
uuuguuaccaagaacuguaugaaagaaguaaauccaccccgauucuguaugauuaauuccaucu

SEQ ID NO: 6088 - RNA, 64 nt, Human
ccccacacauaccaccuuggcuucuucuauaucccaccccgaugcucucccaggugggugugag

SEQ ID NO: 6089 - RNA, 57 nt, Human
cuauuaguacagacguguaaauccuuccaccccgacccgcacacacacccacacugc

SEQ ID NO: 6090 - RNA, 64 nt, Human
ggagggagccuggccccuugcccggucucgcagccaccccgagcguuccaccacacuguccgcc

SEQ ID NO: 6091 - RNA, 64 nt, Human
cugugugugagagcagugcuucugauccugcugucaccccgaccucuggcaggagccggcgcca

SEQ ID NO: 6092 - RNA, 63 nt, Human
ggaggagcccaaaccacugacccacagacucugcaccccgacgccagagauaccuggagcgac

SEQ ID NO: 6093 - RNA, 64 nt, Human
guccugagcaaggucugcagcccccagcucugcucaccccgaauccugccccuuguuuccacac

SEQ ID NO: 6094 - RNA, 64 nt, Human
ccagcccggucaggcucucagaugcagcugguugcaccccgaggggagaugccuucucccccac

SEQ ID NO: 6095 - RNA, 64 nt, Human
gagucgggggaagacgcggcaggccggccgagggcaccccgaggaacauggcauggccucugug

SEQ ID NO: 6096 - RNA, 64 nt, Human
gcagggaaccaaaccaaggucugagaaaugcggacaccccgagcgagcaccccaaagugcacaa

SEQ ID NO: 6097 - RNA, 64 nt, Human
ccacccccaaccauuugcacuacaagggcggaggcaccccgaagaaugaaaaguacacacccau

SEQ ID NO: 6098 - RNA, 64 nt, Human
gaauaaacacgcgagaacauccaccgcuuccuugcaccccgaaacccugcacaaagacacauac

SEQ ID NO: 6099 - RNA, 64 nt, Human
cagcaagugagaaaaugugcaaucaggugucucucaccccgaauuguccuuccuccuuccuccc

SEQ ID NO: 6100 - RNA, 64 nt, Human
uuuugccccaggcaaggucccuguaucucugagacaccccgauuggcuggagaauugacuuggg

SEQ ID NO: 6101 - RNA, 64 nt, Human
gcagcaguccucccccuaccccgccccgagaccccaccccgagaccccaccccggaccaguuac

SEQ ID NO: 6102 - RNA, 64 nt, Human
ccggaggggcgagaggguguacgucaacaucagucaccccgauaugguggacuucgcgagaggg

SEQ ID NO: 6103 - RNA, 64 nt, Human
cucagccugcucccugggaggcaggcuccagaagcaccccgacggggggccuuauuaagugcga

SEQ ID NO: 6104 - RNA, 64 nt, Human
guaucccugguggcuacccaauagacgccaguagcaccccgaauugacaacccaaacucuccag

SEQ ID NO: 6105 - RNA, 64 nt, Human
aacaauaacguacucaccgccgcggacaaucccccaccccgaucccucgccagaccaggacgcu

SEQ ID NO: 6106 - RNA, 64 nt, Human
cuguguagugucucuccccugcugcgggcgcccccaccccgauuccucuccccagaagcggugg

SEQ ID NO: 6107 - RNA, 64 nt, Human
ggggccucccccgugacagugacggcugcgccuccaccccgacugcucagugcaucuaaucacu

SEQ ID NO: 6108 - RNA, 64 nt, Human
cucuggcccagccgcugagcgcccgcacccgccgcaccccgaggccgccaauuguccgccccgc

SEQ ID NO: 6109 - RNA, 64 nt, Human
cggccccugccugggaaaaaccacacucacaccccaccccgaagagcuguggagaccaaaccaa

SEQ ID NO: 6110 - RNA, 64 nt, Human
acagacgagccccagacucugcccauccccaccccaccccgacgucccccggggcucccggucc

SEQ ID NO: 6111 - RNA, 64 nt, Human
gggcugacggagguggcggggcuagagguguagacaccccgagccccgugggcacucgcacugg

SEQ ID NO: 6112 - RNA, 64 nt, Human
uaccugccuugucccuguucugggggaagguguccaccccgaucaagaacauggagaaaguccu

SEQ ID NO: 6113 - RNA, 64 nt, Human
gccccuucaagcaauagggucccgaggggagacccaccccgagcccccuccccuccccuccagg

SEQ ID NO: 6114 - RNA, 64 nt, Human
caucaggcugucccagagagguccgcguucuccccaccccgacggaauuucucucccauuguug

SEQ ID NO: 6115 - RNA, 64 nt, Human
ccucuaccgucaccuagcugcugagcagaaaccgcaccccgagagaaaaucccauccucuguuc

SEQ ID NO: 6116 - RNA, 64 nt, Human
caggccucuuuguggacccaucuuccuccucugccaccccgaucuucacucggauaccucuuga

SEQ ID NO: 6117 - RNA, 64 nt, Human
cggggcaggaaggggccaagggggcuugcccacccaccccgaccccagcccccagccucagccc

SEQ ID NO: 6118 - RNA, 64 nt, Human
gguguaauggggcuggguucugucuucuacaggccaccccgagguccucagugguugccugggg

SEQ ID NO: 6119 - RNA, 64 nt, Human
uucacuucccaggcuccaugugucuuggagccgucaccccgaggcucccucuuuaggucggaga

SEQ ID NO: 6120 - RNA, 64 nt, Human
cgccggaaaagaugaagcuggcccuucccggagucaccccgaugauuacucuuuucagacacag

SEQ ID NO: 6121 - RNA, 64 nt, Human
cucaccacacaggguggugcccuggccccgaggucaccccgacuuuucuaaaucuuguuugagu

SEQ ID NO: 6122 - RNA, 64 nt, Human
cccagccaugugacacuggcucccgguagacgggcaccccgagauguaccaaccuuuucaugua

SEQ ID NO: 6123 - RNA, 64 nt, Human
caggagcugggagcucugcaccacgagcuucagucaccccgagaggagaggagguaacgaggag

SEQ ID NO: 6124 - RNA, 64 nt, Human
guacagaaaucaugcugccaugcugggggggggucaccccgaccccucaggcccaccugucacg

SEQ ID NO: 6125 - RNA, 64 nt, Human
acaauuaagugacccccgucaacccacugccucccaccccgaccccagcaucaaaaaaccaaug

SEQ ID NO: 6126 - RNA, 64 nt, Human
agauucccaagccaaaaaccuuagcucccucccgcaccccgauguggaccucuacuuuccaggc

SEQ ID NO: 6127 - RNA, 64 nt, Human
gucaguccuaccuuuuucuuucugagagccuccccaccccgagaucacauuucucacugccuuc

SEQ ID NO: 6128 - RNA, 64 nt, Human
uuucuaaguuguguuuauuccuggagugacaugccaccccgaauggcucacuuucacugaggau

SEQ ID NO: 6129 - RNA, 64 nt, Human
cuagaccugcuacccugguacuuccacccuaccccaccccgagaagggcagagacgcaugugac

SEQ ID NO: 6130 - RNA, 64 nt, Human
ugaggggugggagaaggugaaugauucauuauuccaccccgagguuugcuggggugaggggaag

SEQ ID NO: 6131 - RNA, 64 nt, Human
uaaacugcugccuggggcugugggaugaaucagucaccccgaaucuuggaaaaacccccuucca

SEQ ID NO: 6132 - RNA, 64 nt, Human
aaucuccauuguugaggagaggcugcucaaucgacaccccgaguucucaugacugggaagauag

SEQ ID NO: 6133 - RNA, 64 nt, Human
gcuugggaccucuuuaggccuuccccuuuuccuccaccccgaugcuccuuagugaugcucugag

SEQ ID NO: 6134 - RNA, 64 nt, Human
ggcacucccuaaaugaucucuccuuccccccccccaccccgagauacgggguuccaggaaaggg

SEQ ID NO: 6135 - RNA, 64 nt, Human
uuuauagcuugaccauaugcugucaugaaaguagcaccccgacggugcuugcuuuacuaaguca

SEQ ID NO: 6136 - RNA, 64 nt, Human
cugcccaggggcuucagaaaaggaguggccacagcaccccgaagggagcaucuguuuaccuggc

SEQ ID NO: 6137 - RNA, 64 nt, Human
ggauccuuuuaucacaaaucgggauucucucccccaccccgaauucugucugcuuaaacuggaa

SEQ ID NO: 6138 - RNA, 64 nt, Human
cccccggccccuauacauaguuuauguuccuggccaccccgaccgcuucccccaaguucugcug

SEQ ID NO: 6139 - RNA, 64 nt, Human
ggucuucagcacgccaagccccccaccaacccuccaccccgagugaaggcuucgcugaaauugc

SEQ ID NO: 6140 - RNA, 64 nt, Human
ggccgacguuccaccuggggcuucccuccccacccaccccgacuccaggcuuucccuuuuuucu

SEQ ID NO: 6141 - RNA, 64 nt, Human
gaaggaagugagcauccuuuugcucuguccuccccaccccgauagugacacaucuucaggcaga

SEQ ID NO: 6142 - RNA, 64 nt, Human
cucuggucuuccccacuggcaguggcagcagccccaccccgagcgcacacugugauggaggaga

SEQ ID NO: 6143 - RNA, 64 nt, Human
gacuccaaucuuccaguggccagcacacccuagacaccccgaggagggagggcuccuuucuagc

SEQ ID NO: 6144 - RNA, 64 nt, Human
ucugcagcuucugacaaggcuucuaaagagcaaccaccccgaggaccuucaggcugcaaaccgg

SEQ ID NO: 6145 - RNA, 64 nt, Human
gugugaggguccugcagccugcaggaccucgugccaccccgagggcugagccuggucccacgag

SEQ ID NO: 6146 - RNA, 64 nt, Human
gagacagguuagcugcuccccacgucagcugggacaccccgacuuuuguuuaccagagaaaaag

SEQ ID NO: 6147 - RNA, 64 nt, Human
gauuucuggaucacgggauaccacuuccuguccacaccccgaccaggggcuagaaaauuuguuu

SEQ ID NO: 6148 - RNA, 64 nt, Human
gcugcacaguccugccaaggggcuuccuccuugucaccccgaaccuuguaaucgugugcuggcg

SEQ ID NO: 6149 - RNA, 64 nt, Human
acuccgucgaggagcaaagugagccccuaccccccaccccgauccccgcucccaacacugccgg

SEQ ID NO: 6150 - RNA, 64 nt, Human
caaagacucgaacuuccagacagggacccagggacaccccgaagcccaccugcaaucucccacc

SEQ ID NO: 6151 - RNA, 64 nt, Human
uauggcuccagagcugcugcucgcuucgucagcacaccccgaauauugaagagggggccaaaaa

SEQ ID NO: 6152 - RNA, 64 nt, Human
ucugccucucugacaaccaucagccaccggaccccaccccgaggcaucaccacaaaucaugguc

SEQ ID NO: 6153 - RNA, 64 nt, Human
agaaugugcagcucuuucuccaggugggauguagcaccccgaaguagagcuuucugcucugcuc

SEQ ID NO: 6154 - RNA, 64 nt, Human
caucauucacagugcccuccccacagcacuaccucaccccgacccccacccucacuccuacccc

SEQ ID NO: 6155 - RNA, 64 nt, Human
cuuugcaccaucugguggucgcacgcccugagggcaccccgacucugucuccaggagucucauc

SEQ ID NO: 6156 - RNA, 64 nt, Human
guuuuggucagucauauacaauaaagaaucaucucaccccgaaaugcaaauugcaggcccauug

SEQ ID NO: 6157 - RNA, 64 nt, Human
gcgcaacauggcugccagccccgccucccacccccaccccgaguccugagcucacuuucgccuu

SEQ ID NO: 6158 - RNA, 64 nt, Human
ucccgggaugugcccugacaugguuaauuuauaacaccccgauuuccucuuggguccccucaag

SEQ ID NO: 6159 - RNA, 64 nt, Human
ccacccccacccacacagcugccgcagcaucucacaccccgagggccugaggagagggagcugu

SEQ ID NO: 6160 - RNA, 64 nt, Human
gcugccgcugucaccuacgguuuuuaaguuauuacaccccgacccuccuccugucagcccccuc

SEQ ID NO: 6161 - RNA, 64 nt, Human
cucugauuggaauuucuggccuccuaaggcuccccaccccgaaaucagcccccagccuuguuuc

SEQ ID NO: 6162 - RNA, 64 nt, Human
uuccaagcccaucccgacucccggggcccucagacaccccgauccucccacaauaaaggcuucu

SEQ ID NO: 6163 - RNA, 64 nt, Human
cgaggccaccgccccccccuccgcugccccugcccaccccgaggcagggcuggggcuuuucuuc

SEQ ID NO: 6164 - RNA, 64 nt, Human
cacgcaaugcuagcugccccuuucccguccugggcaccccgagucucccccgaccccggguccc

SEQ ID NO: 6165 - RNA, 64 nt, Human
cucccuagcucagggaugggccuuccagccggagcaccccgauccccauccggcaccccccaau

SEQ ID NO: 6166 - RNA, 64 nt, Human
uccaccccaaccucugcccugcccgccccaggggcaccccgacauccaggccacccccucaugg

SEQ ID NO: 6167 - RNA, 64 nt, Human
gaaccccucggccccgcccccguggacccggccccaccccgaauaccccggccacgcuccccgu

SEQ ID NO: 6168 - RNA, 64 nt, Human
cgaugggggucaccaggugaccagugggagcccccaccccgagucacaccagaaagcuaggucg

SEQ ID NO: 6169 - RNA, 64 nt, Human
ccucaacacccucucaacaccccccucccucaaccaccccgacaaccacuacagaaccaacauu

SEQ ID NO: 6170 - RNA, 64 nt, Human
ccuuccaaguccaucccgacuccuggagcccugacaccccgauccucccacaauaaaggcuucu

SEQ ID NO: 6171 - RNA, 64 nt, Human
uuccaaguccaucccgucucccggggcccuaggacaccccgauccucccacaauaaaggcuucu

SEQ ID NO: 6172 - RNA, 64 nt, Human
cccgagacacuguacacuguuccuuuucacccaccaccccgaucccuaggugaggagaagcggc

SEQ ID NO: 6173 - RNA, 64 nt, Human
cuccuucuuuucugugcaauacgagacccggccgcaccccgagucacacaggcccccggggcca

SEQ ID NO: 6174 - RNA, 64 nt, Human
ccuuggccagaguccacucccuuccuggcugugucaccccgagcagcucauccaccauggaggu

SEQ ID NO: 6175 - RNA, 64 nt, Human
ccccucccucgccccgacugccccgccccacccucaccccgacugccccgcccucgcccggcug

SEQ ID NO: 6176 - RNA, 64 nt, Human
ccccucccuccuuguuguccagugcugggcuccccaccccgaggucaggcugcccaauccucug

SEQ ID NO: 6177 - RNA, 64 nt, Human
cagagcuggggacauggcaugcccugcacucagucaccccgagggcugagccagauuccuggau

SEQ ID NO: 6178 - RNA, 64 nt, Human
gcucgugacgagcaagugcuggguccccgccaggcaccccgaggcggcgcucuggcuggcagcu

SEQ ID NO: 6179 - RNA, 64 nt, Human
gccccucacacuggcccagccccucacacugccccaccccgagaacccucagcucucaaagguc

SEQ ID NO: 6180 - RNA, 64 nt, Human
agcugugggagcaggcccagugggaggcuguggacaccccgaggacaguguccugucucgaggc

SEQ ID NO: 6181 - RNA, 64 nt, Human
acaacaggauaagcguccaggagccacgggcucccaccccgagcauaucacauggugccgaauu

SEQ ID NO: 6182 - RNA, 64 nt, Human
gccaggucccccugcagcuaguccuagugaaccucaccccgaggcccugcaugggccagccccu

SEQ ID NO: 6183 - RNA, 64 nt, Human
ggggguggcugggucugugaaaaacaguggacagcaccccgagggccacaggugagggacacua

SEQ ID NO: 6184 - RNA, 64 nt, Human
cauaggaauuauuucguuggcugaacguuaccagcaccccgagaacacauuuugauagaaucag

SEQ ID NO: 6185 - RNA, 64 nt, Human
gaguuacuguuaaaagguugguucguaaaguccacaccccgaugcucagaagugucuugccagc

SEQ ID NO: 6186 - RNA, 64 nt, Human
acguucacauuuacguagcugguugcuuacaaacgggccugagccccugguuggguggguggug

SEQ ID NO: 6187 - RNA, 64 nt, Human
ccaccucccacuuuccaagggcuccaggaaucuggggccugaccacagauuccucucccauccu

SEQ ID NO: 6188 - RNA, 64 nt, Human
gacaugcuguggguggauguucccggcgugugccgggccugaauggacaggggccacuucacag

SEQ ID NO: 6189 - RNA, 50 nt, Human
cccaggugaccggcgacugagggccugagcuggcaaggccaaggacaccc

SEQ ID NO: 6190 - RNA, 64 nt, Human
gucccuggccaccauggucaucaccacccuuccagggccugagcagcuggaucugguacaaagc

SEQ ID NO: 6191 - RNA, 64 nt, Human
ccaaggugaaggcccuccugcccuccauggugaagggccugaagaacauggaugggaugcuggu

SEQ ID NO: 6192 - RNA, 64 nt, Human
ccaaccagggcuggcaucacugcuuugcaaaguggggccugagguagaagaaggugucugguuu

SEQ ID NO: 6193 - RNA, 64 nt, Human
cagcuggaggguuuuuggaucccuguccccucuugggccugagguccucccucugaaaugcaga

SEQ ID NO: 6194 - RNA, 64 nt, Human
uggugggaagacgggcaacaaguauaccccaccagggccugagugacuagaggaagaggacgag

SEQ ID NO: 6195 - RNA, 64 nt, Human
aauuuagauauaagaggggggaaaaauggaaccagggccugacauuuuauaaacaaacaaaaug

SEQ ID NO: 6196 - RNA, 64 nt, Human
uugcuccagcagcagugggagaggcacugcucuggggccugaacugccucugcuucccccccug

SEQ ID NO: 6197 - RNA, 64 nt, Human
uuuggugaguguaagggauucugcaagggacagggggccugacuacccagucuuugacuuguau

SEQ ID NO: 6198 - RNA, 64 nt, Human
uuccugucugcacaauuagcuauucagagcaagagggccugauuuuauagaagccccuugaaaa

SEQ ID NO: 6199 - RNA, 64 nt, Human
gacuguccuaggugaccccaucucugcugcuucugggccugauggagaggagaacacuagacau

SEQ ID NO: 6200 - RNA, 64 nt, Human
augcccucagacccuucugggcucugcccgcugggggccugaagacauuccuggaggacacucc

SEQ ID NO: 6201 - RNA, 53 nt, Human
ugaaacuucuagcuccuuagcuggggccugacccauggccugcccuccucccg

SEQ ID NO: 6202 - RNA, 64 nt, Human
ugccauggauucaccccccucugcugccggcucugggccugaggguccaccuggagaguacauu

SEQ ID NO: 6203 - RNA, 64 nt, Human
ccaggucuccucccaccugccacacagcgcuccggggccugagggcucccucagcccugggaag

SEQ ID NO: 6204 - RNA, 64 nt, Human
uguuuccaccuugggaaaaucccuaggcuaagcugggccugacccagcauccucugccuucuag

SEQ ID NO: 6205 - RNA, 64 nt, Human
cagaugcuggccucuuggcaccugccuagcucuugggccugaccuccaguccugcuggccugcu

SEQ ID NO: 6206 - RNA, 64 nt, Human
auagugaggaccggggcugaggccacacagauaggggccugauggaggagaggauagaaguuga

SEQ ID NO: 6207 - RNA, 64 nt, Human
caacuuguggaucuguguguguguguguguguaugggccugaucacacacaaacacacacaccu

SEQ ID NO: 6208 - RNA, 64 nt, Human
cuagggcucccagcccuugacuguccuccugugagggccugaagcugggccagggcccgucgca

SEQ ID NO: 6209 - RNA, 64 nt, Human
ccagguaccauccccccuuagcauacagggggaagggccugagaggaauguaaggaaaccagcc

SEQ ID NO: 6210 - RNA, 64 nt, Human
uagggacagaacuugaaagagaagauggcgaaaagggccugagccagggcugggaaugugucca

SEQ ID NO: 6211 - RNA, 64 nt, Human
uuuaaaauuaaaaagugauuaucaaagaauaucagggccugacauccacaaaaaacaaacuuaa

SEQ ID NO: 6212 - RNA, 64 nt, Human
uucuuugccacuuuucccaccccaaaacagcauggggccugacaucuucugcccugguccccuu

SEQ ID NO: 6213 - RNA, 64 nt, Human
auuuuuuaagcacugccugccagagaugggccuggggccugaugaggaccuuagcgcugcucgu

SEQ ID NO: 6214 - RNA, 64 nt, Human
agcccagagcagggucucucuaaaggggacuugagggccugagcaggaaagacuggcccucuag

SEQ ID NO: 6215 - RNA, 64 nt, Human
cacaguuaagagaagacccuguaguauuugcugugggccugaccuaauguauucccuagggucu

SEQ ID NO: 6216 - RNA, 64 nt, Human
gaaccagccucaaaaacgcccucaagaacaugaugggccugaacucggacaagugaucgccacc

SEQ ID NO: 6217 - RNA, 64 nt, Human
acccuggggagcuacuggcaaacucuccuggauugggccugauuuuuuuggugggaaaggcugc

SEQ ID NO: 6218 - RNA, 64 nt, Human
uuaaauggcugguccaggucagccagcagguguagggccugacaagaacauauuguuucccuga

SEQ ID NO: 6219 - RNA, 64 nt, Human
ccacccagucauguaaaggcaggagaccugcucugggccugacucaaagcaaacacgugggugc

SEQ ID NO: 6220 - RNA, 64 nt, Human
gagccaucacuacucacaccgugguccugggccagggccugagaugacaguggggagcaccauc

SEQ ID NO: 6221 - RNA, 64 nt, Human
ccaccguccugucagcuccuugaccuaugagccggggccugacuaggaaaaguugggaguuaag

SEQ ID NO: 6222 - RNA, 64 nt, Human
ggcacugggaagcucaucagagaaaaugggugcugggccugaguacucccgucggaggggaugg

SEQ ID NO: 6223 - RNA, 64 nt, Human
agcagccgacagggggcagcaugacccaagcaaggggccugaggccucaguggggguagggcaa

SEQ ID NO: 6224 - RNA, 64 nt, Human
ugagcaaacuaaaugccuucaucuuagguagaaagggccugaaucuuccauuuuauauucaaac

SEQ ID NO: 6225 - RNA, 64 nt, Human
gcccccugugccagcucaggugacuggagcccgagggccugacagguucccagcagcugggccg

SEQ ID NO: 6226 - RNA, 64 nt, Human
cggccacugcugcugcucgucccugccagugucugggccugaaggggcucccuccaagcggugc

SEQ ID NO: 6227 - RNA, 64 nt, Human
ggcuagaaacagcacucugguuauaauugccccagggccugauucaggacugacucuccaccau

SEQ ID NO: 6228 - RNA, 64 nt, Human
aaacgaaucggagccauuuucauuuuccuaaccggggccugacaugcuuuaaauuaucuggcug

SEQ ID NO: 6229 - RNA, 64 nt, Human
uacaguucuggaggaggagguaacauagaugccugggccugaugguggggccauacccaugugu

SEQ ID NO: 6230 - RNA, 64 nt, Human
uccaagugacaguacagagcacagcagcgaccuugggccugaaagcagugggccucugagcugg

SEQ ID NO: 6231 - RNA, 64 nt, Human
aaccccuaacuggacaaaugaggucuguuucuuugggccugaggcugugccauauaaagucuua

SEQ ID NO: 6232 - RNA, 64 nt, Human
uagacccagucugagagccgcaagcacugaggcagggccugagacuggaccugggugagcgugg

SEQ ID NO: 6233 - RNA, 64 nt, Human
ccugucaacuggagugcucucucagcacugggaugggccugauagaagugcauucuccuccuau

SEQ ID NO: 6234 - RNA, 64 nt, Human
aucccuuuucucuggcacuccagucccaggccuugggccugaacuacuggaaaaggucuggcgg

SEQ ID NO: 6235 - RNA, 64 nt, Human
acugagccaugcucagaaugucugguccuggcuugggccugaguagggcagagagggccuuucc

SEQ ID NO: 6236 - RNA, 64 nt, Human
ggagcagccagagggccaagugaccaagaggauggggccugagcuggggaagggguggcaucga

SEQ ID NO: 6237 - RNA, 64 nt, Human
gugccuggccaguuuccuguuuguggggcagcuggggccugaggaggagggguucacuuccucc

SEQ ID NO: 6238 - RNA, 64 nt, Human
cagcugcaaggauggaaggcagaggguggguguggggccugaggcuucacaguaccuggaccag

SEQ ID NO: 6239 - RNA, 64 nt, Human
gugaagaggaaggccuguguagcagaaaggcuuugggccugagagguuaaggccacagccuguu

SEQ ID NO: 6240 - RNA, 64 nt, Human
uaagcacacaaugggcaaaugcagaauuauaguugggccugagaugucugaacgaugcuugggu

SEQ ID NO: 6241 - RNA, 64 nt, Human
agggugucugagcccucaaagugaggggaaaccagggccugagccaagcuagaauucccucucu

SEQ ID NO: 6242 - RNA, 64 nt, Human
cauagggccugggcacgugucucuagcaaaaccagggccugagcauaagaacugggacccuucu

SEQ ID NO: 6243 - RNA, 64 nt, Human
aagggguuggggugacagucaucaucagggccuggggccugagagaauuggcucaauaaagauu

SEQ ID NO: 6244 - RNA, 64 nt, Human
guugccuuuuugucuuuaagcaacaccuuagacagggccugaacccugggugggggcacuggau

SEQ ID NO: 6245 - RNA, 64 nt, Human
cauuuuaggguggcuguggcucuuccucagccaggggccugaagaagcuccugccugacuuagg

SEQ ID NO: 6246 - RNA, 64 nt, Human
caaacaaaacuaaaacaaaaauccagugucacaugggccugagauuuuauuuuagaaaaagguu

SEQ ID NO: 6247 - RNA, 64 nt, Human
uauucuuuucccccuguagacccauucuaaaugugggccugaggucaaugggagaugugcccuc

SEQ ID NO: 6248 - RNA, 64 nt, Human
acuaggaacaugcacuagaugacagauugcgggagggccugagagaagcagggacaggagggag

SEQ ID NO: 6249 - RNA, 64 nt, Human
cagcgcauacaggagcuggggaagggggccucuggggccugaccaggcgacagguaggggcgga

SEQ ID NO: 6250 - RNA, 64 nt, Human
gcuccucugauggcugacaucagucacugcgucugggccugagacgugcauggagggcuguaaa

SEQ ID NO: 6251 - RNA, 64 nt, Human
gagcacucaaggggguuuggucuucccaggaagagggccugagguucuccuagugcaggaacgu

SEQ ID NO: 6252 - RNA, 64 nt, Human
gccccaaugcaccgucccucagcucaggagggaugggccugaccugacgcucaggguugacauc

SEQ ID NO: 6253 - RNA, 64 nt, Human
guccauggagccuuucaaaaugggugcccuggaggggccugacaguggguuccuuccauggcgg

SEQ ID NO: 6254 - RNA, 64 nt, Human
cccuucuuuuucccuuugacuucuacagaaaucugggccugagacauugucuacaauuggguuc

SEQ ID NO: 6255 - RNA, 64 nt, Human
ggccaacacuauucgaggaggaggcuguuauuuugggccugaugugacacaacaguugcuacaa

SEQ ID NO: 6256 - RNA, 64 nt, Human
gauaacucagaaucuugauaaacacuuaauauuugggccugaagcauuaaacuuucuuuuuauu

SEQ ID NO: 6257 - RNA, 64 nt, Human
guuguuugcacucuuuggaguucuaguuagcucagggccugacuguauuuuucauccaucuuuu

SEQ ID NO: 6258 - RNA, 64 nt, Human
acuccugccaggaaguguuuauuugccucuaauugggccugagagaccauagggagguuggggc

SEQ ID NO: 6259 - RNA, 64 nt, Human
cuggcuaguuaccacuaggcuaccaggucucuaggggccugagagaggcccucuagagaaucca

SEQ ID NO: 6260 - RNA, 64 nt, Human
gagggggaaguccuagcccagauggaccaaggacgggccugaaggcacaugggggaaagggagc

SEQ ID NO: 6261 - RNA, 64 nt, Human
guccgagcuggaauccuagagcauugcugcccuggggccugauguucuuggcuuccucagagca

SEQ ID NO: 6262 - RNA, 64 nt, Human
caugcagcagugauggcgccaggcucugcagggugggccugaucccagaguggugcuuacugug

SEQ ID NO: 6263 - RNA, 64 nt, Human
gcccccgccccgcgccccgucccgccccaggcccgggccugacaagaaagcgccuuacguuucu

SEQ ID NO: 6264 - RNA, 64 nt, Human
ccucuugcucguuguucucaccaggaaaguacacgggccugaggcaggauugggccacagacag

SEQ ID NO: 6265 - RNA, 64 nt, Human
gcgcuccucggacggcuccggacgcugcugccgugggccugagaccaaggcccccgggccgacg

SEQ ID NO: 6266 - RNA, 64 nt, Human
gcccggcgcugccacgccggggccuccaccgccugggccugagccugaccgggccauucccaaa

SEQ ID NO: 6267 - RNA, 64 nt, Human
uagucagacgaaacuccagaacagugcuuguggagggccugacuguccugcucacccacagccg

SEQ ID NO: 6268 - RNA, 64 nt, Human
uaucacagauguaaauuaacucaccagauuuacugggccugaacucauucucuucuugcuauau

SEQ ID NO: 6269 - RNA, 64 nt, Human
ugaaaaaaauaaaaagaaaugagggcagguuccagggccugaaauguagguaugcugcaaggcu

SEQ ID NO: 6270 - RNA, 64 nt, Human
acauaccucagacgccucuggauccaagaaccaggggccugaggaucuguggacaagagcuggu

SEQ ID NO: 6271 - RNA, 64 nt, Human
cccgguuggaacugggacugagcucgggcacgcagggccugagaucuggccgcccauuccgcga

SEQ ID NO: 6272 - RNA, 64 nt, Human
ccuggcuggggacuuggccgcuucccuacccacagggccugacuuuuacagcuuuucucuuuuu

SEQ ID NO: 6273 - RNA, 64 nt, Human
aaccugucagcauugaaggaacucucaccuccgugggccugaaaugcuugggaguugauggaac

SEQ ID NO: 6274 - RNA, 64 nt, Human
caucucaaagaaggcauuugcaggguccucuucugggccugaccaaacagccaacuagccccug

SEQ ID NO: 6275 - RNA, 64 nt, Human
ucacaggagccaauggggucacggugccugaagagggccugacacuucacagaguggggaccca

SEQ ID NO: 6276 - RNA, 64 nt, Human
ugcugguuuuacuuuagucccuccaugucaaagugggccugagaaaagcucauacaugccucau

SEQ ID NO: 6277 - RNA, 64 nt, Human
ugacauccguuggaacuuugaaaaguuccugguggggccugauggaaucccugucaugcgcugg

SEQ ID NO: 6278 - RNA, 64 nt, Human
ugucucucacggcuuguaaaugugacaccccggggggccugauguguguggguuguugagggga

SEQ ID NO: 6279 - RNA, 64 nt, Human
gaacaccccagccucagacagacacagcaggaaggggccugagaggcugacagaggcaggaugg

SEQ ID NO: 6280 - RNA, 64 nt, Human
ucaugugggcacagaggguccugacacucuggcagggccugagcuggggcaggccucccucagg

SEQ ID NO: 6281 - RNA, 64 nt, Human
cuugcucugagauacagacuuguucauagguguggggccugauuggaacaggaucugccauugg

SEQ ID NO: 6282 - RNA, 64 nt, Human
cagcuccgagagugauauuugcucugguaggugagggccugaggguacauuucuccaccugugc

SEQ ID NO: 6283 - RNA, 64 nt, Human
acaacacccugguuuggagcugggaggaagaagggggccugagagagccccagguccauucuac

SEQ ID NO: 6284 - RNA, 64 nt, Human
aauguuugcacucugaggugcaacuuaacagggagggccugagaaaagaaugggagggggcuau

SEQ ID NO: 6285 - RNA, 64 nt, Human
accgugcaucaucuccucgcccaugcucagcgccgggccugaggaccuggagccgccgcucaaa

SEQ ID NO: 6286 - RNA, 64 nt, Human
cccggcagccacugcccaccuccccucuacccaggggccugaaaagaggggcugcccuccugcg

SEQ ID NO: 6287 - RNA, 64 nt, Human
cuuuuaauuguauagauauauauuucccccuauggggccugacugcacugauauauauuuuuuu

SEQ ID NO: 6288 - RNA, 64 nt, Human
gaccagcuucucaucaacuugggcccggcgugcugggccugaaagucacacuacaugcacugcc

SEQ ID NO: 6289 - RNA, 60 nt, Human
acuaccggauuucugccuagggccaccguagggccugacuccuucugccaguucccuccc

SEQ ID NO: 6290 - RNA, 64 nt, Human
cugcuguccccuacuugaggagggauugggaucugggccugaaauggggcuucuguguuguccc

SEQ ID NO: 6291 - RNA, 62 nt, Human
aguucgugcaccccaucugagugccuggcccagggccugaaacccgcccucaggggccucuc

SEQ ID NO: 6292 - RNA, 64 nt, Human
gggugcuguaaucauggaccguaggccaugugaugggccugaaguggaggcugcucagcacaga

SEQ ID NO: 6293 - RNA, 64 nt, Human
uggaaugcuccuuccaccccuaccucucagagaugggccugacaccucuuucucauucauucuc

SEQ ID NO: 6294 - RNA, 64 nt, Human
ucucuagccguuugcagaggccgccacccagcaggggccugaaaaggagcagccucguauuuuu

SEQ ID NO: 6295 - RNA, 59 nt, Human
cuccugugcagaagguuugaggguggaaagggccugaggggugaagugaaauaggaccc

SEQ ID NO: 6296 - RNA, 64 nt, Human
cguaaaaugcacugaagccuuagggaauauugaagggccugacauggggaaagggaaggcuaaa

SEQ ID NO: 6297 - RNA, 64 nt, Human
cacuaguaaauaaauguaaugaggauuuguaaaagggccugaaaugcgagguguuuugagguuc

SEQ ID NO: 6298 - RNA, 64 nt, Human
cugagccagccccgcccacugccagggacgccgagggccugaccaggggccccgaggccugagg

SEQ ID NO: 6299 - RNA, 64 nt, Human
cuuacugccugaccuuggaaucgucccuauaucagggccugagugaccuccuucugcaaagugg

SEQ ID NO: 6300 - RNA, 64 nt, Human
cacccaggcaggaagcccaggaggagugcgggcagggccugaccuggaggagugaugguugagg

SEQ ID NO: 6301 - RNA, 64 nt, Human
gcgaugugcacuccacccaagccaggcucccagggggccugauuucucucucacugucucuuuu

SEQ ID NO: 6302 - RNA, 64 nt, Human
gaaaacuuaacuggaucucucuugcauccuuaaagggccugagucucaacauggcugcugaucc

SEQ ID NO: 6303 - RNA, 64 nt, Human
gaaccuuucaucauuaaaaaaagggggaccauuggggccugagccaaggaacuuuccuucuacu

SEQ ID NO: 6304 - RNA, 64 nt, Human
accugugggaagggaagcggguucauggcuuugagggccugagaggcaaaugcaucccgccuug

SEQ ID NO: 6305 - RNA, 64 nt, Human
uuccacucugucugccaacaacugcuucaggaaugggccugagaucccaugcaggucccugaga

SEQ ID NO: 6306 - RNA, 64 nt, Human
ucucuggaaccucaaggcaggcagcccaggcccugggccugaucucuaaccccgucaugcugcu

SEQ ID NO: 6307 - RNA, 64 nt, Human
acccugguucuccaggccccucuguccagaggcagggccugaaccucgggcuccugccuggacc

SEQ ID NO: 6308 - RNA, 64 nt, Human
gcacgacuacacugaggcacccucagagaaggcagggccugauuuaucuagcuguccagccgcu

SEQ ID NO: 6309 - RNA, 64 nt, Human
gcugcaggaugguuuccccugggagaggccaggagggccugaucccaggagacaccagggccag

SEQ ID NO: 6310 - RNA, 64 nt, Human
agcugaguuaugauguaaucucucugcagcugccgggccugauuugguacuuuugagugugugu

SEQ ID NO: 6311 - RNA, 64 nt, Human
guacaugacauugaaucacaugaauggauuacuagggccugagggguguccguucuuuagaaaa

SEQ ID NO: 6312 - RNA, 64 nt, Human
accucuccuuccagauguccauggccuuuugagagggccugaaagcagaugccccagccugcag

SEQ ID NO: 6313 - RNA, 64 nt, Human
cugcaugggggcacucugcaggcccuggaacauugggccugaguggagaugggagacagaggca

SEQ ID NO: 6314 - RNA, 64 nt, Human
uuacaaagguuuaaaggaauugauuccucugaaagggccugaaaauaaaaagucuuuaacauac

SEQ ID NO: 6315 - RNA, 64 nt, Human
cauccuggguacaggccugggcucuccagggccugggccugauucaggugcagugggcacuccu

SEQ ID NO: 6316 - RNA, 64 nt, Human
agguccugugcucuggugugugggugauugggcagggccugagcuggacaggggagcuccuagu

SEQ ID NO: 6317 - RNA, 64 nt, Human
ccaucauucauggggggcugcuaccugacccuuggggccugagaaggccuugcggggguggggu

SEQ ID NO: 6318 - RNA, 64 nt, Human
ggcagaugguccuggugccccagacgggggccgagggccugagcccccccaucccuccucugcc

SEQ ID NO: 6319 - RNA, 64 nt, Human
guggcugauaugggugugggggaugcuaaccacagggccugagaagucuugcuuuaugggcuca

SEQ ID NO: 6320 - RNA, 64 nt, Human
agaggggcgggcagggagaggaagcucuagcuccgggccugaguuuccccgaggcugcgucgga

SEQ ID NO: 6321 - RNA, 64 nt, Human
cucaggaguguucaaggguggagggcagggaauggggccugagguauuaaggcuaagagguggg

SEQ ID NO: 6322 - RNA, 64 nt, Human
gccugcuugcuuccucccuuccccauuccuagcagggccugaggcccuccucuucucgcccuuc

SEQ ID NO: 6323 - RNA, 64 nt, Human
ugccccucccaggcuccuuuucacccugcccccugggccugaggcccccuguguccaagccucc

SEQ ID NO: 6324 - RNA, 53 nt, Human
gguguacaccccgggacugagccgggccugagccgggccuugucgcagcgcag

SEQ ID NO: 6325 - RNA, 64 nt, Human
uggucccccagaucugcgccugggggucaggacagggccugauuugagccuccucucugaagau

SEQ ID NO: 6326 - RNA, 64 nt, Human
gcaaugggggugucuucccucggggcaggagggugggccugaggcuuucaaggguuuucuuccc

SEQ ID NO: 6327 - RNA, 64 nt, Human
gaaaaaaccaccuguuuuccaaggggagagggcggggccugagggugggggcggggccucuuca

SEQ ID NO: 6328 - RNA, 64 nt, Human
gaucgugaagaccugcugagccagccuguucuccgggccugaaugucuggggugcuugugccuu

SEQ ID NO: 6329 - RNA, 64 nt, Human
caggcacaggaagugggcggugggggagggguaagggccugacaguggguggguggguauauuc

SEQ ID NO: 6330 - RNA, 64 nt, Human
ggacgcaggagaucaucugaucccagccaaggaggggccugaggcucucccuacucccucagcc

SEQ ID NO: 6331 - RNA, 64 nt, Human
cagcacccauguaaauaccuucuugcuuuucugugggccugaagguccgacugagaagacugcu

SEQ ID NO: 6332 - RNA, 64 nt, Human
agcauuaggggaagaagagagcagugggaucuuggggccugagaagccuuggaacgcuucuggc

SEQ ID NO: 6333 - RNA, 64 nt, Human
gccgugaccacaugauacguagccuacagucagugggccugaagcccaucaucccucagggcag

SEQ ID NO: 6334 - RNA, 64 nt, Human
gggugagggagacuggggccuggucugcuuucccgggccugaaagcuuccccgagguuugcagg

SEQ ID NO: 6335 - RNA, 64 nt, Human
gguguuccuguuucuccuggcccugggugggcuagggccugauucgggaagaugccuuugcagg

SEQ ID NO: 6336 - RNA, 64 nt, Human
gacgggguguccccugcagggggcuaaacugcaggggccugagauuagcugugaacauguggga

SEQ ID NO: 6337 - RNA, 64 nt, Human
ccagagagcuacaggucugcucccgacgggccucgggccugacccguccacacagggccguguc

SEQ ID NO: 6338 - RNA, 64 nt, Human
uuuuauaaaucagggcuguguucauacacagaaggggccugagauuucugcacuuuaaacaagc

SEQ ID NO: 6339 - RNA, 64 nt, Human
cgcagccuggcgccgcgggacugaagcucgagaagggccugaccuaaaggucagguccccucgu

SEQ ID NO: 6340 - RNA, 64 nt, Human
ccugagacccuacugaaguggcugguagaaaaaggggccugaguggaggauuaucaguaucacg

SEQ ID NO: 6341 - RNA, 64 nt, Human
gaccuccaacagguuguuucccaggcuggggugggggccugagcagacacagaggugcaggcac

SEQ ID NO: 6342 - RNA, 64 nt, Human
ucuggggagcccacuccaacugcacagaaguucugggccugacagguagauuccagcuggaagg

SEQ ID NO: 6343 - RNA, 64 nt, Human
cggagguccaaccuucgcagccaguggcucuggagggccugagugacagcggcaguccuguuug

SEQ ID NO: 6344 - RNA, 64 nt, Human
aggugacugucuggggagcgggucugcucccaaggggccugagcaguccuuggccugcuaaggu

SEQ ID NO: 6345 - RNA, 64 nt, Human
ugguuauacuuuuuuuuuuccuuuuuuauugauugggccugaauacaggcuuucuagagaucuu

SEQ ID NO: 6346 - RNA, 64 nt, Human
caccacagcaccuuugauaaccucucuccauccugggccugaugaccugcucuagacuguuaua

SEQ ID NO: 6347 - RNA, 64 nt, Human
accagcuuccucagcgagcagggcccagggcucugggccugaagcaagagccagcccggcuccc

SEQ ID NO: 6348 - RNA, 64 nt, Human
gggagggggacaagaauguauagggagaaaucuugggccugagucaauggauagguccuaggag

SEQ ID NO: 6349 - RNA, 64 nt, Human
cucguggcuacacauauuaugaauaaaugaggaagggccugaaagugacacacaggccugcaug

SEQ ID NO: 6350 - RNA, 64 nt, Human
acuaggugggcccuugaaggggagcccaacucgugggccugaugaaagcuuccugagugguguc

SEQ ID NO: 6351 - RNA, 64 nt, Human
acagccucgcccucagccggacugcaucccuccugggccugagccucgggacucaguggacacc

SEQ ID NO: 6352 - RNA, 64 nt, Human
gcugagcccaccccgcuggcucccagaucagggugggccugaggcaggcagccgaccugaggcc

SEQ ID NO: 6353 - RNA, 64 nt, Human
gccugggcagcugggugggccugggcagcugggugggccugagcuagggcagcagggccuggcu

SEQ ID NO: 6354 - RNA, 64 nt, Human
gagggguccugaggaggggauggggcugggggaugggccugagugagaggggaggccaagagug

SEQ ID NO: 6355 - RNA, 64 nt, Human
uaggugggagagagugcauaaagguucuggggcugggccugagccuaacucccuccacuaccgc

SEQ ID NO: 6356 - RNA, 64 nt, Human
ucacaaucccagauggguucuaaugcagcugcuggggccugaugcccugaguuguuugugauuc

SEQ ID NO: 6357 - RNA, 64 nt, Human
auuuuggggagacaaagggaaaugcagccauagagggccugaugacauccaauacagaguucug

SEQ ID NO: 6358 - RNA, 64 nt, Human
aauuaagugacuugguaugcuuuauuuaauuguagggccugagguuuuccauucucauuuuucu

SEQ ID NO: 6359 - RNA, 64 nt, Human
aagagaccucccucucaugaucacugguaccugggggccugaauucuggcccccggcuccccac

SEQ ID NO: 6360 - RNA, 64 nt, Human
ucuggggucacgagacugagucuacaggagcuuugggccugagggaaggcacaagagugcaaag

SEQ ID NO: 6361 - RNA, 64 nt, Human
accuggugaccccuuuucagcuucugcugggcuggggccugauggggagggucucggugguacc

SEQ ID NO: 6362 - RNA, 64 nt, Human
ccucuagagucucacugcuggggaggagaggacugggccugauggaaguuaacccggagcuaag

SEQ ID NO: 6363 - RNA, 64 nt, Human
ccuacaugauuuuugucauucauggguccucccugggccugacaacgggaguggugggugggug

SEQ ID NO: 6364 - RNA, 64 nt, Human
cccccacuuucaccaguuucugcggccuuccaccgggccugaaccacagcggaggagcuccgcu

SEQ ID NO: 6365 - RNA, 64 nt, Human
uucauucugaauaagauggcaguguucuccucuggggccugauccaccucuacaccagcccagg

SEQ ID NO: 6366 - RNA, 64 nt, Human
caaaguuagauuuugcuuucaagauuugcuuuucgggccugaugauuuuaaagcaaaaaucacc

SEQ ID NO: 6367 - RNA, 64 nt, Human
ugaccguucccaccaccaucugcauguccccacugggccugagucuagccugggagccaggaua

SEQ ID NO: 6368 - RNA, 64 nt, Human
gccuauuauagaggguugguuauguugggagauugggccugaauuucuccacagaaauaaguug

SEQ ID NO: 6369 - RNA, 64 nt, Human
gggacugccaagcaugaggaaauagaagauucaggggccugagcucuggaagcugcaagcaaaa

SEQ ID NO: 6370 - RNA, 64 nt, Human
ccccaaagcauaaccaguggccagaggagugggagggccugaggcaucacaucuugcagaucag

SEQ ID NO: 6371 - RNA, 64 nt, Human
ccugcccucacuggccaguggccacaggaaccccgggccugaguggaggcugagucugaaauaa

SEQ ID NO: 6372 - RNA, 64 nt, Human
cuugcccucuggcuugggcuccuuuuucuggcuggggccugacaccaguuuugcccacauugcu

SEQ ID NO: 6373 - RNA, 64 nt, Human
uggauccuugaggagcugacaacaaguuaucccagggccugagguucuccugcccaguccccuc

SEQ ID NO: 6374 - RNA, 64 nt, Human
ggaagggacaugccaggccaggccuggggccccggggccugacccacaccacgcagaccccggg

SEQ ID NO: 6375 - RNA, 64 nt, Human
ccgucuguacgugugucauugcgugaagcagugugggccugaagugugauuuggccugugaacu

SEQ ID NO: 6376 - RNA, 64 nt, Human
ucgacuuuccucuuaggaaccuggccugggccaggggccugacccucagcacuuucagccgccc

SEQ ID NO: 6377 - RNA, 64 nt, Human
ugagagagacacagcccuccuuucagaaggaaaggggccugaggugccagcuguguccuggguu

SEQ ID NO: 6378 - RNA, 64 nt, Human
gacaaagccuccaauccuggggguccacgagccugggccugacauucccagaacuaccgccagg

SEQ ID NO: 6379 - RNA, 64 nt, Human
cauguguauucagcagcccuauggccuuggcucugggccugaugggacagggguagagggaagg

SEQ ID NO: 6380 - RNA, 64 nt, Human
gcuuggcucaggccucugcgggguggaggccccugggccugaggcugccagcagcgggcaggag

SEQ ID NO: 6381 - RNA, 64 nt, Human
uugugggucuguguggcaggaagccggcagggaagggccugagugccagcccuggcagacugag

SEQ ID NO: 6382 - RNA, 64 nt, Human
ugcucccagaugcauuuguccagugccccaucaugggccugaaaggcagagaaacuuuuuccua

SEQ ID NO: 6383 - RNA, 64 nt, Human
ucuggauauggccaggguggguguguggcuaagugggccugaacagagggaaccuagggcccuu

SEQ ID NO: 6384 - RNA, 64 nt, Human
ccucaugccaccgccaacccccugccccaggagcgggccugagccacguccucuaggagcagcu

SEQ ID NO: 6385 - RNA, 64 nt, Human
aggugagauucaaaccuucauccuucugucuccagggccugaucuuuaccacugcaggggcugc

SEQ ID NO: 6386 - RNA, 64 nt, Human
ugcagagccacguggccgccacgcagugugcuuagggccugaggugugaaagcccagggcucca

SEQ ID NO: 6387 - RNA, 64 nt, Human
aucagggacccugaacccuuccccugggaggugagggccugaucaaggcaccuccucugcccac

SEQ ID NO: 6388 - RNA, 64 nt, Human
ucucugagacuguugcugaacuggcaacuuacuugggccugaaacuggagaaggggugacauuu

SEQ ID NO: 6389 - RNA, 64 nt, Human
cugagaagaccaagauaucaggaaugaggaauaggggccugaggagagaggggaaggguacaga

SEQ ID NO: 6390 - RNA, 55 nt, Human
aggaggagcagaucugcugaccucagggccugacagugugggacaggcucuucuu

SEQ ID NO: 6391 - RNA, 64 nt, Human
gccccgcaggccugccuucucagggacuucugcggggccugaggcaagccauggagugagaccc

SEQ ID NO: 6392 - RNA, 64 nt, Human
ccuugaggcugcccugcccacgugggauucacaggggccugaguagggcccggggaagcagagc

SEQ ID NO: 6393 - RNA, 64 nt, Human
gguuccuaaacaacucacuuugagacuguugaaagggccugaccuaaucaagugaacccuugca

SEQ ID NO: 6394 - RNA, 64 nt, Human
uacauuagcgcuaugauggggacaucacugaccugggccugacgcugucuuacgacgaggacgu

SEQ ID NO: 6395 - RNA, 64 nt, Human
cucuagccccagggcagccccggaggacaggcaagggccugagaccacugccgacucaaagcca

SEQ ID NO: 6396 - RNA, 64 nt, Human
uccucacuuucucuugucccagcuucuccccugggggccugagagacccucaccuuccuucugc

SEQ ID NO: 6397 - RNA, 64 nt, Human
agaaaaugggcauucuggaucuaaaccgccacaggggccugagagcugaagagcaccagguuug

SEQ ID NO: 6398 - RNA, 64 nt, Human
ugaggucucuguugaacuggucuaaugaguucaagggccugaggcagauccagaggacaagccu

SEQ ID NO: 6399 - RNA, 64 nt, Human
ugugaagcccagcucuguuccauccaggugccucgggccugaggagucugaggaucugacuugg

SEQ ID NO: 6400 - RNA, 64 nt, Human
ucugugugucccucucccccaguuaugaggcccagggccugagcucucuuccccagcauugccc

SEQ ID NO: 6401 - RNA, 50 nt, Human
ccuaccugcgugaggauugagggccugagcacacugcccugucuccccac

SEQ ID NO: 6402 - RNA, 64 nt, Human
ccacacagugcucccugcccugccucacguccucgggccugacggguccggcuugucauggaag

SEQ ID NO: 6403 - RNA, 64 nt, Human
acauaaagcaaauaagcaggauggggaacagcuugaccuucauccaccccuaacuccaaaacua

SEQ ID NO: 6404 - RNA, 64 nt, Human
ugaggacaccgugagccagccaggccuggccgcugggccugaccggccccccagccccuacacc

SEQ ID NO: 6405 - RNA, 61 nt, Human
accaguuggaagcauacugaagugucuuggugggccugagccaagcacagguguuugagga

SEQ ID NO: 6406 - RNA, 64 nt, Human
gaaacugcagacucugcuccaaguaaucugggcugggccugagauucugcauuucuaaggaguc

SEQ ID NO: 6407 - RNA, 64 nt, Human
guagauaaauaacugugagcucgcacaaccgaaagggccugaccccuuacuuagcucccuccuu

SEQ ID NO: 6408 - RNA, 64 nt, Human
cuugcaggugcaggagcuccagucucuaggcuuugggccugaggaggggucucuccaggcauug

SEQ ID NO: 6409 - RNA, 61 nt, Human
uuuucugugccauccuuuaagucuuugagaggggccugaagagccuccgggcuccugggac

SEQ ID NO: 6410 - RNA, 64 nt, Human
caucacuuguaggugauuaaaaagauugacagccgggccugaugucucaagccuguaauccuag

SEQ ID NO: 6411 - RNA, 64 nt, Human
cggcuccaaccaacagccaccuuccagggauggggggccugaagccucgaugcuugucuccuga

SEQ ID NO: 6412 - RNA, 64 nt, Human
ggcaugugcucccccuaaggcucugcuccucccugggccugaaaguuccuucucagccugagag

SEQ ID NO: 6413 - RNA, 64 nt, Human
ccccuuggacugugugcagcacgaugcaauuucugggccugaaugucaugcucccuggggcagg

SEQ ID NO: 6414 - RNA, 64 nt, Human
acccauaaccuggaauucccuguuuccuuguccagggccugaggaaauggcuccccaggucugu

SEQ ID NO: 6415 - RNA, 64 nt, Human
ggacucacuuguggccuuugauuaaauuccuaaggggccugaagaagacauuucuacugcagag

SEQ ID NO: 6416 - RNA, 64 nt, Human
ccucuaacagcaggcaugagacuaaccuuccucugggccugaccaucucugggacagaggcaag

SEQ ID NO: 6417 - RNA, 64 nt, Human
ggauugcagugcauacuaacucuacaguggaacugggccugaaaaaucuggcuuuauucuaaac

SEQ ID NO: 6418 - RNA, 64 nt, Human
aaggaaaaacaaguauuaaaggcacaugaaaccagggccugaaauuuugugucugaugcugcuc

SEQ ID NO: 6419 - RNA, 64 nt, Human
uucugggguggaaggcagggaggugcaacuggcagggccugaucagaggcagaaaaugaccccc

SEQ ID NO: 6420 - RNA, 64 nt, Human
caggucuuggcagcaccugucuccuuucaccccagggccugagccuggccagccuacaaugggg

SEQ ID NO: 6421 - RNA, 64 nt, Human
cccguggcuguugacgcaccugugguuguuaguggggccugaggucaucggcguggcccaaggc

SEQ ID NO: 6422 - RNA, 64 nt, Human
cccaggggaugaaaaugcaaggaugagucugcuugggccugagaguuugaucugcaggggcagg

SEQ ID NO: 6423 - RNA, 64 nt, Human
agaacauggcugguagaggcucuagcugugugcggggccugaaggggaguggguucucgcccaa

SEQ ID NO: 6424 - RNA, 64 nt, Human
ugacugagcacucaguacauuuuuguuuaauguugggccugagguuaacugugaccauggucca

SEQ ID NO: 6425 - RNA, 64 nt, Human
guagacuaggcuuccccaggcaugccguccgugggggccugaagagacagugagugccauuggc

SEQ ID NO: 6426 - RNA, 64 nt, Human
ccaaaaaaccauggaugagaaagaaaggagucaggggccugauaaaaaauacagacuuaaugag

SEQ ID NO: 6427 - RNA, 64 nt, Human
acuauugaaggaggagaaugggagagccuccccugggccugaaaacuuggagcaauuaauuuuu

SEQ ID NO: 6428 - RNA, 64 nt, Human
cuuucccuucuucaguaggaaaggcacauuuguagggccugaaacucucccguauuugcugacu

SEQ ID NO: 6429 - RNA, 64 nt, Human
aguuuauggcaagaagugcaaauuuuagcauauggggccugacuucucuaccacauaauucuac

SEQ ID NO: 6430 - RNA, 64 nt, Human
ccauggucaaggguguccugccugccuggguccagggccugagggagccacauggaucccgaga

SEQ ID NO: 6431 - RNA, 64 nt, Human
cuuacgagacccaccuggagacuugccgcuucgagggccugaaggaguuucugcagcagacgga

SEQ ID NO: 6432 - RNA, 64 nt, Human
guccgcugcgccgacggugcggggcgcuggggcagggccugagggcggaccggugguggggagc

SEQ ID NO: 6433 - RNA, 64 nt, Human
gcccucagaccugccacagggcagagcaggucuggggccugaggcagggagaaugagaggccac

SEQ ID NO: 6434 - RNA, 64 nt, Human
gggucugaguucuguggacccacuugugggcugugggccugaagcaguuccacaaugagcgccu

SEQ ID NO: 6435 - RNA, 64 nt, Human
acugagacugaccuccucuggugacacuggccuagggccugacacucuccuaagagguucucuc

SEQ ID NO: 6436 - RNA, 64 nt, Human
uguaccagguacuccaggccagcccaugggcccggggccugaccccaacaccugcaugcugggu

SEQ ID NO: 6437 - RNA, 64 nt, Human
cucagaaaugaccagccaauggccuuuuguuugggggccugaggucaagagagcugagaguauu

SEQ ID NO: 6438 - RNA, 64 nt, Human
auuuucagccaugagcagacggccuguggucccugggccugaggcacggacucguagcaccagg

SEQ ID NO: 6439 - RNA, 64 nt, Human
ggggccugcccagugcacuugcuggaagacgcaagggccugaugggguggaaggcauggcggcc

SEQ ID NO: 6440 - RNA, 64 nt, Human
gucuccuuuccuggaaagcacauguaaaaguuaagggccugaaucucuucuaaaccaauaauug

SEQ ID NO: 6441 - RNA, 64 nt, Human
uuccaucuuccugacauguugccugggaugugacgggccugacaucuccccagggccggggccc

SEQ ID NO: 6442 - RNA, 64 nt, Human
ccgggcccggggucugucgggagggaagagaacugggccugaccuaccugaacugacuggcccu

SEQ ID NO: 6443 - RNA, 64 nt, Human
aagugcugggauugcaggcauaagcuaccaugcugggccugaacauaauuucaagaggaggauu

SEQ ID NO: 6444 - RNA, 64 nt, Human
ggaucucaacgggaaagcagccagagggguuguggggccugaaccccggccucccacccugggg

SEQ ID NO: 6445 - RNA, 64 nt, Human
gagccugguccuucccugauggccuuuggacccagggccugacuugagccacuccuuccuucag

SEQ ID NO: 6446 - RNA, 64 nt, Human
cggccacugccugugugacggaugugaccccgcugggccugaagcugggcccucacuggccugu

SEQ ID NO: 6447 - RNA, 64 nt, Human
gcacgccagccccgacucagcuccucgcggggcugggccugagcucgacaaguugcaucaagug

SEQ ID NO: 6448 - RNA, 64 nt, Human
acccgcgcagaaggggagccggggccgagccuccgggccugaauacgggccagccgccgaggcc

SEQ ID NO: 6449 - RNA, 64 nt, Human
gacaguuucuguaccacaccagggccuugcuucagggccugaagacauucauuuucccucaugu

SEQ ID NO: 6450 - RNA, 64 nt, Human
cugagaugcugcuguguugguugaggaaaaccucgggccugagggccaggccggagcccagguc

SEQ ID NO: 6451 - RNA, 64 nt, Human
ccucuguggaggucagggaggugggaaggugggugggccugaacucaggcagcccuucaguggc

SEQ ID NO: 6452 - RNA, 64 nt, Human
agcuacagucuucauuuuagugcuuuacacauucgggccugaaaacaaauaugaccuuuuuuac

SEQ ID NO: 6453 - RNA, 64 nt, Human
ccagugacugucgcacuugaguuugagggccagugggccugaugaacgcucagaccccuccagc

SEQ ID NO: 6454 - RNA, 64 nt, Human
gcgcuggccucuuccucccucccugcaggguagggggccugaguugaggggcuucccucugcuc

SEQ ID NO: 6455 - RNA, 64 nt, Human
gguggggggagccuggaacagugaccagaucugggggccugaguggggacagaguugaucgucc

SEQ ID NO: 6456 - RNA, 64 nt, Human
ccagaggcuuugcaggacaguguucucaggagcugggccugaggcuuaggagagcugccuucgc

SEQ ID NO: 6457 - RNA, 64 nt, Human
cuuccaccuggugcuuccuguucccaaaucacaagggccugaagguggucccugcuuucucuuu

SEQ ID NO: 6458 - RNA, 64 nt, Human
uccuguuaccugucuugcuccuggggagaaagaggggccugaugagacuccacucaggugcaca

SEQ ID NO: 6459 - RNA, 64 nt, Human
caggggacagguuggggcugugggcuuggacccagggccugagaccuuugugggauuugugcaa

SEQ ID NO: 6460 - RNA, 64 nt, Human
aagugccugugugcagccuccugugccucacccagggccugaccccagaguggucccaacaacc

SEQ ID NO: 6461 - RNA, 64 nt, Human
aaauugggggaaaagcuaaaaugacucaaaauaggggccugaaaaugcuuuaaggaccuuguca

SEQ ID NO: 6462 - RNA, 64 nt, Human
cccugccaaaguugcauuaucuuuggccaaggcugggccugacgguuaugauuucagcccuggg

SEQ ID NO: 6463 - RNA, 64 nt, Human
ccagagcugugaccuggcucugguucaacaaaaggggccugaaaacaucauuugcauggcugga

SEQ ID NO: 6464 - RNA, 64 nt, Human
cugcuccugcuuuucuguccugggcauggguccagggccugacacccccuccccgccccugugg

SEQ ID NO: 6465 - RNA, 64 nt, Human
ugggacaaggucccuuggugcugauggccugaaggggccugagcugugggcagaugcaguuuuc

SEQ ID NO: 6466 - RNA, 64 nt, Human
ccaccaaucuguuuacauauuuauuauccuaugggggccugagcaggauugagggagccagggg

SEQ ID NO: 6467 - RNA, 64 nt, Human
gggagauggguagcaucauuuugauuaacauuuggggccugauaggggaaauggugaagcaaug

SEQ ID NO: 6468 - RNA, 64 nt, Human
acagauugaagaaucugccccuguugaggugggugggccugacuguugccccccaggguccuaa

SEQ ID NO: 6469 - RNA, 64 nt, Human
cuggagcccaccacagcucuucucccuguucucugggccugagccuggggccacccccaagugc

SEQ ID NO: 6470 - RNA, 64 nt, Human
accucacguguggagccaggccuggccagggcaggggccugaaacccacuccuccaucucaugg

SEQ ID NO: 6471 - RNA, 64 nt, Human
uccaccuguaucuacacucugagggcccuggacugggccugagcuugccacagaggcuccgucu

SEQ ID NO: 6472 - RNA, 57 nt, Human
ucgacagcguccuggccuagggugccggggccugaaggucagggucacccaagcaac

SEQ ID NO: 6473 - RNA, 64 nt, Human
ggguuuggugcaguuuccagggugcaguacagcagggccugaauacuggcccuggacucccuuu

SEQ ID NO: 6474 - RNA, 64 nt, Human
uauuuggugccagaugaggugaaagcuuauagaagggccugaggggcucggcugccucaucccc

SEQ ID NO: 6475 - RNA, 64 nt, Human
gaacagaccaccagacgccagggcugauuggugggggccugagaccccgguugcccauucaugg

SEQ ID NO: 6476 - RNA, 64 nt, Human
cagcaggcagggagggaggcaaggcaggggaguggggccugagcugagcacugcccccucaccc

SEQ ID NO: 6477 - RNA, 64 nt, Human
aaugggggaggcacagcucauagccacacacccagggccugacugaggcccacgcaggaaccga

SEQ ID NO: 6478 - RNA, 64 nt, Human
ucuggaccaggcagagggcggaccgggugggcaggggccugaggguggcucgggccagcccacc

SEQ ID NO: 6479 - RNA, 64 nt, Human
ucugcuacauucaaccucgugacuucaugauccugggccugagaacacaggaaugauucauagc

SEQ ID NO: 6480 - RNA, 64 nt, Human
ggguagggaaggaggaccccgggcaccccccucagggccugacucacguacuguaguuugcacu

SEQ ID NO: 6481 - RNA, 64 nt, Human
caccugugagccccaugcuggcugugcacugcgcgggccugagacugcuggauacaauguuggg

SEQ ID NO: 6482 - RNA, 64 nt, Human
ucuggcuggggucuuggcacugucuuccuggccggggccugaaaccuuagcccccagccggccu

SEQ ID NO: 6483 - RNA, 64 nt, Human
aaagcacaaugcccuggucacuuggcaagcggcugggccugacggaggccgaggggcagaccgg

SEQ ID NO: 6484 - RNA, 64 nt, Human
ccacgccccucaaggcaaggcuccuccccuuagggggccugaucccgccccuugaggcuuaggu

SEQ ID NO: 6485 - RNA, 64 nt, Human
ccucccugcacuggcucccucgcccccagccccggggccugagccguccccuguaagaugcggg

SEQ ID NO: 6486 - RNA, 64 nt, Human
gugugcugcagggcugcugggaggagaguggugggggccugagggcugagugauucuguaacca

SEQ ID NO: 6487 - RNA, 64 nt, Human
gaggggagugaggcaggugacagugagguccugggggccugaccucccccuccuucccagcugc

SEQ ID NO: 6488 - RNA, 64 nt, Human
gguggugucaacacaacaucacacacaggugggggggccugauagcccagcacccaugauacag

SEQ ID NO: 6489 - RNA, 64 nt, Human
acccacacagcugccgcagcaucucacaccccgagggccugaggagagggagcugugggccacg

SEQ ID NO: 6490 - RNA, 64 nt, Human
ggguauggcuggagcucacaccacgaagcucuuggggccugauccuucuggugacacuucacuu

SEQ ID NO: 6491 - RNA, 64 nt, Human
acuuuaagaaauaggaucugugguguauuccagggggccugauggacaccuuucccgggcgucu

SEQ ID NO: 6492 - RNA, 64 nt, Human
cgcgcccccugaugaugggccuccaggggagcucgggccugacggcccugacgguccagaggaa

SEQ ID NO: 6493 - RNA, 64 nt, Human
ggccagguuuagagcagggaguuuggcuggugcugggccugagccagggggccgggacacccuu

SEQ ID NO: 6494 - RNA, 64 nt, Human
gcuuccagcaugcuggagggaacagaaaaggcaugggccugaauucaggcugcagagccugacu

SEQ ID NO: 6495 - RNA, 64 nt, Human
cgcacagcugagccgccucugaccccugcuggcugggccugaccuucccgagcccgugggggug

SEQ ID NO: 6496 - RNA, 64 nt, Human
cgccccuguggcuggacugugaccaucccugauggggccugaccgcgggagcugaggaagcgcc

SEQ ID NO: 6497 - RNA, 64 nt, Human
agacaccccugccccccuccagagagugaggagggggccugagacuggaccugggucugccuga

SEQ ID NO: 6498 - RNA, 64 nt, Human
gaccguagccacguccugccucgcgccgccccucgggccugaccuggaagcuccgucagcuccg

SEQ ID NO: 6499 - RNA, 64 nt, Human
ugaauguggcuucaggggcuccuguccugggccagggccugaugggcaccacgugaggggcacu

SEQ ID NO: 6500 - RNA, 64 nt, Human
ggcccuacaguccccucaggggacucuaaccugggggccugaggugccaggguucacagacagg

SEQ ID NO: 6501 - RNA, 64 nt, Human
uggcgugagggaagcuggugcacauggguguccagggccugaugggguguggccaggcaaugaa

SEQ ID NO: 6502 - RNA, 64 nt, Human
cuucccugucuuccccaccuucccccaacuacccgggccugacccggccccuaccagccacggg

SEQ ID NO: 6503 - RNA, 64 nt, Human
cuccuacuagggcuacccuacugcaccccaucaggggccugauggcugccccuuccccagacag

SEQ ID NO: 6504 - RNA, 64 nt, Human
agccaccgugaagaggaagcggaagagccggugggggccugaagaggauaagguagagcuccca

SEQ ID NO: 6505 - RNA, 64 nt, Human
uccuuccccaggaauuaagaccaagaagccuggggggccugagagacuugaacaagugucaaua

SEQ ID NO: 6506 - RNA, 64 nt, Human
cugaccccuccuuccucccucccugugcuuggcugggccugacccuuccugucccagggcccag

SEQ ID NO: 6507 - RNA, 64 nt, Human
ggugaugacguaggacaugugcuugguacaaaaagggccugagacauuccaccuagcuugacug

SEQ ID NO: 6508 - RNA, 64 nt, Human
augccuaccucccuagggcccugcugggacaugggggccugagugcccauccaagggcucucaa

SEQ ID NO: 6509 - RNA, 64 nt, Human
ccuuaaugggaggagcacucggaaggguugguuugggccugaaacucucccaaguggcauagcc

SEQ ID NO: 6510 - RNA, 64 nt, Human
agagaagccaccuguggaggacugggcugugguugggccugaggccuguggaggaggugagugu

SEQ ID NO: 6511 - RNA, 64 nt, Human
acccuuuaacccccacccuuccagucgggugugagggccugaccgggcccagggcaagcagaug

SEQ ID NO: 6512 - RNA, 64 nt, Human
gcuggaagcccagccccuacugcugugaacccuggggccugacugcucagaacuugcugcuguc

SEQ ID NO: 6513 - RNA, 64 nt, Human
gggcccagauucugggaggugcuggggacucagagggccugaccccucaccuccccuucccucu

SEQ ID NO: 6514 - RNA, 64 nt, Human
ugaauuuucucugggcuuuggugcgccuccagcugggccugacccuccauguccugcccucaaa

SEQ ID NO: 6515 - RNA, 64 nt, Human
auauagcagacaagcacccauggaggcagguuucgggccugaagcagaucagagggcuuugcaa

SEQ ID NO: 6516 - RNA, 64 nt, Human
agcagcggccucuagcuccgucucccggggaccugggccugagggagggcuggagucgcacgcg

SEQ ID NO: 6517 - RNA, 64 nt, Human
ccucugaacaccacagccagguccugccuucugggggccugaauauuccagagcugaugugaug

SEQ ID NO: 6518 - RNA, 64 nt, Human
gagaggcgcgucugccccacccucaaacccuguggggccugauggugcucacgacucuuccugc

SEQ ID NO: 6519 - RNA, 53 nt, Human
aaagaauaagccagauguaaucagggccugagugcuuuaccuuuaaaaucauu

SEQ ID NO: 6520 - RNA, 64 nt, Human
gcuucauuuacaagccucaagauggcucuguguagggccugagcuugcugcccaacgggaggau

SEQ ID NO: 6521 - RNA, 64 nt, Human
gugugccguccccuggggcaagggauguaggcuggggccugacuguaaagcccccgucucccug

SEQ ID NO: 6522 - RNA, 64 nt, Human
acaccugcugcacgccgcguuagugugcggcuccgggccugagcauucgcaaagcucgcuucuc

SEQ ID NO: 6523 - RNA, 64 nt, Human
gaccccccaacccucaaaccuugccuccgaggcugggccugagcugggugccccgucgcccucc

SEQ ID NO: 6524 - RNA, 64 nt, Human
gcucugugcggacuggggccaugaucgggcccgggggccugagccugggaccccaccccguguu

SEQ ID NO: 6525 - RNA, 64 nt, Human
ugucagcaaaucagugucuggacagccagcugcagggccugagcauggcuggcaggggcagcug

SEQ ID NO: 6526 - RNA, 64 nt, Human
uuagaacucgcucucuuugagugacuggcuacaagggccugagagguggccagccaggguugga

SEQ ID NO: 6527 - RNA, 64 nt, Human
cauaagagaaugaauggaaaguuuauuuacuccagggccugacacggggugugugcuacagucu

SEQ ID NO: 6528 - RNA, 64 nt, Human
ggaucauugaucuguuugaggaagugucugaccugggccugagagcuggagaaggugcagauuc

SEQ ID NO: 6529 - RNA, 64 nt, Human
ugcgugcaaggcagaccuggugcugcaaaggaaagggccugaggccucagggagccccguggag

SEQ ID NO: 6530 - RNA, 64 nt, Human
gauccaugucauuaacgaccaucccagggugugagggccugauuaaagcuuaucgaacuagaca

SEQ ID NO: 6531 - RNA, 64 nt, Human
aacuguaguccagcugaggaaggaggcagagcuggggccugaaggcucugagcagccuccagcc

SEQ ID NO: 6532 - RNA, 64 nt, Human
uuuccuggcuguccccagcaaguguaggaguggugggccugaacugggccauugaucagacuaa

SEQ ID NO: 6533 - RNA, 64 nt, Human
aaauccuuuauuuuuguaccauggggugggccccgggccugagaaggaagaagcacccucuccc

SEQ ID NO: 6534 - RNA, 64 nt, Human
ucccaccugccuguauaccccagacuugccucuggggccugauuaaauaaggcuguuuugauaa

SEQ ID NO: 6535 - RNA, 64 nt, Human
uaugacugaguggccuguacugucagacgugaaugggccugacgggcaaauccaucccucucuc

SEQ ID NO: 6536 - RNA, 64 nt, Human
ggggugggacugugcaggccagagaagguggcaugggccugaacccaccuggacugacuucugc

SEQ ID NO: 6537 - RNA, 64 nt, Human
uggcaggugacccaaaggcccaaagagggccguggggccugaggaggucauaaucucuucugag

SEQ ID NO: 6538 - RNA, 64 nt, Human
aggcauaggagaagggucgggccagcccagcccagggccugaguuagacuauuucccacauguu

SEQ ID NO: 6539 - RNA, 64 nt, Human
uugauucucucccugggucugcguucccuccccugggccugacugagccugcucauuguuuuuc

SEQ ID NO: 6540 - RNA, 64 nt, Human
gagggcccgaggaccacgcagcagagucccccacgggccugagccugagagcucagaggauucc

SEQ ID NO: 6541 - RNA, 64 nt, Human
gguaauaaagcacuucagggcuugcuccccaagugggccugauuuagcaggugguccugcgggc

SEQ ID NO: 6542 - RNA, 64 nt, Human
uuuaguagauccugagguugaccagcagcccauggggccugaagggaaaugaggcagcugcugu

SEQ ID NO: 6543 - RNA, 64 nt, Human
ucucagccuugguuccugaugggaacagaauggagggccugagaacauacuuucuaaaugccuu

SEQ ID NO: 6544 - RNA, 64 nt, Human
guuuggcaccaagcucuguccaaucagguaggcugggccugaacuagccaaucagaucaacucu

SEQ ID NO: 6545 - RNA, 64 nt, Human
gagcugaacuccaggggugugaccugggacgggugggccugaggugcccagcucagggcagcca

SEQ ID NO: 6546 - RNA, 64 nt, Human
cgguccuggacucccgcaggacuccucugaggcagggccugaagucuguacacgugguccagau

SEQ ID NO: 6547 - RNA, 64 nt, Human
acauuauaugauuuccacgcaggucacaccaucugggccugagguagcagugggucacuuugau

SEQ ID NO: 6548 - RNA, 64 nt, Human
cauguuuuaaaaagaaccgaagaagccacaggcagggccugagggagccccuggcuuuccccuc

SEQ ID NO: 6549 - RNA, 64 nt, Human
ccagagggagcucugaagacaacuagagaauucugggccugaaauuucaaucuaguuagaaaga

SEQ ID NO: 6550 - RNA, 64 nt, Human
acugcgcacugaccgggcccaccccuacuaugcggggccugaggauggcccacaucuacgggcg

SEQ ID NO: 6551 - RNA, 64 nt, Human
agcccuuagaagucugaggccagacugacugagggggccugaagcuacaugcaccucccccacu

SEQ ID NO: 6552 - RNA, 64 nt, Human
cagcucccugaaucugaccacagacacuccuggggggccugaaagcaacagcuggacacccccu

SEQ ID NO: 6553 - RNA, 64 nt, Human
gagcaggugcccccaggugagacagcggucccaggggccugaaaaggaaggaccaggcuggggc

SEQ ID NO: 6554 - RNA, 64 nt, Human
gaagucaagcccagccacguggagccuagagugagggccugaggucuggcugcuugcccccaug

SEQ ID NO: 6555 - RNA, 64 nt, Human
gagcaccuggagggcuggacucaggcuugugccagggccugacuugggccugggggcccuagaa

SEQ ID NO: 6556 - RNA, 64 nt, Human
ucagggcacugauggggucuaccugguaagcggagggccugaggaaaccuguagcuucaaucau

SEQ ID NO: 6557 - RNA, 64 nt, Human
agaacauuucugagccaaaguaaucuuccuucuggggccugaguuccccaaacuaccccacagc

SEQ ID NO: 6558 - RNA, 64 nt, Human
ucuggacucuguuccuauaccacaacagcagcaggggccugaaaugugauguccacaagagcua

SEQ ID NO: 6559 - RNA, 64 nt, Human
gagcuggaguucaaugaguccuagacagugagaggggccugagcuucagcucaauggaagccug

SEQ ID NO: 6560 - RNA, 64 nt, Human
uagcccaagcuccaggucaggaggggagggugcugggccugacauggcuauauacccucccagg

SEQ ID NO: 6561 - RNA, 64 nt, Human
cccagaauggcgaccucucuuuagcucaauuucugggccugaggugcucagacugcccccaaga

SEQ ID NO: 6562 - RNA, 64 nt, Human
cuuucccuuccaguuuauuccagagcugccaguggggccugaggcuccuuaggguuuucucucu

SEQ ID NO: 6563 - RNA, 64 nt, Human
aauggucccagcacgaguggccaguucauugugggggccugauuguuugucgcuggaggaggac

SEQ ID NO: 6564 - RNA, 64 nt, Human; identical to SEQ ID NO: 6563

SEQ ID NO: 6565 - RNA, 64 nt, Human; identical to SEQ ID NO: 6186

SEQ ID NO: 6566 - RNA, 64 nt, Human; identical to SEQ ID NO: 6187

SEQ ID NO: 6567 - RNA, 64 nt, Human; identical to SEQ ID NO: 6188

SEQ ID NO: 6568 - RNA, 50 nt, Human; identical to SEQ ID NO: 6189

SEQ ID NO: 6569 - RNA, 64 nt, Human; identical to SEQ ID NO: 6190

SEQ ID NO: 6570 - RNA, 64 nt, Human; identical to SEQ ID NO: 6191

SEQ ID NO: 6571 - RNA, 64 nt, Human; identical to SEQ ID NO: 6192

SEQ ID NO: 6572 - RNA, 64 nt, Human; identical to SEQ ID NO: 6193

SEQ ID NO: 6573 - RNA, 64 nt, Human; identical to SEQ ID NO: 6194

SEQ ID NO: 6574 - RNA, 64 nt, Human; identical to SEQ ID NO: 6195

SEQ ID NO: 6575 - RNA, 64 nt, Human; identical to SEQ ID NO: 6196

SEQ ID NO: 6576 - RNA, 64 nt, Human; identical to SEQ ID NO: 6197

SEQ ID NO: 6577 - RNA, 64 nt, Human; identical to SEQ ID NO: 6198

SEQ ID NO: 6578 - RNA, 64 nt, Human; identical to SEQ ID NO: 6199

SEQ ID NO: 6579 - RNA, 64 nt, Human; identical to SEQ ID NO: 6200

SEQ ID NO: 6580 - RNA, 53 nt, Human; identical to SEQ ID NO: 6201

SEQ ID NO: 6581 - RNA, 64 nt, Human; identical to SEQ ID NO: 6202

SEQ ID NO: 6582 - RNA, 64 nt, Human; identical to SEQ ID NO: 6203

SEQ ID NO: 6583 - RNA, 64 nt, Human; identical to SEQ ID NO: 6204

SEQ ID NO: 6584 - RNA, 64 nt, Human; identical to SEQ ID NO: 6205

SEQ ID NO: 6585 - RNA, 64 nt, Human; identical to SEQ ID NO: 6206

SEQ ID NO: 6586 - RNA, 64 nt, Human; identical to SEQ ID NO: 6207

SEQ ID NO: 6587 - RNA, 64 nt, Human; identical to SEQ ID NO: 6208

SEQ ID NO: 6588 - RNA, 64 nt, Human; identical to SEQ ID NO: 6209

SEQ ID NO: 6589 - RNA, 64 nt, Human; identical to SEQ ID NO: 6210

SEQ ID NO: 6590 - RNA, 64 nt, Human; identical to SEQ ID NO: 6211

SEQ ID NO: 6591 - RNA, 64 nt, Human; identical to SEQ ID NO: 6212

SEQ ID NO: 6592 - RNA, 64 nt, Human; identical to SEQ ID NO: 6213

SEQ ID NO: 6593 - RNA, 64 nt, Human; identical to SEQ ID NO: 6214

SEQ ID NO: 6594 - RNA, 64 nt, Human; identical to SEQ ID NO: 6215

SEQ ID NO: 6595 - RNA, 64 nt, Human; identical to SEQ ID NO: 6216

SEQ ID NO: 6596 - RNA, 64 nt, Human; identical to SEQ ID NO: 6217

SEQ ID NO: 6597 - RNA, 64 nt, Human; identical to SEQ ID NO: 6218

SEQ ID NO: 6598 - RNA, 64 nt, Human; identical to SEQ ID NO: 6219

SEQ ID NO: 6599 - RNA, 64 nt, Human; identical to SEQ ID NO: 6220

SEQ ID NO: 6600 - RNA, 64 nt, Human; identical to SEQ ID NO: 6221

SEQ ID NO: 6601 - RNA, 64 nt, Human; identical to SEQ ID NO: 6222

SEQ ID NO: 6602 - RNA, 64 nt, Human; identical to SEQ ID NO: 6223

SEQ ID NO: 6603 - RNA, 64 nt, Human; identical to SEQ ID NO: 6224

SEQ ID NO: 6604 - RNA, 64 nt, Human; identical to SEQ ID NO: 6225

SEQ ID NO: 6605 - RNA, 64 nt, Human; identical to SEQ ID NO: 6226

SEQ ID NO: 6606 - RNA, 64 nt, Human; identical to SEQ ID NO: 6227

SEQ ID NO: 6607 - RNA, 64 nt, Human; identical to SEQ ID NO: 6228

SEQ ID NO: 6608 - RNA, 64 nt, Human; identical to SEQ ID NO: 6229

SEQ ID NO: 6609 - RNA, 64 nt, Human; identical to SEQ ID NO: 6230

SEQ ID NO: 6610 - RNA, 64 nt, Human; identical to SEQ ID NO: 6231

SEQ ID NO: 6611 - RNA, 64 nt, Human; identical to SEQ ID NO: 6232

SEQ ID NO: 6612 - RNA, 64 nt, Human; identical to SEQ ID NO: 6233

SEQ ID NO: 6613 - RNA, 64 nt, Human; identical to SEQ ID NO: 6234

SEQ ID NO: 6614 - RNA, 64 nt, Human; identical to SEQ ID NO: 6235

SEQ ID NO: 6615 - RNA, 64 nt, Human; identical to SEQ ID NO: 6236

SEQ ID NO: 6616 - RNA, 64 nt, Human; identical to SEQ ID NO: 6237

SEQ ID NO: 6617 - RNA, 64 nt, Human; identical to SEQ ID NO: 6238

SEQ ID NO: 6618 - RNA, 64 nt, Human; identical to SEQ ID NO: 6239

SEQ ID NO: 6619 - RNA, 64 nt, Human; identical to SEQ ID NO: 6240

SEQ ID NO: 6620 - RNA, 64 nt, Human; identical to SEQ ID NO: 6241

SEQ ID NO: 6621 - RNA, 64 nt, Human; identical to SEQ ID NO: 6242

SEQ ID NO: 6622 - RNA, 64 nt, Human; identical to SEQ ID NO: 6243

SEQ ID NO: 6623 - RNA, 64 nt, Human; identical to SEQ ID NO: 6244

SEQ ID NO: 6624 - RNA, 64 nt, Human; identical to SEQ ID NO: 6245

SEQ ID NO: 6625 - RNA, 64 nt, Human; identical to SEQ ID NO: 6246

SEQ ID NO: 6626 - RNA, 64 nt, Human; identical to SEQ ID NO: 6247

SEQ ID NO: 6627 - RNA, 64 nt, Human; identical to SEQ ID NO: 6248

SEQ ID NO: 6628 - RNA, 64 nt, Human; identical to SEQ ID NO: 6249

SEQ ID NO: 6629 - RNA, 64 nt, Human; identical to SEQ ID NO: 6250

SEQ ID NO: 6630 - RNA, 64 nt, Human; identical to SEQ ID NO: 6251

SEQ ID NO: 6631 - RNA, 64 nt, Human; identical to SEQ ID NO: 6252

SEQ ID NO: 6632 - RNA, 64 nt, Human; identical to SEQ ID NO: 6253

SEQ ID NO: 6633 - RNA, 64 nt, Human; identical to SEQ ID NO: 6254

SEQ ID NO: 6634 - RNA, 64 nt, Human; identical to SEQ ID NO: 6255

SEQ ID NO: 6635 - RNA, 64 nt, Human; identical to SEQ ID NO: 6256

SEQ ID NO: 6636 - RNA, 64 nt, Human; identical to SEQ ID NO: 6257

SEQ ID NO: 6637 - RNA, 64 nt, Human; identical to SEQ ID NO: 6258

SEQ ID NO: 6638 - RNA, 64 nt, Human; identical to SEQ ID NO: 6259

SEQ ID NO: 6639 - RNA, 64 nt, Human; identical to SEQ ID NO: 6260

SEQ ID NO: 6640 - RNA, 64 nt, Human; identical to SEQ ID NO: 6261

SEQ ID NO: 6641 - RNA, 64 nt, Human; identical to SEQ ID NO: 6262

SEQ ID NO: 6642 - RNA, 64 nt, Human; identical to SEQ ID NO: 6263

SEQ ID NO: 6643 - RNA, 64 nt, Human; identical to SEQ ID NO: 6264

SEQ ID NO: 6644 - RNA, 64 nt, Human; identical to SEQ ID NO: 6265

SEQ ID NO: 6645 - RNA, 64 nt, Human; identical to SEQ ID NO: 6266

SEQ ID NO: 6646 - RNA, 64 nt, Human; identical to SEQ ID NO: 6267

SEQ ID NO: 6647 - RNA, 64 nt, Human; identical to SEQ ID NO: 6268

SEQ ID NO: 6648 - RNA, 64 nt, Human; identical to SEQ ID NO: 6269

SEQ ID NO: 6649 - RNA, 64 nt, Human; identical to SEQ ID NO: 6270

SEQ ID NO: 6650 - RNA, 64 nt, Human; identical to SEQ ID NO: 6271

SEQ ID NO: 6651 - RNA, 64 nt, Human; identical to SEQ ID NO: 6272

SEQ ID NO: 6652 - RNA, 64 nt, Human; identical to SEQ ID NO: 6273

SEQ ID NO: 6653 - RNA, 64 nt, Human; identical to SEQ ID NO: 6274

SEQ ID NO: 6654 - RNA, 64 nt, Human; identical to SEQ ID NO: 6275

SEQ ID NO: 6655 - RNA, 64 nt, Human; identical to SEQ ID NO: 6276

SEQ ID NO: 6656 - RNA, 64 nt, Human; identical to SEQ ID NO: 6277

SEQ ID NO: 6657 - RNA, 64 nt, Human; identical to SEQ ID NO: 6278

SEQ ID NO: 6658 - RNA, 64 nt, Human; identical to SEQ ID NO: 6279

SEQ ID NO: 6659 - RNA, 64 nt, Human; identical to SEQ ID NO: 6280

SEQ ID NO: 6660 - RNA, 64 nt, Human; identical to SEQ ID NO: 6281

SEQ ID NO: 6661 - RNA, 64 nt, Human; identical to SEQ ID NO: 6282

SEQ ID NO: 6662 - RNA, 64 nt, Human; identical to SEQ ID NO: 6283

SEQ ID NO: 6663 - RNA, 64 nt, Human; identical to SEQ ID NO: 6284

SEQ ID NO: 6664 - RNA, 64 nt, Human; identical to SEQ ID NO: 6285

SEQ ID NO: 6665 - RNA, 64 nt, Human; identical to SEQ ID NO: 6286

SEQ ID NO: 6666 - RNA, 64 nt, Human; identical to SEQ ID NO: 6287

SEQ ID NO: 6667 - RNA, 64 nt, Human; identical to SEQ ID NO: 6288

SEQ ID NO: 6668 - RNA, 60 nt, Human; identical to SEQ ID NO: 6289

SEQ ID NO: 6669 - RNA, 64 nt, Human; identical to SEQ ID NO: 6290

SEQ ID NO: 6670 - RNA, 62 nt, Human; identical to SEQ ID NO: 6291

SEQ ID NO: 6671 - RNA, 64 nt, Human; identical to SEQ ID NO: 6292

SEQ ID NO: 6672 - RNA, 64 nt, Human; identical to SEQ ID NO: 6293

SEQ ID NO: 6673 - RNA, 64 nt, Human; identical to SEQ ID NO: 6294

SEQ ID NO: 6674 - RNA, 59 nt, Human; identical to SEQ ID NO: 6295

SEQ ID NO: 6675 - RNA, 64 nt, Human; identical to SEQ ID NO: 6296

SEQ ID NO: 6676 - RNA, 64 nt, Human; identical to SEQ ID NO: 6297

SEQ ID NO: 6677 - RNA, 64 nt, Human; identical to SEQ ID NO: 6298

SEQ ID NO: 6678 - RNA, 64 nt, Human; identical to SEQ ID NO: 6299

SEQ ID NO: 6679 - RNA, 64 nt, Human; identical to SEQ ID NO: 6300

SEQ ID NO: 6680 - RNA, 64 nt, Human; identical to SEQ ID NO: 6301

SEQ ID NO: 6681 - RNA, 64 nt, Human; identical to SEQ ID NO: 6302

SEQ ID NO: 6682 - RNA, 64 nt, Human; identical to SEQ ID NO: 6303

SEQ ID NO: 6683 - RNA, 64 nt, Human; identical to SEQ ID NO: 6304

SEQ ID NO: 6684 - RNA, 64 nt, Human; identical to SEQ ID NO: 6305

SEQ ID NO: 6685 - RNA, 64 nt, Human; identical to SEQ ID NO: 6306

SEQ ID NO: 6686 - RNA, 64 nt, Human; identical to SEQ ID NO: 6307

SEQ ID NO: 6687 - RNA, 64 nt, Human; identical to SEQ ID NO: 6308

SEQ ID NO: 6688 - RNA, 64 nt, Human; identical to SEQ ID NO: 6309

SEQ ID NO: 6689 - RNA, 64 nt, Human; identical to SEQ ID NO: 6310

SEQ ID NO: 6690 - RNA, 64 nt, Human; identical to SEQ ID NO: 6311

SEQ ID NO: 6691 - RNA, 64 nt, Human; identical to SEQ ID NO: 6312

SEQ ID NO: 6692 - RNA, 64 nt, Human; identical to SEQ ID NO: 6313

SEQ ID NO: 6693 - RNA, 64 nt, Human; identical to SEQ ID NO: 6314

SEQ ID NO: 6694 - RNA, 64 nt, Human; identical to SEQ ID NO: 6315

SEQ ID NO: 6695 - RNA, 64 nt, Human; identical to SEQ ID NO: 6316

SEQ ID NO: 6696 - RNA, 64 nt, Human; identical to SEQ ID NO: 6317

SEQ ID NO: 6697 - RNA, 64 nt, Human; identical to SEQ ID NO: 6318

SEQ ID NO: 6698 - RNA, 64 nt, Human; identical to SEQ ID NO: 6319

SEQ ID NO: 6699 - RNA, 64 nt, Human; identical to SEQ ID NO: 6320

SEQ ID NO: 6700 - RNA, 64 nt, Human; identical to SEQ ID NO: 6321

SEQ ID NO: 6701 - RNA, 64 nt, Human; identical to SEQ ID NO: 6322

SEQ ID NO: 6702 - RNA, 64 nt, Human; identical to SEQ ID NO: 6323

SEQ ID NO: 6703 - RNA, 53 nt, Human; identical to SEQ ID NO: 6324

SEQ ID NO: 6704 - RNA, 64 nt, Human; identical to SEQ ID NO: 6325

SEQ ID NO: 6705 - RNA, 64 nt, Human; identical to SEQ ID NO: 6326

SEQ ID NO: 6706 - RNA, 64 nt, Human; identical to SEQ ID NO: 6327

SEQ ID NO: 6707 - RNA, 64 nt, Human; identical to SEQ ID NO: 6328

SEQ ID NO: 6708 - RNA, 64 nt, Human; identical to SEQ ID NO: 6329

SEQ ID NO: 6709 - RNA, 64 nt, Human; identical to SEQ ID NO: 6330

SEQ ID NO: 6710 - RNA, 64 nt, Human; identical to SEQ ID NO: 6331

SEQ ID NO: 6711 - RNA, 64 nt, Human; identical to SEQ ID NO: 6332

SEQ ID NO: 6712 - RNA, 64 nt, Human; identical to SEQ ID NO: 6333

SEQ ID NO: 6713 - RNA, 64 nt, Human; identical to SEQ ID NO: 6334

SEQ ID NO: 6714 - RNA, 64 nt, Human; identical to SEQ ID NO: 6335

SEQ ID NO: 6715 - RNA, 64 nt, Human; identical to SEQ ID NO: 6336

SEQ ID NO: 6716 - RNA, 64 nt, Human; identical to SEQ ID NO: 6337

SEQ ID NO: 6717 - RNA, 64 nt, Human; identical to SEQ ID NO: 6338

SEQ ID NO: 6718 - RNA, 64 nt, Human; identical to SEQ ID NO: 6339

SEQ ID NO: 6719 - RNA, 64 nt, Human; identical to SEQ ID NO: 6340

SEQ ID NO: 6720 - RNA, 64 nt, Human; identical to SEQ ID NO: 6341

SEQ ID NO: 6721 - RNA, 64 nt, Human; identical to SEQ ID NO: 6342

SEQ ID NO: 6722 - RNA, 64 nt, Human; identical to SEQ ID NO: 6343

SEQ ID NO: 6723 - RNA, 64 nt, Human; identical to SEQ ID NO: 6344

SEQ ID NO: 6724 - RNA, 64 nt, Human; identical to SEQ ID NO: 6345

SEQ ID NO: 6725 - RNA, 64 nt, Human; identical to SEQ ID NO: 6346

SEQ ID NO: 6726 - RNA, 64 nt, Human; identical to SEQ ID NO: 6347

SEQ ID NO: 6727 - RNA, 64 nt, Human; identical to SEQ ID NO: 6348

SEQ ID NO: 6728 - RNA, 64 nt, Human; identical to SEQ ID NO: 6349

SEQ ID NO: 6729 - RNA, 64 nt, Human; identical to SEQ ID NO: 6350

SEQ ID NO: 6730 - RNA, 64 nt, Human; identical to SEQ ID NO: 6351

SEQ ID NO: 6731 - RNA, 64 nt, Human; identical to SEQ ID NO: 6352

SEQ ID NO: 6732 - RNA, 64 nt, Human; identical to SEQ ID NO: 6353

SEQ ID NO: 6733 - RNA, 64 nt, Human; identical to SEQ ID NO: 6354

SEQ ID NO: 6734 - RNA, 64 nt, Human; identical to SEQ ID NO: 6355

SEQ ID NO: 6735 - RNA, 64 nt, Human; identical to SEQ ID NO: 6356

SEQ ID NO: 6736 - RNA, 64 nt, Human; identical to SEQ ID NO: 6357

SEQ ID NO: 6737 - RNA, 64 nt, Human; identical to SEQ ID NO: 6358

SEQ ID NO: 6738 - RNA, 64 nt, Human; identical to SEQ ID NO: 6359

SEQ ID NO: 6739 - RNA, 64 nt, Human; identical to SEQ ID NO: 6360

SEQ ID NO: 6740 - RNA, 64 nt, Human; identical to SEQ ID NO: 6361

SEQ ID NO: 6741 - RNA, 64 nt, Human; identical to SEQ ID NO: 6362

SEQ ID NO: 6742 - RNA, 64 nt, Human; identical to SEQ ID NO: 6363

SEQ ID NO: 6743 - RNA, 64 nt, Human; identical to SEQ ID NO: 6364

SEQ ID NO: 6744 - RNA, 64 nt, Human; identical to SEQ ID NO: 6365

SEQ ID NO: 6745 - RNA, 64 nt, Human; identical to SEQ ID NO: 6366

SEQ ID NO: 6746 - RNA, 64 nt, Human; identical to SEQ ID NO: 6367

SEQ ID NO: 6747 - RNA, 64 nt, Human; identical to SEQ ID NO: 6368

SEQ ID NO: 6748 - RNA, 64 nt, Human; identical to SEQ ID NO: 6369

SEQ ID NO: 6749 - RNA, 64 nt, Human; identical to SEQ ID NO: 6370

SEQ ID NO: 6750 - RNA, 64 nt, Human; identical to SEQ ID NO: 6371

SEQ ID NO: 6751 - RNA, 64 nt, Human; identical to SEQ ID NO: 6372

SEQ ID NO: 6752 - RNA, 64 nt, Human; identical to SEQ ID NO: 6373

SEQ ID NO: 6753 - RNA, 64 nt, Human; identical to SEQ ID NO: 6374

SEQ ID NO: 6754 - RNA, 64 nt, Human; identical to SEQ ID NO: 6375

SEQ ID NO: 6755 - RNA, 64 nt, Human; identical to SEQ ID NO: 6376

SEQ ID NO: 6756 - RNA, 64 nt, Human; identical to SEQ ID NO: 6377

SEQ ID NO: 6757 - RNA, 64 nt, Human; identical to SEQ ID NO: 6378

SEQ ID NO: 6758 - RNA, 64 nt, Human; identical to SEQ ID NO: 6379

SEQ ID NO: 6759 - RNA, 64 nt, Human; identical to SEQ ID NO: 6380

SEQ ID NO: 6760 - RNA, 64 nt, Human; identical to SEQ ID NO: 6381

SEQ ID NO: 6761 - RNA, 64 nt, Human; identical to SEQ ID NO: 6382

SEQ ID NO: 6762 - RNA, 64 nt, Human; identical to SEQ ID NO: 6383

SEQ ID NO: 6763 - RNA, 64 nt, Human; identical to SEQ ID NO: 6384

SEQ ID NO: 6764 - RNA, 64 nt, Human; identical to SEQ ID NO: 6385

SEQ ID NO: 6765 - RNA, 64 nt, Human; identical to SEQ ID NO: 6386

SEQ ID NO: 6766 - RNA, 64 nt, Human; identical to SEQ ID NO: 6387

SEQ ID NO: 6767 - RNA, 64 nt, Human; identical to SEQ ID NO: 6388

SEQ ID NO: 6768 - RNA, 64 nt, Human; identical to SEQ ID NO: 6389

SEQ ID NO: 6769 - RNA, 55 nt, Human; identical to SEQ ID NO: 6390

SEQ ID NO: 6770 - RNA, 64 nt, Human; identical to SEQ ID NO: 6391

SEQ ID NO: 6771 - RNA, 64 nt, Human; identical to SEQ ID NO: 6392

SEQ ID NO: 6772 - RNA, 64 nt, Human; identical to SEQ ID NO: 6393

SEQ ID NO: 6773 - RNA, 64 nt, Human; identical to SEQ ID NO: 6394

SEQ ID NO: 6774 - RNA, 64 nt, Human; identical to SEQ ID NO: 6395

SEQ ID NO: 6775 - RNA, 64 nt, Human; identical to SEQ ID NO: 6396

SEQ ID NO: 6776 - RNA, 64 nt, Human; identical to SEQ ID NO: 6397

SEQ ID NO: 6777 - RNA, 64 nt, Human; identical to SEQ ID NO: 6398

SEQ ID NO: 6778 - RNA, 64 nt, Human; identical to SEQ ID NO: 6399

SEQ ID NO: 6779 - RNA, 64 nt, Human; identical to SEQ ID NO: 6400

SEQ ID NO: 6780 - RNA, 50 nt, Human; identical to SEQ ID NO: 6401

SEQ ID NO: 6781 - RNA, 64 nt, Human; identical to SEQ ID NO: 6402

SEQ ID NO: 6782 - RNA, 64 nt, Human; identical to SEQ ID NO: 6404

SEQ ID NO: 6783 - RNA, 61 nt, Human; identical to SEQ ID NO: 6405

SEQ ID NO: 6784 - RNA, 64 nt, Human; identical to SEQ ID NO: 6406

SEQ ID NO: 6785 - RNA, 64 nt, Human; identical to SEQ ID NO: 6407

SEQ ID NO: 6786 - RNA, 64 nt, Human; identical to SEQ ID NO: 6408

SEQ ID NO: 6787 - RNA, 61 nt, Human; identical to SEQ ID NO: 6409

SEQ ID NO: 6788 - RNA, 64 nt, Human; identical to SEQ ID NO: 6410

SEQ ID NO: 6789 - RNA, 64 nt, Human; identical to SEQ ID NO: 6411

SEQ ID NO: 6790 - RNA, 64 nt, Human; identical to SEQ ID NO: 6412

SEQ ID NO: 6791 - RNA, 64 nt, Human; identical to SEQ ID NO: 6413

SEQ ID NO: 6792 - RNA, 64 nt, Human; identical to SEQ ID NO: 6414

SEQ ID NO: 6793 - RNA, 64 nt, Human; identical to SEQ ID NO: 6415

SEQ ID NO: 6794 - RNA, 64 nt, Human; identical to SEQ ID NO: 6416

SEQ ID NO: 6795 - RNA, 64 nt, Human; identical to SEQ ID NO: 6417

SEQ ID NO: 6796 - RNA, 64 nt, Human; identical to SEQ ID NO: 6418

SEQ ID NO: 6797 - RNA, 64 nt, Human; identical to SEQ ID NO: 6419

SEQ ID NO: 6798 - RNA, 64 nt, Human; identical to SEQ ID NO: 6420

SEQ ID NO: 6799 - RNA, 64 nt, Human; identical to SEQ ID NO: 6421

SEQ ID NO: 6800 - RNA, 64 nt, Human; identical to SEQ ID NO: 6422

SEQ ID NO: 6801 - RNA, 64 nt, Human; identical to SEQ ID NO: 6423

SEQ ID NO: 6802 - RNA, 64 nt, Human; identical to SEQ ID NO: 6424

SEQ ID NO: 6803 - RNA, 64 nt, Human; identical to SEQ ID NO: 6425

SEQ ID NO: 6804 - RNA, 64 nt, Human; identical to SEQ ID NO: 6426

SEQ ID NO: 6805 - RNA, 64 nt, Human; identical to SEQ ID NO: 6427

SEQ ID NO: 6806 - RNA, 64 nt, Human; identical to SEQ ID NO: 6428

SEQ ID NO: 6807 - RNA, 64 nt, Human; identical to SEQ ID NO: 6429

SEQ ID NO: 6808 - RNA, 64 nt, Human; identical to SEQ ID NO: 6430

SEQ ID NO: 6809 - RNA, 64 nt, Human; identical to SEQ ID NO: 6431

SEQ ID NO: 6810 - RNA, 64 nt, Human; identical to SEQ ID NO: 6432

SEQ ID NO: 6811 - RNA, 64 nt, Human; identical to SEQ ID NO: 6433

SEQ ID NO: 6812 - RNA, 64 nt, Human; identical to SEQ ID NO: 6434

SEQ ID NO: 6813 - RNA, 64 nt, Human; identical to SEQ ID NO: 6435

SEQ ID NO: 6814 - RNA, 64 nt, Human; identical to SEQ ID NO: 6436

SEQ ID NO: 6815 - RNA, 64 nt, Human; identical to SEQ ID NO: 6437

SEQ ID NO: 6816 - RNA, 64 nt, Human; identical to SEQ ID NO: 6438

SEQ ID NO: 6817 - RNA, 64 nt, Human; identical to SEQ ID NO: 6439

SEQ ID NO: 6818 - RNA, 64 nt, Human; identical to SEQ ID NO: 6440

SEQ ID NO: 6819 - RNA, 64 nt, Human; identical to SEQ ID NO: 6441

SEQ ID NO: 6820 - RNA, 64 nt, Human; identical to SEQ ID NO: 6442

SEQ ID NO: 6821 - RNA, 64 nt, Human; identical to SEQ ID NO: 6443

SEQ ID NO: 6822 - RNA, 64 nt, Human; identical to SEQ ID NO: 6444

SEQ ID NO: 6823 - RNA, 64 nt, Human; identical to SEQ ID NO: 6445

SEQ ID NO: 6824 - RNA, 64 nt, Human; identical to SEQ ID NO: 6446

SEQ ID NO: 6825 - RNA, 64 nt, Human; identical to SEQ ID NO: 6447

SEQ ID NO: 6826 - RNA, 64 nt, Human; identical to SEQ ID NO: 6448

SEQ ID NO: 6827 - RNA, 64 nt, Human; identical to SEQ ID NO: 6449

SEQ ID NO: 6828 - RNA, 64 nt, Human; identical to SEQ ID NO: 6450

SEQ ID NO: 6829 - RNA, 64 nt, Human; identical to SEQ ID NO: 6451

SEQ ID NO: 6830 - RNA, 64 nt, Human; identical to SEQ ID NO: 6452

SEQ ID NO: 6831 - RNA, 64 nt, Human; identical to SEQ ID NO: 6453

SEQ ID NO: 6832 - RNA, 64 nt, Human; identical to SEQ ID NO: 6454

SEQ ID NO: 6833 - RNA, 64 nt, Human; identical to SEQ ID NO: 6455

SEQ ID NO: 6834 - RNA, 64 nt, Human; identical to SEQ ID NO: 6456

SEQ ID NO: 6835 - RNA, 64 nt, Human; identical to SEQ ID NO: 6457

SEQ ID NO: 6836 - RNA, 64 nt, Human; identical to SEQ ID NO: 6458

SEQ ID NO: 6837 - RNA, 64 nt, Human; identical to SEQ ID NO: 6459

SEQ ID NO: 6838 - RNA, 64 nt, Human; identical to SEQ ID NO: 6460

SEQ ID NO: 6839 - RNA, 64 nt, Human; identical to SEQ ID NO: 6461

SEQ ID NO: 6840 - RNA, 64 nt, Human; identical to SEQ ID NO: 6462

SEQ ID NO: 6841 - RNA, 64 nt, Human; identical to SEQ ID NO: 6463

SEQ ID NO: 6842 - RNA, 64 nt, Human; identical to SEQ ID NO: 6464

SEQ ID NO: 6843 - RNA, 64 nt, Human; identical to SEQ ID NO: 6465

SEQ ID NO: 6844 - RNA, 64 nt, Human; identical to SEQ ID NO: 6466

SEQ ID NO: 6845 - RNA, 64 nt, Human; identical to SEQ ID NO: 6467

SEQ ID NO: 6846 - RNA, 64 nt, Human; identical to SEQ ID NO: 6468

SEQ ID NO: 6847 - RNA, 64 nt, Human; identical to SEQ ID NO: 6469

SEQ ID NO: 6848 - RNA, 64 nt, Human; identical to SEQ ID NO: 6470

SEQ ID NO: 6849 - RNA, 64 nt, Human; identical to SEQ ID NO: 6471

SEQ ID NO: 6850 - RNA, 57 nt, Human; identical to SEQ ID NO: 6472

SEQ ID NO: 6851 - RNA, 64 nt, Human; identical to SEQ ID NO: 6473

SEQ ID NO: 6852 - RNA, 64 nt, Human; identical to SEQ ID NO: 6474

SEQ ID NO: 6853 - RNA, 64 nt, Human; identical to SEQ ID NO: 6475

SEQ ID NO: 6854 - RNA, 64 nt, Human; identical to SEQ ID NO: 6476

SEQ ID NO: 6855 - RNA, 64 nt, Human; identical to SEQ ID NO: 6477

SEQ ID NO: 6856 - RNA, 64 nt, Human; identical to SEQ ID NO: 6478

SEQ ID NO: 6857 - RNA, 64 nt, Human; identical to SEQ ID NO: 6479

SEQ ID NO: 6858 - RNA, 64 nt, Human; identical to SEQ ID NO: 6480

SEQ ID NO: 6859 - RNA, 64 nt, Human; identical to SEQ ID NO: 6481

SEQ ID NO: 6860 - RNA, 64 nt, Human; identical to SEQ ID NO: 6482

SEQ ID NO: 6861 - RNA, 64 nt, Human; identical to SEQ ID NO: 6483

SEQ ID NO: 6862 - RNA, 64 nt, Human; identical to SEQ ID NO: 6484

SEQ ID NO: 6863 - RNA, 64 nt, Human; identical to SEQ ID NO: 6485

SEQ ID NO: 6864 - RNA, 64 nt, Human; identical to SEQ ID NO: 6486

SEQ ID NO: 6865 - RNA, 64 nt, Human; identical to SEQ ID NO: 6487

SEQ ID NO: 6866 - RNA, 64 nt, Human; identical to SEQ ID NO: 6488

SEQ ID NO: 6867 - RNA, 64 nt, Human; identical to SEQ ID NO: 6489

SEQ ID NO: 6868 - RNA, 64 nt, Human; identical to SEQ ID NO: 6490

SEQ ID NO: 6869 - RNA, 64 nt, Human; identical to SEQ ID NO: 6491

SEQ ID NO: 6870 - RNA, 64 nt, Human; identical to SEQ ID NO: 6492

SEQ ID NO: 6871 - RNA, 64 nt, Human; identical to SEQ ID NO: 6493

SEQ ID NO: 6872 - RNA, 64 nt, Human; identical to SEQ ID NO: 6494

SEQ ID NO: 6873 - RNA, 64 nt, Human; identical to SEQ ID NO: 6495

SEQ ID NO: 6874 - RNA, 64 nt, Human; identical to SEQ ID NO: 6496

SEQ ID NO: 6875 - RNA, 64 nt, Human; identical to SEQ ID NO: 6497

SEQ ID NO: 6876 - RNA, 64 nt, Human; identical to SEQ ID NO: 6498

SEQ ID NO: 6877 - RNA, 64 nt, Human; identical to SEQ ID NO: 6499

SEQ ID NO: 6878 - RNA, 64 nt, Human; identical to SEQ ID NO: 6500

SEQ ID NO: 6879 - RNA, 64 nt, Human; identical to SEQ ID NO: 6501

SEQ ID NO: 6880 - RNA, 64 nt, Human; identical to SEQ ID NO: 6502

SEQ ID NO: 6881 - RNA, 64 nt, Human; identical to SEQ ID NO: 6503

SEQ ID NO: 6882 - RNA, 64 nt, Human; identical to SEQ ID NO: 6504

SEQ ID NO: 6883 - RNA, 64 nt, Human; identical to SEQ ID NO: 6505

SEQ ID NO: 6884 - RNA, 64 nt, Human; identical to SEQ ID NO: 6506

SEQ ID NO: 6885 - RNA, 64 nt, Human; identical to SEQ ID NO: 6507

SEQ ID NO: 6886 - RNA, 64 nt, Human; identical to SEQ ID NO: 6508

SEQ ID NO: 6887 - RNA, 64 nt, Human; identical to SEQ ID NO: 6509

SEQ ID NO: 6888 - RNA, 64 nt, Human; identical to SEQ ID NO: 6510

SEQ ID NO: 6889 - RNA, 64 nt, Human; identical to SEQ ID NO: 6511

SEQ ID NO: 6890 - RNA, 64 nt, Human; identical to SEQ ID NO: 6512

SEQ ID NO: 6891 - RNA, 64 nt, Human; identical to SEQ ID NO: 6513

SEQ ID NO: 6892 - RNA, 64 nt, Human; identical to SEQ ID NO: 6514

SEQ ID NO: 6893 - RNA, 64 nt, Human; identical to SEQ ID NO: 6515

SEQ ID NO: 6894 - RNA, 64 nt, Human; identical to SEQ ID NO: 6516

SEQ ID NO: 6895 - RNA, 64 nt, Human; identical to SEQ ID NO: 6517

SEQ ID NO: 6896 - RNA, 64 nt, Human; identical to SEQ ID NO: 6518

SEQ ID NO: 6897 - RNA, 53 nt, Human; identical to SEQ ID NO: 6519

SEQ ID NO: 6898 - RNA, 64 nt, Human; identical to SEQ ID NO: 6520

SEQ ID NO: 6899 - RNA, 64 nt, Human; identical to SEQ ID NO: 6521

SEQ ID NO: 6900 - RNA, 64 nt, Human; identical to SEQ ID NO: 6522

SEQ ID NO: 6901 - RNA, 64 nt, Human; identical to SEQ ID NO: 6523

SEQ ID NO: 6902 - RNA, 64 nt, Human; identical to SEQ ID NO: 6524

SEQ ID NO: 6903 - RNA, 64 nt, Human; identical to SEQ ID NO: 6525

SEQ ID NO: 6904 - RNA, 64 nt, Human; identical to SEQ ID NO: 6526

SEQ ID NO: 6905 - RNA, 64 nt, Human; identical to SEQ ID NO: 6527

SEQ ID NO: 6906 - RNA, 64 nt, Human; identical to SEQ ID NO: 6528

SEQ ID NO: 6907 - RNA, 64 nt, Human; identical to SEQ ID NO: 6529

SEQ ID NO: 6908 - RNA, 64 nt, Human; identical to SEQ ID NO: 6530

SEQ ID NO: 6909 - RNA, 64 nt, Human; identical to SEQ ID NO: 6531

SEQ ID NO: 6910 - RNA, 64 nt, Human; identical to SEQ ID NO: 6532

SEQ ID NO: 6911 - RNA, 64 nt, Human; identical to SEQ ID NO: 6533

SEQ ID NO: 6912 - RNA, 64 nt, Human; identical to SEQ ID NO: 6534

SEQ ID NO: 6913 - RNA, 64 nt, Human; identical to SEQ ID NO: 6535

SEQ ID NO: 6914 - RNA, 64 nt, Human; identical to SEQ ID NO: 6536

SEQ ID NO: 6915 - RNA, 64 nt, Human; identical to SEQ ID NO: 6537

SEQ ID NO: 6916 - RNA, 64 nt, Human; identical to SEQ ID NO: 6538

SEQ ID NO: 6917 - RNA, 64 nt, Human; identical to SEQ ID NO: 6539

SEQ ID NO: 6918 - RNA, 64 nt, Human; identical to SEQ ID NO: 6540

SEQ ID NO: 6919 - RNA, 64 nt, Human; identical to SEQ ID NO: 6541

SEQ ID NO: 6920 - RNA, 64 nt, Human; identical to SEQ ID NO: 6542

SEQ ID NO: 6921 - RNA, 64 nt, Human; identical to SEQ ID NO: 6543

SEQ ID NO: 6922 - RNA, 64 nt, Human; identical to SEQ ID NO: 6544

SEQ ID NO: 6923 - RNA, 64 nt, Human; identical to SEQ ID NO: 6545

SEQ ID NO: 6924 - RNA, 64 nt, Human; identical to SEQ ID NO: 6546

SEQ ID NO: 6925 - RNA, 64 nt, Human; identical to SEQ ID NO: 6547

SEQ ID NO: 6926 - RNA, 64 nt, Human; identical to SEQ ID NO: 6548

SEQ ID NO: 6927 - RNA, 64 nt, Human; identical to SEQ ID NO: 6549

SEQ ID NO: 6928 - RNA, 64 nt, Human; identical to SEQ ID NO: 6550

SEQ ID NO: 6929 - RNA, 64 nt, Human; identical to SEQ ID NO: 6551

SEQ ID NO: 6930 - RNA, 64 nt, Human; identical to SEQ ID NO: 6552

SEQ ID NO: 6931 - RNA, 64 nt, Human; identical to SEQ ID NO: 6553

SEQ ID NO: 6932 - RNA, 64 nt, Human; identical to SEQ ID NO: 6554

SEQ ID NO: 6933 - RNA, 64 nt, Human; identical to SEQ ID NO: 6555

SEQ ID NO: 6934 - RNA, 64 nt, Human; identical to SEQ ID NO: 6556

SEQ ID NO: 6935 - RNA, 64 nt, Human; identical to SEQ ID NO: 6557

SEQ ID NO: 6936 - RNA, 64 nt, Human; identical to SEQ ID NO: 6558

SEQ ID NO: 6937 - RNA, 64 nt, Human; identical to SEQ ID NO: 6559

SEQ ID NO: 6938 - RNA, 64 nt, Human; identical to SEQ ID NO: 6560

SEQ ID NO: 6939 - RNA, 64 nt, Human; identical to SEQ ID NO: 6561

SEQ ID NO: 6940 - RNA, 64 nt, Human; identical to SEQ ID NO: 6562

SEQ ID NO: 6941 - RNA, 64 nt, Human; identical to SEQ ID NO: 6563

SEQ ID NO: 6942 - RNA, 64 nt, Human; identical to SEQ ID NO: 6563

SEQ ID NO: 6943 - RNA, 60 nt, Human
gguggaacauggugcccugagccugcccccacccgccauccucucugcccucuugcuagg

SEQ ID NO: 6944 - RNA, 64 nt, Human
uaaagacuugguguccccuucucucuccucccccacccgccacuccuggguacaucugggccgu

SEQ ID NO: 6945 - RNA, 64 nt, Human
ugccucagccucccaaguagcugggauuacaggcacccgccaccacaccuggcuaauuuuuuug

SEQ ID NO: 6946 - RNA, 64 nt, Human
ucuguuagagggggacggucguauuuuccucccuacccgccaagucauccuuucuacugcuuuu

SEQ ID NO: 6947 - RNA, 64 nt, Human
accugggcaguccugucaggcagcagcgauuccgacccgccaagucucggccuccacauuaacc

SEQ ID NO: 6948 - RNA, 64 nt, Human
caucccaucuaggaagugaggagcgccucuucccacccgccaucccaucuaggaagugaggagc

SEQ ID NO: 6949 - RNA, 64 nt, Human
uggaccaggcuugcaggcugccagacgucacuccacccgccagggagaggggagccagagccgg

SEQ ID NO: 6950 - RNA, 64 nt, Human
caaauuucacaagcacugacccccuggcaccaacacccgccaguacugugacuuccaaagccag

SEQ ID NO: 6951 - RNA, 64 nt, Human
ccucuccuuuucuguguuuuccaccccuacccccacccgccacccaguaauaaacuauuuccuu

SEQ ID NO: 6952 - RNA, 64 nt, Human
ugccucagccuccugaguagcugagaccacaggcacccgccaccacacccagcuauuuuuuugu

SEQ ID NO: 6953 - RNA, 64 nt, Human
aggcauuuauggggagaaaaggcccuccccaccgacccgccaccugccaccucugacggagugg

SEQ ID NO: 6954 - RNA, 64 nt, Human
gagcagugacaagacagguggggccuggcuccccacccgccagcuccaggacugccccuuccug

SEQ ID NO: 6955 - RNA, 64 nt, Human
ucucucuuucugucuagaaucauaagaauguggaacccgccauggcccccaaccaauguacaag

SEQ ID NO: 6956 - RNA, 64 nt, Human
ugccucagccucccgaguagcugggacuacaggcacccgccaccauuccgagcuaauuucuaua

SEQ ID NO: 6957 - RNA, 64 nt, Human
gugucgguucuuccuggaaguugacuuuccuuagacccgccaggucaaguuagccgcgugacgg

SEQ ID NO: 6958 - RNA, 63 nt, Human
gcuggcugcucaaguacuagccccggccccagcacccgccaggauguggagaccgaggcccau

SEQ ID NO: 6959 - RNA, 64 nt, Human
aaccagauaccccaggugggccggagggaccccagaccuucagagggcugcccugguguucucc

SEQ ID NO: 6960 - RNA, 64 nt, Human
ugccucagccucccaaguagcugggauuacaggcacccgccaccacgcccagcuaauuuuugua

SEQ ID NO: 6961 - RNA, 64 nt, Human
uggcucagccucccaaguagcugggacuacaggcacccgccacagugccuggcuaauuuuuugu

SEQ ID NO: 6962 - RNA, 64 nt, Human
ccgggcagguuuuaaacucuugaccucauguuccacccgccacggccucccaaagugcugugau

SEQ ID NO: 6963 - RNA, 64 nt, Human
ccccaggugcaggugcugacaauacugcugccuuacccgccauacauuaaggagcaggguccug

SEQ ID NO: 6964 - RNA, 64 nt, Human
aucccagcuuccggcucccucuucuccccccucuacccgccaccccaccccaccccacccccgc

SEQ ID NO: 6965 - RNA, 64 nt, Human
ugccucagccucccaagcagcugggauuauagacacccgccaacacgccaggcuaauguuuuug

SEQ ID NO: 6966 - RNA, 64 nt, Human
ggacagcaggggccacguggagcccgggccgcucacccgccacccagugcuggccgccuucuug

SEQ ID NO: 6967 - RNA, 64 nt, Human
acagccaaccugcccagucuuuccucugggcuugacccgccaggggaguucuccaggccuaggg

SEQ ID NO: 6968 - RNA, 64 nt, Human
cacacgcaccguguccccacccaggacagcagacacccgccagagugugcgcgcccagugacug

SEQ ID NO: 6969 - RNA, 64 nt, Human
ugccucagccuccugaguagcugggauuacaggcacccgccaccacgccuggcuaauuuuugua

SEQ ID NO: 6970 - RNA, 64 nt, Human
ugccucagccucccgaguagcugggacuacaggcacccgccaccacauccggcuaauuuuuugu

SEQ ID NO: 6971 - RNA, 64 nt, Human
gcagggccaccugaagcgggccuccaacgagagcacccgccagaggcugcagcagcagcugacc

SEQ ID NO: 6972 - RNA, 64 nt, Human
caggaaaggccuucugcagagaaaauguccccccacccgccaucugcagccaggugugugccac

SEQ ID NO: 6973 - RNA, 64 nt, Human
gacuauuuagugacucucucugcaugucccccucacccgccaacccuccguuucauuauauagg

SEQ ID NO: 6974 - RNA, 64 nt, Human
ccuggcagagaaacagggaggccuggggagagcuacccgccagcuugggcugccgugggccccu

SEQ ID NO: 6975 - RNA, 64 nt, Human
cggaguucgcuccaggagaaggcugcgcacccacacccgccagagcccuacacgguggcgccgg

SEQ ID NO: 6976 - RNA, 64 nt, Human
ugccucagccuccggaguagcugggauugcaggcacccgccaccacgccuggcuaauuuuugua

SEQ ID NO: 6977 - RNA, 64 nt, Human
ggcaggcugucucuggaaaaagccuccauugcccacccgccaggcggaaagucacccuguuccc

SEQ ID NO: 6978 - RNA, 64 nt, Human
uuccugcuccguggacugcagucggcaugccaggacccgccagccccgcucccaccuagugccc

SEQ ID NO: 6979 - RNA, 64 nt, Human
ugccucagccucccaaguagcugggauuacaggcacccgccaccacacccagcuaauuuuuugu

SEQ ID NO: 6980 - RNA, 64 nt, Human
uguuggcuuacgcacuggcccucagagcugaccaacccgccaggccugcucaaugcauuggguu

SEQ ID NO: 6981 - RNA, 64 nt, Human
agccucagccucccgaguagcugggauuacagacacccgccaccacgcccggcuaauuuuuucu

SEQ ID NO: 6982 - RNA, 64 nt, Human
guagaagggaagagaauuggugcugcagaaguguacccgccaugaagccgaugagaaaccucgu

SEQ ID NO: 6983 - RNA, 64 nt, Human
cacugggugcaggagcugcuggcugucccuguggacccgccauccaccguccugcccacgccgc

SEQ ID NO: 6984 - RNA, 64 nt, Human
ugagaggaggcuagccgggccucaccccaccccuacccgccacagccucagggugugcagggga

SEQ ID NO: 6985 - RNA, 64 nt, Human
acuccagaggugucacacguggaacugacaggagacccgccaccguggaggcagggggcaagaa

SEQ ID NO: 6986 - RNA, 64 nt, Human
ucuuuuuucuuuuuuaaaauguuuuauuuauuuaacccgccauuguguguuuuuaaguauuuuc

SEQ ID NO: 6987 - RNA, 64 nt, Human
ccaggauggucucgaucuccugaccucaugauccacccgccauggccucccaaagugcugggau

SEQ ID NO: 6988 - RNA, 64 nt, Human
uccucugcaucauucugggcuuggccuggacagcacccgccagugagagcugugggccucaccc

SEQ ID NO: 6989 - RNA, 64 nt, Human
ccucucuauuuuaccucuuuccgugcaucccugcacccgccacacccccuucagcuaugcuuuu

SEQ ID NO: 6990 - RNA, 64 nt, Human
aucacaggggugagauagguuggggccugcccuaacccgccagccuccuccucucgggcuggau

SEQ ID NO: 6991 - RNA, 64 nt, Human
ccaucuguagccucuuccucuacucaggcagucgacccgccacgaugagaagugggaccagcag

SEQ ID NO: 6992 - RNA, 64 nt, Human
ggaggagaaauugggcugaugugagcuccccgucacccgccauggagccggcuguguguguuca

SEQ ID NO: 6993 - RNA, 64 nt, Human
ggaccgagacccacauccucucacucacuucuccacccgccaggcagcugccacaggccuaagg

SEQ ID NO: 6994 - RNA, 64 nt, Human
ugccucagccuccugaguagcugggauuacagacacccgccauggcacccagcuaauuuuguau

SEQ ID NO: 6995 - RNA, 64 nt, Human
gucaguguccacuuguguauccuucugcaggaagacccgccaaauagaagagaugggacaaaaa

SEQ ID NO: 6996 - RNA, 64 nt, Human
gagagaagccgcgucugugggacgaagaccgggcacccgccagagaggggaagguaccagguug

SEQ ID NO: 6997 - RNA, 64 nt, Human
ugccucagccucccaaguagcugggauuacaggcacccgccaccgugcccggcuaguuuuuuuu

SEQ ID NO: 6998 - RNA, 64 nt, Human
uugcccuccccggcaugaagaagucacaauucugacccgccaccucuccaggggcggugccugg

SEQ ID NO: 6999 - RNA, 64 nt, Human
cccucagcccggcccuggccccuucccgacccccacccgccauucagaccccauuaagaagguu

SEQ ID NO: 7000 - RNA, 64 nt, Human
ggagggcaucuguguuaguccuuuccuggcugugacccgccacacucacugucaguauuaaggc

SEQ ID NO: 7001 - RNA, 64 nt, Human
gcaaacagucagugagaguggaggcuccagucagacccgccagauccuugggcaccuggcacuc

SEQ ID NO: 7002 - RNA, 64 nt, Human
ugccucagccucccgaguagcugggauuacaggcacccgccaccguaccuggcuaauuuuugua

SEQ ID NO: 7003 - RNA, 64 nt, Human
guucugcuggggccuccuuguuggugcuguaggcacccgccagggagcagggacccgacuugca

SEQ ID NO: 7004 - RNA, 64 nt, Human
uuucacugucaggacccccggucacacaggaaccacccgccaggggagccugugacugucaguu

SEQ ID NO: 7005 - RNA, 64 nt, Human
accuggggccucggggcgggcuccccucucgccaacccgccaaccgcgagagacccaggcuggc

SEQ ID NO: 7006 - RNA, 64 nt, Human
ugccucagccuccugaguagcugggaugacaggcacccgccaccacacccagcuaauuuuugua

SEQ ID NO: 7007 - RNA, 64 nt, Human
cagcucggccccucuuucccugucgccugcagccacccgccaagcauaguucagggccacgcgc

SEQ ID NO: 7008 - RNA, 64 nt, Human
caaauaacucguugccuuaaccgcaucacuccccacccgccacccacccuggagcccgccggcc

SEQ ID NO: 7009 - RNA, 64 nt, Human
ugucucagccucccgaguagcugggacuacaggcacccgccaacacgcccggcuaauuuuuugu

SEQ ID NO: 7010 - RNA, 64 nt, Human
ugccucagccuccugaguagcugggacuacaggcacccgccaccaugcccagcuaauuuuugua

SEQ ID NO: 7011 - RNA, 64 nt, Human
caccucagccuccugaguagcugggauuacaggcacccgccaccacguccagcuaauuuuuaua

SEQ ID NO: 7012 - RNA, 64 nt, Human
agacuccaacuuccccuccaaaccccgaagugaaacccgccaccggguuacccccacaaggggg

SEQ ID NO: 7013 - RNA, 64 nt, Human
ugccucagccucccaaguagcugggacuacaggcacccgccacuacgccuggcuaauuuuuugu

SEQ ID NO: 7014 - RNA, 64 nt, Human
gggcucaaugcaaagguggcagacauuuauggacacccgccacguggucccggaguggaacggu

SEQ ID NO: 7015 - RNA, 64 nt, Human
cagguccgggagggcuggggcuucggggagcccuacccgccaaaccugcuguuggcccgggaga

SEQ ID NO: 7016 - RNA, 64 nt, Human
cugccucagccuccugaguagcugggauuacagcacccgccaccaugccgagcuaauuuuugua

SEQ ID NO: 7017 - RNA, 64 nt, Human
ugggcacugguccgcugacugccaggcugaagggacccgccaaggacugaacggguaagagaag

SEQ ID NO: 7018 - RNA, 64 nt, Human
agacaugucuagggugagaccagugcucagcaccacccgccaaggaacacugaugaguuguggg

SEQ ID NO: 7019 - RNA, 64 nt, Human
ccggccacugccgcacacccacccagagcacgccacccgccaugggagugugcucaggagucgc

SEQ ID NO: 7020 - RNA, 64 nt, Human
ugccucagccucccgaguagcugggauuauaggcacccgccaccaugucuggcuuuuaguagag

SEQ ID NO: 7021 - RNA, 64 nt, Human
uguggcacacaaugcuuauucacuagugugucccacccgccagccccacagaugacuggaggaa

SEQ ID NO: 7022 - RNA, 64 nt, Human
ugucucagccucccaaguagcuggaauuacagggacccgccaccacgcccggcuaauuuuuuug

SEQ ID NO: 7023 - RNA, 64 nt, Human
ugccucagccuccugaguagcugggacuacaggcacccgccaccacacccggcuaauuuuugga

SEQ ID NO: 7024 - RNA, 64 nt, Human
uucaaaauauuuccauucaaaaugugguucacagacccgccacaucagcaccauccgagagcuu

SEQ ID NO: 7025 - RNA, 64 nt, Human
accuccgugaugucuacugugccucaggauaaggacccgccaugcccuggcuagacagugugug

SEQ ID NO: 7026 - RNA, 64 nt, Human
uggaugcucaaggcccugcccccagcccugcaggacccgccacaugugcccccgagggucccac

SEQ ID NO: 7027 - RNA, 64 nt, Human
cuacccacugccuccccauccccgcuggccccagacccgccaaggaucauccugccuacgguaa

SEQ ID NO: 7028 - RNA, 64 nt, Human
gcugccugcucuuccuuaagauggccuccccccgacccgccacggcccucaguugccagggaug

SEQ ID NO: 7029 - RNA, 51 nt, Human
ucuuccaucgcccugccuagcacccgccagcacacccuuagccuccagcac

SEQ ID NO: 7030 - RNA, 64 nt, Human
accuggccccgcuggugaccgacgcggacaacugacccgccaggcgggagcggccccacacgug

SEQ ID NO: 7031 - RNA, 64 nt, Human
uggauucuucuccagaccccccugcuucaggaacacccgccagggcccaccccucccaccccgu

SEQ ID NO: 7032 - RNA, 63 nt, Human
uuuuuuuuucucuuuuugguggugguuaaaagggaacacaaaacauuuaaauaaaacuuucca

SEQ ID NO: 7033 - RNA, 63 nt, Human
uuaacauggauuaaugugggaacuuggcuucaagaacacaaccuuaggaccuugggccccaaa

SEQ ID NO: 7034 - RNA, 63 nt, Human
uaaaaaaauuacuguagaaauauugaauaacuagaacacaagccacuguuucagcuccagaaa

SEQ ID NO: 7035 - RNA, 63 nt, Human
acaguguguacuguuuugccacauacuucuaaagaacacaauuuuauauaauuuugaaaucau

SEQ ID NO: 7036 - RNA, 63 nt, Human
aggcugcugcuaaaguggauccugagccuagaagaacacaaauggccaaauauuucccuuccg

SEQ ID NO: 7037 - RNA, 63 nt, Human
agcuugcuauuuuuauaacauggugauugaguugaacacaaucaaaguacaguaguaacugau

SEQ ID NO: 7038 - RNA, 63 nt, Human
guaaucccagcacuuugcggggccgaggcaggggaacacaaggucaggagaucaagacugucc

SEQ ID NO: 7039 - RNA, 63 nt, Human
caacauggugucccuuaagcuucuaggcuuucagaacacaacuuaaacuugaacucuuauggu

SEQ ID NO: 7040 - RNA, 63 nt, Human
cauggaguauagugcaaauucauuuuuaagauagaacacaaaacuugaaagaaguuuuaugcg

SEQ ID NO: 7041 - RNA, 63 nt, Human
cucucagcguauuugggucuucuuugcccaaaagaacacaaaagccuuuuuccauuguaugga

SEQ ID NO: 7042 - RNA, 63 nt, Human
uguuguuuaagcauuuuuuuaaggugaacaaaugaacacaauguaucuaccuuugaacuguuu

SEQ ID NO: 7043 - RNA, 63 nt, Human
uucucggcuucugguuuuucuuucuuuuugguagaacacaacaucuaccauucaguuaaaccu

SEQ ID NO: 7044 - RNA, 63 nt, Human
gccagugucucuguagcccugacauaaggaacagaacacaacaaaacacagcaaaccaugugc

SEQ ID NO: 7045 - RNA, 63 nt, Human
gucuagcaugugggaggcugaggauggagcugggaacacaaaggcagcugauaagcagguucu

SEQ ID NO: 7046 - RNA, 63 nt, Human
ccuuggacacuggguuaauucuguuugccccuggaacacaaucacguaaguuuccuucuagac

SEQ ID NO: 7047 - RNA, 63 nt, Human
gagacuguagauugcuucuguaguacuccuuaagaacacaaagcggggggaggguuggggagg

SEQ ID NO: 7048 - RNA, 63 nt, Human
caugaauauauuauguuuauacaaaaucaaucugaacacaauucauaaagauuucucuuuuau

SEQ ID NO: 7049 - RNA, 63 nt, Human
uguguuggugcuuuagcgauugauugauguacagaacacaaaugucuaguuucuagugucacu

SEQ ID NO: 7050 - RNA, 63 nt, Human
ccuaacccuuccuuauuuagccuaggaguaagagaacacaaucucuguuucuucaaugguucu

SEQ ID NO: 7051 - RNA, 63 nt, Human
gccaaagugccaguuucuuuaauaugugaccaagaacacaaggagcauccauauggccaaaua

SEQ ID NO: 7052 - RNA, 63 nt, Human
aaggacauauuuugauaaaguauuauuuguaaugaacacaagccucucuugaguagaagucua

SEQ ID NO: 7053 - RNA, 63 nt, Human
uuuauuagugaaguaugcacuaaucaauacuuugaacacaaagccuguguuacugauuuggcc

SEQ ID NO: 7054 - RNA, 63 nt, Human
cauuugauaaguuggauguuccauuacauagaggaacacaaaauuccaggguuuuuggaggaa

SEQ ID NO: 7055 - RNA, 63 nt, Human
ugcucugucaccuaggcuagaguggaguggcaugaacacaacgcacugcagccucuaccuccu

SEQ ID NO: 7056 - RNA, 63 nt, Human
gcuguucugaauuuauccacaguaauauagucugaacacaaauaguuuacuuaacuuauccuu

SEQ ID NO: 7057 - RNA, 63 nt, Human
guggaggagcucaggacacuaauacaccagguagaacacaaggucauuugcuaacuagcuugg

SEQ ID NO: 7058 - RNA, 63 nt, Human
aucuagagguaaucuggcagucuugugaaaaccgaacacaacucagaaacuuggaaucguuuu

SEQ ID NO: 7059 - RNA, 63 nt, Human
auguccugguguucuguugauuuaggugcuugggaacacaaugcucccaguucuguuaggaca

SEQ ID NO: 7060 - RNA, 63 nt, Human
agggaaaaguugcaagaaugcugaaaaaaaauugaacacaaucucauugaggagcauuuuuua

SEQ ID NO: 7061 - RNA, 63 nt, Human
acacagucagggcggggcuggccagcugugcgagaacacaagccacgccugcgauggugcugc

SEQ ID NO: 7062 - RNA, 63 nt, Human
uuauuacuaugaaauggauggaauaaggagggggaacacaacuagcaagaacaaaacauuggg

SEQ ID NO: 7063 - RNA, 63 nt, Human
ucuugucuuaugucuugaccuguuucugagugcgaacacaaaccagguguuucugucucuuuc

SEQ ID NO: 7064 - RNA, 63 nt, Human
gcugugaugcuaguguugauuuugcucucagaugaacacaaugucucauacuaaccaagaagc

SEQ ID NO: 7065 - RNA, 63 nt, Human
cucccugcagggccccuguuccaaugaaaaacagaacacaaaagagcagagcaccuaagccug

SEQ ID NO: 7066 - RNA, 63 nt, Human
aacauauuugaaacucagggggaacaugauuaagaacacaaacugguagcuacacaugaaggu

SEQ ID NO: 7067 - RNA, 63 nt, Human
cuggguguauucuaguguggaacaaaaaacagugaacacaagugcuuacuuguggauacuauc

SEQ ID NO: 7068 - RNA, 63 nt, Human
uguaaaccaauuuuuuguucuucagagaucauggaacacaaacacauuguuauuuucagugau

SEQ ID NO: 7069 - RNA, 63 nt, Human
cuacaucuaagcuguucccgaaagaguguuacagaacacaacaguauuguacaauauucgaua

SEQ ID NO: 7070 - RNA, 63 nt, Human
cccugcccucaaaacacagugauguucagaacagaacacaagguaagcccuuuccaauuugug

SEQ ID NO: 7071 - RNA, 63 nt, Human
gaaggaugccauauauguuguugccaacacuuggaacacaaugacuaaagacauaguugugca

SEQ ID NO: 7072 - RNA, 63 nt, Human
aaagcaaaacaaacaaacaaaaacaaauuuuaagaacacaacaaaaaagauuugacuuccgaa

SEQ ID NO: 7073 - RNA, 63 nt, Human
cuucaggcuugggucaucaagaugcacagcauggaacacaagcuccucuggauccugcagcug

SEQ ID NO: 7074 - RNA, 63 nt, Human
ggaacagaccagccacugcagcagacagaccaggaacacaaugagacugacauuucaaaaaaa

SEQ ID NO: 7075 - RNA, 63 nt, Human
aaugguuccauuuugcccaguguuguaccacaagaacacaacaccuugccaguaucucaggca

SEQ ID NO: 7076 - RNA, 63 nt, Human
auuguugguguuaauugaaaguauaauuugcuggaacacaaagaccaaaaugaaaguuuuuuc

SEQ ID NO: 7077 - RNA, 63 nt, Human
guuauaucauucacuuuugaaauaaaccaucgagaacacaaaaugacaagugaguuagguugg

SEQ ID NO: 7078 - RNA, 63 nt, Human
ucagucaccuguucagccggcacugagaagaacgaacacaagaaaaagauaagaaauacuaga

SEQ ID NO: 7079 - RNA, 63 nt, Human
acccaguggaggcuuaaaaaaaaaaaaauccaagaacacaauucauuuucaccaccucuggug

SEQ ID NO: 7080 - RNA, 63 nt, Human
ugcaggguuugauggagccucauuucccuuugugaacacaaagugcaaaaugaauucuuuuua

SEQ ID NO: 7081 - RNA, 63 nt, Human
gccagaauuagcacuggggaaaacuggccaggggaacacaaagcaggagacagccugcguuaa

SEQ ID NO: 7082 - RNA, 63 nt, Human
uuuggaguucacuggauuugguugaccuuuguggaacacaaauaaugaaggagcagaacauug

SEQ ID NO: 7083 - RNA, 63 nt, Human
agggcuuaaccugcuagaaaaugcauggaaugugaacacaaguuaauuauuucaaaauguuuu

SEQ ID NO: 7084 - RNA, 63 nt, Human
uguuaacuuugacagcugagagugggcuugcaagaacacaaucuaaaaguguguuucaauuga

SEQ ID NO: 7085 - RNA, 63 nt, Human
guuuaccccaaaacaagugucaauuaagaauuugaacacaaccacauuuuuuaaaaugaaacu

SEQ ID NO: 7086 - RNA, 63 nt, Human
uuguuuuuacuuuuuuuuugucaucgcacuauggaacacaaauggaauucucuuaauuuauaa

SEQ ID NO: 7087 - RNA, 63 nt, Human
aaaauugaagagccuuuucauguauuaaauaaugaacacaaauuauauaauuaaaauaauugg

SEQ ID NO: 7088 - RNA, 63 nt, Human
uaacggagacaaaggaugguauuuaaaaauguagaacacaaugaaauuuguaugccuugauuu

SEQ ID NO: 7089 - RNA, 63 nt, Human
ucaagcaagaugaaaagguaauuuuaaauuagagaacacaaauaaaauguauuagugaauaaa

SEQ ID NO: 7090 - RNA, 63 nt, Human
ccuacggcauaaaaacaccaaggaaauaucaaagaacacaacgcagguaaauuaacaguauau

SEQ ID NO: 7091 - RNA, 63 nt, Human
uagguacauaagugaaagaagucucaguucagugaacacaaaacuuauuuaaagaugcuuuau

SEQ ID NO: 7092 - RNA, 63 nt, Human
uucgcaucagaauaacaugaguaagaugaacuggaacacaaaauuuucagcucuuuggucaaa

SEQ ID NO: 7093 - RNA, 63 nt, Human
gacuaaugcauauuaugaauugaguccacaaaggaacacaaaacucuuuguaauucuguuaaa

SEQ ID NO: 7094 - RNA, 63 nt, Human
uucaguuccucauuuuucuaguucccacaggaggaacacaaagggcccaugaugaaagccugc

SEQ ID NO: 7095 - RNA, 63 nt, Human
acauaccaaaaaauaacaccaaaaccucugucagaacacaaaggaaugugcauaauggagaga

SEQ ID NO: 7096 - RNA, 63 nt, Human
gcaccauuggucucuggguagugcuuuaagaaugaacacaaucacguuauaguccauggucca

SEQ ID NO: 7097 - RNA, 63 nt, Human
acugagcuuccuuauguuucacacauuguauuugaacacaaaacauuaacaacuccacucaua

SEQ ID NO: 7098 - RNA, 63 nt, Human
uuaaguguuacuguuucugccuguuaaugcugggaacacaaauagugcaauuugugcaauugg

SEQ ID NO: 7099 - RNA, 63 nt, Human
gacaccuaaguuuaccaacauguuaauaaacaggaacacaaauacauuucaguuggauaaucu

SEQ ID NO: 7100 - RNA, 63 nt, Human
cauagcccugcaaagagaucuggccccagcagugaacacaaacucaguaauucucuuuagagu

SEQ ID NO: 7101 - RNA, 63 nt, Human
augagaaucuguucaccaaaccaaauguggaaagaacacaaagaagacauaagacuucaguca

SEQ ID NO: 7102 - RNA, 63 nt, Human
aaagaaacuuaaaguaaugcccaauuauuaaaugaacacaagagcugagaugucacauucguc

SEQ ID NO: 7103 - RNA, 63 nt, Human
gaaaaaaauacaacuaaugaugcacauuucuuagaacacaauaguccauugauauacuacugc

SEQ ID NO: 7104 - RNA, 63 nt, Human
accacugccaagugaucacucuuaggcccaggggaacacaaugacuaucauuacugaugcaga

SEQ ID NO: 7105 - RNA, 63 nt, Human
ugaucgcacacaugcuuuguuuggauauggagugaacacaauuauguaccaaauuuaacuugg

SEQ ID NO: 7106 - RNA, 63 nt, Human
uuuauaaagcaguuuagguauggugauuuagcagaacacaagagagcaagaaaaugucacauc

SEQ ID NO: 7107 - RNA, 63 nt, Human
guaaaaccagugcauuucagcuugcaaguuacugaacacaauaaugcuguuuuaauuuuguuu

SEQ ID NO: 7108 - RNA, 63 nt, Human
aucuuuagauucuuguuuagaacuguugauuuugaacacaacauacacugucaaacuuuacau

SEQ ID NO: 7109 - RNA, 63 nt, Human
gaaugcuuuuccacguagacuuaucuggaaugugaacacaacucuuugguuaauaguaaaugc

SEQ ID NO: 7110 - RNA, 63 nt, Human
ugauuucaaaaucugggggcgagcaaccucaaggaacacaauuucccucccuaucaacaagag

SEQ ID NO: 7111 - RNA, 63 nt, Human
ccaagugcuggcaccuacuugcucagugaucaugaacacaauuuuaaaucuuucugaaucuca

SEQ ID NO: 7112 - RNA, 63 nt, Human
aaacacuuaggacugaacugaaccccuccccaugaacacaaggguuuuauccuuuccuuuaaa

SEQ ID NO: 7113 - RNA, 63 nt, Human
aagcaauuacuacaaauggaugacacauuuaaugaacacaauuuuauuuuuuuucuguaacug

SEQ ID NO: 7114 - RNA, 63 nt, Human
gaaauugucuuugguguuuagaggagggaaugagaacacaaauuggauaauccacugucuccc

SEQ ID NO: 7115 - RNA, 63 nt, Human
uuguuuaagguuuccucaaacugugauuuuucugaacacaauaaacuauuuugaugaucuugg

SEQ ID NO: 7116 - RNA, 63 nt, Human
accucucuucagccccuagugcuauucuguguugaacacaauugauacuucaggugcuuuuga

SEQ ID NO: 7117 - RNA, 63 nt, Human
uguggguuuugugccuuauaaauggaaauguaugaacacaauauaugcucauguagaauuuuc

SEQ ID NO: 7118 - RNA, 63 nt, Human
ucagcgacugaggcuggaagaugauauggauuggaacacaaaaaaucuuuuuuuaaucuuuuu

SEQ ID NO: 7119 - RNA, 63 nt, Human
gcacuggaccuccugucuguccgugaggcugcagaacacaaggcagcucccaaugccgcugga

SEQ ID NO: 7120 - RNA, 63 nt, Human
acuaguaacagcaggccuuuugcguuuacaauggaacacaaucaccaagaaauuagucagggc

SEQ ID NO: 7121 - RNA, 63 nt, Human
gagcgacugucgagaucgccuaguauguucugugaacacaaauaaaauugauuuacugucugc

SEQ ID NO: 7122 - RNA, 63 nt, Human
auuaaguucuucauucacuaaggaaggaauugggaacacaaagggugggggcaggggaguuug

SEQ ID NO: 7123 - RNA, 63 nt, Human
auuuacagauuuacuacagguauucugaaccaggaacacaaucagguuucaggccaguuugau

SEQ ID NO: 7124 - RNA, 63 nt, Human
accauuggacagauuucaguaaugucuucaguggaacacaaaugaaaaugaauagcuuguuuc

SEQ ID NO: 7125 - RNA, 63 nt, Human
uacuguacaguuaaucuuauuugccaucaucuugaacacaaaauguguauuuagaauauuugu

SEQ ID NO: 7126 - RNA, 63 nt, Human
cugauucuuuaaaaguaguuauugggaguagaagaacacaauauaaauauuuccguguaauag

SEQ ID NO: 7127 - RNA, 63 nt, Human
auaauaaauuuaaaaucuaaaauguaaaauuuugaacacaacacuggaaaggguauccacagc

SEQ ID NO: 7128 - RNA, 63 nt, Human
cacuaaguccaagugugagccauucacagacuagaacacaaggagggagagagacucuuaaac

SEQ ID NO: 7129 - RNA, 63 nt, Human
agaauuuuaauuuguaaagaauugagccacauugaacacaauugaaugagauucagaauaaac

SEQ ID NO: 7130 - RNA, 63 nt, Human
cugaccaauauggagaaacccugucucuacuaagaacacaaaauuagcugggcaugguggugc

SEQ ID NO: 7131 - RNA, 63 nt, Human
uagccagcagggaccuaaacuuuggcaaaaagugaacacaauucaaauacgaaugaaggaaga

SEQ ID NO: 7132 - RNA, 63 nt, Human
aauauuggauucauuuuaucgagaugccaagaugaacacaaugugaauaucauuuccauuucu

SEQ ID NO: 7133 - RNA, 63 nt, Human
gaguuuccaucccaacaugauggacuuugguuugaacacaauucguuuuuucauuugaauugg

SEQ ID NO: 7134 - RNA, 63 nt, Human
ggcaaagcuucuaccugauccucaaaacucauugaacacaagaaaauucauacuggagagaaa

SEQ ID NO: 7135 - RNA, 63 nt, Human
accccacgaccuuggcccgagccccuccgugaggaacacaaucucaaucguugcugaauccuu

SEQ ID NO: 7136 - RNA, 63 nt, Human
auuucacagauaaacuguaacaggugaacaggugaacacaaacaugagggaggguuggagucu

SEQ ID NO: 7137 - RNA, 63 nt, Human
auauuuuuggaaaagcaugaucaugcuugucuagaacacaagguaugguauauacaauuugca

SEQ ID NO: 7138 - RNA, 63 nt, Human
caguuguuacccuagcaaggcuagggagggcaugaacacaaacauaagaacuggucuucuaca

SEQ ID NO: 7139 - RNA, 63 nt, Human
gguucucuugcaguuucugguggcaucucaggggaacacaaagcuaugucuauuccccaauau

SEQ ID NO: 7140 - RNA, 63 nt, Human
acaccuccaguuuuugcucuuuuguguuguacugaacacaauauuuguguuuuuauuauuuau

SEQ ID NO: 7141 - RNA, 63 nt, Human
uuucucacuggaggcuggaaugaaugaucacuagaacacaaaagagugaaugaugacacuuga

SEQ ID NO: 7142 - RNA, 63 nt, Human
uucguaugauuuaauugagccaaauuugggucagaacacaaauuugaagaugacuuuucagua

SEQ ID NO: 7143 - RNA, 63 nt, Human
gcaggcacauccacuugguuggggacccagauggaacacaaagggagaagacaagcaaauucu

SEQ ID NO: 7144 - RNA, 63 nt, Human
gccuacaugccacuuacguuuuaaguuauuuaggaacacaaaggacagacaaaaaagccauau

SEQ ID NO: 7145 - RNA, 63 nt, Human
auaugugaagcauugggucgggaacuagcuguagaacacaacuaaaaacucaugucuuuuuuc

SEQ ID NO: 7146 - RNA, 63 nt, Human
cagcugugaacugcaugaaauguauugugaaacgaacacaagauuaagcuuugucagguuaau

SEQ ID NO: 7147 - RNA, 63 nt, Human
aacagugucaguuuaggaaauuauuacuacuuugaacacaaacugaaauugcaacuuugccuu

SEQ ID NO: 7148 - RNA, 63 nt, Human
ugcuuuuucacuguuuccuauuaaucuucagcugaacacaagcaaaccuucucaggagguguc

SEQ ID NO: 7149 - RNA, 63 nt, Human
gcgcuugaugguuuaguggaucgacucaacucagaacacaagcuuggaaaguguuagggguuu

SEQ ID NO: 7150 - RNA, 63 nt, Human
uuaucauaaauucacaaaauauuuuugcaaccagaacacaaaagcaggcuagucagcuaaggu

SEQ ID NO: 7151 - RNA, 63 nt, Human
uuaaagacuuuuggaaauuuggcugaacaauuagaacacaacaggccaacucauacucauuug

SEQ ID NO: 7152 - RNA, 63 nt, Human
acugguuuuguucugaauaguacagauugaugugaacacaaagcauuuuguguaaggagaacc

SEQ ID NO: 7153 - RNA, 63 nt, Human
cgauuaaaguugccaaauugauuacuggauccagaacacaauuuuccccucagaacagauaga

SEQ ID NO: 7154 - RNA, 63 nt, Human
cuuugcugcuguuggacacuccgucaccuuuuggaacacaaguauaucaagauaguggcuacu

SEQ ID NO: 7155 - RNA, 63 nt, Human
aaggaaaaaaagaaaaaaggaaaaaaacaguuugaacacaaaggcucuauggaagaaaugccu

SEQ ID NO: 7156 - RNA, 63 nt, Human
uccuguguaauuuggguagauuuucaagagugugaacacaaauuuaaaauaagcuauaaucag

SEQ ID NO: 7157 - RNA, 55 nt, Human
guuugcaagugacagcauaaagacggaacacaacaaauccuuccugaagugaauu

SEQ ID NO: 7158 - RNA, 63 nt, Human
agugaacacauuuacacauaucaauuucuuaaagaacacaaaauguuuccucccuagcaaaac

SEQ ID NO: 7159 - RNA, 63 nt, Human
auaacauuuuucauuaaagcaucugagaucuaagaacacaauuauuauucuaacaaugauuau

SEQ ID NO: 7160 - RNA, 60 nt, Human
aucuuuacagauucauuuaagccaucagacgaacacaagagaggcucaaacaagaaauuc

SEQ ID NO: 7161 - RNA, 63 nt, Human
ccacugucauauuuuguuaauaaaauuuuauuggaacacaaucacauucauuuguuuacuuac

SEQ ID NO: 7162 - RNA, 63 nt, Human
ccacugucauauuuuguuaauaaaauuuuauuggaacacaaccacauucauuuguuuacuuac

SEQ ID NO: 7163 - RNA, 63 nt, Human
uccguucaugcauggacaccagaagacgauucagaacacaagaggagaaugagcuggagcgcc

SEQ ID NO: 7164 - RNA, 63 nt, Human
uaauaauuacaaauauccgaaagucauuucuuggaacacaaguggaguaugccaaauuuuaua

SEQ ID NO: 7165 - RNA, 63 nt, Human
uacgagugcuaaguguaggauauuuugucaccagaacacaaugcuaccgccccaaaguaaaag

SEQ ID NO: 7166 - RNA, 63 nt, Human
uguaauacgugugcauaaaaauuaaauagaggugaacacaauuauuuuaaggcaguuaaauua

SEQ ID NO: 7167 - RNA, 63 nt, Human
uagaauaaaauguugauaaggcacugccucuuagaacacaaacagaauauugcaaaugcauuu

SEQ ID NO: 7168 - RNA, 63 nt, Human
gcauauccuauuuccaggcaggcucucuuacuugaacacaaauccaaaaacuaauuuagaguc

SEQ ID NO: 7169 - RNA, 63 nt, Human
guucguagagcaguuauuugaaaaacaguuauggaacacaaaacauuuuauagauuuaauauc

SEQ ID NO: 7170 - RNA, 63 nt, Human
cagucuagguugaaagauaggcagccuuacccagaacacaacauuagcagcugggaagguguc

SEQ ID NO: 7171 - RNA, 63 nt, Human
ugcacuggccuugcucucccgcacgaggacggagaacacaaacuccgcaucugugggucaggc

SEQ ID NO: 7172 - RNA, 63 nt, Human
uuauuauuucucaauaugcgaacacaguauuuagaacacaauauuagaaacacaauucuaacu

SEQ ID NO: 7173 - RNA, 63 nt, Human
auaaacuaugaauggcuauucuuauauaguuuagaacacaacuaauccauacuuuauugugga

SEQ ID NO: 7174 - RNA, 63 nt, Human
ucaccaucuauacacccuguauguccagcuuuugaacacaagggaaccaugcuucucuuagag

SEQ ID NO: 7175 - RNA, 63 nt, Human
aagcaaaguuuggggagggcugacgauuuuguagaacacaacagugacaauuuuuuuuaaaag

SEQ ID NO: 7176 - RNA, 63 nt, Human
uugcaauuagugguuagggaaaagccucaggcagaacacaaauagaaauuuaaugauguguuc

SEQ ID NO: 7177 - RNA, 63 nt, Human
guucugcugaggaaauggguaugaaugugccuugaacacaaagcucugucaauaagugauaca

SEQ ID NO: 7178 - RNA, 63 nt, Human
ccccucuccuuucuccuggcagcagaaaaggaagaacacaagagcaaacacacaacaaugaug

SEQ ID NO: 7179 - RNA, 63 nt, Human
ccuauuucccuagauucuauuuucugaacuugggaacacaaugccuacuucaaggguauggcu

SEQ ID NO: 7180 - RNA, 63 nt, Human
guuaggaaacagugagcuccggccccaccucgugaacacaaagccucggaucagccuugagag

SEQ ID NO: 7181 - RNA, 63 nt, Human
aauaaauguaaaauaugacuaaaguuuucauuggaacacaauguagacaggagguuuauuaug

SEQ ID NO: 7182 - RNA, 63 nt, Human
uaaugaauuuuuaucuuauguaaauuauuuuuagaacacaaguugggaaauguggcuucuguu

SEQ ID NO: 7183 - RNA, 63 nt, Human
gcucaauagcaucuuaacgugaagaucaaacaagaacacaacaagccccuacugauuucuggg

SEQ ID NO: 7184 - RNA, 63 nt, Human
acuauguuaguaucuaacacacuccuggauacagaacacaagucuuggcacauaugugaugga

SEQ ID NO: 7185 - RNA, 63 nt, Human
aaauacucuauuguucaauucucuaaaaucccagaacacaaucagaaauagcucaggcagaca

SEQ ID NO: 7186 - RNA, 63 nt, Human
gcaaccaaacuuacuacuagccugcaaugcaaugaacacaagugguugcugagucucagccuu

SEQ ID NO: 7187 - RNA, 63 nt, Human
cuacagugccugguagacaagugcuacauugaagaacacaaaccucuuguuaagacuuguccu

SEQ ID NO: 7188 - RNA, 63 nt, Human
uaucgaugacuugguggcuuuuccuugaauccagaacacaaccuuguuugugguguccccuau

SEQ ID NO: 7189 - RNA, 63 nt, Human
uaugcugggcacugccagacugaaccagagcuggaacacaauaauguguccuucuacauuuua

SEQ ID NO: 7190 - RNA, 63 nt, Human
gauguuuaaaaacuggaggucuccugauaaggagaacacaauccaccauugucauuuaaguaa

SEQ ID NO: 7191 - RNA, 63 nt, Human
accuucuaauugguuuuuacugaaacauugagggaacacaaauuuaugggcuuccugaugaug

SEQ ID NO: 7192 - RNA, 63 nt, Human
gcuuuuaguuguaugagucucuuucuaugaacugaacacaaaacucaggaauugguggcuuaa

SEQ ID NO: 7193 - RNA, 63 nt, Human
cugcagugcuguaaacuuaacuguucuuugccagaacacaagacaccaaauugaacucacugc

SEQ ID NO: 7194 - RNA, 63 nt, Human
cuucauuaccuuuuuuauucagaacgaggaagagaacacaaggaaugauucaagauccaccuu

SEQ ID NO: 7195 - RNA, 63 nt, Human
gucugugugaggugcuuaaccuaucagcccugagaacacaaagcaauaaucuuuguuacugag

SEQ ID NO: 7196 - RNA, 63 nt, Human
uugaucuuuucuuuagauugaaagucugucucugaacacaauuauuuguaaaaguuaguaguu

SEQ ID NO: 7197 - RNA, 63 nt, Human
ucagauuuuauuugugugacuuagaaauuccaggaacacaauuaggauauuuucauacacaua

SEQ ID NO: 7198 - RNA, 63 nt, Human
cuuugcaagauggcugaggagaaagcacacugggaacacaauccagaauguucuaacaauaag

SEQ ID NO: 7199 - RNA, 63 nt, Human
aucagcacaaagaagcaaucaucaaauaauucugaacacaaauuuaauauuuuuuuuucugaa

SEQ ID NO: 7200 - RNA, 63 nt, Human
ucauuggcuugguauuuccuaaauguuuaacaagaacacaaguguuccugauaagauuuccua

SEQ ID NO: 7201 - RNA, 63 nt, Human
aggaagauaggacguauuuauaauagguauauagaacacaagggauauaaaaugaaagauuuu

SEQ ID NO: 7202 - RNA, 63 nt, Human
gcugcuuugcaaugaauuuccuuuaccuuucuggaacacaagcugcugugaaccaaacugaua

SEQ ID NO: 7203 - RNA, 63 nt, Human
cagucagacugggcugguaguaagcugccgguggaacacaaucauuugcccuggguguccuug

SEQ ID NO: 7204 - RNA, 63 nt, Human
ugcguuaggaugcucugaucugacauuugacaugaacacaaaguugcuagaugcucuuguuga

SEQ ID NO: 7205 - RNA, 63 nt, Human
ccaguuguucuugaugaaucuauaugagucauagaacacaaaucuauugacggaagucauuag

SEQ ID NO: 7206 - RNA, 63 nt, Human
gugauaucugauggcuugaacuugcccacaguugaacacaagugcugucauugcauuucuucc

SEQ ID NO: 7207 - RNA, 63 nt, Human
ugauugaacuuuucaagacauuggaaacaaauagaacacaauauaauuuacauuaaaaaauaa

SEQ ID NO: 7208 - RNA, 63 nt, Human
uuaggaggacaguuuuaaugauuguacuugcaugaacacaaucauaugaugguaaagcagaaa

SEQ ID NO: 7209 - RNA, 63 nt, Human
gaauagcuaaugacacagaaguagaucaaaauagaacacaauagagaacuucaaaauaaaaca

SEQ ID NO: 7210 - RNA, 63 nt, Human
gaacagcaaaaucaagcacugcuuuaugggcaggaacacaagagaaagcaaacugcccaagaa

SEQ ID NO: 7211 - RNA, 63 nt, Human
uguaagccguggcuauaguuuuaucaagacucugaacacaagauguaacaaugcaaauaaauu

SEQ ID NO: 7212 - RNA, 63 nt, Human
agucaccuccauucucuaccucccaugcagcaugaacacaauuucucuccaccuggcucccaa

SEQ ID NO: 7213 - RNA, 63 nt, Human
cuugaccuucaaaaaaauuuguuuuucagaauagaacacaauaggacagugacugcacaguug

SEQ ID NO: 7214 - RNA, 63 nt, Human
ggguuggguauuuagaaauguagguggcauuuagaacacaauguuuaaucaaugggcugaaca

SEQ ID NO: 7215 - RNA, 63 nt, Human
uacgccuuuggaauugcucuucauucagaagaggaacacaaaggaagccacccaggaaggaag

SEQ ID NO: 7216 - RNA, 63 nt, Human
aggucugaaccuccgaaugccuuuuauuugggggaacacaaaaccaaacagcagauguuuugg

SEQ ID NO: 7217 - RNA, 63 nt, Human
aagagaaaucaacuucgugguuggauggggccggaacacaaccagucuuuuuguauuuauugu

SEQ ID NO: 7218 - RNA, 63 nt, Human
uuuucaucaagcaacagaggaccaaugcaacaagaacacaaaugugaaaucaugggcugacug

SEQ ID NO: 7219 - RNA, 63 nt, Human
gaugguguacucuaauuuuuuaaaacaguaauggaacacaauuuuuuucauucuuccuccucu

SEQ ID NO: 7220 - RNA, 63 nt, Human
ccuaggguccaacugcuuauucuuccaacuguggaacacaaggggagucucagcaucuggucc

SEQ ID NO: 7221 - RNA, 63 nt, Human
gcuucugagagcaaagaaaagucuucugugugggaacacaagauaguaaacuuauuuaaaaac

SEQ ID NO: 7222 - RNA, 63 nt, Human
uaaucauccuuaauccuuaucuuagggauacuugaacacaaacacugugguaggauaacagua

SEQ ID NO: 7223 - RNA, 63 nt, Human
gaaacccuugauagaaacuggaagccugccauggaacacaauacuuugggcaauaaucagaaa

SEQ ID NO: 7224 - RNA, 63 nt, Human
uugguaagagaaagcaggucuuaaugucugccagaacacaauuuauaugccuuauuggcuuca

SEQ ID NO: 7225 - RNA, 63 nt, Human
caaccugcggaaggagguucucccagcccaucugaacacaaccagagguggcaggagaauuuc

SEQ ID NO: 7226 - RNA, 63 nt, Human
cuucucuugucgguguaugccaucugaaccuaggaacacaaaguauauuggccucaaacggag

SEQ ID NO: 7227 - RNA, 63 nt, Human
uugcacaagguguguguaguaaguuaaauuguugaacacaaaaauguugcugcuugaggcaua

SEQ ID NO: 7228 - RNA, 63 nt, Human
ucauuucacugggauuuugaagcauuucugucugaacacaaagccuguucuaguccuggcgga

SEQ ID NO: 7229 - RNA, 63 nt, Human
aggguucuuaaaaucaaguaucaauacaaaauagaacacaauuaaaaucuuaauuguuggcug

SEQ ID NO: 7230 - RNA, 63 nt, Human
guggaucucuuggcauaaccacugccucccagggaacacaaggccuuugccauuggucgcagg

SEQ ID NO: 7231 - RNA, 63 nt, Human
ugcugcguagaauaugaauugauuuuggaaucagaacacaagcaccauacugaaggacuagca

SEQ ID NO: 7232 - RNA, 63 nt, Human
aucuaucauaagcagaccuaagcacaguuuuaugaacacaauuuugcccaugacauugccuac

SEQ ID NO: 7233 - RNA, 62 nt, Human
uagauuuguacagaaaaaaaugauaauaaaugagaacacaaaacauauaauuuaaauuuggu

SEQ ID NO: 7234 - RNA, 63 nt, Human
agaccuggacacaacagacacacaucacaaggcgaacacaaauggacacacauaccuggccac

SEQ ID NO: 7235 - RNA, 63 nt, Human
ccgcugccaggcgagcauguugugguaauucuggaacacaagaagagaaauugcuggguuuag

SEQ ID NO: 7236 - RNA, 63 nt, Human
agaggaggcaggaggagcaacucaaauccccaagaacacaagaagacccauccugaacuggga

SEQ ID NO: 7237 - RNA, 63 nt, Human
agagaccuacuugcacauucuuaaccuguauuugaacacaaaauaucuauacuucaugcucca

SEQ ID NO: 7238 - RNA, 63 nt, Human
caucgggcaaccaaagaaaugaguuuuggggaggaacacaacucccaucccagucaguuuccu

SEQ ID NO: 7239 - RNA, 63 nt, Human
ugacuguaaugaagagacuggcagcaccuccuggaacacaagccuaggugaggcccagucuuu

SEQ ID NO: 7240 - RNA, 63 nt, Human
cugccuuaauuuuugaaaagcugcuaacuacaugaacacaaauguguauuuuuguugcagugu

SEQ ID NO: 7241 - RNA, 63 nt, Human
cagcccggggacuguccuggguggagggcaggugaacacaagcugcugccggggacuguccug

SEQ ID NO: 7242 - RNA, 63 nt, Human
gcugccggggacuguccuggguggacggcaggugaacacaagcggcugccgcauguagccacu

SEQ ID NO: 7243 - RNA, 63 nt, Human
gccgcagggcguguaugagcaguuuugcaaacagaacacaaccacaaugaugguauuuugaaa

SEQ ID NO: 7244 - RNA, 63 nt, Human
ggugacuugggguggacgccucugccuucacuugaacacaaaugugcuuccuauaaaaucaug

SEQ ID NO: 7245 - RNA, 63 nt, Human
ggaggauuuugacccacagaaaaggagcccauggaacacaaguuaaagagguuuugcuggcca

SEQ ID NO: 7246 - RNA, 63 nt, Human
auaacuagguaucuguauaaugcaacaacauuggaacacaauaaagauguauuuuuguaaauu

SEQ ID NO: 7247 - RNA, 63 nt, Human
gacuuguuuacaugugagugaaacugcacaaaggaacacaaaacaaaacuugcacuuuaacgg

SEQ ID NO: 7248 - RNA, 63 nt, Human
ggcaacaguacagucgcgcuuacgaccuggcuagaacacaaggucagaugauaaacagaagca

SEQ ID NO: 7249 - RNA, 63 nt, Human
ggauuuuuccagauaaauuuguacucaaggaaagaacacaagaaguaaguacaaaaguuucug

SEQ ID NO: 7250 - RNA, 63 nt, Human
ggagacccaaggcaucuugaaucccaucuauaagaacacaaucuuccagcauacguuugcuuu

SEQ ID NO: 7251 - RNA, 63 nt, Human
uuaaaaauaauacuuuuagcucuaauagcucaagaacacaauauucguuaauguucaguaaag

SEQ ID NO: 7252 - RNA, 63 nt, Human
ccucgacucuuaguaaauuugagaguuuauauggaacacaaacccuacaaauauaaagaaugu

SEQ ID NO: 7253 - RNA, 63 nt, Human
gcaucagggguguguacucaguauuucaaaucagaacacaagauuggaacuuuuggaaaaaug

SEQ ID NO: 7254 - RNA, 63 nt, Human
aggacaaguuggcgaccuuacuccuccaaaacugaacacaaggggagggaaagaucauuacau

SEQ ID NO: 7255 - RNA, 63 nt, Human
ggagaugacaacugaguggggaaaacagaccgugaacacaaaacaucaaguuccacacacgcu

SEQ ID NO: 7256 - RNA, 63 nt, Human
caccuaaccuugcaaguuuuaccgccuuuugaggaacacaaaucggagaacaaacccaggguu

SEQ ID NO: 7257 - RNA, 63 nt, Human
uuccucccucaauagugaagugucaaccauccagaacacaaggaugcuggcuuucaaagcaac

SEQ ID NO: 7258 - RNA, 63 nt, Human
agauuuauggaaaauacucugacgaguacucuugaacacaaguuccugauaacuuuaagauca

SEQ ID NO: 7259 - RNA, 63 nt, Human
gggugggggcugcggaucccagggacugccccagaacacaaaccuaaguccugugccuguccc

SEQ ID NO: 7260 - RNA, 63 nt, Human
uucguguaaccacugcaaccacauaaaacuaaugaacacaaagucccucaugcuaccuuuuua

SEQ ID NO: 7261 - RNA, 63 nt, Human
uaagcugaaacuaauaauuaggcaaugucaagugaacacaaauucaggaugacagacugcaaa

SEQ ID NO: 7262 - RNA, 63 nt, Human
acaaagcaucaaaagacucacucacaaacuucugaacacaaacuccauggaugaaagcuguuu

SEQ ID NO: 7263 - RNA, 63 nt, Human
agaaaugcaaaccucgacucucaaggaugugaggaacacaaguucauuucuguuguugcggag

SEQ ID NO: 7264 - RNA, 63 nt, Human
cacuuuaccuauacaaaaugacugcuauggugggaacacaauaaacaccaguuuugacuuuua

SEQ ID NO: 7265 - RNA, 63 nt, Human
uccccugcguacuugcucaugggauguugcaaagaacacaaagugugccuuagacauucucaa

SEQ ID NO: 7266 - RNA, 63 nt, Human
ggaucuuuggggaauggcuucaaaauaagucacgaacacaaauucuuuguaaauuauguaaau

SEQ ID NO: 7267 - RNA, 63 nt, Human
cacagcaauaggaagucucuccacaaacuaggggaacacaaauggggucauucacgugccugg

SEQ ID NO: 7268 - RNA, 63 nt, Human
aaaacauggaaacuuagacuuguauaguguaaugaacacaaauaccaaaacugcauuuugguu

SEQ ID NO: 7269 - RNA, 63 nt, Human
guuacugcugcgauugauguaguggagaugccugaacacaauucuauauuuuaguauuuuuua

SEQ ID NO: 7270 - RNA, 63 nt, Human
agugugaaagaaaacacguuucuguaacagagagaacacaaaggccuguggauacucuuaaag

SEQ ID NO: 7271 - RNA, 63 nt, Human
uuggaaagcagugugcauaucuugaggggugaugaacacaagcaaaccaaguugcaccuggcu

SEQ ID NO: 7272 - RNA, 63 nt, Human
auagcacauacccccacccaguaccaaauuucagaacacaagaagguccaguucuucccccuu

SEQ ID NO: 7273 - RNA, 63 nt, Human
cuuggguggguuccuuuggagaagauguggcuggaacacaaacaaucuuugaaagaaauaaau

SEQ ID NO: 7274 - RNA, 63 nt, Human
uuguuaaauugacucuucaaauauauaacauuugaacacaauuguguguguuuugguuaauca

SEQ ID NO: 7275 - RNA, 63 nt, Human
ugaauacuucagaugcuuucaggagugacacaagaacacaaugauuuuugcuuauaaucacuu

SEQ ID NO: 7276 - RNA, 63 nt, Human
ucuuuguagccuaaagaccauuuaaucuugaaggaacacaaagaucaaaugaaaaguaaaaca

SEQ ID NO: 7277 - RNA, 63 nt, Human
uuuguauauuuucugugacuugaaauaaacuuugaacacaauuuuaguacacugcaaauugau

SEQ ID NO: 7278 - RNA, 63 nt, Human
uagacuaagaauaagaagcaucauacuauaacugaacacaauguguauucauaguauacugau

SEQ ID NO: 7279 - RNA, 63 nt, Human
agugaauuuugucaaacaauaaaaaugugucaggaacacaaggaugaaggggaugucauuugc

SEQ ID NO: 7280 - RNA, 63 nt, Human
acugcuuuagcauuaaaaauuguuuugaaagaagaacacaauuuacaauuuuggaaccacuga

SEQ ID NO: 7281 - RNA, 63 nt, Human
auugaaacacucaaaaauaccacuucucaguaugaacacaauugcuaagagccuaauuugguu

SEQ ID NO: 7282 - RNA, 63 nt, Human
aaauaguaggcaagauggcacagggcaugaaaugaacacaaauuaugcuaagaauuuuuuauu

SEQ ID NO: 7283 - RNA, 63 nt, Human
ugugccacgucauccauaguuuauuguuaguaugaacacaacuguaacauuuaccugguaucu

SEQ ID NO: 7284 - RNA, 63 nt, Human
aaacuuauuauauaaacuuucauauuauaggcagaacacaauggcuaaauaucuguugcaugu

SEQ ID NO: 7285 - RNA, 63 nt, Human
uaaaaaaucagggugcgucuuuugggagcuuuagaacacaaggauguuagaaaugucuuaguu

SEQ ID NO: 7286 - RNA, 63 nt, Human
cucagugauacugugaaaggugcagucucaggggaacacaaagcagcccugauaauuugaaaa

SEQ ID NO: 7287 - RNA, 63 nt, Human
agccacaauaagccacugguaucugggggacuagaacacaaauccaacgcuuuucccaccucu

SEQ ID NO: 7288 - RNA, 63 nt, Human
aaggcauuuaggaaagaggcugcuauuagaggggaacacaaagugaagguuuuuuuaaaaaag

SEQ ID NO: 7289 - RNA, 63 nt, Human
cuucccucuggaaaucacaguguugugcaccaggaacacaaagaugagucaaaucuuuauccu

SEQ ID NO: 7290 - RNA, 63 nt, Human
aggcuuuaaugaccuuacaaagugaacauaacugaacacaaguauuuuuucaaugcaagauga

SEQ ID NO: 7291 - RNA, 61 nt, Human
uggaaaccccugccccauaaacggcccucucgaacacaaugggacggaauccacccacaac

SEQ ID NO: 7292 - RNA, 63 nt, Human
ccuaaaccuagccucugaacaacacuaacaugagaacacaagaacuuaagagaaaaagaaacc

SEQ ID NO: 7293 - RNA, 63 nt, Human
cugucaacccacuugacugugugggugcauugagaacacaaaguuuccuagacacacaggaga

SEQ ID NO: 7294 - RNA, 63 nt, Human
agugccugccauggugugaaaucuggcuuuugagaacacaaacuuuucccccacggaccuccc

SEQ ID NO: 7295 - RNA, 63 nt, Human
accugauuugaaagcuaacaauuuugauagucugaacacaagcauuucacuucuccaagaagu

SEQ ID NO: 7296 - RNA, 63 nt, Human; identical to SEQ ID NO: 7295

SEQ ID NO: 7297 - RNA, 64 nt, Human
cauccucucugcccucuugcuagggaacccugccagggugaaggcaaggaacaaccaccuggcc

SEQ ID NO: 7298 - RNA, 64 nt, Human
gggggauuguuggguacuagggagacuggguacaagggugaaaaguaguucccauaauacacau

SEQ ID NO: 7299 - RNA, 64 nt, Human
ugaaaaugcaaguguuugaagucugcucauuccgagggugaaacaaaauccaacccugucagaa

SEQ ID NO: 7300 - RNA, 64 nt, Human
ugggcugccugggacaggcuccugaggaggauugagggugaaagucucccacgaguacacuaaa

SEQ ID NO: 7301 - RNA, 64 nt, Human
ggaacugcuugggccuugcugagccaggguccucagggugaagcaggacugaggaguggccagc

SEQ ID NO: 7302 - RNA, 64 nt, Human
ccccauuucugaccucaguuccuggaggggggaaagggugaaagagaaaccacguauuuuguua

SEQ ID NO: 7303 - RNA, 64 nt, Human
caaagacaaacuggauuuaauggcccaacaucaaagggugaacccaggauaugaauuuuugcau

SEQ ID NO: 7304 - RNA, 64 nt, Human
cuuuugaaaaccuggaccucuaugucaacaugacagggugaaacuauucccccuaagacuguuc

SEQ ID NO: 7305 - RNA, 64 nt, Human
uauacuaaguucuuggugcccucuucggcagccaagggugaaggccccauagaggagaggaucc

SEQ ID NO: 7306 - RNA, 64 nt, Human
uguaauucagacacucagcuucugaucugaguauagggugaauugauggaggggcauagcuagu

SEQ ID NO: 7307 - RNA, 64 nt, Human
gacugccucuccagagcaaggcccagcugggcagagggugaaaaagagaaaugugagcauccgc

SEQ ID NO: 7308 - RNA, 64 nt, Human
ugagcuuuaaugucagugucucuuagacauucagagggugaaccaccaucccuucaccccaaag

SEQ ID NO: 7309 - RNA, 64 nt, Human
ugagauacagugaaaugagccagggcgaggagggagggugaaggaacggagggcgggcggcucc

SEQ ID NO: 7310 - RNA, 64 nt, Human
aguaagaaagagaggccgacccaggaggaaacaaagggugaaugaagaagaacaaucaugaaau

SEQ ID NO: 7311 - RNA, 64 nt, Human
cccaggguccacaaaggugccugaggcucugguaagggugaagauaaaaguauuuaacaaccgc

SEQ ID NO: 7312 - RNA, 64 nt, Human
acacagggaugcgcagggcgcccccuucuguuccagggugaacauagcacacgcccuccuggcu

SEQ ID NO: 7313 - RNA, 64 nt, Human
uuuagcuguuucugcagcugaggucaguuucaggagggugaagcugauccccaggaauggauca

SEQ ID NO: 7314 - RNA, 64 nt, Human
aggugaugugccauuccauaauggcuuccagacuagggugaauuuuauguucuguacuguacug

SEQ ID NO: 7315 - RNA, 64 nt, Human
ucuaagaagucccauugccaaagcuuucugcaggagggugaaugccgcagcuuggcagccccug

SEQ ID NO: 7316 - RNA, 64 nt, Human
gaacagugggacaugagcaggggugugggcuuggagggugaagaggaugugguccuaucagaug

SEQ ID NO: 7317 - RNA, 64 nt, Human
uugaguacuuucuccugccuccaggcauuggcucagggugaauuacaaggggcuacugaauggc

SEQ ID NO: 7318 - RNA, 64 nt, Human
cuggucuaccugagaucuauauggagcuuaaaggagggugaauaagauuaaugaccugaauuga

SEQ ID NO: 7319 - RNA, 64 nt, Human
augcccagaccugucccugucccuccucagcucuagggugaaaggcgagagguugcacaggaca

SEQ ID NO: 7320 - RNA, 64 nt, Human
agauagugcucugugccuaaggugaagccacacuagggugaagccucacuucccuguuugagca

SEQ ID NO: 7321 - RNA, 64 nt, Human
cugacggaaagcagccuucuguacaacagaugggagggugaagggggcagaaugaaaaucgaac

SEQ ID NO: 7322 - RNA, 64 nt, Human
caagggucauggcagugccugaacauggcagucuagggugaacaauccccuaacacaaguuuac

SEQ ID NO: 7323 - RNA, 64 nt, Human
uuccccaccucaggccucacacuuucccaugaaaagggugaauguauauaaccugagcccucuc

SEQ ID NO: 7324 - RNA, 64 nt, Human
uucucucucaggauaaagagugaauagaggcugaagggugaauuucuuauuauacauaaaacac

SEQ ID NO: 7325 - RNA, 64 nt, Human
ggcugugacucuggcugagcccaggaaagcgacaagggugaacugggagaggacuuacucagag

SEQ ID NO: 7326 - RNA, 64 nt, Human
uggccaggccuuccuuugcuggaggaagguacacagggugaagcugaugcuguacuugggggau

SEQ ID NO: 7327 - RNA, 64 nt, Human
ugucucacaauccuggguauuguuaauucaacauagggugaaacuauuucugauaaagaacuuu

SEQ ID NO: 7328 - RNA, 64 nt, Human
aaguggaugaugugggaguugacaggccagggagagggugaagcagguaucagagucacuccuc

SEQ ID NO: 7329 - RNA, 64 nt, Human
cagcaaccuguggagacaacccacacugugucugagggugaaaggacaccaggagucacuucua

SEQ ID NO: 7330 - RNA, 64 nt, Human
ggcugucaugcuuagacagugauuccugcaacuugaccuucaggcugggagagguggagagcca

SEQ ID NO: 7331 - RNA, 64 nt, Human
ugucuuuauuuagcauaaaaguggccuuagaagaagggugaagguuagauagauggaaucucug

SEQ ID NO: 7332 - RNA, 64 nt, Human
aacaaaggccugugccucccacccaggaggugggagggugaauuuuauguuuaaaugaagaagu

SEQ ID NO: 7333 - RNA, 64 nt, Human
aauuugcauuuacacuuagacacuuucuaaaaacagggugaacuuaauugaaauuuuucagugu

SEQ ID NO: 7334 - RNA, 64 nt, Human
aagacuauguauacuagaauaauaguagcagaguagggugaaaaggaacuuucuguucugaaag

SEQ ID NO: 7335 - RNA, 64 nt, Human
cuucuuaaaacuggggacaugagccugagcagaaagggugaagaagagccaugggacacagagu

SEQ ID NO: 7336 - RNA, 64 nt, Human
auguuguuucauagaguuuggaguguuuugauacagggugaaaaugaacuucugguuucaaacc

SEQ ID NO: 7337 - RNA, 64 nt, Human
uaugaucaugacugaucagauuugcaaauucuuaagggugaaauaggccuauuuuugcuauuuu

SEQ ID NO: 7338 - RNA, 64 nt, Human
gucuuauugccaaacugauuguaaugaggcaguaagggugaaaacauuguacauguugugaaga

SEQ ID NO: 7339 - RNA, 64 nt, Human
gauuucauuugucuuauacccaggugaaaggggaagggugaaugggacuggcugguuccuuuaa

SEQ ID NO: 7340 - RNA, 64 nt, Human
uguuucaaagggcuaaaguuggagaugaguagauagggugaaaaauggguuaaauuugcuagcu

SEQ ID NO: 7341 - RNA, 64 nt, Human
uagcagcccugccaucccugcagcagaaugagagagggugaacagggaacucuaugcuagauuu

SEQ ID NO: 7342 - RNA, 64 nt, Human
auuuaccaaugagacaucuuccuaggaacuggcuagggugaaaugacaucaucuugcauuuaaa

SEQ ID NO: 7343 - RNA, 64 nt, Human
auaucuuuguugacucaggaguauguugcaagugagggugaagaagauccagaaguugaauuuu

SEQ ID NO: 7344 - RNA, 64 nt, Human
auaaaauuuuucuaaauaaauuccacaaaaacaaagggugaagauggucucucccuuucguucc

SEQ ID NO: 7345 - RNA, 64 nt, Human
ggggcagagucauacguguggccaggaaguagccagggugaagagagacucggugcgggcaggg

SEQ ID NO: 7346 - RNA, 64 nt, Human
uugcucccguuccguucggcuuuugcuuugcguuagggugaagacccuagcguccagcuccccu

SEQ ID NO: 7347 - RNA, 64 nt, Human
gcacauuuccuguucuugaauucugcuccugaagagggugaacaaauggggcauucaaguugug

SEQ ID NO: 7348 - RNA, 64 nt, Human
ucacuggcacagaaguuuaagacuaugaguuuuuagggugaagaaaaaacuguacaguuuaaau

SEQ ID NO: 7349 - RNA, 64 nt, Human
uugacuuguguuugugccaagcgggcuuuccauugaccuucaguuaaagaacaaaccaugugac

SEQ ID NO: 7350 - RNA, 64 nt, Human
gcugaaagugaggauacuccgugcuccaggccacagggugaauguggccaugccuaccuguuuu

SEQ ID NO: 7351 - RNA, 64 nt, Human
ggcugaguuggguuggaguacacaccuggugugcagggugaagcagcucauuuugucugguccu

SEQ ID NO: 7352 - RNA, 64 nt, Human
gaucugccaguaaagaaggcuuucuuucauuaucagggugaaggucuuuccugauucuuccaag

SEQ ID NO: 7353 - RNA, 64 nt, Human
uuuaagggcaugccuugugcuguuaauagaucuuagggugaaccacuucauucugcaggguucu

SEQ ID NO: 7354 - RNA, 64 nt, Human
aaauaaagaaucuuuguaccaaacugcccacaugagggugaagagauuuccucaaaagacuuaa

SEQ ID NO: 7355 - RNA, 64 nt, Human
caggaaaugcaggaugggacuccccagggaacgcagggugaagggaacaaagcuggaggcucug

SEQ ID NO: 7356 - RNA, 64 nt, Human
cccuggucccugauugcaaggagcuucugaagcaagggugaauccuucccacacuccuccaugg

SEQ ID NO: 7357 - RNA, 64 nt, Human
ccugaagauuuugcugugguguuuggagaagcagagggugaacuugcuguuggaggagucuucu

SEQ ID NO: 7358 - RNA, 64 nt, Human
ucccgucuggcuccagcccuugucagauucacccagggugaagccuucaaagcuuuuugcuacc

SEQ ID NO: 7359 - RNA, 64 nt, Human
uaaggguuaaccacagauccaaggacucaguaaaagggugaaaggcuucucaugcaguuagccu

SEQ ID NO: 7360 - RNA, 64 nt, Human
guaaaugugccacgagcuccaacacgaccaucguagggugaagcccacguuuucuuccauggcc

SEQ ID NO: 7361 - RNA, 64 nt, Human
gggccccaguggcuuugggaagcacccccagcccagggugaaacaugcuucuucucuuccugug

SEQ ID NO: 7362 - RNA, 64 nt, Human
augaaacucacgaaucuacggacauuuugcuuucagggugaagcaagcuugaauuuggauugcc

SEQ ID NO: 7363 - RNA, 64 nt, Human
aaaacucuugaaaacucauguaaauaaaaaucauagggugaaaauuguauuuguuaaaauaccu

SEQ ID NO: 7364 - RNA, 64 nt, Human
aaccucgauauuaaaaucauccuugacaugaaacagggugaagagaagcuguccguggcggcug

SEQ ID NO: 7365 - RNA, 64 nt, Human
aaggaaaauaagacucuaggggcuccagauaauaagggugaagcaagaagcauuucauuugcac

SEQ ID NO: 7366 - RNA, 64 nt, Human
aaugucuuucucuuccuuuuauauaaauaucguuagggugaagcauuauggucuaaugauucaa

SEQ ID NO: 7367 - RNA, 64 nt, Human
gauaguacauacucaacaaagguuugugggacaaagggugaauaaaaugaaugaauuacaauga

SEQ ID NO: 7368 - RNA, 64 nt, Human
aaccuuauacaaacucguauaaagaauguaggaagaccuucacccagaagccaggacugacugu

SEQ ID NO: 7369 - RNA, 64 nt, Human
ugaagaucaugaagaauagccaaacuugucuuugagggugaauuugacacuuuaaaauaaucag

SEQ ID NO: 7370 - RNA, 64 nt, Human
uauguuuuuaaccgcuuaggucuauuuggauguaagggugaaaauucauuugauggaaauacuu

SEQ ID NO: 7371 - RNA, 64 nt, Human
gcacuagguguaaaaggugcuggccaaaugguucagggugaagagggcucuugauucaggggcu

SEQ ID NO: 7372 - RNA, 64 nt, Human
cugccugguccuugagccccugaguuguggggguagggugaagagcauaucccacaagaggccc

SEQ ID NO: 7373 - RNA, 64 nt, Human
uuguuguguaacauaaauaagccuucugagaagcagggugaauaaaguuuagggagcugggaca

SEQ ID NO: 7374 - RNA, 64 nt, Human
gagcccagugcucccuugucccucuuuuaugaucagggugaaauguacuuccugauguaaugaa

SEQ ID NO: 7375 - RNA, 64 nt, Human
gugccccacuuuucugcaaguagcuggcuuguaaagggugaacagagccaugggaggaaggucu

SEQ ID NO: 7376 - RNA, 64 nt, Human
acgaggucaggagaucgagaccauccuggcuaacagggugaaaccccaucgcuacuaaaaauau

SEQ ID NO: 7377 - RNA, 64 nt, Human
cccggccggcgcgcucaucccacccgcccaccgcagggugaacugcagcgaguacuucccgcug

SEQ ID NO: 7378 - RNA, 64 nt, Human
accacaagucucaagaauuugccacguauguucaagggugaauuugaagaauuucagaaccacu

SEQ ID NO: 7379 - RNA, 64 nt, Human
ucaacugauaaaucuauauucacccaaauaaucaagggugaagguaaaauaauacauuuuuaga

SEQ ID NO: 7380 - RNA, 64 nt, Human
cauggaagacaauucauguuugacaaaugcugacagggugaagaaagcccaguguaaaaaugaa

SEQ ID NO: 7381 - RNA, 64 nt, Human
augccugauaauuucagaugccaccguauagcaaagggugaacauguuuucaacccuuuaacuu

SEQ ID NO: 7382 - RNA, 64 nt, Human
uaauaauggcuuauagagagagacuuuuauuugaagggugaaucuuguuuuuuuuaucuuuaaa

SEQ ID NO: 7383 - RNA, 64 nt, Human
aaaauugauuucacuuagaaaaacuucuaggaacagggugaaccacugauuuuaauuugccuaa

SEQ ID NO: 7384 - RNA, 64 nt, Human
auucucuagucugugaugucuggagcuaguuuugagggugaaccacacuuuauccaacauacaa

SEQ ID NO: 7385 - RNA, 64 nt, Human
uugggagcagugacagagagucauggccguggugagggugaaucccaaguggauggcucaggac

SEQ ID NO: 7386 - RNA, 64 nt, Human
ggggggaaaaaggcuuuuuaacccauuuuugaagagggugaaguuuggagaacaaauuuaaaaa

SEQ ID NO: 7387 - RNA, 64 nt, Human
uggaauguugacuguguuuggcacacaggacacggaccuucauggaaguccuugcucugcgugg

SEQ ID NO: 7388 - RNA, 64 nt, Human
gcuggaggaagucauggugucacugggguacaggagggugaaugaagggcaugcaggcccucag

SEQ ID NO: 7389 - RNA, 64 nt, Human
uuggcuggaaucuucugaaggggauaccacucaaagggugaagaggucagcuguccuccuguca

SEQ ID NO: 7390 - RNA, 64 nt, Human
aaaugaaguguaauaucuauagaaaaguagagugagggugaauuuauauauauauuuuguuuug

SEQ ID NO: 7391 - RNA, 64 nt, Human
aucauucagcuaauacuauuggaauauaguauguagggugaaaguugacagaaaucuguacuuc

SEQ ID NO: 7392 - RNA, 64 nt, Human
ccuugacaaaauccagcuuuuguaugaggacuauagggugaauucucugauuaguaauuuuaga

SEQ ID NO: 7393 - RNA, 64 nt, Human
agccaaguaaggaacugaaguuguaucugacuguagggugaaugucugaggccugccuccuaau

SEQ ID NO: 7394 - RNA, 59 nt, Human
cgcagaagaagaguguaugauucuggaacagggugaaacucucccagagacgaagaaag

SEQ ID NO: 7395 - RNA, 64 nt, Human
cuuucaaaagggaagaguuuuugugaugggggagagggugaaggaggucaggccccacuccuuc

SEQ ID NO: 7396 - RNA, 64 nt, Human
aaauuaaguuuggcauuauugucagacuggauggagggugaaguaaaauaguaugaacaauuaa

SEQ ID NO: 7397 - RNA, 64 nt, Human
cgggaaaggggcugugaccguggggugggggcaaagggugaagagagugugggcuuuaggagaa

SEQ ID NO: 7398 - RNA, 64 nt, Human
ucaucucccacaucaccuucccugggaacuggacagggugaaaguccucaaacucugggaacag

SEQ ID NO: 7399 - RNA, 64 nt, Human
augugccuucaggggguuguuacuugagagcuccagggugaagggagaaagccugugcucuggc

SEQ ID NO: 7400 - RNA, 64 nt, Human
ccuuccccuucaagcauuuuccucuucccuuuucagggugaagcucuuccuucaagaguuucua

SEQ ID NO: 7401 - RNA, 64 nt, Human
uggcagggccaggcaaggccagagugcuaggggcagggugaaggcuucagcucacuguuguagu

SEQ ID NO: 7402 - RNA, 64 nt, Human
caagcgguguaggcuccaaugcugcuuucccaggagggugaagauggugcugugcugaggaaag

SEQ ID NO: 7403 - RNA, 64 nt, Human
uaaacuuugugauuuaaauuuacugaauuuaauuagggugaaaauuuugaaaguuguauucuca

SEQ ID NO: 7404 - RNA, 64 nt, Human
cguaucuuagaaaaauucuacaguacauccacauagggugaaaguacccuuacucucuugaaaa

SEQ ID NO: 7405 - RNA, 64 nt, Human
gcaggcagcucacaccaggaagagacuguauugcagggugaagagugggcucccgugggcccag

SEQ ID NO: 7406 - RNA, 64 nt, Human
gagugugaacgguacagccccggccugacccggggaccuucagccuggacacccggcagcuucu

SEQ ID NO: 7407 - RNA, 64 nt, Human
uccugcuguucuccuacagaaaagugauucugugagggugaacaggaaaugccuuguggaaaca

SEQ ID NO: 7408 - RNA, 64 nt, Human
ucucauagacaugcgccaccuccacgugagaacaagggugaaggugagggaagccccucaccuu

SEQ ID NO: 7409 - RNA, 64 nt, Human
acagggccugcuauugcagaaugaagccauuuagagggugaaggagaaauacccauguuacuuc

SEQ ID NO: 7410 - RNA, 64 nt, Human
aagccacuuuagugagaagcagguaccaagccucagggugaagggggucccuugagggagcgug

SEQ ID NO: 7411 - RNA, 64 nt, Human
caccaggguauacuugaggguggaggguggcaggagggugaagauugaaaagcugccuauugcg

SEQ ID NO: 7412 - RNA, 64 nt, Human
gagcugggagucccgcuggucucccugaggacugagggugaacuucgcucuuugccuuaaaccu

SEQ ID NO: 7413 - RNA, 64 nt, Human
ucgucuuguuuaccccuagccauccuuucuuucaagggugaaccaggccuuccacccugaccuu

SEQ ID NO: 7414 - RNA, 64 nt, Human
uuuuauugucuucaaagaggaagggccccauuaaagggugaacuuguaauaaauuggaauuuca

SEQ ID NO: 7415 - RNA, 64 nt, Human
uaaccugguagagguagacgggcgcuucguguggagggugaacuuggaugcccugacccagcac

SEQ ID NO: 7416 - RNA, 64 nt, Human
aagggugaauacuaguaguccaggcuugauuuggagggugaaugacgccuagcaagauguauug

SEQ ID NO: 7417 - RNA, 64 nt, Human
guuuuaaauacuagacgcuagauuuuuuuuucuaagggugaauacuaguaguccaggcuugauu

SEQ ID NO: 7418 - RNA, 64 nt, Human
gaaugcuauuuguguaacugaaagguugcacucuagggugaaccaagcuauaaaagcccaugcu

SEQ ID NO: 7419 - RNA, 64 nt, Human
guauucuaaauuuuauaucuuguagcuuuaucaaagggugaaaauuauuuuguucauacauauu

SEQ ID NO: 7420 - RNA, 64 nt, Human
agaaaauuucagcuucucuacccaaguaugaacaagggugaaauuuguguuuuaaaaauaaaac

SEQ ID NO: 7421 - RNA, 64 nt, Human
ccaaaaggagaaagcuauguagaaagauacauuaagggugaaaauagcaauacaguagauuuga

SEQ ID NO: 7422 - RNA, 64 nt, Human
agcaaaaacauguugcuuuuaucaguuaggauacagggugaacuguaacaaagaaaccccuaaa

SEQ ID NO: 7423 - RNA, 64 nt, Human
ugaggagagaugaaaaccagggcgguagaacuucagggugaaggacagaguccuggguggggca

SEQ ID NO: 7424 - RNA, 64 nt, Human
ugguauagggacugucauaccagugaagaauaaaagggugaagaauaaaagggauaugaugaca

SEQ ID NO: 7425 - RNA, 64 nt, Human
ugcuucaguuuaauuggcuuggaaaggggucagcagggugaaaccgaaccccagaaaacuugau

SEQ ID NO: 7426 - RNA, 64 nt, Human
aaaaauuuuagaacaguccagcaaauugcuagucagggugaauugugaaauugggugaagagcu

SEQ ID NO: 7427 - RNA, 64 nt, Human
ucuuucuugcuggguuuuaaugaggaaacaggaaagggugaaggaaauccuugucuaaggacug

SEQ ID NO: 7428 - RNA, 64 nt, Human
auuuguaugguagaccaaaaagaaccaaauccauagggugaaauuuugagaccuagacucugua

SEQ ID NO: 7429 - RNA, 64 nt, Human
aagaaggaaaagaaacugacaugguaauuuggauagggugaagcuuugaaauaaauacugcacc

SEQ ID NO: 7430 - RNA, 64 nt, Human
aacagagauuguggcuacgcaaaugcaccaaaaaagggugaaauauaucugaaauguaccuggu

SEQ ID NO: 7431 - RNA, 64 nt, Human
cuuaaauaaagaagaguaaacuuauuuuuuauagagggugaaggaugcuggaaggguaaggauu

SEQ ID NO: 7432 - RNA, 64 nt, Human
acuguuucuugucaucacgcagcccuggacccaaagggugaacuaaaguuuaaggagaugagag

SEQ ID NO: 7433 - RNA, 64 nt, Human
aaaauucauagaggagcaaacuggggcccauugaagggugaagaguuacucaaggucaaacagc

SEQ ID NO: 7434 - RNA, 64 nt, Human
ccaucacuuuguaaugaugauacuuaacaugagcagggugaaugacagguacugacgaagucca

SEQ ID NO: 7435 - RNA, 64 nt, Human
gagucaacaaaaguuuuuaauuuuuuauuacagaagggugaaguucaauuuaacaugcguugug

SEQ ID NO: 7436 - RNA, 64 nt, Human
auaguuuugggaaaggagugggaucuuugauuucagggugaaaacagaguaccccuuuaaacac

SEQ ID NO: 7437 - RNA, 64 nt, Human
ucccucuuccugaaacuggacuguuccugggaaaagggugaagccaccucuagaagggacuuug

SEQ ID NO: 7438 - RNA, 64 nt, Human
ggucugugcucauggccaccaggcccuacugcucagggugaaugcagcuggucucuggccagug

SEQ ID NO: 7439 - RNA, 64 nt, Human
gacccccuguccuaggucaugaaggacacucugcagggugaagcaccagggagaggccucggcu

SEQ ID NO: 7440 - RNA, 64 nt, Human
ugcagcagcagugacggaggaaacagacauggggagggugaacaguccccacagcagacagcua

SEQ ID NO: 7441 - RNA, 64 nt, Human
acaaaucuugggugggugaaggccuggcuggaagagggugaaaggcagggcccuuggggcuggg

SEQ ID NO: 7442 - RNA, 64 nt, Human
gagcagcugggcugcucccgccccagcccggcccagggugaaggaagaggcacgugcuccucag

SEQ ID NO: 7443 - RNA, 64 nt, Human
cucaccucgaaaggaggcccuguucccuggagucagggugaacugcaaagcuuuggcugagacc

SEQ ID NO: 7444 - RNA, 64 nt, Human
ugcagaagggcaaagcugcuuaagagagaggaucagggugaaguuuggcacacaggguuuauua

SEQ ID NO: 7445 - RNA, 64 nt, Human
gcaaggaccuaggcuggggauguccuccgagcagagggugaaguuucucucaguucucucccug

SEQ ID NO: 7446 - RNA, 64 nt, Human
gcucccuaauucauuucccaggaagcugugauacagggugaaauaaagucuugucuuagaaacc

SEQ ID NO: 7447 - RNA, 64 nt, Human
cccccagggaucuucuauuuaaguggcuucugagagggugaacaggauuguuacuuuuaagccu

SEQ ID NO: 7448 - RNA, 64 nt, Human
uaaugcauguggcacuuagguccaaggucuccagagggugaaagcuggagucugucaauguccu

SEQ ID NO: 7449 - RNA, 64 nt, Human
gggcccacauuugggaaaguucuugauguaggaaagggugaaaaagcccaaaugcugcuguggu

SEQ ID NO: 7450 - RNA, 64 nt, Human
gguaaccauguagguucuugggagggaaugggacagggugaauaaagcagggaauauuuuagaa

SEQ ID NO: 7451 - RNA, 64 nt, Human
agaaauuuuucagaugcuucugggagacacccaaagggugaagcuauuuaucuguaguaaacua

SEQ ID NO: 7452 - RNA, 64 nt, Human
cuggcagaguugucucgggagcggggugagcugcagggugaacgcggggagcuacggggccggc

SEQ ID NO: 7453 - RNA, 64 nt, Human
augaucacgugacccaccccccagggcagguaucagggugaacugaucuuagcaccggccaaau

SEQ ID NO: 7454 - RNA, 64 nt, Human
aaaacaagacaaaacuaaaaaaauacaacugagaagggugaagagaaguauguuuguuaaacag

SEQ ID NO: 7455 - RNA, 64 nt, Human
ucauuugagcauaaaauauuuucagauauuuuccagggugaaaucuguaaugcagaugauauaa

SEQ ID NO: 7456 - RNA, 64 nt, Human
gcagccaguuccaaugcuggacaccucaaccaucagggugaaaucuggggccucagcuuuuuaa

SEQ ID NO: 7457 - RNA, 64 nt, Human
cuagggaagcagugcgugugaaacagcguaacggagggugaagagcauaguuaauaagcaacug

SEQ ID NO: 7458 - RNA, 64 nt, Human
ggauacgugcaagggaaguugggcuguuguaaacagggugaaggguguguuuggucggccauuu

SEQ ID NO: 7459 - RNA, 64 nt, Human
ggaguggagaguaggguggucuugugaguugugcagggugaagaccgcuucccugagacagggg

SEQ ID NO: 7460 - RNA, 64 nt, Human
ucuucuuucugguuguuuuuguucuuuguguuuuagggugaaacuuaaaaaaaaaauucugccc

SEQ ID NO: 7461 - RNA, 64 nt, Human
aauccuuacuucugccagucuguauuuccuaucaagggugaaagugaugaugguggugcaggag

SEQ ID NO: 7462 - RNA, 64 nt, Human
uagucuaccuuccuuauuuggggcaauagggaggagggugaauguuucuucuuucucaucuacu

SEQ ID NO: 7463 - RNA, 50 nt, Human
cucuugaaucuacccucuagagggugaaaaaaguuaagggaaaagacuuu

SEQ ID NO: 7464 - RNA, 64 nt, Human
cacugagcccagcugacugaaaacaaggacagucagggugaaacuucuuuugccagaagugugg

SEQ ID NO: 7465 - RNA, 64 nt, Human
ccucaacuucuagcaguauaucaguuaugaacugagggugaaauauauuucugaauagcuaaau

SEQ ID NO: 7466 - RNA, 64 nt, Human
ucugaaauauauugauuuuuaucacaguauucucagggugaaauuaaaccaacuauaggccuuu

SEQ ID NO: 7467 - RNA, 64 nt, Human
acuuagagaagcaccuugcuagcaugguuucugaagggugaauucugguggggaaccagaaacu

SEQ ID NO: 7468 - RNA, 64 nt, Human
caggcugggcccugcauuucuggggcaggaacagagggugaaagggacagauagaugcaggucc

SEQ ID NO: 7469 - RNA, 64 nt, Human
uccuucgucuuugcauguaagcucuuugagaggaagggugaagccuuauuuguuuuuuaugucc

SEQ ID NO: 7470 - RNA, 64 nt, Human
uguccauuaguaaaagugaaauucagucuuaaguagggugaauuggaucaccauuuacacaaga

SEQ ID NO: 7471 - RNA, 64 nt, Human
cacgaagucaggagaucaagaccaucuggcuaacagggugaaacccugucucuacuaaaaaaua

SEQ ID NO: 7472 - RNA, 64 nt, Human
gaaguaaauauagugcgucauaauugcuaaaaacagggugaauuucuuucacuuaaguuggaaa

SEQ ID NO: 7473 - RNA, 64 nt, Human
gugcugcuucuucagaugauggggagcacuuuucagggugaaauucaggcgaguuuugcccagg

SEQ ID NO: 7474 - RNA, 64 nt, Human
cauacugacuguuguugcuucuuucuagcagugcagggugaaacuaacuagcaaagacaaaaau

SEQ ID NO: 7475 - RNA, 64 nt, Human
cugguaaaucucuuugucaaauuacgaaaacuucagggugaaauccuaugcuuccauguacauu

SEQ ID NO: 7476 - RNA, 64 nt, Human
ucuugcagaagccccaguaagcuguuuaggaguuagggugaaagagaaaauguuuguugaaaaa

SEQ ID NO: 7477 - RNA, 64 nt, Human
aacacauuugauuaauuguguuguuucaacguuuagggugaagugccuuggcacgggauuucuc

SEQ ID NO: 7478 - RNA, 64 nt, Human
cccccaaguguuuaauaacuggcauuaagcuuagagggugaaaaaaaaaaaaaagauugauagu

SEQ ID NO: 7479 - RNA, 64 nt, Human
ugaccuuucguaaauuugggcuggaacauguaaaagggugaaaguuagucguuuuuggucuucu

SEQ ID NO: 7480 - RNA, 64 nt, Human
uuacuuucaaccauaagcgguaauagcagaggaaagggugaagggagucugggcaagcaaagca

SEQ ID NO: 7481 - RNA, 64 nt, Human
cucaccccaguagauccaaccuccagccccauauagggugaaccucuugauaagcucucugccu

SEQ ID NO: 7482 - RNA, 64 nt, Human
uugccaacacggagagggcagagaugcacuagaagaccuucauccuccccuuccucugccccaa

SEQ ID NO: 7483 - RNA, 64 nt, Human
ggguuucugccagaaauguccagagccuaacugcagggugaaaaagucccugcacggccaccac

SEQ ID NO: 7484 - RNA, 64 nt, Human
agggcugggggaaggaguguguggaggagggaggagggugaagacugaggcuaggugccagaau

SEQ ID NO: 7485 - RNA, 64 nt, Human
aaugcuccuauacaaggcagcagaaaccuacugcagggugaagaauuacucagagcuuuggauc

SEQ ID NO: 7486 - RNA, 64 nt, Human
aacaaccuguucaccacuccugggugcaugauugagggugaagcauccaccagcacuucaaggg

SEQ ID NO: 7487 - RNA, 64 nt, Human
augaaaaguuauacagacaacaguaauaacuaaaagggugaaucugcuaaauccuuuugaaaug

SEQ ID NO: 7488 - RNA, 64 nt, Human
ccucgcaggucucagugucaugcugucuuggggcagggugaaaggguaguggcagcagggcgcc

SEQ ID NO: 7489 - RNA, 64 nt, Human
cuagggguaccccagcugcugccacuccugcuggagggugaacuggggacccugcacccuccgg

SEQ ID NO: 7490 - RNA, 64 nt, Human
ucaguccccaggcagcccugccucugacuccaagagggugaaguccacagaagugagcuccugc

SEQ ID NO: 7491 - RNA, 64 nt, Human
cuaggacagcuggcugagaaguggguucaggcgaagggugaagccauguguagcaguuccugcc

SEQ ID NO: 7492 - RNA, 64 nt, Human
cuccauucaugggaugcaggucuuucugagcucaagggugaaagaugaauacaauaacaaccau

SEQ ID NO: 7493 - RNA, 64 nt, Human
agaaauguacagcaaggagauuuacaacugggggagggugaagugaagacaaugacuuacugua

SEQ ID NO: 7494 - RNA, 64 nt, Human
ucauaaaagcugccuuuaaauaucccuaggagacagggugaaggagacccuugacagccccagc

SEQ ID NO: 7495 - RNA, 64 nt, Human
acgacgucaggagauccagaccaucuuggcuaacagggugaaaccccgucucuacuaaaaauac

SEQ ID NO: 7496 - RNA, 64 nt, Human
ggagucccgugcaagccaucagaauguugaaaugagggugaagagcucagaucccucucuuugg

SEQ ID NO: 7497 - RNA, 64 nt, Human
aaaggccaaccagggcccaaccgugcaugaugacagggugaagagaaggcaggucugggcacug

SEQ ID NO: 7498 - RNA, 64 nt, Human
aaauguauuuuaucauuaaauggcauuauuuuaaagggugaaaaacugacacagucaauucaga

SEQ ID NO: 7499 - RNA, 64 nt, Human
acgcccaacaccauggccugcaaccccagggucaagggugaaggaaagcaagcucaccgccuga

SEQ ID NO: 7500 - RNA, 64 nt, Human
gugagcacagacuucuaguuggcaggagcugaggagggugaacaaaccccgagggaggcccggc

SEQ ID NO: 7501 - RNA, 64 nt, Human
caaguuggauuuuauauuuuaauaaggaaguuaagaccuucauuuaagaggcagaagauuaaga

SEQ ID NO: 7502 - RNA, 64 nt, Human
gucucacccuucuccccuacaggucaggccaagaagggugaaggccucuugcacuccagaccuc

SEQ ID NO: 7503 - RNA, 64 nt, Human
gcuugggauggauuugacuaaaucugccccgaggagggugaacaaggugaucucagagaucacu

SEQ ID NO: 7504 - RNA, 64 nt, Human
agccucagcuagccugaugacaaaaaugacuucuagggugaagccugggugaugaggcugcugg

SEQ ID NO: 7505 - RNA, 64 nt, Human
cuaaucaguugaacuuaacauuuaauaaaaagaaagggugaaauaaacugaagaccauuuuaga

SEQ ID NO: 7506 - RNA, 64 nt, Human
caggacugcacgguuuaacacagcagaguacagaagggugaagaagugagcagaggcuuaugaa

SEQ ID NO: 7507 - RNA, 64 nt, Human
aaaagaguaagaggaaauauucccacagccaugaagggugaaagggcaccuugugccuagacua

SEQ ID NO: 7508 - RNA, 64 nt, Human
acccuuugccuguuccgcauccuggaggcggcaaagggugaaauccgcauugauggccucaaug

SEQ ID NO: 7509 - RNA, 64 nt, Human
ggagauucgauacguggacuacggcggauauaagagggugaaaguagacgugcuccggcaaauc

SEQ ID NO: 7510 - RNA, 64 nt, Human
gagccuggacuucugugcaagaaagggagaccuaagggugaacaguggccaauaaaaacccuag

SEQ ID NO: 7511 - RNA, 64 nt, Human
gcagaauugagggagagaccuuucuuccuuguugagggugaaaaauaaauaagaauuacauguc

SEQ ID NO: 7512 - RNA, 64 nt, Human
aaaacucggucacaacuaagugaucccaagcucaagggugaauccccaauacuuuacuuauuca

SEQ ID NO: 7513 - RNA, 64 nt, Human
ccucacagccuacuuccccuuccccggggcugagagggugaaaguguguggggaaggagaggac

SEQ ID NO: 7514 - RNA, 64 nt, Human
ccgcccugcacuucuagcccucauuuaagauuugagggugaaaccaaagaaaacccccuaagug

SEQ ID NO: 7515 - RNA, 64 nt, Human
cugcucucagaguuuacacauucaauugcuuccaagggugaaucuccugcucugugaaugcuau

SEQ ID NO: 7516 - RNA, 64 nt, Human
caucugagccuugguaggguuaaagggaggugacagggugaagagggauccugugcaggggcca

SEQ ID NO: 7517 - RNA, 64 nt, Human
cauacaucacugugauagaaugugggcuuuuucaagggugaagauacaagucuuaaccacagug

SEQ ID NO: 7518 - RNA, 64 nt, Human
uuggcugggccucggcuucgcuggaguguacuccagggugaaggcagagugggauuugagaccc

SEQ ID NO: 7519 - RNA, 64 nt, Human
uuuuuauuuuguaauagaagugaacugucucugaagggugaaggcaggccguccugggauggua

SEQ ID NO: 7520 - RNA, 64 nt, Human
agaacucugcuuacuaauguauuaauaccacugagaccuucaggccuugccugggauaucacuu

SEQ ID NO: 7521 - RNA, 64 nt, Human
auugaagaagagaauugacucguaugaacaggacagggugaaaaugcugggaauuauuauggga

SEQ ID NO: 7522 - RNA, 64 nt, Human
augaagguuuggcuacuuguauaggucugccugcagggugaaaaugccagugugaauauucuag

SEQ ID NO: 7523 - RNA, 64 nt, Human
aaggucaaugccauuauuugauuauaccauuuugagggugaauauggcuaggcacuuuagauaa

SEQ ID NO: 7524 - RNA, 55 nt, Human
augguggaggugaugacugaacuucagggugaacuugguuuuuggacaaguacaa

SEQ ID NO: 7525 - RNA, 64 nt, Human
uuuugaggcucgcucuugcgcggugccugagaagagggugaaggagcuggggcaggccccaucc

SEQ ID NO: 7526 - RNA, 64 nt, Human
cacgcccagcuccagugauuacucggaccuacagagggugaaacagguaacuugggggggaagu

SEQ ID NO: 7527 - RNA, 64 nt, Human
ccuuccagcaggcagcuggccucuccaaggaauaagggugaaauugccacagcuggcugacaca

SEQ ID NO: 7528 - RNA, 64 nt, Human
accaugugcugauguaugugcucugccagugugaagggugaacagcuccaacuuuauguccccc

SEQ ID NO: 7529 - RNA, 64 nt, Human
aggcugguggcuuuuaaaccaggagcccggaggaagggugaaagagaaagccugugaaauaggc

SEQ ID NO: 7530 - RNA, 64 nt, Human
ugagcguccuggccugggcccuaugcccgggggaagggugaaauugggguucaggcccacccag

SEQ ID NO: 7531 - RNA, 64 nt, Human
uaaggcccacuguuuuacuggggcccauuguaugagggugaaguuuggcaguuacccaagagac

SEQ ID NO: 7532 - RNA, 64 nt, Human
ugaguuggagggcaagggcuggggcugggaugggagggugaagaugcccaagcugaagaugccu

SEQ ID NO: 7533 - RNA, 64 nt, Human
ugaggccaagguagccaaggucagcccugaggccagggugaaaggucccagacuucgaaugccc

SEQ ID NO: 7534 - RNA, 64 nt, Human
gucgagaucucaggagccccuugcuguuuuuuggagggugaaagaagaaaccuuaaacauaguc

SEQ ID NO: 7535 - RNA, 64 nt, Human
gcguggccgggcacuaaacacccgccugccugccagggugaacacacagccagcuuaucccucu

SEQ ID NO: 7536 - RNA, 64 nt, Human
aacccacggaagggggagacucuuucggauuuguagggugaaauggcaauuauucucuccaugc

SEQ ID NO: 7537 - RNA, 64 nt, Human
uagcuggccagugcugaggagguuggagagagaaagggugaaagcagagagaccagugcagggc

SEQ ID NO: 7538 - RNA, 64 nt, Human
gucagagccacugagugcugugcugcucgacgugagggugaaaugauugacuugugaccugcca

SEQ ID NO: 7539 - RNA, 64 nt, Human
cugaggucaggaguucgagaccagccuggccaacagggugaaaccccgucucuacuaaaaguac

SEQ ID NO: 7540 - RNA, 64 nt, Human
acccaggucccuccuuuggacccuguaaagggucagggugaaucagaugggggacugagcaagu

SEQ ID NO: 7541 - RNA, 64 nt, Human
guuugggaaggaauaacacacuggcccauuaguaagggugaaggcuggagggauuuguugacuu

SEQ ID NO: 7542 - RNA, 64 nt, Human
cagaaggcuggguccaggggagggaaaagcuaagagggugaacaaagaaaagacauugaaagcu

SEQ ID NO: 7543 - RNA, 57 nt, Human
uggaagucaguguaacaugacaacgccagggugaacacacgccacuucccagcuagg

SEQ ID NO: 7544 - RNA, 64 nt, Human
cugcccaucugcauaggagaugaaggcugggguuagggugaaacgguuugaguuaaauggaaaa

SEQ ID NO: 7545 - RNA, 64 nt, Human
uucaucucggaguccaggccuggcccugggagacagggugaagggagugguuuuuaugaacuua

SEQ ID NO: 7546 - RNA, 64 nt, Human
accacaggguggcagcagggaaaaaaauuagaaaagggugaaagauugggacuuaacacuucag

SEQ ID NO: 7547 - RNA, 64 nt, Human
aucagcgugaccuggaccugcugggcaggaucccagggugaaccugccugugaacucugaaguc

SEQ ID NO: 7548 - RNA, 64 nt, Human
acaggccagcuggccggggguuggggagccacacagggugaacgggcagcagccggcuccaugc

SEQ ID NO: 7549 - RNA, 64 nt, Human
caucaucugcgucagccgguccuagcccaucugcagggugaaagaacucaucaagagcuccuuc

SEQ ID NO: 7550 - RNA, 64 nt, Human
agagaccuaacagccuuggucuaccgugcugaccagggugaaggcacggcgagggacuccuccc

SEQ ID NO: 7551 - RNA, 64 nt, Human
cggcccccugugcagggccguaguaccucccagcagggugaagaguccaagaagccagcaccac

SEQ ID NO: 7552 - RNA, 64 nt, Human
uucuuuucgagugugggaaaaggguuuuaguagaagggugaaucguauuuuacacagcggucuu

SEQ ID NO: 7553 - RNA, 64 nt, Human
ugccccaagggggaccaaaagggccggacguuacagggugaaacccucugaccccucgcgacac

SEQ ID NO: 7554 - RNA, 64 nt, Human
caucaugaugaugauaauuuauuaacuuuuuggaagggugaauaguuuccuaaugguuaaaaac

SEQ ID NO: 7555 - RNA, 64 nt, Human
acaaggaaauuuacaaaauacuagaguaucuagaagggugaaaacaaaaaaaaauaaaaagaaa

SEQ ID NO: 7556 - RNA, 64 nt, Human
acggugaagacaagcugcgagagcugggagcuggagggugaagaggugaacacuugagugguua

SEQ ID NO: 7557 - RNA, 64 nt, Human
auucaugugcagauaaaagagguuuaugaaguuuagggugaaguaggcaagggaaucuguuuac

SEQ ID NO: 7558 - RNA, 64 nt, Human
aaauaucuuugaaggcagaaucaguugaguugugagggugaagccucacauacuucucaacaga

SEQ ID NO: 7559 - RNA, 64 nt, Human
ggaggacugcgugggcugagaugccacccuuugaagggugaacagcauggcggcaucugggccc

SEQ ID NO: 7560 - RNA, 64 nt, Human
uuguugcugagagaguggaacauagguccuagacagggugaagaguucuggcacauuuuagcug

SEQ ID NO: 7561 - RNA, 64 nt, Human
gaaucaucgcuauaucaaguaucuaaaauuugggagggugaaucaguacacugugaccaagguc

SEQ ID NO: 7562 - RNA, 64 nt, Human
agcagcaaggacaaagggcaguuuagggagaggcagggugaaggggauagcucgauugggcauc

SEQ ID NO: 7563 - RNA, 64 nt, Human
gcauaagcgggaagggcuuggucuggauguagagagggugaauaaaauugccaagagagauauu

SEQ ID NO: 7564 - RNA, 64 nt, Human
uaacaaguaagaugcaaucuagcaaaagucagucagggugaaagagaauugguugcaaaugagg

SEQ ID NO: 7565 - RNA, 64 nt, Human
uaauuugcaauuugucaguguauaagacacaugcagggugaaguguacagaguuuuguaacaaa

SEQ ID NO: 7566 - RNA, 64 nt, Human
gggucuuauggagguggcccggccccuccccgcucccuuccacucugcacgaggccgccacacc

SEQ ID NO: 7567 - RNA, 64 nt, Human
uggcuccacaccaguuaccugggaccaguaggugcccuuccagccugaagaucugggggcacag

SEQ ID NO: 7568 - RNA, 64 nt, Human
agucugugccuaugccgagcgcgcuaagaagucucccuuccagcuguuccauucucuccaccac

SEQ ID NO: 7569 - RNA, 64 nt, Human
aagcaccaugguccagccaccaggcucccugugucccuuccaugggaaggucuuccgcugugcc

SEQ ID NO: 7570 - RNA, 64 nt, Human
agggaagaguucuccccaaaacccuagcucuuuacccuuccauuuuagccuuccacccagcuuc

SEQ ID NO: 7571 - RNA, 64 nt, Human
aagcacuggaguggaugcugggcuaucuugcucccccuuccacugugggcagggccuuucgcuu

SEQ ID NO: 7572 - RNA, 64 nt, Human
caagaugggucccuggccaccauggucaucaccacccuuccagggccugagcagcuggaucugg

SEQ ID NO: 7573 - RNA, 64 nt, Human
ccucacacauuaugcggacuuauugccuggcucucccuuccacguggcucucccaccaccugag

SEQ ID NO: 7574 - RNA, 64 nt, Human
guacucaaagugucuuucuaccagggcaccagaucccuuccauggagcaggucaucucggguuc

SEQ ID NO: 7575 - RNA, 64 nt, Human
aaugacccguacugagaccacagcuucuuggccucccuuccagcucugcagcuaaugagguccu

SEQ ID NO: 7576 - RNA, 64 nt, Human
aagcugccauauuggccugcuuccgucccugaaucccuuccaaccugugcuuuagugaacguug

SEQ ID NO: 7577 - RNA, 64 nt, Human
ccucuucccucaggggcugcacccuccucucacucccuuccaugccggaacccaggccagggac

SEQ ID NO: 7578 - RNA, 64 nt, Human
aguugauagaaauggggguucuggaccagaugaucccuuccaauguggugcuagcaggcaggau

SEQ ID NO: 7579 - RNA, 64 nt, Human
uauuauaggauuuguauuuucuccuuuuuuuucccccuuccauuccuucuccccucuugcauuc

SEQ ID NO: 7580 - RNA, 64 nt, Human
acacauggcugggacaucuguucccagcuguaggcccuuccaccagcuggggagcuagagggag

SEQ ID NO: 7581 - RNA, 64 nt, Human
cacuuuuggagaccguaaaacaacaacgcccccucccuuccagcccugagccgggaaccaucuc

SEQ ID NO: 7582 - RNA, 64 nt, Human
guuguagcuccauuauuuuuuuuauuaaaaaauacccuuccaccuggaggcucccuugucuccc

SEQ ID NO: 7583 - RNA, 64 nt, Human
cccuuauuuaaaaaggccccagagagcuaacucacccuuccaccauaugaggacguggcaagaa

SEQ ID NO: 7584 - RNA, 64 nt, Human
uggaagauaagcucuguccugaguccaaaccaagcccuuccaagagagaacaaaggucagagau

SEQ ID NO: 7585 - RNA, 64 nt, Human
auugacacugauaauuagccuauagggcucccuacccuuccauuaagaaucuaccaagcauuag

SEQ ID NO: 7586 - RNA, 64 nt, Human
auauuuaaaccgcauuaaucauggcaaucaagcccccuuccagauuacugucucuugaacaguu

SEQ ID NO: 7587 - RNA, 64 nt, Human
uagauugguguugcaucccugccacuucacaugacccuuccauguuaaagcugacuuuucuugc

SEQ ID NO: 7588 - RNA, 57 nt, Human
ccaucggccgcuucacguagcucggagcccuuccacuccucccagguaagaacccuc

SEQ ID NO: 7589 - RNA, 64 nt, Human
ugaggccuucuugucuucaaccuggccuguccagcccuuccagauauggccaaacccauggccu

SEQ ID NO: 7590 - RNA, 64 nt, Human
uuugcugguguguuuggggcauaaggcacugcuccccuuccaucucuagcagauaucaucuucu

SEQ ID NO: 7591 - RNA, 64 nt, Human
gagguccugccccauccucucucugaagccagggcccuuccauuccauuuagccuuuggaucau

SEQ ID NO: 7592 - RNA, 64 nt, Human
auauucuggcucuacucuggccuuuuuucugguucccuuccaaaaugcacaaaucauacccuug

SEQ ID NO: 7593 - RNA, 64 nt, Human
uacuuucuauguacuauuuacuuagaagggagcccccuuccagucaugaaacuucauuuguuuu

SEQ ID NO: 7594 - RNA, 64 nt, Human
gugaauguuaagcagaagggagagaguccuuacucccuuccaaucucuguucagugcaaaaccc

SEQ ID NO: 7595 - RNA, 64 nt, Human
gauggggcagagcuucuccugaccagggcaaggccccuuccacgggggcuguggcucugggugg

SEQ ID NO: 7596 - RNA, 64 nt, Human
gcuuggaacccuggguccaguuccucuucacacccccuuccacucugaguagcacaucucccca

SEQ ID NO: 7597 - RNA, 64 nt, Human
cucggggcaucuccugaugcuccggggcucaccccccuuccagcggcuggucccgcuuuccugg

SEQ ID NO: 7598 - RNA, 64 nt, Human
agcaggcagaagcccacugguaugggccucccgccccuuccacauccauguugugauuggaucc

SEQ ID NO: 7599 - RNA, 64 nt, Human
uggcaucguagaagagauguggcaaagugcuguacccuuccaccuccuagaggugggcagcugg

SEQ ID NO: 7600 - RNA, 64 nt, Human
caaagguggauuuaagaauuaaaccauuacaugccccuuccaaaaggcagaaauccauucaaac

SEQ ID NO: 7601 - RNA, 64 nt, Human
uucacacaccauaguaguugggcacacacaucuucccuuccaaagggcuuuuuccuugaguugc

SEQ ID NO: 7602 - RNA, 64 nt, Human
gguugaccguugugguccuuagaagucccauucucccuuccaguuaugagaaaccaaugccuuc

SEQ ID NO: 7603 - RNA, 64 nt, Human
ggaaagaguuaacggugugggccacuccagcuugcccuuccacugccacucacuggggugaggc

SEQ ID NO: 7604 - RNA, 64 nt, Human
uuaaauaauaaagaaacaaaacuaucugcccuuucccuuccaguggguuccucuggugcugcag

SEQ ID NO: 7605 - RNA, 64 nt, Human
accaucagcaaacaugagcacucuucccuuucuccccuuccaccugcugcgggcugggcugguu

SEQ ID NO: 7606 - RNA, 64 nt, Human
gccgggucugcaaagcccugucagacagacugggcccuuccaaggucaagccaugugucugaug

SEQ ID NO: 7607 - RNA, 64 nt, Human
agcugugugacuuuaucguuggagaguauuguuacccuuccaggauacauaucaggguuaaccu

SEQ ID NO: 7608 - RNA, 64 nt, Human
cauagaugggcagaggggugagauuggcucaucccccuuccagauucugcaauaaagcggugug

SEQ ID NO: 7609 - RNA, 64 nt, Human
ggggucucuuccccaucccuucuacucuaccuggcccuuccagccccagccuuuggagcguuca

SEQ ID NO: 7610 - RNA, 64 nt, Human
ggguaggcuaggggguuucuucuaugacacuugacccuuccaugcugguucccaagccuauugg

SEQ ID NO: 7611 - RNA, 64 nt, Human
aaaccagaagcccugcugucugucugugcccaagcccuuccaccagaaaagcuagucuaggugu

SEQ ID NO: 7612 - RNA, 64 nt, Human
uuuuugugaaagagaagccuaaauucagcaucuccccuuccacccucacccccaggucccagcc

SEQ ID NO: 7613 - RNA, 64 nt, Human
uuaacuucaguuuuuugaaugcaacaggauaccucccuuccaaacugaacuguagaagcagagc

SEQ ID NO: 7614 - RNA, 64 nt, Human
ggcaguaucacaagaagauuaaaguggcagacaccccuuccagcggaaguuacuaauucggacc

SEQ ID NO: 7615 - RNA, 64 nt, Human
augaaaccuguuuuccauuuguauuaacucaucucccuuccacucaugauccgucacucuuccu

SEQ ID NO: 7616 - RNA, 64 nt, Human
ugcagggacuagaagccucaguuuccccauuuuacccuuccacacaauagccucuguagguuag

SEQ ID NO: 7617 - RNA, 64 nt, Human
cacuuucaguauucucagguguucuucguucuggcccuuccaggguaauuaggaaggcagaaca

SEQ ID NO: 7618 - RNA, 64 nt, Human
uucagggggagcuggcggacucccacuccccgcucccuuccagccaagcugccuuaacucgccc

SEQ ID NO: 7619 - RNA, 64 nt, Human
cccagcacacuauaauauagugaacuggaaaagucccuuccagaaacagcuuggccagcuuugu

SEQ ID NO: 7620 - RNA, 64 nt, Human
uuggcccccugcccuccucucccucccagauggacccuuccaugggaggaaauaaaguuuccau

SEQ ID NO: 7621 - RNA, 64 nt, Human
cccuuguucuguaucccccuuugcccuugccuugcccuuccaacaaacccuaggcccuugagaa

SEQ ID NO: 7622 - RNA, 64 nt, Human
cuggagcuuacacuguucugggguuuguucucuacccuuccaaccaaucacaccccugccuuuu

SEQ ID NO: 7623 - RNA, 64 nt, Human
auaaguacuaaacagaaaccuuaccaucugaagucccuuccauuguuuucuaguugcuuccuca

SEQ ID NO: 7624 - RNA, 64 nt, Human
uuucuaacuucucucucagaagcuucuacagaaacccuuccaucuguagccucaagggcccacc

SEQ ID NO: 7625 - RNA, 64 nt, Human
auagucuacauggucugugagugugugagaugaacccuuccauccuuugacaccugguuguaug

SEQ ID NO: 7626 - RNA, 64 nt, Human
aaauguagaaauacacgauucugucaccucugaucccuuccaucugaaagguuacaaggagugu

SEQ ID NO: 7627 - RNA, 64 nt, Human
gauuacauuuggaaauacuuuguguaaaccaucccccuuccaccuccauuugucuguugaaaga

SEQ ID NO: 7628 - RNA, 64 nt, Human
aacgcgacauuccuccccucacgccuggcccggucccuuccagggcaacucccagggauguggu

SEQ ID NO: 7629 - RNA, 64 nt, Human
acacucagcacgaaggucucucccuuaacugcugcccuuccaagacuugcucccgagauggagu

SEQ ID NO: 7630 - RNA, 64 nt, Human
agcuucaauaauugugacuggccucaggaauucucccuuccacaccugcccaccucaccucacu

SEQ ID NO: 7631 - RNA, 64 nt, Human
ccccccuucagccccuacuaaacucuuaagccuccccuuccagucuuucuggacagcuauuaag

SEQ ID NO: 7632 - RNA, 64 nt, Human
ucaugcggaaugauugguucagaacuguuccuuucccuuccaugauguccuugacacagaaggu

SEQ ID NO: 7633 - RNA, 64 nt, Human
gugugaaucagagcacagcagccccugcacaaagcccuuccaugucgccucugcauucaggauc

SEQ ID NO: 7634 - RNA, 50 nt, Human
ccgcccccagccucuucugacccuuccaugcuggccccuggcccagcagg

SEQ ID NO: 7635 - RNA, 64 nt, Human
gggcacacccuguccucccaccccugcccccuugcccuuccagcccuuucagcugcagcuggga

SEQ ID NO: 7636 - RNA, 64 nt, Human
auucugaguggugucugcuuagaguuuacuccuacccuuccagggaccccuauccugaucccca

SEQ ID NO: 7637 - RNA, 64 nt, Human
uggacagcugcauguucugugcucuccaguuugucccuuccaauauuaauaaacuucccuuuua

SEQ ID NO: 7638 - RNA, 64 nt, Human
agggaaggauuggugauagcagagcuccaggccucccuuccagucagaacaguugagcaguuua

SEQ ID NO: 7639 - RNA, 64 nt, Human
cacaguccaaagucucaucugagacaaggcaagucccuuccaccuaugagccuguaaaaucaaa

SEQ ID NO: 7640 - RNA, 64 nt, Human
auacuuggggaaaaaacaaggccauauguaaaaacccuuccaaugccuaagugucuuucuccug

SEQ ID NO: 7641 - RNA, 64 nt, Human
ucgucucuuacauacucucaucuucucccccgcucccuuccacuccaaggagcgaggagggcaa

SEQ ID NO: 7642 - RNA, 64 nt, Human
gccaggaggccgaggucccucaguccuccccugucccuuccaaggugggucaggagguucuggc

SEQ ID NO: 7643 - RNA, 64 nt, Human
uugcccuccgcccugaaaaagguguccuugaagucccuuccaccucuaugccacugucugcuua

SEQ ID NO: 7644 - RNA, 64 nt, Human
ugugcagccucacaaacauggccuuuucucucuccccuuccacuuuuaaggauuuauuuuuuuc

SEQ ID NO: 7645 - RNA, 64 nt, Human
gcccacaaauauuuauuacaaucaguauuuuggucccuuccagcuuuucuguagaaucuuacug

SEQ ID NO: 7646 - RNA, 64 nt, Human
ggagggaauuccuagcuguaaauauaaauuuugucccuuccauuucuacuguauaaacaaauua

SEQ ID NO: 7647 - RNA, 64 nt, Human
gaaacuauaguggccacacucugccuuccugagucccuuccagucaugugugcaucaugucucu

SEQ ID NO: 7648 - RNA, 64 nt, Human
uuagcuuuuuucagaauuuaucuuucauucaguucccuuccauuaucauuuacuuuuacuuaga

SEQ ID NO: 7649 - RNA, 64 nt, Human
agcaagcccccauuuucacccgauccugggcucucccuuccaagcuagagggcugggcccuaug

SEQ ID NO: 7650 - RNA, 64 nt, Human
cugggaagggcagcugggggcaguggcgccaguucccuuccauggucucccggcuggcaaugug

SEQ ID NO: 7651 - RNA, 64 nt, Human
aggaaaaugacccuugggcuggcaggggcagugacccuuccaggguaccacugagggaagggcc

SEQ ID NO: 7652 - RNA, 64 nt, Human
ugcagagacuuuauccaugccaauaguugcuguccccuuccaggggucaccuugagaggcauga

SEQ ID NO: 7653 - RNA, 64 nt, Human
ugagaagaaaugcugcuggcucuauuuuuacauucccuuccaccucuauacugucaugucaccg

SEQ ID NO: 7654 - RNA, 64 nt, Human
ugacccucuugucccuaccagcagcuucucuugccccuuccauucaggguucccuggcagggga

SEQ ID NO: 7655 - RNA, 64 nt, Human
gucagauccugaccagcaagcccccccccagccccccuuccaagugacuccgugccuugagugu

SEQ ID NO: 7656 - RNA, 64 nt, Human
uuucucuccaucacaucauuucugaccauuugcucccuuccauucuugaaacaccucaugcccc

SEQ ID NO: 7657 - RNA, 64 nt, Human
uccaucccaaccagugccaaggaccuccucuucccccuuccaaauaauaaagucuauggacagg

SEQ ID NO: 7658 - RNA, 64 nt, Human
accuuccacucagggccucugcucuauaucuauucccuuccagccagacuggcagaugggggcu

SEQ ID NO: 7659 - RNA, 64 nt, Human
cucuuaaaaaauaacagacuugaggaaccccucucccuuccauaauuccccucauccaccgccc

SEQ ID NO: 7660 - RNA, 64 nt, Human
gaugauuuuagcuuguccuaaaucuugcuguccacccuuccaggaaagggacauuguaaaugaa

SEQ ID NO: 7661 - RNA, 64 nt, Human
cugucuuagcugaccuguuuuugguccacuuuugcccuuccaugacuaauaaggaagauaugug

SEQ ID NO: 7662 - RNA, 64 nt, Human
cuaccaccucuauaagccuagucaaugagcagaccccuuccaguauuuguaaaaguaguacuag

SEQ ID NO: 7663 - RNA, 64 nt, Human
guauucauuuugaaugugcauauaguuauuugaccccuuccaaauacuuguagccaaacauugg

SEQ ID NO: 7664 - RNA, 64 nt, Human
uuuaugauuugccagauucaacauuuaugaccuccccuuccaaagacugucuccguugaccuug

SEQ ID NO: 7665 - RNA, 64 nt, Human
gaaauccccacccccguccaccccagagacccugcccuuccacccggaggccaaaggccaacug

SEQ ID NO: 7666 - RNA, 64 nt, Human
cugguuuucuguguuuggaugaugaagauuuggacccuuccauucauaaucccuuucuaaguga

SEQ ID NO: 7667 - RNA, 64 nt, Human
gcccuccauucucgacauuccccaaccucccagccccuuccaagcaggacuaggugcccugcau

SEQ ID NO: 7668 - RNA, 64 nt, Human
uuugaguuguagugaauaugcaauuucuguguuccccuuccacccuuuaaaucuuaggaugaca

SEQ ID NO: 7669 - RNA, 64 nt, Human
aagugaagcaggauauuagcuccuuauaccuucucccuuccauuucugagaucucacauuccau

SEQ ID NO: 7670 - RNA, 64 nt, Human
acccucaagugaagcuggcucaggguggggcugucccuuccaggaguuuugccccuacaagggg

SEQ ID NO: 7671 - RNA, 64 nt, Human
uuguauugcuccauuuucuugucaauggaagaaacccuuccacguguaugcaagugggagauga

SEQ ID NO: 7672 - RNA, 64 nt, Human
aggcaaggugggaggugggauggggcaggacuuucccuuccaagcacaugcauggcaggugggg

SEQ ID NO: 7673 - RNA, 64 nt, Human
cacugcagauguucaaacucuccauuucucuuuccccuuccaccugccaguuuugcugacucuc

SEQ ID NO: 7674 - RNA, 64 nt, Human
ucccaaugaaauacugagaugcugggcugucucucccuuccaggaaugcugggcccccagccug

SEQ ID NO: 7675 - RNA, 64 nt, Human
uugcagaggugagggguagagagucagccucccucccuuccagcagcgacccagcuucccucca

SEQ ID NO: 7676 - RNA, 64 nt, Human
uggugccugagcgcagcuccagggaagccccagccccuuccaggcggggaaccugcuuccugcc

SEQ ID NO: 7677 - RNA, 64 nt, Human
aucauaaacauaauuaugauguuuuuuucaugcucccuuccaggggcucagucacuugaagaaa

SEQ ID NO: 7678 - RNA, 64 nt, Human
aaugaaaauaauggaauuuagagaacucuuucaucccuuccaggauggauguugggaaauuccc

SEQ ID NO: 7679 - RNA, 64 nt, Human
ucuacccucaggaccugggguugguuggacucugcccuuccaaauaaaccuugcuaaguccaac

SEQ ID NO: 7680 - RNA, 64 nt, Human
ccacaggcaccagcaaaacaacggaugaauguagcccuuccaacaccugacagaaugagaccaa

SEQ ID NO: 7681 - RNA, 64 nt, Human
uccagggccacaggagcacgugcugaccaguuuucccuuccaguuccugcacaaaaagugucca

SEQ ID NO: 7682 - RNA, 64 nt, Human
acccugggccacacaggcguggagguguccccaccccuuccaccugucccccagacccaaagcu

SEQ ID NO: 7683 - RNA, 64 nt, Human
agggagagagccaaaugucugaguaaacagauaucccuuccaagucucacaccucccuuagucc

SEQ ID NO: 7684 - RNA, 64 nt, Human
ccuuuccauuugcccacauauucuucuugcacaccccuuccauuacugcugaauaggacauugc

SEQ ID NO: 7685 - RNA, 64 nt, Human
aauguaauaacuuucuuaccauuaacauuuuuuacccuuccauagaagggagggaauaaaucau

SEQ ID NO: 7686 - RNA, 64 nt, Human
gacccauauaccacguugcugacucacguugcugcccuuccaugauguugccaucuccuugaga

SEQ ID NO: 7687 - RNA, 64 nt, Human
aauaagugcuuuugucuccagaguaugcgggagacccuuccaccucaagauggauauuucuucc

SEQ ID NO: 7688 - RNA, 64 nt, Human
ccgcuugccggucagggccugccgagcugccugccccuuccagcugggcagaguccccugcaag

SEQ ID NO: 7689 - RNA, 64 nt, Human
gugaaccacagguuuuagcauugucuuguucugucccuuccacuucuaacuccacuggcuccau

SEQ ID NO: 7690 - RNA, 64 nt, Human
agaacuuggggauagaggaggaagcuccucguggcccuuccaaggugaggcaaaggcaucugga

SEQ ID NO: 7691 - RNA, 64 nt, Human
uucccacauuggcccuuggauuguucggauuaaccccuuccacuccucacuggcugguucacug

SEQ ID NO: 7692 - RNA, 64 nt, Human
aauuuguuguugguuccuuuuagaccacggcugccccuuccacaccccaucuugcucuaaugau

SEQ ID NO: 7693 - RNA, 64 nt, Human
cagcugcugagcagcugaggugcugcagccccuucccuuccagcccacaagugugugcauauug

SEQ ID NO: 7694 - RNA, 64 nt, Human
aagucaguacccaccaccuucuucuccuacauaucccuuccagauggucauccagacucagagc

SEQ ID NO: 7695 - RNA, 64 nt, Human
ccauggugcaugacucuuccauaagggauccucacccuuccacuuucaugcaagaaggcccagu

SEQ ID NO: 7696 - RNA, 64 nt, Human
acccucgaggaauaccucaauaccucagacaaggcccuuccaauauguuuacguuuucaaagaa

SEQ ID NO: 7697 - RNA, 64 nt, Human
gcuggugugguccaagcuucugugugaacccuggcccuuccaucagacagcauuacccuuuguc

SEQ ID NO: 7698 - RNA, 64 nt, Human
caacagccugcccagaucccucuguucauccuaucccuuccaagguugguccaugccaacauaa

SEQ ID NO: 7699 - RNA, 64 nt, Human
cuuuuggauuuggaggguaaaagcuccuucacaccccuuccaaaagucagucacagaccacugc

SEQ ID NO: 7700 - RNA, 64 nt, Human
ccucuggggccuccaguccuucacucagugucaucccuuccagcagcucccugggccucuuggu

SEQ ID NO: 7701 - RNA, 64 nt, Human
auccacuacugcugccuuucauuuauaauaauagcccuuccaucuggcaguggggguagaauac

SEQ ID NO: 7702 - RNA, 64 nt, Human
cuuaaaauuauucucuuuuuuucuaagagucccucccuuccaaaaguguauuuuuuucaaagau

SEQ ID NO: 7703 - RNA, 64 nt, Human
uacuagggcgacuccugugugacugaagucccagcccuuccauucagccugugccaucccuggc

SEQ ID NO: 7704 - RNA, 64 nt, Human
ucaacuucugcagcaccugcuucucccccacugucccuuccaucuuggaaugugucuaaaaaag

SEQ ID NO: 7705 - RNA, 64 nt, Human
uccagguuaaaguugauucagcuuuaagauguuacccuuccagagguacagaagaaaccuauuu

SEQ ID NO: 7706 - RNA, 64 nt, Human
cccacuacguguccuggguucucucuacucagaucccuuccagaaacuuuauauggguagagga

SEQ ID NO: 7707 - RNA, 64 nt, Human
gauggauuuaggagccacugcucagugcacuucucccuuccaacugcaucaacuaacucucggg

SEQ ID NO: 7708 - RNA, 64 nt, Human
ugguuccaccuuuccauuccaaaccaccuguuuccccuuccauuagcagaaacucugggggaac

SEQ ID NO: 7709 - RNA, 64 nt, Human
gccauagacaacacacaaacgagagggcuuggcucccuuccaggaagauuuauuuaacaggcuc

SEQ ID NO: 7710 - RNA, 64 nt, Human
aguuugcuccccuuugcuugaagagacccccucccccuuccaacgagcuuccggacuugucugc

SEQ ID NO: 7711 - RNA, 63 nt, Human
cccuugucagggacuccugagggccuggguggccccuuccauuuccuggcccugcucugcuuc

SEQ ID NO: 7712 - RNA, 64 nt, Human
uauaaagccuccaauggcuuuauccuaccuagaucccuuccagcccauuuuaauuagacuaugu

SEQ ID NO: 7713 - RNA, 64 nt, Human
auaggugccuaucccugugaagaugaaccucuggcccuuccaggauggaaggagugcaauguag

SEQ ID NO: 7714 - RNA, 64 nt, Human
uuuaaaaauuaaaauaaaaaaaacacauggcucacccuuccacccacucuggggucaaauagua

SEQ ID NO: 7715 - RNA, 64 nt, Human
uugcccaucaucccuucuuccauccuuagagggacccuuccaaggucccgaccccaucccuauc

SEQ ID NO: 7716 - RNA, 64 nt, Human
ccccagaaacuccaaccccugcccuuccucuucccccuuccacccucacauccccauccccuuc

SEQ ID NO: 7717 - RNA, 64 nt, Human
gacccaguggugggguuugagcaaugcuucucugcccuuccauggaaaguggaaccagaaaugg

SEQ ID NO: 7718 - RNA, 64 nt, Human
cuucauuuccgugaagggcaccgagaacucgaagcccuuccagugguaccagcucacucccugg

SEQ ID NO: 7719 - RNA, 64 nt, Human
gggaccuguguuggaggagggguguuggggggcccccuuccaugacucuguccccugggggagg

SEQ ID NO: 7720 - RNA, 64 nt, Human
gucuccugagcccugagggauggaugucuccugacccuuccaccccgccucacucccuccgucc

SEQ ID NO: 7721 - RNA, 64 nt, Human
acggcccccagaacaacauucucccugcuggcagcccuuccaugucuccaaaccugggucagag

SEQ ID NO: 7722 - RNA, 64 nt, Human
cuaguccccgugagauguaaagaaacaguacagccccuuccacugcccauuuuaccagcucaca

SEQ ID NO: 7723 - RNA, 64 nt, Human
ugcccagccccugccccuacgggcgcugcagccucccuuccaugccccaggaucacucucugcu

SEQ ID NO: 7724 - RNA, 64 nt, Human
agcagcuggggaagcugccgcccacgggcucugccccuuccagcuggagccgcccgugccucca

SEQ ID NO: 7725 - RNA, 64 nt, Human
cuguagugaccggcagggcuggggugagaccccucccuuccagaauccaggccccaucuccccc

SEQ ID NO: 7726 - RNA, 64 nt, Human
gcccacccaccuccgguuccccugugccuccugucccuuccacgcuuaaacaggguucucuguc

SEQ ID NO: 7727 - RNA, 64 nt, Human
cugggaaggcuagacuuccucagcccgagggcugcccuuccaaacucuaucggcugaugcagcg

SEQ ID NO: 7728 - RNA, 64 nt, Human
cacugggggcagaacuuggggagaccgaagccggcccuuccacuccccuaaaccuacaguccug

SEQ ID NO: 7729 - RNA, 64 nt, Human
gcuuaguuugguaccuggagcgagagcuucuccgcccuuccaccaaccccacaggccgcuucgc

SEQ ID NO: 7730 - RNA, 64 nt, Human
uugcacauggaggacuuuucaagaugucaggauacccuuccaucaccccaccaccgccacccca

SEQ ID NO: 7731 - RNA, 64 nt, Human
acuacaguauaguuuucucuauucuuuuguuucccccuuccacauucuuuuauuauacaugaag

SEQ ID NO: 7732 - RNA, 64 nt, Human
auuuuugcaacuuccuguggccaguguguauaaccccuuccacuaucucacagauagucacagc

SEQ ID NO: 7733 - RNA, 64 nt, Human
agaucaagaaaaggaaauguuagaaguuauuuuucccuuccagaggggucuauauguguaagca

SEQ ID NO: 7734 - RNA, 64 nt, Human
uaagaaaccugccuguaaacgcucuguaaauacucccuuccacccaucccagccccugggcagc

SEQ ID NO: 7735 - RNA, 64 nt, Human
caccccauuccauacccuucuucaccugggguaccccuuccaguuuuccccuugcuucccaggc

SEQ ID NO: 7736 - RNA, 64 nt, Human
gggguguucagggucagcccucagggugcuggggcccuuccaucccuuguccccuucagguugg

SEQ ID NO: 7737 - RNA, 64 nt, Human
gugcuaacauccccuuuagaguucacacaucuugcccuuccaugaaugaccccucagucuggcc

SEQ ID NO: 7738 - RNA, 64 nt, Human
ggccuuccccuuucaacaauuuaguugaaugacucccuuccaucuaucagucuuacuccaaaua

SEQ ID NO: 7739 - RNA, 64 nt, Human
ggaaggaguuucugauagucuccugcuguuuuaccccuuccauuuuuuaaaauaagaaauuagc

SEQ ID NO: 7740 - RNA, 64 nt, Human
ugugacagagcccaaagcaaggcuggaacgcagucccuuccagcuuagucuuucugacuccuag

SEQ ID NO: 7741 - RNA, 64 nt, Human
acgacaguacugauacauaauuuaaaagcacacucccuuccacuuuguaauaccagaacucuaa

SEQ ID NO: 7742 - RNA, 64 nt, Human
aacaauagcagaaauaacagugugacauaaagugcccuuccaccuauuuuucuuugguuugcaa

SEQ ID NO: 7743 - RNA, 64 nt, Human
cuccuccaccauccacagucaauggcugugcuuucccuuccaagccagggcuuccaaagacccc

SEQ ID NO: 7744 - RNA, 64 nt, Human
cucccuugguugccaaaaaaaugauaacuuaaaucccuuccagacuuaagaauuuuauggcaug

SEQ ID NO: 7745 - RNA, 64 nt, Human
cuggaccuuggcaccugcuaggaagagccuuggacccuuccaguugcguaaagcaaaccuaccc

SEQ ID NO: 7746 - RNA, 64 nt, Human
cugacucccgcuuagcacacccuuaggcaggcgccccuuccaccuuuccccgagaccgucgucg

SEQ ID NO: 7747 - RNA, 64 nt, Human
gccccuggagacugauccccucugaguccucugccccuuccaaggacacuaaugagccugggag

SEQ ID NO: 7748 - RNA, 64 nt, Human
cugugaauguacaggcggaacuguacgaacagcucccuuccauccauuuuuaacucuuucggaa

SEQ ID NO: 7749 - RNA, 64 nt, Human
auccaccccguugcucaagccggaaacucggcagcccuuccaaacucuucccucucucacuccc

SEQ ID NO: 7750 - RNA, 64 nt, Human
aaguaggaaaguaggcugcuaccuaacuuuuagucccuuccaaaaccauuuaguaggguucuau

SEQ ID NO: 7751 - RNA, 64 nt, Human
guggagagcccacggugggcuuagccugccuaggcccuuccauuucucuucuuugaccgugcua

SEQ ID NO: 7752 - RNA, 64 nt, Human
ccagcgccuuucccucaaguccuuucugauucugcccuuccaacgcaucacccgccucaaacug

SEQ ID NO: 7753 - RNA, 64 nt, Human
agacaccaacagccccugagagccgccuggcuuucccuuccaguuccgggagagcggcugcccg

SEQ ID NO: 7754 - RNA, 64 nt, Human
ggauugagugccaggugcauccaagacuuucccucccuuccagaaggcacugacugaagacagg

SEQ ID NO: 7755 - RNA, 64 nt, Human
gaccggggugaauuagaacguuuuuaaagacacccccuuccaaauucuguaacacauuguaauu

SEQ ID NO: 7756 - RNA, 64 nt, Human
gagccccgcggggaggcggcggcgacugccacagcccuuccagccugucuugcuggccgcccug

SEQ ID NO: 7757 - RNA, 64 nt, Human
agcaaagcccacugccaguaagaaggccaaagggcccuuccauccuagcccucugcaggcaugc

SEQ ID NO: 7758 - RNA, 64 nt, Human
ugacuguaacugaaguggccgggcccagacaugccccuuccaaaacuggaacaccuagcuaaca

SEQ ID NO: 7759 - RNA, 64 nt, Human
ucuuuugauuacauccuaaaacuacaugcuuccccccuuccaguagcgagccaccagaagcuuu

SEQ ID NO: 7760 - RNA, 64 nt, Human
ugcagcuccgcacccccgggggccucagaacuaccccuuccagggccucagaacuaccccuaca

SEQ ID NO: 7761 - RNA, 64 nt, Human
ccaagucaggaucuuaggccucagcaggcagggacccuuccaggccacaguaggcugaagcagc

SEQ ID NO: 7762 - RNA, 64 nt, Human
guugcagcaugcuugaaaucugggauguggaagacccuuccaaugcagcuaacccucccuuaug

SEQ ID NO: 7763 - RNA, 64 nt, Human
ccggagcuacaccacgcagcugaccaugaacauccccuuccaguccauccacuucaucaccuau

SEQ ID NO: 7764 - RNA, 64 nt, Human
uucucuuugauagaauuuugaggccaugccaccucccuuccaguccacauggaauuccagaauc

SEQ ID NO: 7765 - RNA, 64 nt, Human
ugccccauuuguuuuacuuguucuuuaauauaaacccuuccauuuuuuaacaauuccuaacacu

SEQ ID NO: 7766 - RNA, 64 nt, Human
caauucaugguauuuauuuguuauucuucaaugacccuuccacaucaacaguauuuaucaugug

SEQ ID NO: 7767 - RNA, 64 nt, Human
aaugacccacuuuagaugcuccaagaacaagcaucccuuccauguaugucuugagaaagaaauc

SEQ ID NO: 7768 - RNA, 64 nt, Human
aagcagugauuccuuuggugccauauaccacucucccuuccacucuggcuuuacugcagcgauc

SEQ ID NO: 7769 - RNA, 64 nt, Human
gcuccccuuugugcaggcuggccagccaagaguucccuuccagcucccacugcugcuuuccacc

SEQ ID NO: 7770 - RNA, 64 nt, Human
caaggaccacgaggcuuucugcacuuucugcacccccuuccaaagugaccacaaaauuucaaag

SEQ ID NO: 7771 - RNA, 64 nt, Human
cugacuguaauuuauuucccuguuucacgucucucccuuccauucugcaggaguuuuagcuauu

SEQ ID NO: 7772 - RNA, 64 nt, Human
ucagaaggugccaguccggucccaggucccuugucccuuccacagaggccuuccuagaagaugc

SEQ ID NO: 7773 - RNA, 64 nt, Human
ccucuccuccuuggcacuggcggccuccuugccucccuuccacccgugcugccaucccgugccu

SEQ ID NO: 7774 - RNA, 64 nt, Human
cgugcacggcucucucaugaccagcucucugccucccuuccaggaggcuccaucccacacuguu

SEQ ID NO: 7775 - RNA, 64 nt, Human
ucaaaugcauaccacaaaugcaauaauacaauaccccuuccaagugccuuuuuaaauuguauag

SEQ ID NO: 7776 - RNA, 64 nt, Human
auucuaaauguacguaagguaaagacuaaagucacccuuccaccauuguccuagcuacuugguu

SEQ ID NO: 7777 - RNA, 64 nt, Human
uguuugaaaacuucagaagcaaacaauauugucucccuuccagcaauaagugguaguuauguga

SEQ ID NO: 7778 - RNA, 64 nt, Human
cugaggcaggagggcaugugcagacacucaagagcccuuccaggagugggucgcccacgggugu

SEQ ID NO: 7779 - RNA, 64 nt, Human
ccuccacagaaugucugaauucuugcauucuuuacccuuccaucacuauauugauucuuuuuuu

SEQ ID NO: 7780 - RNA, 64 nt, Human
ggcugccaggauuccccuggcccgucugggccaacccuuccaugggugaagacaagcaaguccc

SEQ ID NO: 7781 - RNA, 64 nt, Human
gcccuguccugccuuggacacuucccugagaagccccuuccacucucccacccacccucuucaa

SEQ ID NO: 7782 - RNA, 64 nt, Human
aaugaacagaaugaucugugugagccgaugccugcccuuccagaggggccacuguccccagccg

SEQ ID NO: 7783 - RNA, 64 nt, Human
uguuuucuauaugguuuuuccagcuagcaguacucccuuccauaccugugacugggcagugcuu

SEQ ID NO: 7784 - RNA, 64 nt, Human
gaaaauaauucuuugagacagauuucagcuaccucccuuccagguucgauuuaacuugguugua

SEQ ID NO: 7785 - RNA, 64 nt, Human
cugcagucgucaaggggcuccugaugcaagaugccccuuccauuuuaagucugucuccuuacag

SEQ ID NO: 7786 - RNA, 64 nt, Human
uccaaaacugccaagugacucauugccuucccaacccuuccagaggcuuucugugaaagucuca

SEQ ID NO: 7787 - RNA, 64 nt, Human
gcuuuccgagucuggugggcaggacuucucgcugcccuuccaagcccggcuuugggccaggaaa

SEQ ID NO: 7788 - RNA, 64 nt, Human
caucgugccugggaaggcgaaauauacccccagccccuuccaacacacacacuccagcgagagg

SEQ ID NO: 7789 - RNA, 64 nt, Human
aggcccccccacuccuaggcccggcagcugcagccccuuccagaugaagaccaagcgccccucc

SEQ ID NO: 7790 - RNA, 64 nt, Human
gcucaccuccgccuccaggaagaccagacucccacccuuccacaccuccagagcagugggacuu

SEQ ID NO: 7791 - RNA, 64 nt, Human
agucuuuuuuuauugaguccuccucuuugcugaucccuuccaaggguucaauauauauacaugu

SEQ ID NO: 7792 - RNA, 64 nt, Human
gcaacauggggugaaccucagcacucccacaccucccuuccagcaggccagugguuauggccag

SEQ ID NO: 7793 - RNA, 64 nt, Human
cccacucuggcacuggcuucauccuuuaccuauccccuuccacccuccuuugcugcuuaauaaa

SEQ ID NO: 7794 - RNA, 64 nt, Human
ccagugacacaggcagagcggugcagcccuccuucccuuccauuuggaggagguggugccagga

SEQ ID NO: 7795 - RNA, 64 nt, Human
uuucuguaaaagaaagggaaaccuaaaacaaauacccuuccauauauaauauauauggaauaug

SEQ ID NO: 7796 - RNA, 64 nt, Human
gcuauugcacaaacccuaucaagagcugcugcuucccuuccagccagaaaagugguaagcggag

SEQ ID NO: 7797 - RNA, 64 nt, Human
uuguacaguaugaccuauaugugaccauguuacucccuuccauuucacacaaagaaauagacac

SEQ ID NO: 7798 - RNA, 64 nt, Human
caggugcagccuaagaagggaaccugcuuccucucccuuccaaagacagugacagcugacugag

SEQ ID NO: 7799 - RNA, 64 nt, Human
auucccacauggggagcaccaggagcccuggagccccuuccacccaaucccaucucgcaggaga

SEQ ID NO: 7800 - RNA, 64 nt, Human
gagccgacugugccacccacuugcgagccucagucccuuccaagcugcacuggucauugggaau

SEQ ID NO: 7801 - RNA, 64 nt, Human
uaguuuguugcauugcagguaagucugguuuugucccuuccaggaggacauagccugcaaagcu

SEQ ID NO: 7802 - RNA, 64 nt, Human
agaguuccugaaacaggugaaaccuguaugacagcccuuccacuuuggggagccacgcuuuuga

SEQ ID NO: 7803 - RNA, 64 nt, Human
ucccauguauuuuaaccuaaauggaauguaucuucccuuccaagcugccuaaagcgcuguuuua

SEQ ID NO: 7804 - RNA, 64 nt, Human
auuuucccuuuaaauaucucuuaugucugcauuucccuuccauucccaucacuagcacuguccu

SEQ ID NO: 7805 - RNA, 64 nt, Human
uccugaaaugacagcagggagacuugggugaccccccuuccaggcgccaucuagcacagccugg

SEQ ID NO: 7806 - RNA, 64 nt, Human
ugcacguaguccagaugccugggaaggaacaucucccuuccagcaucugcugguagcaggcugg

SEQ ID NO: 7807 - RNA, 64 nt, Human
cuggucagcugguccaggcugguccccgccgguccccuuccaguccagccaccaagaguccacu

SEQ ID NO: 7808 - RNA, 64 nt, Human
aaggccucccacaggugacagaauguucugccuucccuuccaucucuucaccccuagcugucag

SEQ ID NO: 7809 - RNA, 64 nt, Human
acauugcuuagaacguuaaacuauuagaguauuucccuuccaaagagggauguuuggaaaaaac

SEQ ID NO: 7810 - RNA, 64 nt, Human
gggggaaaggacucuguccccuuggggcucaucacccuuccacauccuccuccucguugccccc

SEQ ID NO: 7811 - RNA, 64 nt, Human
uaauggauggggguuaccuagcccuggcuaauuccccuuccauucccaacucucucucucuuuu

SEQ ID NO: 7812 - RNA, 64 nt, Human
cgcaguccaaaguuucaucugagacaaggcaagucccuuccacuuaugaaccuguaaaaucaaa

SEQ ID NO: 7813 - RNA, 64 nt, Human
ucccugccauugaugcuguugcucucguccgccucccuuccacagguaagcacgcaagacacag

SEQ ID NO: 7814 - RNA, 64 nt, Human
gauguucuaagucuuuccauuggaucucauuggacccuuccauggugugaucgucugacuggug

SEQ ID NO: 7815 - RNA, 64 nt, Human
gaguaagucaaccugccugacauuuggaguguuccccuuccacugagggcagucgauagagcug

SEQ ID NO: 7816 - RNA, 64 nt, Human
uccaacaaacagggcuggcuccagcacaaacucucccuuccaccuuuacgacccucuccagacc

SEQ ID NO: 7817 - RNA, 64 nt, Human
gacuguugcuguggucucuucucaucuuaacugucccuuccaaccacccuccacacugcugcca

SEQ ID NO: 7818 - RNA, 64 nt, Human
gccccuggcccagugagcccagacgcuccuccaccccuuccagaccaagcucaacgccuccaag

SEQ ID NO: 7819 - RNA, 64 nt, Human
gucagaacuuuccauacgaguauaucagaacacacccuuccaagguauguaugcucuguuguuc

SEQ ID NO: 7820 - RNA, 64 nt, Human
ccuccuuuugcuccuggacccuuuagccucucugcccuuccacucucugaccaccgcccccgcc

SEQ ID NO: 7821 - RNA, 64 nt, Human
uggggguugaggcagggcaaaugacaugcacugacccuuccagacauacgaaacacaaaccaca

SEQ ID NO: 7822 - RNA, 64 nt, Human
gucccugggaggaaauuugaauggguccauuuugcccuuccauagccuaaucccugggcauugc

SEQ ID NO: 7823 - RNA, 64 nt, Human
uuugugccuuuggccuggggugcaucuccucccgcccuuccaugugccuuucuuugccucugca

SEQ ID NO: 7824 - RNA, 64 nt, Human
gggagagagagauuagauuauuuugacaugggaucccuuccauaacagguacuuugaaggcaag

SEQ ID NO: 7825 - RNA, 64 nt, Human
gaguuggggagcuggacuggaugacucuggaggccccuuccaaaccucaaguguccggcgcuuu

SEQ ID NO: 7826 - RNA, 64 nt, Human
cugaccgacuccacuuaacccccaaacccagccccccuuccagggguccagggccagccugaga

SEQ ID NO: 7827 - RNA, 64 nt, Human
uugguacuaccucagcugaggguggugacacaaccccuuccauuugucagcacuuuccagccug

SEQ ID NO: 7828 - RNA, 64 nt, Human
ccaguggcaugaugaauggagaggauggcuggaccccuuccacuacuuauguuuauaauuuuuu

SEQ ID NO: 7829 - RNA, 64 nt, Human
cuuguuguugguuguuuuuuccuuugcucuuucccccuuccaucucugacuuaagcaaaagaaa

SEQ ID NO: 7830 - RNA, 64 nt, Human
aaacucaccauugcccuauccuugugucuccacccccuuccauguguugaauaauaaaaggugg

SEQ ID NO: 7831 - RNA, 64 nt, Human
cccucaggugguccaccagucucccccuuugguucccuuccagucucuucccccuuucuauccc

SEQ ID NO: 7832 - RNA, 64 nt, Human
gucauaccagaguggccaagaguguuuaucccaacccuuccauuuaacaggauuucacucacau

SEQ ID NO: 7833 - RNA, 64 nt, Human
aauucaucucagcaaucacaagccaaggucugaacccuuccaccaaaaacuggguguucaaggc

SEQ ID NO: 7834 - RNA, 64 nt, Human
ugacucagggugggcccugcaugugaugacugggcccuuccagagggagcucuuuggccagggg

SEQ ID NO: 7835 - RNA, 64 nt, Human
ugcacaggcugccagccccccaguccagcccucucccuuccacuggugccuugcuuagagccag

SEQ ID NO: 7836 - RNA, 64 nt, Human
agggcacgaguucucucagcccauuccccaccuccccuuccauaccccuuccuggaucuccagu

SEQ ID NO: 7837 - RNA, 64 nt, Human
aguuaguucugcagucuaguaugguccccauuugcccuuccacuccaccccacccuaaaccaug

SEQ ID NO: 7838 - RNA, 64 nt, Human
uuggaacacuuuguuuuucucccugugccauuuacccuuccaccuuuccauccugccuucuacc

SEQ ID NO: 7839 - RNA, 64 nt, Human
uguuuaccuaccguagcuuuuuaccguucacuuccccuuccaacuauguccagaugugcaggcu

SEQ ID NO: 7840 - RNA, 64 nt, Human
guuagcuccaaagcauuucccacccuccaucuaccccuuccagaagcaaaaacaaaccaugacu

SEQ ID NO: 7841 - RNA, 64 nt, Human
aguuauguuuccuugccccgucgcauuaaugaggcccuuccacaucauuuuuaaacuaauguuu

SEQ ID NO: 7842 - RNA, 64 nt, Human
cagcuguguccuggguuagggguugggggucggccccuuccagggccaggagggcagguucccu

SEQ ID NO: 7843 - RNA, 64 nt, Human
caugagagugaggacuuuccgcgcccauuggugacccuuccaggcagacagccucagcaacgcc

SEQ ID NO: 7844 - RNA, 64 nt, Human
uuguagauccuuagagguccucuggagcccuaaccccuuccagaucacugccacacucuccauc

SEQ ID NO: 7845 - RNA, 64 nt, Human
uuccuucuggccuuuccucucuccuguuucccuucccuuccacugccucugccuuagaggagcc

SEQ ID NO: 7846 - RNA, 64 nt, Human
cucagcaauaacuccaugggcucugggacccuaccccuuccaaccuucccugcuucugagacuu

SEQ ID NO: 7847 - RNA, 64 nt, Human
uccguuggcuucugaacuggaauucugcagcuaacccuuccacgacuagaaccuuaggcauugg

SEQ ID NO: 7848 - RNA, 64 nt, Human
caggccugucgggccccccgacgccgccccauuucccuuccagcaaacucaacucggcaaucca

SEQ ID NO: 7849 - RNA, 64 nt, Human
uggcuucagggccacuauggaacccugcuguucccccuuccaaaggauacuaagaugccccucu

SEQ ID NO: 7850 - RNA, 64 nt, Human
cuuccucccgcucucugcuggcacgcgaggcuuccccuuccaccccauguggguauucccacaa

SEQ ID NO: 7851 - RNA, 64 nt, Human
agucugugugcacagaguggguguuccuucgagccccuuccacucagagggccacacccagcga

SEQ ID NO: 7852 - RNA, 64 nt, Human
gagauuggccauuaggccuccugagauuccagcucccuuccaccaagcccagucuugcuacgug

SEQ ID NO: 7853 - RNA, 64 nt, Human
uuggaaucucuccaucuguaauuccucacccucacccuuccaccguuguuaguaucaugguguu

SEQ ID NO: 7854 - RNA, 64 nt, Human
auggcuguggugugcauacuguguaguuacauagcccuuccaauucuggguccauuugcacuag

SEQ ID NO: 7855 - RNA, 64 nt, Human
uccuucucucucuccuuuucucuucccuuccuuccccuuccaucuuucuuuccacauguccuuu

SEQ ID NO: 7856 - RNA, 64 nt, Human
ucucccugcccccaccccaguuccccaacccacucccuuccaacaacaaccagcuccaacugac

SEQ ID NO: 7857 - RNA, 64 nt, Human
uggcuauucugugucccuacacuaccuggcuacccccuuccauggccccagcucugccuacauu

SEQ ID NO: 7858 - RNA, 64 nt, Human
uuuuaaugaacccucuaagcucucucaguuccuucccuuccacaaaaugcaagagcaaaagcaa

SEQ ID NO: 7859 - RNA, 64 nt, Human
ugauauuuuaaucagguuuuacuaucugcuaggccccuuccaucaauucuuauuaaauucucaa

SEQ ID NO: 7860 - RNA, 64 nt, Human
acaucugucugugagacacagcgcaaugcuacugcccuuccagaaacugugcuaaaaagagaaa

SEQ ID NO: 7861 - RNA, 64 nt, Human
ggaugaaucagucaccccgaaucuuggaaaaacccccuuccaggagaggaugggcaggcauuua

SEQ ID NO: 7862 - RNA, 64 nt, Human
ggcagccacuaugccuaggcccauguggucugggcccuuccagugcuuuggccuuacgcccuuc

SEQ ID NO: 7863 - RNA, 64 nt, Human
caaagagagggcuggcuuaguuauuugccaaagccccuuccaggccugaauuccacaaguacga

SEQ ID NO: 7864 - RNA, 64 nt, Human
cccugggacacccacagcugcagcaggugaccuccccuuccagacccagccaugcugugauacc

SEQ ID NO: 7865 - RNA, 64 nt, Human
cuugaagccagguagcuggggacuauggugucugcccuuccaaucaccucccugaccccugcug

SEQ ID NO: 7866 - RNA, 64 nt, Human
ggggcauguauggaauuugcugcuucucuggggucccuuccacaggagguccugugagaaccaa

SEQ ID NO: 7867 - RNA, 64 nt, Human
acuaagagaucucaaauauuagucuuuguccggacccuuccauaguacaccuuagcgcugagac

SEQ ID NO: 7868 - RNA, 64 nt, Human
uuauuacuagaccucaaccacagucuucuuuuuccccuuccaccucucuuugccuguaggaugu

SEQ ID NO: 7869 - RNA, 64 nt, Human
uguuaguagucauuuugguccaacugcaugucaacccuuccauuucaaucccaguuagaaauga

SEQ ID NO: 7870 - RNA, 64 nt, Human
gacugggggaggaccugcucugcccucuccccaccccuuccaaugagcuccuuguuuuugccaa

SEQ ID NO: 7871 - RNA, 64 nt, Human
gcccccaacuccauuuccugucugucuuagacagcccuuccaacugugucaucucuucucugga

SEQ ID NO: 7872 - RNA, 64 nt, Human
gaugccugugcccucuggaaaaauuuccuccuagcccuuccagggccuuaucauaaaacucugg

SEQ ID NO: 7873 - RNA, 64 nt, Human
uauuguucuccaaggaugggaaucaggcaugugucccuuccaagcuguguuaacuguucaaacu

SEQ ID NO: 7874 - RNA, 64 nt, Human
gccccgggacuuggggccaauacggaaacccuaccccuuccaugcucaucucacugcccaguga

SEQ ID NO: 7875 - RNA, 64 nt, Human
gggacaccacccacucaggacucuuccccaucaucccuuccauugccacacccuagauccagcc

SEQ ID NO: 7876 - RNA, 64 nt, Human
aaucaucaaaggugucaacaaauccagccugauacccuuccagucucacuuccaguggaaggca

SEQ ID NO: 7877 - RNA, 64 nt, Human
guaaaaugugggugcuggauuggaucuuaaagaucccuuccagcucugaaaugcugauuguaca

SEQ ID NO: 7878 - RNA, 64 nt, Human
cucugagcuguauuguucuuuaauggcugucuugcccuuccaaaaaaaauugaaaaaaaaaaaa

SEQ ID NO: 7879 - RNA, 64 nt, Human
agcauaaagcaucaaccucauagcaacugaauagcccuuccauuauaaauaacauugagaguuu

SEQ ID NO: 7880 - RNA, 64 nt, Human
uuuuuaaauuuaaaugggaauauaacacaguuuucccuuccauauuccucucuugaguuuaugc

SEQ ID NO: 7881 - RNA, 64 nt, Human
aaggggccauggaagguucucugugcuccuccuacccuuccagugcccuaggccuggcgacugc

SEQ ID NO: 7882 - RNA, 64 nt, Human
gagacacuuagcuucccucucccucauucccggacccuuccaccccacugggcccaaccauggg

SEQ ID NO: 7883 - RNA, 64 nt, Human
guuccuucucuuccugcggauguagagguggggccccuuccaagagggacaggccucuccccag

SEQ ID NO: 7884 - RNA, 64 nt, Human
ccacuucccauuuccucugcccuuuuccaccucccccuuccaucccaccagcugccaguggcuc

SEQ ID NO: 7885 - RNA, 64 nt, Human
aaaguccaaaucuucuugauauugugaaccguaccccuuccaguuuaguuucuucuggacuuuc

SEQ ID NO: 7886 - RNA, 64 nt, Human
gcuuugcaggugacgaugccccccgggcugucuucccuuccaucguggggugccccaggcacca

SEQ ID NO: 7887 - RNA, 64 nt, Human
cuccagcuagacuuuucucuuugccuccucccuucccuuccacucuuuaaaguucugcaguuca

SEQ ID NO: 7888 - RNA, 64 nt, Human
uuaagaaauuuuucuucauauuaucacaaucaugcccuuccauugaauuauuaauuacaauuaa

SEQ ID NO: 7889 - RNA, 64 nt, Human
cauuugcgugaucucaagaccuccagccagaagucccuuccaaauauaagaguacucauguuua

SEQ ID NO: 7890 - RNA, 64 nt, Human
gcuggaguuugcugugggcacugaggcgcgggcgcccuuccaaagcacauacucaccgaauguu

SEQ ID NO: 7891 - RNA, 64 nt, Human
ggaugaaagaaugucaagccaugauggaaaaugccccuuccaaucagcugccuucacaagcagg

SEQ ID NO: 7892 - RNA, 64 nt, Human
ucgucccagcugcuaacuuggggccggggccccucccuuccacauauaccuuggguuugugcau

SEQ ID NO: 7893 - RNA, 64 nt, Human
ccugcugccaugugaagaaggauguguuugcuuccccuuccaccaugauuguaaguuucaugag

SEQ ID NO: 7894 - RNA, 64 nt, Human
ccagugucuggcacacaguaggugcucauuggcucccuuccaccugucauucccaccacccuga

SEQ ID NO: 7895 - RNA, 64 nt, Human
cauugagaacuugaaauuauuuccugaucccuuccccuuccacuauuaauaauucauuucuguc

SEQ ID NO: 7896 - RNA, 64 nt, Human
ugguuuuuuguuguauuucccccuuuccacugggcccuuccaacacaaugaaugaaggaaauau

SEQ ID NO: 7897 - RNA, 64 nt, Human
uugucaucaggcaacuuuaacccuuagagugcuucccuuccauuaagcugaaauugccccacgg

SEQ ID NO: 7898 - RNA, 64 nt, Human
cacucugcagcucaaacaagaagcucagagcugccccuuccacuuccuccccaaaagggaugaa

SEQ ID NO: 7899 - RNA, 64 nt, Human
cggacagacugugaacuugccaagagaugcaauacccuuccacaccuuugggugucugucuggc

SEQ ID NO: 7900 - RNA, 64 nt, Human
cuccucagcccucuucucccugcuccaguagucucccuuccaaauaaaucacuuuucugccuuc

SEQ ID NO: 7901 - RNA, 64 nt, Human
uuaagggugggagucuggagccagacagccaagccccuuccacaucuacagggucacugucauc

SEQ ID NO: 7902 - RNA, 64 nt, Human
cugaucuccgggagggacagauggccaaucucuccccuuccaaagcaggcccugcuccccgggc

SEQ ID NO: 7903 - RNA, 64 nt, Human
cuucaugcccuucucugcagagcaugggauggggcccuuccagcccacuuugccuacuguuagg

SEQ ID NO: 7904 - RNA, 64 nt, Human
caguguuuuccaccucauucucccagauugagcucccuuccaaaggaucguuccucucauugca

SEQ ID NO: 7905 - RNA, 64 nt, Human
ggaggcauuaugacuaaauaggcccagccuccuucccuuccagcucuguccuaggagcauaggc

SEQ ID NO: 7906 - RNA, 64 nt, Human
acuaaccauccuugagcccagauggggcucagggcccuuccagagccugucauguccuugugca

SEQ ID NO: 7907 - RNA, 64 nt, Human
uauguguccuuacauagaccuuaaaaagagcucacccuuccaggccaaugcugaagacacagcu

SEQ ID NO: 7908 - RNA, 64 nt, Human
gggcguggggagggccguaccccacccucagcaccccuuccauguggagaaaggagugaaaccu

SEQ ID NO: 7909 - RNA, 64 nt, Human
gccccgaugaccaucuggucagcccucccaaccucccuuccagggggcuuaccagcaaagccau

SEQ ID NO: 7910 - RNA, 64 nt, Human
acauuuccaucaccccagaaacuccccuuguacccccuuccacuucgucuccccuagcuccuag

SEQ ID NO: 7911 - RNA, 64 nt, Human
ugccaucugaacaaacuaugcaauaccaccugcucccuuccaggagcauuuuaauaaaagauuu

SEQ ID NO: 7912 - RNA, 64 nt, Human
cuugacccauucccucccagccuccgcucugccucccuuccacagaagcccucuucgggcagcc

SEQ ID NO: 7913 - RNA, 64 nt, Human
gcaaaggacacccagaccuccaagguuugugggccccuuccacaaagcuguaagucccagccca

SEQ ID NO: 7914 - RNA, 64 nt, Human
ugcucagcugcccgucucuggccugggccccugccccuuccacccugugcuuagaaagucgaag

SEQ ID NO: 7915 - RNA, 64 nt, Human
ugugagguguggggaagcccugggacccucacuccccuuccaguguguaacuggauuggcuccc

SEQ ID NO: 7916 - RNA, 64 nt, Human
guucuuguccgccugucacgcccucaccacccuccccuuccagccaccacccuuuccguuccgc

SEQ ID NO: 7917 - RNA, 64 nt, Human
acauauccguggccaccugagaccugcuccacgacccuuccaggcagagccgagaguucgcccc

SEQ ID NO: 7918 - RNA, 64 nt, Human
gcugauuggguuuuacaagagugcauuugucucccccuuccacccguggggccccaccuucagg

SEQ ID NO: 7919 - RNA, 64 nt, Human
aacaaucugcaauuuuucaguccgugagauccugcccuuccaccucuuucccauacccccaagg

SEQ ID NO: 7920 - RNA, 64 nt, Human
caugcucugggcagcuguuccaagacagagcugacccuuccauuaccaauggccugucccucac

SEQ ID NO: 7921 - RNA, 64 nt, Human
uccuagcuugggggcucugaaugaaagguuucuucccuuccaguucgaauuuggaaacucccaa

SEQ ID NO: 7922 - RNA, 64 nt, Human
ccaaccaguucaaucucaucccucccagcagcuccccuuccaccccccggggaacugaagauug

SEQ ID NO: 7923 - RNA, 64 nt, Human
aaugucugaacucuccagcuucgcgugagaaguccccuuccaucccagagggugggcuucaggg

SEQ ID NO: 7924 - RNA, 64 nt, Human
gguccuguucccaucagcgauuccccugcuuaaacccuuccaugacuccccacugcccuaagcu

SEQ ID NO: 7925 - RNA, 64 nt, Human
ccuuugugaggaagccgcuggggccaguuggucccccuuccauggacuuuguuaguuucuccaa

SEQ ID NO: 7926 - RNA, 64 nt, Human
aagugccauagccuuuauucagggggccuauaaacccuuccaguucuugccccagggcuggccu

SEQ ID NO: 7927 - RNA, 64 nt, Human
ggagaaccgucagggcaggaaccccacagacugucccuuccagcccacacucugccaccuccug

SEQ ID NO: 7928 - RNA, 64 nt, Human
cuccugcccacaccagccacuuuggugacaaugacccuuccaagaaucuuugguucaaggagca

SEQ ID NO: 7929 - RNA, 64 nt, Human
cccucccuuuccuccccucccugccucccuucuucccuuccaucucccccuccucccugccuuc

SEQ ID NO: 7930 - RNA, 64 nt, Human
uacuuuaaacuuuuuugcucugcagccuuccuugcccuuccaccuccuccuccuaauauucacu

SEQ ID NO: 7931 - RNA, 64 nt, Human
cuuuccccccaggcucuuuguuucccuccacccacccuuccauauccucuggagcaggagacaa

SEQ ID NO: 7932 - RNA, 64 nt, Human
uguguguccccucacgcaagugccagggcugggccccuuccaaaugucccuccaacacagaucc

SEQ ID NO: 7933 - RNA, 64 nt, Human
gaagcaagcggccguccgggcguccgccuccguccccuuccauguuccuccucuuccuucgcuu

SEQ ID NO: 7934 - RNA, 64 nt, Human
ggcccuggucacugcaugauccgcucuggucaaacccuuccaggccagccagaguggggauggu

SEQ ID NO: 7935 - RNA, 64 nt, Human
gcuuuuuuucuuccgagcuugucuuaucucaaaccccuuccagucaaggaacuagaaucagcaa

SEQ ID NO: 7936 - RNA, 64 nt, Human
guugauccucaaguccuacagguuccuugucuuccccuuccagugacccaccccugaccccaga

SEQ ID NO: 7937 - RNA, 64 nt, Human
uugucucaccaggacccauaccuuucaccuuguucccuuccaccccuccaguuagucccuaucu

SEQ ID NO: 7938 - RNA, 64 nt, Human
acggggcacgcggugguagaucccuuucuaaggucccuuccagcccagccguucugggagccca

SEQ ID NO: 7939 - RNA, 64 nt, Human
guacauccagugaggguuuuauuacgcuagguuucccuuccauagauugugccuuucagaaaug

SEQ ID NO: 7940 - RNA, 64 nt, Human
caucguggagcccauggagucccacccuccuucccccuuccacccugcgcaaaaggggacggcc

SEQ ID NO: 7941 - RNA, 64 nt, Human
gaguaugucccaucacuaccaugaagugugcucacccuuccagccuccucugcccucacccccg

SEQ ID NO: 7942 - RNA, 64 nt, Human
ugguugcugugaugauauccagugucccucugcccccuuccauccccaaccacauuugacugua

SEQ ID NO: 7943 - RNA, 64 nt, Human
ugaacugagcccaaguguauucucuggccugggccccuuccagaaucagugcgagcguccugca

SEQ ID NO: 7944 - RNA, 64 nt, Human
ccuauggacucccgggccuugugugcaggccaggcccuuccacugauuuuuuaaagugaaccau

SEQ ID NO: 7945 - RNA, 64 nt, Human
uccacaccucuuggcaaugaaauuugcagcuccucccuuccauaaaugaagucucuuuccccac

SEQ ID NO: 7946 - RNA, 64 nt, Human
gaaagacucacgagaaaagccaguggagaaagcgcccuuccagggcggcagcagcgggagccac

SEQ ID NO: 7947 - RNA, 64 nt, Human
cgagagagacugcacuuggccacagcgccuccaucccuuccagacugguccagacgucggggag

SEQ ID NO: 7948 - RNA, 64 nt, Human
gggaggcaugguaggaucauaagucauuccccuccccuuccaggccuccugcuauauuuggggg

SEQ ID NO: 7949 - RNA, 64 nt, Human
gaaagagagagaagccagagauagccugauccugcccuuccaguucaguucugaaaaguaaggu

SEQ ID NO: 7950 - RNA, 64 nt, Human
cucuugccagcuucucugacacuuggguugggggcccuuccaggaggaaacccccuugggugcc

SEQ ID NO: 7951 - RNA, 64 nt, Human
cauguuuucuaaugcuggggagcugcacccaccucccuuccagggauuugaauagugguuuuuc

SEQ ID NO: 7952 - RNA, 64 nt, Human
uugaguucaguguggagacuugaaacuugaaugucccuuccaacuuuuauauuaaaaauaaaaa

SEQ ID NO: 7953 - RNA, 64 nt, Human
cgcuccaccgggggcguggcuagaucugaccgcgcccuuccaggccccgcccucagguauggga

SEQ ID NO: 7954 - RNA, 64 nt, Human
uugagcaaguagguugcugucucuaagcccccuucccuuccacuaugagcugcuggcagugggu

SEQ ID NO: 7955 - RNA, 64 nt, Human
cugcagccccuggcuucccagccuuccuccugaccccuuccaacagccuuggaacuccagcugc

SEQ ID NO: 7956 - RNA, 64 nt, Human
gaaaaggauggaccuucucuucuucucagauggucccuuccauuccccugaaaccugcaugaga

SEQ ID NO: 7957 - RNA, 64 nt, Human
acuucaagcaccagggaagaucuaacauuugagucccuuccaggccaucagaggccuagucagc

SEQ ID NO: 7958 - RNA, 64 nt, Human
uccacugucuccuggggcaguugugggucacugucccuuccagcugccccagacaggaagcaga

SEQ ID NO: 7959 - RNA, 64 nt, Human
uucaucuccagcccgugagcugguccugcuuccucccuuccaugcccuaacuuuuaauaugcuu

SEQ ID NO: 7960 - RNA, 64 nt, Human
auuaacaacagaguguaggggagauuaacugccucccuuccaauagacacuaucagcagggaca

SEQ ID NO: 7961 - RNA, 64 nt, Human
uuaguugggcagugcucccacccacccuccagaucccuuccagcuaaaacccuucccccuuccc

SEQ ID NO: 7962 - RNA, 64 nt, Human
gccgggaggauggugcaccccaacuccacaaggacccuuccagaccucacccuguguaucucuu

SEQ ID NO: 7963 - RNA, 64 nt, Human
cugugaccaccacacuccaggaggcagccccauccccuuccagccccuaaguaggcccuccccu

SEQ ID NO: 7964 - RNA, 64 nt, Human
gccucacccucccucuaggauuaaagugcuucugcccuuccacgaacuccuccuccauuuccuu

SEQ ID NO: 7965 - RNA, 64 nt, Human
cugccuguuggcaggcccacuccccagccccagccccuuccaugguacuguagcaggggaauuc

SEQ ID NO: 7966 - RNA, 64 nt, Human
gcuggggacaguccgcacucugccacccuccugccccuuccacccaccccagcucuaugucugu

SEQ ID NO: 7967 - RNA, 64 nt, Human
gcuuuuuauauuguuuauuucaugcuuguacuuucccuuccaauccuuggaucaaauauugauu

SEQ ID NO: 7968 - RNA, 64 nt, Human
ccugccugugucccagugagaacugaccugaguccccuuccaaacccagacccaccuccugccc

SEQ ID NO: 7969 - RNA, 64 nt, Human
ugaguccacuugcgggguaagagauaaacaguaacccuuccaggagcccacugacguuggagug

SEQ ID NO: 7970 - RNA, 64 nt, Human
cacccugugggaccgccuggcccucccucccuagcccuuccagccugggacacacacacacaca

SEQ ID NO: 7971 - RNA, 64 nt, Human
uagcaacauacagggacacuuggaaaaccauuuccccuuccaguagcuugguguccaucccaga

SEQ ID NO: 7972 - RNA, 64 nt, Human
caggcccacagguuuaaggcugaggcugcccugacccuuccacagucauuucuucuagguuuuc

SEQ ID NO: 7973 - RNA, 64 nt, Human
ugggcucugcugcccuggaccccucuauuuauuucccuuccacagugugguuucuuccucugcg

SEQ ID NO: 7974 - RNA, 64 nt, Human
gagagcuaagacaaccaccuaccagugcccaugucccuuccagcucaccuugagcagccucaga

SEQ ID NO: 7975 - RNA, 64 nt, Human
gcuuucacacuuuccccaugcacucucucccacccccuuccagggccucugcuccaaaggaggc

SEQ ID NO: 7976 - RNA, 64 nt, Human
gcaugaggaggaccaguuccucagguccuccagacccuuccauccucccuguucucaguucacc

SEQ ID NO: 7977 - RNA, 64 nt, Human
aaagugggcgggucugggcuauucuugagaaugucccuuccauuucugagaacaagucagcccc

SEQ ID NO: 7978 - RNA, 64 nt, Human
acccagugugcgcccuugacugcuuucuuugcugcccuuccagggagcugccccccugguaggg

SEQ ID NO: 7979 - RNA, 64 nt, Human
uucuuguaaaaugaauauguauguaggguuuuaacccuuccauuacuugaauaauucuuugggc

SEQ ID NO: 7980 - RNA, 64 nt, Human
cauuaaaaguauagaagauauaggaaguucuauacccuuccacuguacuucucaaaguugguua

SEQ ID NO: 7981 - RNA, 64 nt, Human
aagaagacucugcaucagugaaguccuuagaucucccuuccauugguggcagcaguguuggcaa

SEQ ID NO: 7982 - RNA, 64 nt, Human
cagaaauucaaaauaaagccuugacauuaaauaccccuuccacugcucacuuuguggaugguag

SEQ ID NO: 7983 - RNA, 64 nt, Human
uaugcaggcauggguucagcuuaauuccauaauucccuuccagauuauuaacucuucauacuua

SEQ ID NO: 7984 - RNA, 64 nt, Human
aagccccccaggcuucgugaauugcaagaagggacccuuccaggaugacacuaggaacagggcu

SEQ ID NO: 7985 - RNA, 64 nt, Human
gaagaaaaagcuucuggauguccagccagcugcccccuuccagccccuccaggaccccuggacc

SEQ ID NO: 7986 - RNA, 64 nt, Human
caauaccucugagugcccggaugcccucccugcacccuuccauuucuccaggagccuggcacug

SEQ ID NO: 7987 - RNA, 64 nt, Human
ggcaguggagucucugccucacccaaagacuuuucccuuccagacuuugagugucuucccuucu

SEQ ID NO: 7988 - RNA, 64 nt, Human
ccaccugaaagccugucucuuuccacuuuguuggcccuuccagugggauuaucgagcauguugu

SEQ ID NO: 7989 - RNA, 64 nt, Human
uuuuaagcaaagguauuuuugaagugguguagaacccuuccaagcuuuccugcucaguguucua

SEQ ID NO: 7990 - RNA, 64 nt, Human
uauuucgguugauuucauuuucuccccucucuuccccuuccacgaacugcaauaccaguaaccu

SEQ ID NO: 7991 - RNA, 64 nt, Human
cccccugcggcggcugucagaccugggcggaggccccuuccacgcggugccggcggggcucgcc

SEQ ID NO: 7992 - RNA, 64 nt, Human
acuuguccgccaaguaaaccaugauauaugucuucccuuccaccuuaacuuugccccaacuccu

SEQ ID NO: 7993 - RNA, 64 nt, Human
gaccccuggcaugcaugcuggcggcggcaugccucccuuccacaagcccaugcugcugcagagg

SEQ ID NO: 7994 - RNA, 64 nt, Human
uaauacaaugucacuguguuuccucugcacuguucccuuccacuuccucauccucuuugugaca

SEQ ID NO: 7995 - RNA, 64 nt, Human
auccagagaauuugggucuaguauaguacauuuucccuuccauuuaaaaugucuugggauaucu

SEQ ID NO: 7996 - RNA, 64 nt, Human
gaacagccccugcaacuguggggccugcacacagcccuuccacaguuggcacugcaggugcagg

SEQ ID NO: 7997 - RNA, 64 nt, Human
uggcuuuuauucauacuaauccucccaauguuaccccuuccaucuuccaagaagaaaaaaaaug

SEQ ID NO: 7998 - RNA, 64 nt, Human
cguuccagaaaagggcccagcucugagccccucacccuuccacacucacgaacucucagccgag

SEQ ID NO: 7999 - RNA, 64 nt, Human
aguauuuauuguucccacaauggcugggagggggcccuuccagauugggggcccuggggucccc

SEQ ID NO: 8000 - RNA, 64 nt, Human
ucgguuuccuuucauaaaggaguuguguccccagcccuuccacuccaguaaagaacugaauugg

SEQ ID NO: 8001 - RNA, 64 nt, Human
gggcccuagaccuccuccacucuccauccccuuucccuuccacuuuggguucacuuugaauuuu

SEQ ID NO: 8002 - RNA, 64 nt, Human
ggaccuguacacccugaguggacucuaucccucccccuuccaccgggacaacuucagcccuuac

SEQ ID NO: 8003 - RNA, 64 nt, Human
gcccaguccuuccaccucgacguuuacaagcccccccuuccacuuuuuuuuguauguuuuuuuu

SEQ ID NO: 8004 - RNA, 64 nt, Human
auauguaggugauggagggagaguguauugcuaacccuuccaggucuaguccagcgcugagauu

SEQ ID NO: 8005 - RNA, 64 nt, Human
ggaggggccaguggauucccacagcacaaccggucccuuccaugcccugggaugccucaccaca

SEQ ID NO: 8006 - RNA, 58 nt, Human
ugugccugcgcccgcgcuaacgccccggcccuuccagauucgccugugagcgaugagg

SEQ ID NO: 8007 - RNA, 64 nt, Human
uggccucuuuuuacccacugacuccccagaacaacccuuccaggcuucucuugucaucuuucuc

SEQ ID NO: 8008 - RNA, 64 nt, Human
aaacaaaggaacacuaggagaaaaaauggaaaaacccuuccaguaauuaaaaaggaagaaacca

SEQ ID NO: 8009 - RNA, 64 nt, Human
ucuuuaaaaaggaucccguagcaggcagaaaagccccuuccauccugcuccucugauacugugc

SEQ ID NO: 8010 - RNA, 64 nt, Human
aggucacagguugcagcccuggccuucugugaaucccuuccacagcuaaagggcauauguccuc

SEQ ID NO: 8011 - RNA, 64 nt, Human
agggguguagugaggacccacggggagccugggccccuuccagccgugggcaaacccugaagac

SEQ ID NO: 8012 - RNA, 64 nt, Human
ucccugguccccacugcccauaucuguggacugccccuuccaaagaccccuggggggggugggg

SEQ ID NO: 8013 - RNA, 64 nt, Human
agccagcaagcugagcacagaccagcagcgaccucccuuccagcccccagaaagcucggucacu

SEQ ID NO: 8014 - RNA, 64 nt, Human
uggugaccugcccaccgucccuguccaugccccgcccuuccagcugaggacaggcuggcgccuc

SEQ ID NO: 8015 - RNA, 64 nt, Human
ccugugcugcccacuggguaacuucuacaguucucccuuccacuucccuaagucucucuucagc

SEQ ID NO: 8016 - RNA, 64 nt, Human
ggcacccagagagggcauggaggcuccacgcaaccccuuccacccccacaucuuccuuugucuu

SEQ ID NO: 8017 - RNA, 64 nt, Human
ggcuauccccccagagccccucuucagcauccgccccuuccaguucacauagugagaccccccc

SEQ ID NO: 8018 - RNA, 64 nt, Human
caccaugcuccaacucccacacaaacgcuucuaccccuuccagaacuuacccaucaucccccca

SEQ ID NO: 8019 - RNA, 64 nt, Human
cucacuguuauuuccccguucaacucccuguugucccuuccauccugggcaaaacugaaaggga

SEQ ID NO: 8020 - RNA, 64 nt, Human
accuccauccuggacacugccuugauaacauagacccuuccacugacacccucgcucucacacc

SEQ ID NO: 8021 - RNA, 64 nt, Human
ggcagcuaacacccgcgcugcgcgccacuggcugcccuuccaggugcuuaacuccugucccugc

SEQ ID NO: 8022 - RNA, 64 nt, Human
ccugaggucaagcuuccaaaagugcccgaggcagcccuuccagagguucgacucccagaggugg

SEQ ID NO: 8023 - RNA, 64 nt, Human
ccucacuaacuccuccugagggccccaccaagcacccuuccacuuccaucugggagccccaaga

SEQ ID NO: 8024 - RNA, 64 nt, Human
cucucuuguuugguucuacccugcacccucgguccccuuccagguuccuguuuauaagccccaa

SEQ ID NO: 8025 - RNA, 64 nt, Human
acucuccuuagguucauagucucuccccuucuuucccuuccacuucuagagcagggaggcuugg

SEQ ID NO: 8026 - RNA, 64 nt, Human
aggaaaaucccuucuaggcaucuccucuccccaacccuuccacacguuugauuucuuccugcag

SEQ ID NO: 8027 - RNA, 64 nt, Human
gagccucgggaaagucuggucccacaucugcccgcccuuccagcccuuccccagccccuccucu

SEQ ID NO: 8028 - RNA, 64 nt, Human
cuuuuuggaggcucuaggggagcgucuuucuuugcccuuccagcuucuagaagcugcccaaauu

SEQ ID NO: 8029 - RNA, 64 nt, Human
ucuguaaacuaggagaacuggagaagacuccacgcccuuccagcuuugguaucuggagauuucc

SEQ ID NO: 8030 - RNA, 64 nt, Human
gaguggggaagauuuccccuuuagaucaaacugccccuuccauggaaaagcuggaaaaaaacuc

SEQ ID NO: 8031 - RNA, 64 nt, Human
cagagggugugacccaguuacccuuuaacccccacccuuccagucgggugugagggccugaccg

SEQ ID NO: 8032 - RNA, 64 nt, Human
gggaagggggcguucgcugcgcucggagcggcgucccuuccaacccgccggucucauuucuucu

SEQ ID NO: 8033 - RNA, 64 nt, Human
agaauuaucaguggagaagcaccuuuugacucuucccuuccaauguaaucucugccaacaccau

SEQ ID NO: 8034 - RNA, 64 nt, Human
aaaggguccagccacuacccuguuggcaaacauucccuuccauggucagccugccaggaggagg

SEQ ID NO: 8035 - RNA, 64 nt, Human
uugcggugggggcugugccagcggcuccgcagggcccuuccaacucuggagugucuguaguucu

SEQ ID NO: 8036 - RNA, 64 nt, Human
gcaauuaggggccagccugccuccaccucccacccccuuccaccuccaucagucaugugugcag

SEQ ID NO: 8037 - RNA, 64 nt, Human
gaagcuuaagcuuuaggucaacacuugcaagagccccuuccaaagcucagcacaguuuccuccu

SEQ ID NO: 8038 - RNA, 64 nt, Human
ucaagauaaaggccucgagaauaaagagccagcccccuuccauuuagucuccugccguuuccca

SEQ ID NO: 8039 - RNA, 64 nt, Human
ugugugucucaccccucauccuuuuacuuuuugccccuuccacuuugaguaccaaauccacaag

SEQ ID NO: 8040 - RNA, 64 nt, Human
gugugccuuagacauucucaagucaucagcgucacccuuccagaauguucacguccacacccau

SEQ ID NO: 8041 - RNA, 64 nt, Human
guuggugaaaauuuguuccuggucuaauuuggcacccuuccaaccugaguauuguaggggaagg

SEQ ID NO: 8042 - RNA, 64 nt, Human
uauccuagcuaauggcuucuuaaagguaauaaaacccuuccaacguaauuggucagauaaaacu

SEQ ID NO: 8043 - RNA, 64 nt, Human
cauuuaaaaucugcagccauuccuugcuucaguucccuuccaccacccagggcuggcuuuccua

SEQ ID NO: 8044 - RNA, 64 nt, Human
ucuauuuucugcucugugaggacacaaugcuccucccuuccaaaagaugcagcaugaaggcauc

SEQ ID NO: 8045 - RNA, 64 nt, Human
agagugggcugggaugugcauccugcucccugaacccuuccauccgagacugugcccacauccg

SEQ ID NO: 8046 - RNA, 64 nt, Human
ccuggugugcugggcgaaaacccuuaugacuccccccuuccaaaucaggcuggguugucacuga

SEQ ID NO: 8047 - RNA, 61 nt, Human
cccaucucguguacagauagaccggccucgccccuuccagcuccaagggcuacaucaaccg

SEQ ID NO: 8048 - RNA, 64 nt, Human
ugcaccccugguuucuuuaagucuuaagugaugccccuuccaaaccaucauccuguccccacgc

SEQ ID NO: 8049 - RNA, 64 nt, Human
agaauaaaauacugcaaaauguuuuuauauuuggcccuuccacccauuuuuaauugugagagau

SEQ ID NO: 8050 - RNA, 64 nt, Human
ccaaagccuuuguucuuucuuauuguggagcguccccuuccaucaagcagccugcccucaagcc

SEQ ID NO: 8051 - RNA, 64 nt, Human
uucagaucuuccuuccucccaaguacucaccaaccccuuccacuucccacuucccccaggcuug

SEQ ID NO: 8052 - RNA, 64 nt, Human
uaucgaccguauuuuguaaaaggcaagauauccucccuuccaggcugguaacggguuucaaggg

SEQ ID NO: 8053 - RNA, 64 nt, Human
agaaagauguguuuuguuuuggacucucuguggucccuuccaaugcuguggguuuccaaccagg

SEQ ID NO: 8054 - RNA, 64 nt, Human
aguuccggcaccaguagcaggcccgaaagaggcacccuuccaucugauuccagcacaaccuuca

SEQ ID NO: 8055 - RNA, 64 nt, Human
cauacaguagauuugaugugauccuuuucucccucccuuccauaauggaucguggucuguguga

SEQ ID NO: 8056 - RNA, 64 nt, Human
uggggcacaaugcgguccagacccugcugcgucucccuuccaaacucuggugcugaauaaaccc

SEQ ID NO: 8057 - RNA, 64 nt, Human
cauugggaagggcugugaaggccuccaggcuggccccuuccaggggaauccuggaggccugggg

SEQ ID NO: 8058 - RNA, 64 nt, Human
ucaugugagcugugcccuucccucuccucaugcccccuuccagcggcuucugccaaccaugggg

SEQ ID NO: 8059 - RNA, 64 nt, Human
gucuagggcaaacuguggcccccaggagacacuacccuuccaugccccagaccucugucuugca

SEQ ID NO: 8060 - RNA, 64 nt, Human
gaaucccucacucuucccggguucagcccagaagcccuuccaggcaugaucuuccccaucaggc

SEQ ID NO: 8061 - RNA, 64 nt, Human
ucuggguuagccaggccugcguggcccaugguggcccuuccagugcauauacauacauauauau

SEQ ID NO: 8062 - RNA, 64 nt, Human
cacaacagacccgggacccagcugugcuacccaccccuuccauggacugaauaagauggacuaa

SEQ ID NO: 8063 - RNA, 64 nt, Human
uuccuagugguguuuagaaaaugccuccacagcccccuuccaccaugggcaugagagcuggggu

SEQ ID NO: 8064 - RNA, 64 nt, Human
ggaggugugguugugguggagagcaccagcuagccccuuccagaaggggaggccacauuugccc

SEQ ID NO: 8065 - RNA, 64 nt, Human
ugccugggcuguuccugcucucaugcacaaccagcccuuccacgugccugccugugggacagga

SEQ ID NO: 8066 - RNA, 64 nt, Human
ucauuccugcaaacacagugcucagccuucaguucccuuccacuugaguucucucuucuccugc

SEQ ID NO: 8067 - RNA, 64 nt, Human
ggcagcuccuagccauagagcuuccuuuccagaacccuuccacugcccaauguggagacggguu

SEQ ID NO: 8068 - RNA, 64 nt, Human
guuguugagggcauuuggcuuccucugcugcauccccuuccagcucccuccccugcucagaauc

SEQ ID NO: 8069 - RNA, 64 nt, Human
uuuuuuguaggucugugauaaagaacuuagucaucccuuccaccuccuacugugaagaacagac

SEQ ID NO: 8070 - RNA, 64 nt, Human
agucaggcagccacaccuugguccucaucuuggucccuuccaaucugaaaccucgugccuggcu

SEQ ID NO: 8071 - RNA, 64 nt, Human
ucccuugcccgcgugggaccccaauagaacucagcccuuccaugccagcccuuccugcugccuc

SEQ ID NO: 8072 - RNA, 64 nt, Human
cuccucccagggcucugccagggccuugcucagucccuuccaccaaagucaucugaacuuccgu

SEQ ID NO: 8073 - RNA, 64 nt, Human
caacaggauagggacaucagacagccccagaaaccccuuccagaucugauaugggacuauuaau

SEQ ID NO: 8074 - RNA, 64 nt, Human
uucuggaaagcccuagaaacuaggguuccucugccccuuccacaucccaccugucucucuagcu

SEQ ID NO: 8075 - RNA, 64 nt, Human
guucuuguucuuucugacucaggugacuuuucagcccuuccaauuccccucuuuuucugcccuc

SEQ ID NO: 8076 - RNA, 64 nt, Human
cuccauuucccaaaguccucugcuccagcaacugcccuuccaggugggugugggacaccuggga

SEQ ID NO: 8077 - RNA, 64 nt, Human
uggugcuucccccaccccuccacguguccguccacccuuccaucagcgggucuccucccagcgg

SEQ ID NO: 8078 - RNA, 64 nt, Human
cuccgccgcacgcugacggaccacgagggcugaccccuuccagccugacuugguucauggaggc

SEQ ID NO: 8079 - RNA, 64 nt, Human
ccccugagagccuguggaggggcuugggccugcacccuuccacagcuggccugguuuccucgag

SEQ ID NO: 8080 - RNA, 64 nt, Human
uaagggguugcagaaucacgggagcauaauaauucccuuccauaaucuuuagcauuguucuuuc

SEQ ID NO: 8081 - RNA, 64 nt, Human
ucuaggcuggccccuuguccaccccucuccacaccccuuccagcccaggguucccauuuggcuu

SEQ ID NO: 8082 - RNA, 64 nt, Human
cuccuccuagcagugcgcgccccgccuguguuugcccuuccagcagugacccucccuucuaguc

SEQ ID NO: 8083 - RNA, 64 nt, Human
ugaccacacuccccucgcagcgucagugguacgacccuuccagccggcuagccugcgcuucugg

SEQ ID NO: 8084 - RNA, 64 nt, Human
uaaaccagagagcugcuggggauucuggccuagucccuuccacacccccaccccuugcucucaa

SEQ ID NO: 8085 - RNA, 64 nt, Human
gaggcuuauccuggcaaugggguagucacugccacccuuccacacacacacacacacacacaca

SEQ ID NO: 8086 - RNA, 64 nt, Human
agugccaggugggagagggagcagaacagccagccccuuccagguggcagucggaaggguuuuu

SEQ ID NO: 8087 - RNA, 64 nt, Human
uuucauuuucuuuccuuuccccuucccuucccuucccuuccaucucuuccuuuccuuuccuuuc

SEQ ID NO: 8088 - RNA, 64 nt, Human
guuugugcuaggcccccgggugugaagcacagaccccuuccagggguuuacagucuauuugaga

SEQ ID NO: 8089 - RNA, 64 nt, Human
uuauuagcauacccuaguacaucuuacagcuuuccccuuccauguuagcacuuuacugcugaau

SEQ ID NO: 8090 - RNA, 64 nt, Human
ugaagcucccuauaauccugaaaugaagagaauucccuuccagaagcuacgaaaaagggagcug

SEQ ID NO: 8091 - RNA, 64 nt, Human
aaaauaaauaaauaaaauaaauucuuaguucauacccuuccagaauucucucucuuuuuaaaac

SEQ ID NO: 8092 - RNA, 64 nt, Human
uaauauuuuguaaucaccguguggcaaaacauuccccuuccaaucuggugcuaguagaguauau

SEQ ID NO: 8093 - RNA, 64 nt, Human
cuccccccacccuccccucacaccccgcacucaccccuuccacccaccuccccccauggcccgc

SEQ ID NO: 8094 - RNA, 64 nt, Human
gggcucccuauuuggaagcaagcggggcaaggggcccuuccagaugccaccaccgccaacaggc

SEQ ID NO: 8095 - RNA, 64 nt, Human
cccugggcgcgccucccaccuuccacccccaacucccuuccaggguucgccucaucugaggccc

SEQ ID NO: 8096 - RNA, 64 nt, Human
uuuugccaaccauggauggcaaaugugaugugcucccuuccagcuggugagaggaggaguuaga

SEQ ID NO: 8097 - RNA, 64 nt, Human
guacuucuguuugugcccuucugcuucccccauucccuuccacagcucauagcucgucaucucg

SEQ ID NO: 8098 - RNA, 64 nt, Human
agcucccucaaagaggcaguugcccagccucuuucccuuccaguuuauuccagagcugccagug

SEQ ID NO: 8099 - RNA, 64 nt, Human
caaacucccaucagcccaaucccugaucccugaucccuuccaccugcucugcugaugacccccc

SEQ ID NO: 8100 - RNA, 64 nt, Human
uuuuauaaggacuuccugauugguuucucuucuccccuuccauuucugccuuuuguucauuuca

SEQ ID NO: 8101 - RNA, 64 nt, Human
acacagcaaaaugccagcagcgugccggaccccucccuuccauccuccucuccaaagaacagag

SEQ ID NO: 8102 - RNA, 60 nt, Human
accccguuaucuauauuuuaaaugcuuuuugcccaacacugacccuauguucaacuuugu

SEQ ID NO: 8103 - RNA, 60 nt, Human
guagggcugcuggcaggcacacuggguguagcccaacaccgugaggcacuggcccacuug

SEQ ID NO: 8104 - RNA, 60 nt, Human
ucauuucugucugcugagaucucagagccugcccaacagcagggaagccaagcacccauu

SEQ ID NO: 8105 - RNA, 60 nt, Human
aagagaggcaaagacaaacuggauuuaauggcccaacaucaaagggugaacccaggauau

SEQ ID NO: 8106 - RNA, 60 nt, Human
cucaugucaucaaaaccugcgcagucauuggcccaacaagaagguuucuguccuaaucau

SEQ ID NO: 8107 - RNA, 60 nt, Human
cggggaggugggacccccaaacauauaucagcccaacagcccuaagucuccuucuuuauu

SEQ ID NO: 8108 - RNA, 60 nt, Human
aguucaaggggaggggacaaagaccccacagcccaacagcaggacuguagaggucacucu

SEQ ID NO: 8109 - RNA, 60 nt, Human
cuuuucuugacucacagcccagguucuucugcccaacacaaaaggagugaguuggggucu

SEQ ID NO: 8110 - RNA, 60 nt, Human
caccuggggucaggaguucaagaccagccugcccaacauggcaaaaccucgucucuacua

SEQ ID NO: 8111 - RNA, 60 nt, Human
aaaaucccuaccuucagagacucuagcccagcccaacaccaucucuuccuaccucucagc

SEQ ID NO: 8112 - RNA, 60 nt, Human
gagucacuccucgggucucuccauaauucagcccaacaaugcuugguuuauuucaaucag

SEQ ID NO: 8113 - RNA, 60 nt, Human
ggaguugggcuguguuggaaugggccugcagcccaacaaacaagggaacuaggaccgaca

SEQ ID NO: 8114 - RNA, 60 nt, Human
agaaaccccuccagaacucccacccugacagcccaacaccaccuuccuccuggcuuccag

SEQ ID NO: 8115 - RNA, 60 nt, Human
cuauucacuaaaauuaaucuggaauuuaaggcccaacauuaaacacaaagcuguugaaau

SEQ ID NO: 8116 - RNA, 60 nt, Human
uccuuucuucgcccgccuucgggcugagccgcccaacaaguugugggacuccagucggga

SEQ ID NO: 8117 - RNA, 60 nt, Human
uucugccugaaaacaauguauuaccccagggcccaacaguaaaagauuguggacuuuuug

SEQ ID NO: 8118 - RNA, 60 nt, Human
uauuuauuuccguugucucucugcugugucgcccaacacuucccagggugcugcugccac

SEQ ID NO: 8119 - RNA, 60 nt, Human
gacccucuccuagcccuucccauacaggccgcccaacacucccccuacguugcgcugcuc

SEQ ID NO: 8120 - RNA, 60 nt, Human
cuuacguuaguauuguaauauguaaaguaagcccaacaaaaauuuuuaaaaauuugauga

SEQ ID NO: 8121 - RNA, 60 nt, Human
ggaggcucugcgcucugauccgcuguuugagcccaacacuuuaauuuauucuuucuggac

SEQ ID NO: 8122 - RNA, 59 nt, Human
ccccagacucauggguguagcaucaagaugcccaacagaggaacucuuucuuucuaacc

SEQ ID NO: 8123 - RNA, 60 nt, Human
uuaaaaauacuucuacaugacugcuugacagcccaacagccacucucaauagagagcuau

SEQ ID NO: 8124 - RNA, 60 nt, Human
caccugaggugaggaguucaagaccagccugcccaacauagugaaacuccgucucuacca

SEQ ID NO: 8125 - RNA, 60 nt, Human
accuucagucauccuacaggucaccucugugcccaacaacuuuacuugccuacaacgguu

SEQ ID NO: 8126 - RNA, 60 nt, Human
uguauccucuaaccacgagacccucaaccagcccaacaucuuccauggacacaugacauu

SEQ ID NO: 8127 - RNA, 60 nt, Human
uaaugggccaccuccccacaacagaauucugcccaacacaggagauuucuauaguuauug

SEQ ID NO: 8128 - RNA, 60 nt, Human
aucuucuaugaaauggugguaccaaggggcgcccaacagcuuuuauccccauucuuagag

SEQ ID NO: 8129 - RNA, 60 nt, Human
aacaacaaagugcaauacaggcugaaccuggcccaacagaaaaacccugccccaaugcac

SEQ ID NO: 8130 - RNA, 60 nt, Human
gucacagucuccggacaccacaccacaugagcccaacagguccacgauggauccaccagu

SEQ ID NO: 8131 - RNA, 60 nt, Human
cuucagaccguuuguccugucaucuguccugcccaacacuguaugguuuuucucuagcac

SEQ ID NO: 8132 - RNA, 60 nt, Human
ccugcuucuccagccuggacccccagcuuugcccaacaccagccccugccccagcccaag

SEQ ID NO: 8133 - RNA, 60 nt, Human
cuucugagagccaggaauccugcggucugggcccaacacugcauagcacugugcauaggc

SEQ ID NO: 8134 - RNA, 60 nt, Human
cagccaucggucuagcauaucagucacugggcccaacauauccauuuuuaaacccuuucc

SEQ ID NO: 8135 - RNA, 60 nt, Human
ugguggcugagaugcuauaaaaacagcucggcccaacagacacuuccccuggguugcauc

SEQ ID NO: 8136 - RNA, 60 nt, Human
uaaugugguucucagaaauuggucaguauggcccaacauagcuucugcucugucuuacug

SEQ ID NO: 8137 - RNA, 60 nt, Human
gugugaauucugacugcaauaggcaccagugcccaacacauacagccccaccaucauccc

SEQ ID NO: 8138 - RNA, 60 nt, Human
uucagcagugagaugagggcugugauuaaggcccaacacccagacuacucuuucggggag

SEQ ID NO: 8139 - RNA, 60 nt, Human
gcuguaugcuuuuuugccaccgugcaacuugcccaacaucaaucuucacccucaucccua

SEQ ID NO: 8140 - RNA, 60 nt, Human
gccugacuagguacaggcaagcuugugugggcccaacaggcccuugguagagcuggugcc

SEQ ID NO: 8141 - RNA, 60 nt, Human
uggauccacaucccggugccggggagggaagcccaacauccccuuguacagaugauccug

SEQ ID NO: 8142 - RNA, 60 nt, Human
uacuacucaauuguucuuuuccuuucucucgcccaacacgaucuuguaagauggauuuca

SEQ ID NO: 8143 - RNA, 60 nt, Human
acuguaucagucauccagagaccguuuauugcccaacacguuauucuugcuguugguggg

SEQ ID NO: 8144 - RNA, 60 nt, Human
gauuugauggugaggaaaaugauugacaaagcccaacaaugaucucaggaauuacauuuu

SEQ ID NO: 8145 - RNA, 60 nt, Human
auuuuuuagugcauccaguuaaccaagucagcccaacaggcaggugccggaggggaggac

SEQ ID NO: 8146 - RNA, 60 nt, Human
uaucgcacaacaggugcuaguuuugagaaggcccaacaggaguuugcaacaggugugaug

SEQ ID NO: 8147 - RNA, 60 nt, Human
uuuuucacccuauuuucagauagcacaugagcccaacacucacuuaauucucauuaugaa

SEQ ID NO: 8148 - RNA, 60 nt, Human
gaggugaguccagccccuuggaacaggcuugcccaacauggagggauggcguuggcagug

SEQ ID NO: 8149 - RNA, 60 nt, Human
gcgguggcacugaagagauagcuuucaagggcccaacacuuugcacuucggcuggcugug

SEQ ID NO: 8150 - RNA, 51 nt, Human
ugaucaccaucuacuccuaaugcccaacagcaucacggcacucugggacag

SEQ ID NO: 8151 - RNA, 60 nt, Human
gaugcuguaugggaaucaaaacaauugaaugcccaacauuuuguguauuacauuguuguc

SEQ ID NO: 8152 - RNA, 60 nt, Human
cgaaucugccuugacuguauauuucauacugcccaacaaaacaauaaaaaacaauuuuaa

SEQ ID NO: 8153 - RNA, 60 nt, Human
ugggaaaaguagcucuuuaaaaaucauauugcccaacagaaaccuuaggcugaauuuaca

SEQ ID NO: 8154 - RNA, 60 nt, Human
accgagaacugagaaucacaagggaguugcgcccaacaugcagaacaugaauccucugag

SEQ ID NO: 8155 - RNA, 60 nt, Human
uagaaaguuccuuuggccaacugcuuagaagcccaacacaacccaaaggcucuuuucaga

SEQ ID NO: 8156 - RNA, 60 nt, Human
ccccaggguagguaacagucuuaggacuuagcccaacaucacaacaucugcucuucgggu

SEQ ID NO: 8157 - RNA, 60 nt, Human
ucaacuguugccaggagauggaauaucaaugcccaacagggcaaccaauaaaagugucac

SEQ ID NO: 8158 - RNA, 60 nt, Human
caaacaugacaacauuuuuuuuggcccugggcccaacaguuuguacuucaugaaacauau

SEQ ID NO: 8159 - RNA, 60 nt, Human
caccagcaaggacagagaaucaaucuaagugcccaacaacaguaaauucaaugaaaaaaa

SEQ ID NO: 8160 - RNA, 60 nt, Human
gguucagguccccuuucagagauauaauaagcccaacaaguugaagaagcuggcggaucu

SEQ ID NO: 8161 - RNA, 60 nt, Human
uggcuuaccugccuucacucccagcaccuugcccaacaggauaagcuggauccccuuggc

SEQ ID NO: 8162 - RNA, 60 nt, Human
acaaccccugcuuuccugacuuccucuucugcccaacacugggugccccuucccaguuuc

SEQ ID NO: 8163 - RNA, 60 nt, Human
ccccaaaaguuauaaaaccauuuuaucagggcccaacauguggcaugcaaugaagagaaa

SEQ ID NO: 8164 - RNA, 60 nt, Human
aucacgaggucaggaguucgagaccagccugcccaacauggugaaacccugucucuacua

SEQ ID NO: 8165 - RNA, 60 nt, Human
uagauuuuaguugauuuuuuaaagaauacagcccaacacuuguuuuuuacauuuuaagag

SEQ ID NO: 8166 - RNA, 60 nt, Human
agguccucccaaccucugaagugcucaguagcccaacaacaaggcugcugggggccuguu

SEQ ID NO: 8167 - RNA, 60 nt, Human
ggcacaugaacagcuugccagggaugggcagcccaacagcacuuuuccucuucuagaugg

SEQ ID NO: 8168 - RNA, 60 nt, Human
ggacugggugugaccagaggaaaaggaagugcccaacaucucccagccuccccaggugcc

SEQ ID NO: 8169 - RNA, 60 nt, Human
auggaucgggguaugaagugugcacacgcagcccaacaacgggcaguggucucugugcuc

SEQ ID NO: 8170 - RNA, 60 nt, Human
uggcuucuggaggaaggcgccccuccgagggcccaacacuggccagggaugacaaccugg

SEQ ID NO: 8171 - RNA, 60 nt, Human
acugcugggauuacaggugugagccaccaugcccaacacccacugaucuuuaacucucac

SEQ ID NO: 8172 - RNA, 60 nt, Human
gcugcaaccuuucuguuuuauuuaaagaaagcccaacauuaaaggguuuucauugcaagc

SEQ ID NO: 8173 - RNA, 60 nt, Human
gcacauccugcaggugcuacugagacugcugcccaacaugagcagugaucuccaaggcca

SEQ ID NO: 8174 - RNA, 60 nt, Human
ugacuaccccugaauccacccagaaagggggcccaacacccuuguccauuuauggguauu

SEQ ID NO: 8175 - RNA, 60 nt, Human
uggccccaacugcugcagcucucggcuuccgcccaacagccucuggaggugaggcgggag

SEQ ID NO: 8176 - RNA, 60 nt, Human
acccccuucccuuauuacauuugcaacucugcccaacaaaaacaagcaagcaaaccacaa

SEQ ID NO: 8177 - RNA, 60 nt, Human
gcuuuucacagaaagggucaugaagcccuggcccaacaggacugugguacuaggggcugg

SEQ ID NO: 8178 - RNA, 60 nt, Human
ggcuccucggguggugcccugugugacaaagcccaacagcaagggugacuccuggcaggu

SEQ ID NO: 8179 - RNA, 60 nt, Human
cucacgccgcccugcagcccccaugccccugcccaacaugcuggggguccagaaaccacc

SEQ ID NO: 8180 - RNA, 60 nt, Human
ugguuaacucuuucccucuguuuuccuuaugcccaacacugggucaggcagagugggcga

SEQ ID NO: 8181 - RNA, 60 nt, Human
aaaaccuuaggauagauuccuaagggacaugcccaacagaguuuuaaaauggauguuuuc

SEQ ID NO: 8182 - RNA, 60 nt, Human
aauuuuguuuuuuaauuacguaauguaaaagcccaacaaacacuuuaugcaagauuggaa

SEQ ID NO: 8183 - RNA, 60 nt, Human
cuuuguccaccugaaguccaccucuggagagcccaacaucccuugacuuugguuuauuua

SEQ ID NO: 8184 - RNA, 60 nt, Human
uaucguuagugcuaguggauuuuacauguggcccaacacaauucuucuuccaacguggcc

SEQ ID NO: 8185 - RNA, 60 nt, Human
caauaaauguuggucauuguuaucacugaagcccaacaugcuagugcuucuagacccuuc

SEQ ID NO: 8186 - RNA, 60 nt, Human
agcaccuugagcacacaggagccaggaggagcccaacagagcagcaggggcuggggucuu

SEQ ID NO: 8187 - RNA, 60 nt, Human
gcccgcgccccgagccccacgcgcaagacagcccaacagcuguuccuccccuccccgccg

SEQ ID NO: 8188 - RNA, 60 nt, Human
ucacuggguaccccaccuccucucucauaugcccaacacgaccacugccucccugccccc

SEQ ID NO: 8189 - RNA, 60 nt, Human
uaccaagaaguccaaacccagcacgcaacagcccaacauaaccuagaaugucaagacacu

SEQ ID NO: 8190 - RNA, 60 nt, Human
uggggacaggaaccaaguccuuugcguguggcccaacaaccaucuacagaacagcugcug

SEQ ID NO: 8191 - RNA, 60 nt, Human
ugcccucagggagccacgguugagggugaggcccaacaccugccuuagggcccugggugg

SEQ ID NO: 8192 - RNA, 60 nt, Human
acucacguauaccccauuuccuuccagucagcccaacauuuuccaccagucuguccccau

SEQ ID NO: 8193 - RNA, 60 nt, Human
cgcauacggcccaggauggcuuugaaugcagcccaacacaaauucguaaacuuucuuaaa

SEQ ID NO: 8194 - RNA, 60 nt, Human
agcagucaagccgagcaaccuguauaagcagcccaacacaaaacgaguguggauuuaucu

SEQ ID NO: 8195 - RNA, 60 nt, Human
agguccccccagcucaccugcccuacuggggcccaacacuguacccagcugguugggagg

SEQ ID NO: 8196 - RNA, 60 nt, Human
ucucuccucccuguuggugcuguucuuccugcccaacaccuguuucucuuuuccucaagg

SEQ ID NO: 8197 - RNA, 60 nt, Human
gggaggguuaauaagacuccaacccuaauggcccaacagggaaauucucauuuuggucga

SEQ ID NO: 8198 - RNA, 60 nt, Human
cauagagcuagaaaguagcaucucaugauggcccaacaaucucuguugccaguuaaaggu

SEQ ID NO: 8199 - RNA, 60 nt, Human
augcuuggcccaccuuccaagacuggcacugcccaacagacaccgcugaaaucauguggg

SEQ ID NO: 8200 - RNA, 60 nt, Human
ccacaaagucagugccuggagaaggguucagcccaacauggggccccucucaucacugaa

SEQ ID NO: 8201 - RNA, 52 nt, Human
agaaggaaagaggcaaguagaggcccaacagcagaaccccaaagugaaguua

SEQ ID NO: 8202 - RNA, 60 nt, Human
uuacuucguaagcagaauuuccagccuacagcccaacaacaacuuacuaaaccagcuaaa

SEQ ID NO: 8203 - RNA, 60 nt, Human
uuuucaagaguaaaccagaaauacuuuugggcccaacacuugcaguugccuuccugaugu

SEQ ID NO: 8204 - RNA, 60 nt, Human
guuagaacgaauuuguuguaguauuugauagcccaacagggugacuacagucaacaauaa

SEQ ID NO: 8205 - RNA, 60 nt, Human
cacccuguugaaaguuccaguuauuuauaugcccaacaaauuucauagccugcugaacug

SEQ ID NO: 8206 - RNA, 60 nt, Human
ugcgcccagucuacacacuaauucuuguuagcccaacagcuguucuguucuaucuacccc

SEQ ID NO: 8207 - RNA, 60 nt, Human
uggaggugguagaauuuguaugcucuuagagcccaacagccaaggcagggucaagaagau

SEQ ID NO: 8208 - RNA, 60 nt, Human
uuguuuuuuuuuaagggugagccaggucuagcccaacagucuaaacuauccagucaauac

SEQ ID NO: 8209 - RNA, 60 nt, Human
cacccagguuccuccagaaagcuccuuggagcccaacaacuuaacaaaucaacuuggcug

SEQ ID NO: 8210 - RNA, 60 nt, Human
gacacaauccaaaucauaaaccuggcucaugcccaacacauuucugcuaauagggagagg

SEQ ID NO: 8211 - RNA, 60 nt, Human
aggacguugugguggccucaccccaggcaugcccaacaguaacugucagcauaaaccugg

SEQ ID NO: 8212 - RNA, 60 nt, Human
cuuggguggccagcguuccuacugcagacggcccaacauccagucuuuccccaggacaga

SEQ ID NO: 8213 - RNA, 60 nt, Human
aauuuuuuuuuuaagaaacgucaaaguugugcccaacacuguggaucagcaaacacgaua

SEQ ID NO: 8214 - RNA, 60 nt, Human
gccaccugcagacccuggcucugaggaauggcccaacaguggccccuucaggguggcagc

SEQ ID NO: 8215 - RNA, 60 nt, Human
acccauccugccacaggacccagaaaaaaagcccaacacacacucggguuaagaaauacc

SEQ ID NO: 8216 - RNA, 60 nt, Human
cacuuggaaggauauauuaugccuaacccugcccaacaaauuaagguuugugccuaaaau

SEQ ID NO: 8217 - RNA, 60 nt, Human
cuggcgcuagagccauccagaaguggcagugcccaacagcuuugggauggguucguaccu

SEQ ID NO: 8218 - RNA, 52 nt, Human
guggucaggggccugacugaaugcccaacacugcaucucucuuccugcuucu

SEQ ID NO: 8219 - RNA, 60 nt, Human
aucccgcaggacagcugcacucagggauacgcccaacaccauggccugcaaccccagggu

SEQ ID NO: 8220 - RNA, 60 nt, Human
cugcaugcucacacagcccuucccucuggggcccaacaaugccacagccuguucuaucaa

SEQ ID NO: 8221 - RNA, 60 nt, Human
ccugaagcuggggagcccugcguggagucagcccaacagggacugcauuugcuccucucu

SEQ ID NO: 8222 - RNA, 60 nt, Human
guacaugccuagaccugggcuccggccagcgcccaacagcguggaugucgaugacuucau

SEQ ID NO: 8223 - RNA, 60 nt, Human
cugcaguaugagugaccacagggccucccagcccaacaucuccagcuggaucccagggaa

SEQ ID NO: 8224 - RNA, 60 nt, Human
uagagcaaucuacagcuguuuaugugaggugcccaacacccauucaucucaagugcuuca

SEQ ID NO: 8225 - RNA, 60 nt, Human
uuuagguugcuuuuuaaaagagaacucucugcccaacacccccacaagguuuguaauuaa

SEQ ID NO: 8226 - RNA, 60 nt, Human
aucucucagccccaaacacccacccaauuggcccaacacugucugccccucgggguguca

SEQ ID NO: 8227 - RNA, 60 nt, Human
ggagcugggggcucucagugguuaaacaaugcccaacaaccaaccagcuggcccuugguc

SEQ ID NO: 8228 - RNA, 60 nt, Human
agccuggccggaaagaccaagguucaugcagcccaacaaaugauuguugagcaccucucg

SEQ ID NO: 8229 - RNA, 60 nt, Human
ugcaccccucccuucuccaucucgcuugcugcccaacaccauggcccucacaggcccaac

SEQ ID NO: 8230 - RNA, 60 nt, Human
agcagugacaccugccaaugacagaugcaagcccaacacccuuuugguacgcaaaaccug

SEQ ID NO: 8231 - RNA, 60 nt, Human
guuguuuccugggaucuuggggcugggggugcccaacagccuggcaucuucuuguuucuc

SEQ ID NO: 8232 - RNA, 60 nt, Human
gagcucucccgguaccaguguccacagaccgcccaacacagaggcuuugaggcuucucua

SEQ ID NO: 8233 - RNA, 60 nt, Human
acacagauguggguaagaugaaaaacuguggcccaacagggcuuaacccuauggauggug

SEQ ID NO: 8234 - RNA, 60 nt, Human
caaccagauaagugauauuuacagucacaagcccaacaucucaggacucuugacugcagg

SEQ ID NO: 8235 - RNA, 58 nt, Human
ucagccucccaaguagcugggauuacaggugcccaacaccacgccuggcuaauuuuug

SEQ ID NO: 8236 - RNA, 60 nt, Human
uccaccgcugcugagucucagaaacacuuggcccaacauagcccuguccagcccagugcc

SEQ ID NO: 8237 - RNA, 60 nt, Human
gccgcuaacccggggcgggcagggacgcgggcccaacaauaaaugccgcguggucugcuc

SEQ ID NO: 8238 - RNA, 60 nt, Human
acacuaaccaaggcuuccaggccagggauugcccaacacuccuagggcagcccucccagc

SEQ ID NO: 8239 - RNA, 60 nt, Human
ucaucuuuaugccccagcacuagguacggggcccaacacgugguaggcacuccaucagug

SEQ ID NO: 8240 - RNA, 60 nt, Human
ccuggggaggggcuccuggaauccaggccagcccaacagcccuggcuggggaggugucag

SEQ ID NO: 8241 - RNA, 60 nt, Human
ggugccugucagcccgcagagcccaucuacgcccaacacagagcucacacaggucacugc

SEQ ID NO: 8242 - RNA, 60 nt, Human
ccugcugcuugugguagaaaugcugccacagcccaacauugaggagcccucgaugacugc

SEQ ID NO: 8243 - RNA, 60 nt, Human
gaauuggcugccaagaguccaagccaucuggcccaacauacgcacugggcauuggguaag

SEQ ID NO: 8244 - RNA, 60 nt, Human
uacuuguuuauaggcugcauccuuuuuucagcccaacauuuagcuuuauggagugccaaa

SEQ ID NO: 8245 - RNA, 60 nt, Human
ugaaaaacagcaggauuaaguacugaaagagcccaacacaauuacccuguaaacucucug

SEQ ID NO: 8246 - RNA, 60 nt, Human
ugguauguuuuucuuauagauguuagcccugcccaacagccagggcuacacuacaaaagg

SEQ ID NO: 8247 - RNA, 60 nt, Human
guucuuucuggagccugcaagaagacaguugcccaacacuuugacacuugcuaguagguc

SEQ ID NO: 8248 - RNA, 59 nt, Human
ucacccuggccgaugacugagccccgagggcccaacacagaucauggauuugcggccag

SEQ ID NO: 8249 - RNA, 60 nt, Human
ccugcacacagccgucugagcagggcaggugcccaacaccccccaccggaggacacgcug

SEQ ID NO: 8250 - RNA, 60 nt, Human
agaccuacccuguaacgccugccccucucagcccaacaucagcuuccucuuucucccuug

SEQ ID NO: 8251 - RNA, 60 nt, Human
accuccgaccccagcgccaggcuccucggagcccaacagucccaagggggcaggagacgg

SEQ ID NO: 8252 - RNA, 60 nt, Human
agguagaccuguggggauggcucgguccaagcccaacacugcccgcuccagagagccuca

SEQ ID NO: 8253 - RNA, 60 nt, Human
cucauuauuuuucacugccccagacacagugcccaacaccccgucguauacccuggauga

SEQ ID NO: 8254 - RNA, 60 nt, Human
guggggaggagccccuuguaccugcuccgugcccaacacaugcccucucuguacaucuuu

SEQ ID NO: 8255 - RNA, 60 nt, Human
caccuaaggucaggaguuugagaucagccugcccaacauggugaaaccucgucucuacua

SEQ ID NO: 8256 - RNA, 60 nt, Human
gggucagggccgcucccuagggucccuccugcccaacauguggagguggcugguucccau

SEQ ID NO: 8257 - RNA, 60 nt, Human
gccucuacgagagguccucaucuccaucuggcccaacaauucccagauucugaagcuugg

SEQ ID NO: 8258 - RNA, 60 nt, Human
ggccuccuguggccugccagucaucgaguggcccaacaggggcuccaugccagccgaccu

SEQ ID NO: 8259 - RNA, 60 nt, Human
ggagcugagucaccuccuccacucacuccagcccaacagaaggaaggaggagggcgccca

SEQ ID NO: 8260 - RNA, 60 nt, Human
caccugaggucaggaguucaagaccagccugcccaacauggugaaaccccaucuggacua

SEQ ID NO: 8261 - RNA, 64 nt, Human; identical to SEQ ID NO: 6086

SEQ ID NO: 8262 - RNA, 64 nt, Human; identical to SEQ ID NO: 6087

SEQ ID NO: 8263 - RNA, 64 nt, Human; identical to SEQ ID NO: 6088

SEQ ID NO: 8264 - RNA, 57 nt, Human; identical to SEQ ID NO: 6089

SEQ ID NO: 8265 - RNA, 64 nt, Human; identical to SEQ ID NO: 6090

SEQ ID NO: 8266 - RNA, 64 nt, Human; identical to SEQ ID NO: 6091

SEQ ID NO: 8267 - RNA, 63 nt, Human; identical to SEQ ID NO: 6092

SEQ ID NO: 8268 - RNA, 64 nt, Human; identical to SEQ ID NO: 6093

SEQ ID NO: 8269 - RNA, 64 nt, Human; identical to SEQ ID NO: 6094

SEQ ID NO: 8270 - RNA, 64 nt, Human; identical to SEQ ID NO: 6095

SEQ ID NO: 8271 - RNA, 64 nt, Human; identical to SEQ ID NO: 6096

SEQ ID NO: 8272 - RNA, 64 nt, Human; identical to SEQ ID NO: 6097

SEQ ID NO: 8273 - RNA, 64 nt, Human; identical to SEQ ID NO: 6098

SEQ ID NO: 8274 - RNA, 64 nt, Human; identical to SEQ ID NO: 6099

SEQ ID NO: 8275 - RNA, 64 nt, Human; identical to SEQ ID NO: 6100

SEQ ID NO: 8276 - RNA, 64 nt, Human; identical to SEQ ID NO: 6101

SEQ ID NO: 8277 - RNA, 64 nt, Human; identical to SEQ ID NO: 6102

SEQ ID NO: 8278 - RNA, 64 nt, Human; identical to SEQ ID NO: 6103

SEQ ID NO: 8279 - RNA, 64 nt, Human; identical to SEQ ID NO: 6104

SEQ ID NO: 8280 - RNA, 64 nt, Human; identical to SEQ ID NO: 6105

SEQ ID NO: 8281 - RNA, 64 nt, Human; identical to SEQ ID NO: 6106

SEQ ID NO: 8282 - RNA, 64 nt, Human; identical to SEQ ID NO: 6107

SEQ ID NO: 8283 - RNA, 64 nt, Human; identical to SEQ ID NO: 6108

SEQ ID NO: 8284 - RNA, 64 nt, Human; identical to SEQ ID NO: 6109

SEQ ID NO: 8285 - RNA, 64 nt, Human; identical to SEQ ID NO: 6110

SEQ ID NO: 8286 - RNA, 64 nt, Human; identical to SEQ ID NO: 6111

SEQ ID NO: 8287 - RNA, 64 nt, Human; identical to SEQ ID NO: 6112

SEQ ID NO: 8288 - RNA, 64 nt, Human; identical to SEQ ID NO: 6113

SEQ ID NO: 8289 - RNA, 64 nt, Human; identical to SEQ ID NO: 6114

SEQ ID NO: 8290 - RNA, 64 nt, Human; identical to SEQ ID NO: 6115

SEQ ID NO: 8291 - RNA, 64 nt, Human; identical to SEQ ID NO: 6116

SEQ ID NO: 8292 - RNA, 64 nt, Human; identical to SEQ ID NO: 6117

SEQ ID NO: 8293 - RNA, 64 nt, Human; identical to SEQ ID NO: 6118

SEQ ID NO: 8294 - RNA, 64 nt, Human; identical to SEQ ID NO: 6119

SEQ ID NO: 8295 - RNA, 64 nt, Human; identical to SEQ ID NO: 6120

SEQ ID NO: 8296 - RNA, 64 nt, Human; identical to SEQ ID NO: 6121

SEQ ID NO: 8297 - RNA, 64 nt, Human; identical to SEQ ID NO: 6122

SEQ ID NO: 8298 - RNA, 64 nt, Human; identical to SEQ ID NO: 6123

SEQ ID NO: 8299 - RNA, 64 nt, Human; identical to SEQ ID NO: 6124

SEQ ID NO: 8300 - RNA, 64 nt, Human; identical to SEQ ID NO: 6125

SEQ ID NO: 8301 - RNA, 64 nt, Human; identical to SEQ ID NO: 6126

SEQ ID NO: 8302 - RNA, 64 nt, Human; identical to SEQ ID NO: 6127

SEQ ID NO: 8303 - RNA, 64 nt, Human; identical to SEQ ID NO: 6128

SEQ ID NO: 8304 - RNA, 64 nt, Human; identical to SEQ ID NO: 6129

SEQ ID NO: 8305 - RNA, 64 nt, Human; identical to SEQ ID NO: 6130

SEQ ID NO: 8306 - RNA, 64 nt, Human; identical to SEQ ID NO: 6131

SEQ ID NO: 8307 - RNA, 64 nt, Human; identical to SEQ ID NO: 6132

SEQ ID NO: 8308 - RNA, 64 nt, Human; identical to SEQ ID NO: 6133

SEQ ID NO: 8309 - RNA, 64 nt, Human; identical to SEQ ID NO: 6134

SEQ ID NO: 8310 - RNA, 64 nt, Human; identical to SEQ ID NO: 6135

SEQ ID NO: 8311 - RNA, 64 nt, Human; identical to SEQ ID NO: 6136

SEQ ID NO: 8312 - RNA, 64 nt, Human; identical to SEQ ID NO: 6137

SEQ ID NO: 8313 - RNA, 64 nt, Human; identical to SEQ ID NO: 6138

SEQ ID NO: 8314 - RNA, 64 nt, Human; identical to SEQ ID NO: 6139

SEQ ID NO: 8315 - RNA, 64 nt, Human; identical to SEQ ID NO: 6140

SEQ ID NO: 8316 - RNA, 64 nt, Human; identical to SEQ ID NO: 6141

SEQ ID NO: 8317 - RNA, 64 nt, Human; identical to SEQ ID NO: 6142

SEQ ID NO: 8318 - RNA, 64 nt, Human; identical to SEQ ID NO: 6143

SEQ ID NO: 8319 - RNA, 64 nt, Human; identical to SEQ ID NO: 6144

SEQ ID NO: 8320 - RNA, 64 nt, Human; identical to SEQ ID NO: 6145

SEQ ID NO: 8321 - RNA, 64 nt, Human; identical to SEQ ID NO: 6146

SEQ ID NO: 8322 - RNA, 64 nt, Human; identical to SEQ ID NO: 6147

SEQ ID NO: 8323 - RNA, 64 nt, Human; identical to SEQ ID NO: 6148

SEQ ID NO: 8324 - RNA, 64 nt, Human; identical to SEQ ID NO: 6149

SEQ ID NO: 8325 - RNA, 64 nt, Human; identical to SEQ ID NO: 6150

SEQ ID NO: 8326 - RNA, 64 nt, Human; identical to SEQ ID NO: 6151

SEQ ID NO: 8327 - RNA, 64 nt, Human; identical to SEQ ID NO: 6152

SEQ ID NO: 8328 - RNA, 64 nt, Human; identical to SEQ ID NO: 6153

SEQ ID NO: 8329 - RNA, 64 nt, Human; identical to SEQ ID NO: 6154

SEQ ID NO: 8330 - RNA, 64 nt, Human; identical to SEQ ID NO: 6155

SEQ ID NO: 8331 - RNA, 64 nt, Human; identical to SEQ ID NO: 6156

SEQ ID NO: 8332 - RNA, 64 nt, Human; identical to SEQ ID NO: 6157

SEQ ID NO: 8333 - RNA, 64 nt, Human; identical to SEQ ID NO: 6158

SEQ ID NO: 8334 - RNA, 64 nt, Human; identical to SEQ ID NO: 6159

SEQ ID NO: 8335 - RNA, 64 nt, Human; identical to SEQ ID NO: 6160

SEQ ID NO: 8336 - RNA, 64 nt, Human; identical to SEQ ID NO: 6161

SEQ ID NO: 8337 - RNA, 64 nt, Human; identical to SEQ ID NO: 6162

SEQ ID NO: 8338 - RNA, 64 nt, Human; identical to SEQ ID NO: 6163

SEQ ID NO: 8339 - RNA, 64 nt, Human; identical to SEQ ID NO: 6164

SEQ ID NO: 8340 - RNA, 64 nt, Human; identical to SEQ ID NO: 6165

SEQ ID NO: 8341 - RNA, 64 nt, Human; identical to SEQ ID NO: 6166

SEQ ID NO: 8342 - RNA, 64 nt, Human; identical to SEQ ID NO: 6167

SEQ ID NO: 8343 - RNA, 64 nt, Human; identical to SEQ ID NO: 6168

SEQ ID NO: 8344 - RNA, 64 nt, Human; identical to SEQ ID NO: 6169

SEQ ID NO: 8345 - RNA, 64 nt, Human; identical to SEQ ID NO: 6170

SEQ ID NO: 8346 - RNA, 64 nt, Human; identical to SEQ ID NO: 6171

SEQ ID NO: 8347 - RNA, 64 nt, Human; identical to SEQ ID NO: 6172

SEQ ID NO: 8348 - RNA, 64 nt, Human; identical to SEQ ID NO: 6173

SEQ ID NO: 8349 - RNA, 64 nt, Human; identical to SEQ ID NO: 6174

SEQ ID NO: 8350 - RNA, 64 nt, Human; identical to SEQ ID NO: 6175

SEQ ID NO: 8351 - RNA, 64 nt, Human; identical to SEQ ID NO: 6176

SEQ ID NO: 8352 - RNA, 64 nt, Human; identical to SEQ ID NO: 6177

SEQ ID NO: 8353 - RNA, 64 nt, Human; identical to SEQ ID NO: 6178

SEQ ID NO: 8354 - RNA, 64 nt, Human; identical to SEQ ID NO: 6179

SEQ ID NO: 8355 - RNA, 64 nt, Human; identical to SEQ ID NO: 6180

SEQ ID NO: 8356 - RNA, 64 nt, Human; identical to SEQ ID NO: 6181

SEQ ID NO: 8357 - RNA, 64 nt, Human; identical to SEQ ID NO: 6182

SEQ ID NO: 8358 - RNA, 64 nt, Human; identical to SEQ ID NO: 6183

SEQ ID NO: 8359 - RNA, 64 nt, Human; identical to SEQ ID NO: 6184

SEQ ID NO: 8360 - RNA, 64 nt, Human; identical to SEQ ID NO: 6185

SEQ ID NO: 8361 - RNA, 64 nt, Human
cgcauaugcaugccaggcugggcacggcuccgagggcggccagggacagacgcuugcgccgaga

SEQ ID NO: 8362 - RNA, 64 nt, Human
gcaagagcucuugugaauauuguggcucccugggggcggccagcccucccagcaguggcuugcu

SEQ ID NO: 8363 - RNA, 64 nt, Human
ugguccgcagaagcccugccugguccaguccgggggcggccaggccaacugcaagauucuggac

SEQ ID NO: 8364 - RNA, 64 nt, Human
auaccagcuucccccagccccugccaccccagagggcggccacgacagggagagguguagaugc

SEQ ID NO: 8365 - RNA, 64 nt, Human
auccgaagguuucucuuggggguaggggcuccugggcggccagaugaaugggucccugggaacc

SEQ ID NO: 8366 - RNA, 64 nt, Human
uggaccuaccaccugcggaggccugcugcccccuggcggccagugcuguuagagugcugccaag

SEQ ID NO: 8367 - RNA, 64 nt, Human
ggaguuggugaccuuuaucacaauuauuauuuuaggcggccagugaacugcugcuucagaaguc

SEQ ID NO: 8368 - RNA, 64 nt, Human
gagggcggcuucacccuucguaaccaggagacaaggcggccauggauuugcccuugauucuauu

SEQ ID NO: 8369 - RNA, 64 nt, Human
cuggugcucucuccaggcccaccaugcugggagaggcggccagagccuggggccuccagccugg

SEQ ID NO: 8370 - RNA, 64 nt, Human
cuccugucaaaaacccugaucagguagauuuggaggcggccacgauuuccuguuuggccccugu

SEQ ID NO: 8371 - RNA, 64 nt, Human
ccuucucugcacgcuugaccaaagcagugaugagggcggccaguaccugcggugugcgugguag

SEQ ID NO: 8372 - RNA, 64 nt, Human
ccucuggugggagggagaacgcacaucucuucugggcggccaccugaggagugacuccaagaag

SEQ ID NO: 8373 - RNA, 64 nt, Human
ggagcuccaggaggcgagggaagagcccuagcagggcggccaucacaaccacucacugagaguu

SEQ ID NO: 8374 - RNA, 50 nt, Human
cggccugcgugauccucugaggcggccaccgcgcgccggccgcgcucugc

SEQ ID NO: 8375 - RNA, 64 nt, Human
gucugccucuucuguccccaggcucacucagccuggcggccauggggccugccgugccugcccc

SEQ ID NO: 8376 - RNA, 64 nt, Human
gagagucgaugcuguucccgcugcacggcccaccggcggccagccccagagaccagaacugauc

SEQ ID NO: 8377 - RNA, 64 nt, Human
cagcagaucugagccaccgccugccagugugagaggcggccacuuucauggcagcucaucaggc

SEQ ID NO: 8378 - RNA, 64 nt, Human
aguugguccugcugccaagagccccgugcauccaggcggccaagcacaaacugggggagaggag

SEQ ID NO: 8379 - RNA, 64 nt, Human
ccaaagaccaucugaggaaugagaagucugcggaggcggccagggacucugccgaggcccugag

SEQ ID NO: 8380 - RNA, 64 nt, Human
agcuuggucccuaugggcuuccgcacaugccgcgggcggccaggcaacgugcgugucucugcca

SEQ ID NO: 8381 - RNA, 64 nt, Human
uuggcugcugccuggggaagcuucuccuccccaaggcggccauggggcagccugcagaggacag

SEQ ID NO: 8382 - RNA, 64 nt, Human
gugcaaggccgccugagcgcggcccccacccggcggcggccagggacccccgaggccccccucu

SEQ ID NO: 8383 - RNA, 59 nt, Human
acuucucagccaugagcuaacugcccccuggcggccaggaagagaaacagcuccucccc

SEQ ID NO: 8384 - RNA, 64 nt, Human
auacugugcgucucuggggaagacgcaccuagguggcggccacucccauggccuugucuaggac

SEQ ID NO: 8385 - RNA, 64 nt, Human
acuccccucagccucccaaagugcugggauuacaggcggccaggccuauuuucaauuuucaagu

SEQ ID NO: 8386 - RNA, 64 nt, Human
agaacucagacgggugccccagagggggcuggggggcggccaggcccaggccucccuccugccc

SEQ ID NO: 8387 - RNA, 64 nt, Human
guuuccaagucccgggucucaacuuuaagauagaggcggccauaagaggugaucucugggaguu

SEQ ID NO: 8388 - RNA, 64 nt, Human
acuccguaaucuuaaacagaugcaaauccaauuaggcggccaaguagguggagacgaagcaccu

SEQ ID NO: 8389 - RNA, 62 nt, Human
guuccacugagggcaccuagacucuacagccaggcggccaggauucaacucccugccuggau

SEQ ID NO: 8390 - RNA, 64 nt, Human
cacagguacuugcuccacugugccaggcucaaugggcggccagugugugaggacagcuucagcc

SEQ ID NO: 8391 - RNA, 64 nt, Human
auaacugugcuuccaacugccaccuggacggggaggcggccaaaaagcugaugggcgaggaggc

SEQ ID NO: 8392 - RNA, 64 nt, Human
ccaggaccuagcaagccggggaccagccaccaguggcggccagggaccaccuucagcauccacu

SEQ ID NO: 8393 - RNA, 64 nt, Human
gacuuucccucaacaaguccugcuaucuccacaaggcggccagcccagcccuguccucaccuuc

SEQ ID NO: 8394 - RNA, 64 nt, Human
ggccuccuucucugggguuugccugccucuugauggcggccaugccucuguccucucgcagggg

SEQ ID NO: 8395 - RNA, 64 nt, Human
aggggaggaggggagcgcugggcauccucaggcuggcggccaaggccugccccuggaggcacua

SEQ ID NO: 8396 - RNA, 64 nt, Human
agcugggggaggccagacccugagggcuuugcagggcggccagugcagugaugccuggcgcuuc

SEQ ID NO: 8397 - RNA, 64 nt, Human
gacacgcugggaccuacgucgggcuuccugcuggggcggccagcacccucuccacgugcagacc

SEQ ID NO: 8398 - RNA, 64 nt, Human
gacugcgugccucuccgccggaggucuagcugugggcggccaagaagggucacccuugaggaca

SEQ ID NO: 8399 - RNA, 64 nt, Human
uugggggccuggagcucuccaggaaagccaagcuggcggccaccgcaggggcccuccacauucu

SEQ ID NO: 8400 - RNA, 64 nt, Human
aggcggcuggaggacaagcggcucuaacccugggggcggccauguuguccaggcccaggccccu

SEQ ID NO: 8401 - RNA, 60 nt, Human
accuccagaccgaggucugagcgggugggcggcggccacgcacugggccacggaggaggg

SEQ ID NO: 8402 - RNA, 64 nt, Human
ccaggcccgcaccccggccucagggcgcucagacggcggccaggcacagggcccgcagugcugg

SEQ ID NO: 8403 - RNA, 64 nt, Human
uucgccgaauggggcagcaccacugacguuucugggcggccagugcggcugccagguuccugua

SEQ ID NO: 8404 - RNA, 64 nt, Human
aggcuucgucucagaaggcucuaucugcugggcuggcggccauccccguguuggguggaccccg

SEQ ID NO: 8405 - RNA, 64 nt, Human
ccucgcacuggggccagggcaggcaccagccccaggcggccagucggccacggccuguccucuu

SEQ ID NO: 8406 - RNA, 64 nt, Human
aggcugccacugcugcacaugcucagugaggcuuggcggccauccuggcacauggcucuuccug

SEQ ID NO: 8407 - RNA, 64 nt, Human
cuugucccucucacuaaaaaggaguguuguguguggcggccacgugcuucuaugugguguuuga

SEQ ID NO: 8408 - RNA, 64 nt, Human
cauggagaccaugucuucuuagagcaaauguggaggcggccagggcaguuguugggugaaugug

SEQ ID NO: 8409 - RNA, 64 nt, Human
uauggauucuccgcaccucuguucagggaagggcggcggccacauccccugccgucugcguguc

SEQ ID NO: 8410 - RNA, 64 nt, Human
gggcggcauccccagcugguucgggccgugacggggcggccagcagggacgcgccccagguggg

SEQ ID NO: 8411 - RNA, 64 nt, Human
gaggcuggccuacacaggugcccgucauggaagaggcggccaugcuguggccagccaggcagga

SEQ ID NO: 8412 - RNA, 64 nt, Human
cucugucgcauuucaaaacaaaccaugauggaguggcggccaguccagccuuuuaaagaacguc

SEQ ID NO: 8413 - RNA, 64 nt, Human
guggcacuuccaaaaaauuggcaaagcggaaugcggcggccaaaaugcugcuucgagugcacac

SEQ ID NO: 8414 - RNA, 64 nt, Human
aggguuccugucuggccucccuggugagcagaggggcggccacggcgggcgguggccuagagac

SEQ ID NO: 8415 - RNA, 64 nt, Human
aaccacgcauuuaugaagacauccaggacuacgaggcggccaaggcucuguuccagguggggau

SEQ ID NO: 8416 - RNA, 54 nt, Human
caucgccgacggggccaugauggaggcggccagcgugugcauggggcagauggu

SEQ ID NO: 8417 - RNA, 64 nt, Human
gaggauuuccuggcgggugggaaggaauggcuggggcggccaguuuugacacgccccagugccc

SEQ ID NO: 8418 - RNA, 64 nt, Human
ggcaggcguguggcagccacacgcaggcggccagggcggccagggacccaaagcaggaugacca

SEQ ID NO: 8419 - RNA, 64 nt, Human
agggggcacggcaggcguguggcagccacacgcaggcggccagggcggccagggacccaaagca

SEQ ID NO: 8420 - RNA, 51 nt, Human
aagaccaagacuccaagugagggcggccaaguccucgcugagcagagaggg

SEQ ID NO: 8421 - RNA, 64 nt, Human
ggccacugcuggaggcagcgcuggucgucaccugggcggccagaggcugggaucugcgaaguug

SEQ ID NO: 8422 - RNA, 64 nt, Human
augugcggaaaauguuuucuuggcuuggaaacugggcggccaggggaugacaguauggacuucc

SEQ ID NO: 8423 - RNA, 64 nt, Human
ggucccagugccuuggauggagacggccaguucuggcggccagauguggugcucuggaauccag

SEQ ID NO: 8424 - RNA, 64 nt, Human
gcgggccuggcugggcaucccugugccugucccuggcggccaggccauugccuucccacuaugc

SEQ ID NO: 8425 - RNA, 64 nt, Human
guguguggagacuggagagaucaagagagaguauggcggccaccagaaggcuguugucugccug

SEQ ID NO: 8426 - RNA, 64 nt, Human
cccaagucugggggcagaaccugaguguggauggggcggccaggaagaggccccuuccugccgg

SEQ ID NO: 8427 - RNA, 64 nt, Human
agggcgcagcgggacgcggggcucggaucugaaaggcggccagauccacaucuggaucuggauc

SEQ ID NO: 8428 - RNA, 64 nt, Human
gccgcucguacuccuggcaccagcgggcagugcgggcggccagauugcuguggcccauccugau

SEQ ID NO: 8429 - RNA, 64 nt, Human
ucaaguuccacuucccagggagcucugggggaggggcggccauucuggcuccguccccaguggc

SEQ ID NO: 8430 - RNA, 57 nt, Human
uugaggaucaggaagucuaaagccucaggcggccagagggugugcggagcugguggg

SEQ ID NO: 8431 - RNA, 64 nt, Human
ucagagucuggaggguuccaucggucaggggaauggcggccacgugaccucuugccgugccccu

SEQ ID NO: 8432 - RNA, 64 nt, Human
uacgccucaccccuccucccucucacagguucugggcggccagugagagaaacgcaguggggga

SEQ ID NO: 8433 - RNA, 64 nt, Human
aaggcccgaggggcgcgaucuugacccuaagaccggcggccaugauggugcugaccucuggugg

SEQ ID NO: 8434 - RNA, 64 nt, Human
ucccugacucaacuuccccgaaggaggccucuguggcggccagggucccccccuggagcugcug

SEQ ID NO: 8435 - RNA, 64 nt, Human
cguagguaacucaguggcugugaccagcucgacuggcggccacuggcuguucccaugaguucag

SEQ ID NO: 8436 - RNA, 64 nt, Human
ccccggagagaacguggcccagcccuggagggcaggcggccacucccccagccagaagucuuuu

SEQ ID NO: 8437 - RNA, 64 nt, Human
uggcccccugcuggucgcuguuucggggacucggggcggccaguaccaccgccugaggcggggc

SEQ ID NO: 8438 - RNA, 64 nt, Human
ccucgcugguacggaaugccgcugggugcccggaggcggccauggugucucgauggacggcagc

SEQ ID NO: 8439 - RNA, 64 nt, Human
ggggccaggcgugugacugacgcuguccgacgaaggcggccacggacggacgccagcacacgaa

SEQ ID NO: 8440 - RNA, 64 nt, Human
gccugcgugugacccuaccucacucggccggcgcggcggccacuccccccgccucgacggcacc

SEQ ID NO: 8441 - RNA, 59 nt, Human
accugcccuucuucagguagcugcuuggcggcggccagccccacagggggccaggggca

SEQ ID NO: 8442 - RNA, 64 nt, Human
ccucgaacgccuggcuuggggugucauucugccuggcggccaggccuccagcuuccccugcccc

SEQ ID NO: 8443 - RNA, 64 nt, Human
cacgcccuggcacacccuucacgguugcuacccaggcggccaagcuccagaccgugccagaccc

SEQ ID NO: 8444 - RNA, 64 nt, Human
aggggcacgcaggauucugagcaccaggggcagaggcggccagacaaccucagggaggaguguc

SEQ ID NO: 8445 - RNA, 64 nt, Human
ccuugggacacuacgcuaagggagggaggcuaaaggcggccagguuugcagugcgggaagauga

SEQ ID NO: 8446 - RNA, 64 nt, Human
gccaccaaggcccuggguuucaagcacaaaacugggcggccauucgggcagacaccgagcuagc

SEQ ID NO: 8447 - RNA, 64 nt, Human
cugcuuugaaauaaacggacguuugagcucacguggcggccaugcaugguuuguggcggaagac

SEQ ID NO: 8448 - RNA, 64 nt, Human
cgugguccagucccacucggggauggagugggccggcggccaaaccagucacucggggaggaau

SEQ ID NO: 8449 - RNA, 64 nt, Human
ccaacaccaaccugacaagguucggagugaugggggcggccaaggugacacuggguccaggagc

SEQ ID NO: 8450 - RNA, 64 nt, Human
cuggccgaggcagcccagagcagcgggaugagcuggcggccagagaacgcccagcccagcccac

SEQ ID NO: 8451 - RNA, 64 nt, Human
ucaggggcugaacgcggcccggaccgggaacggaggcggccagcggcgcccggaggggaggaag

SEQ ID NO: 8452 - RNA, 64 nt, Human
agcagcagcagcaggcgguggccaggccgggccgggcggccaccagcggcccucggagguaccc

SEQ ID NO: 8453 - RNA, 64 nt, Human
ucaggcacagggaggggagggaucagccaaauugggcggccacccccgccuccaccacuuucca

SEQ ID NO: 8454 - RNA, 60 nt, Human
accaggugcccgcguacugaguccgcgcgcggcggccacccuccccaaggggcgggcucg

SEQ ID NO: 8455 - RNA, 64 nt, Human
ggcucccacaccgugcuggacuucuacgagccgcggcggccagaggacgaugacccuacagaac

SEQ ID NO: 8456 - RNA, 64 nt, Human
aggaagcagagagcgccagauuugugguggaaaaggcggccaucaucucugcugagggugacuc

SEQ ID NO: 8457 - RNA, 64 nt, Human
acguggggcuaagccgagaggcacaggcgggcgaggcggccacaggcgagggugggcugaggcu

SEQ ID NO: 8458 - RNA, 64 nt, Human
guuugucccaccagaucaccucccgcguggucucggcggccacgcagcugcggcacuucuuccu

SEQ ID NO: 8459 - RNA, 64 nt, Human
ccucuguuuccagauagcugccuggugcggcagcggcggccaaaucuuccguccucccguggau

SEQ ID NO: 8460 - RNA, 64 nt, Human
ucacgccuguaauccuagcacuuugggaggccgaggcggccagaucacaagguuaggaguucaa

SEQ ID NO: 8461 - RNA, 64 nt, Human
gccucgccggaucugagggagaacaagaccgaucggcggccacugcgcccuuaacugcauccag

SEQ ID NO: 8462 - RNA, 64 nt, Human
augugcgcaucacuggcugagcgguggagcugcgggcggccagggccgggcgcucugugcggac

SEQ ID NO: 8463 - RNA, 64 nt, Human
cccgcagcgccucuuggacccugcgggaugccggggcggccaggcuggcccaacggacagacag

SEQ ID NO: 8464 - RNA, 64 nt, Human
ggcggggccggcgucucgcagacuaggggcugggggcggccacagacggccucgaaaccacagc

SEQ ID NO: 8465 - RNA, 64 nt, Human
ugccuaugcaaaaauucaucuuucggugauugugggcggccaauacauaccuucuguaacuccu

SEQ ID NO: 8466 - RNA, 64 nt, Human
auaccaaagagagccaggggagggccccggguucggcggccagaggcaggucagggguccccuc

SEQ ID NO: 8467 - RNA, 64 nt, Human
caagcaaaucaggcauacggagaggcugugagcuggcggccaccggaucugagaggggggagcc

SEQ ID NO: 8468 - RNA, 64 nt, Human
cccucccaggagaguacauggcauugagacaucuggcggccaagugaggaaaagacacccuguc

SEQ ID NO: 8469 - RNA, 64 nt, Human
cacuuauuuccugggcuggugcgccccaaaacacggccccgacacuuaguguggccccaggccc

SEQ ID NO: 8470 - RNA, 64 nt, Human
aaccggcgucgcuggcgcauccuggguggaggcaggccccgagcucggggaagggguuuucccu

SEQ ID NO: 8471 - RNA, 64 nt, Human
ggucagcaagagcaacugauggcugccacuuccaggccccgagagacaggccucacguaacuuu

SEQ ID NO: 8472 - RNA, 64 nt, Human
auuaaauauaaauauccccagggacagaaaccaaggccccgagcucagggcagcugugcugggu

SEQ ID NO: 8473 - RNA, 64 nt, Human
gcgggagccccacaugugugcacuguaggacagcggccccgagguggaagccuggcuggagggc

SEQ ID NO: 8474 - RNA, 64 nt, Human
gggcagggagggaccauggcccgcagggucaaggggccccgaugugcacagcugccacagggag

SEQ ID NO: 8475 - RNA, 64 nt, Human
aggaaucaaauuuugccagagaaacuaacuugguggccccgacaggucuuccggggccaugggc

SEQ ID NO: 8476 - RNA, 64 nt, Human
guggcggcaacauugaagacguggacggaggaggggccccgacgacagguggcaacaaugcccc

SEQ ID NO: 8477 - RNA, 64 nt, Human
ccggccuuguggcagaggcuccucccgcggggacggccccgacggcuucucugcgagucucucu

SEQ ID NO: 8478 - RNA, 64 nt, Human
gcaaacacggaaguucauacuugaaugcugaauuggccccgacagauuaaaugcguguugggga

SEQ ID NO: 8479 - RNA, 64 nt, Human
gaacgcccacccacgaaggcccagggcgccagacggccccgaaaaggcgcucggggagcguuua

SEQ ID NO: 8480 - RNA, 64 nt, Human
gcuguggagcggcgccgaccuucgcccggucagcggccccgacccccgcgccgcgccccugcuc

SEQ ID NO: 8481 - RNA, 64 nt, Human
caccuccagaaguggcuggauguacccugccugaggccccgacgaggagggguaugcaggcugg

SEQ ID NO: 8482 - RNA, 64 nt, Human
gaugaagcugaggcugcugccaggcccggcaugaggccccgaggcucgagcucggggcuggggg

SEQ ID NO: 8483 - RNA, 64 nt, Human
uccaugggucucauacagcugccuuauugaaauaggccccgaacccccuaaaugcaaaaaauac

SEQ ID NO: 8484 - RNA, 50 nt, Human
acaacaagaagcuggacugaggccccgacugcagccugcauucugcacac

SEQ ID NO: 8485 - RNA, 64 nt, Human
gcccuagcgcccgccaaaccuggugguccugggcggccccgagaccccaacacaugcuucuucg

SEQ ID NO: 8486 - RNA, 64 nt, Human
uugaguuacauggaaucacccacaggguuuuggaggccccgagaagcgucuucccuugaguugg

SEQ ID NO: 8487 - RNA, 64 nt, Human
gagggcaggagccuccuguuugcagacguuggcgggccccgaggcucccagagcagccucuguc

SEQ ID NO: 8488 - RNA, 64 nt, Human
gcccacugccagggacgccgagggccugaccaggggccccgaggccugagggccccuccccugu

SEQ ID NO: 8489 - RNA, 64 nt, Human
ucucucccuugagcaccaggagugggugccagccggccccgaggauucccagcaccccaccuau

SEQ ID NO: 8490 - RNA, 64 nt, Human
cacugcuccucaacagcuguaacccuuuccugagggccccgacuuuucagaauaggagcagaga

SEQ ID NO: 8491 - RNA, 64 nt, Human
cugcaccucuucaaugacugucugcugcugucucggccccgagagucagugacuggaguggcag

SEQ ID NO: 8492 - RNA, 51 nt, Human
agccgcggcaucgcuucugauggccccgaauccccauugagcagcacaaag

SEQ ID NO: 8493 - RNA, 64 nt, Human
uagccccuggcucuggcaucucuccagccccacuggccccgagcugcuugacucaccggcuucc

SEQ ID NO: 8494 - RNA, 64 nt, Human
ggcaugaggugcggccuccagggcgccuccugccggccccgaccuugggacaggccuuccgccc

SEQ ID NO: 8495 - RNA, 64 nt, Human
cgggggccgagggcggccggggagggcgggccuuggccccgagugaaggcgcggcggcccaacc

SEQ ID NO: 8496 - RNA, 64 nt, Human
cccggaggccccggcgcccgcacccacccggcccggccccgagagcaggcucgaccgccgcccc

SEQ ID NO: 8497 - RNA, 64 nt, Human
cagggccucucccuuuaguggagccagguugucgggccccgaaugucacugguggaucuaagaa

SEQ ID NO: 8498 - RNA, 64 nt, Human
uaguaagugccuuccaugucggccucuaaccccaggccccgaggacccagacccaguggggagg

SEQ ID NO: 8499 - RNA, 64 nt, Human
accaugcgacacugggaggccagugagccacuccggccccgaauguugagguggacucucacca

SEQ ID NO: 8500 - RNA, 64 nt, Human
ggauccccaccugacacuaaccagagucagcacaggccccgaggagcccgaagucugcugcugu

SEQ ID NO: 8501 - RNA, 64 nt, Human
uagcuuugucaacacgcauuguccuugucauuugggccccgagcucugacccucgugucugacg

SEQ ID NO: 8502 - RNA, 63 nt, Human
ccgacacugagggcuccuagccgcagcagcgcaggccccgaccagggcacacccaccggcccg

SEQ ID NO: 8503 - RNA, 64 nt, Human
ugucaaugccccuccagggcuggaggggaagaggggccccgaggaugggccugggcucagcauu

SEQ ID NO: 8504 - RNA, 64 nt, Human
guggagccugagaaggcccccgggccccagcaugggccccgagccuuggaggagcacuggcagu

SEQ ID NO: 8505 - RNA, 64 nt, Human
caggagguggcgugaggccgcccgcgcccgccgcggccccgaucggggcgggggaauccccgga

SEQ ID NO: 8506 - RNA, 64 nt, Human
gcagaaacgccggcugggcgccggggaggacgauggccccgacccuggcagcgagaggagacca

SEQ ID NO: 8507 - RNA, 64 nt, Human
gaggguguaacuaggacauccucaagggcagcuaggccccgaauguacaauguuaagacaggga

SEQ ID NO: 8508 - RNA, 64 nt, Human
gacugcacccaggaggggaacacugcccucgcacggccccgaagggcccccacauuugugccga

SEQ ID NO: 8509 - RNA, 64 nt, Human
guuaaggguguggacucugggcuccugcugccugggccccgauuccagcauggggcaugcuacu

SEQ ID NO: 8510 - RNA, 64 nt, Human
ugacuguaaaccucaccacacaggguggugcccuggccccgaggucaccccgacuuuucuaaau

SEQ ID NO: 8511 - RNA, 64 nt, Human
auguuuuccaggaaggggcucagaagcugcacuaggccccgaguccccaugugucuccuugaau

SEQ ID NO: 8512 - RNA, 64 nt, Human
cgcgggcgcgaucccacacaggcuggcgggggccggccccgaggccgcgugcgugagaaccgcg

SEQ ID NO: 8513 - RNA, 64 nt, Human
gucucugccccucucucagccucagugucccgagggccccgaagcauuccauucucguggagga

SEQ ID NO: 8514 - RNA, 64 nt, Human
cacggagcugcacaucuagcuguggcccaggcugggccccgaccugggaugcgcacaguguccc

SEQ ID NO: 8515 - RNA, 64 nt, Human
guaccaucaaaggaauuucaggugggcugggcggggccccgaucccagaauuaucaacuccacc

SEQ ID NO: 8516 - RNA, 64 nt, Human
auuauuauuauuauuugcaaugagagagaugguuggccccgaaugaggcucaugggagguuugg

SEQ ID NO: 8517 - RNA, 64 nt, Human
ugccaacaaagagcgaccuggcgugcuguggcugggccccgaggguggaaacguauucgcgucu

SEQ ID NO: 8518 - RNA, 64 nt, Human
guaccaaggccugagggccgccagcggccucuacggccccgacggacgcuugugaggcccgagg

SEQ ID NO: 8519 - RNA, 64 nt, Human
gcagcugggaugaagagagauggcaugucaggcuggccccgaaucauagcucccugagagggcc

SEQ ID NO: 8520 - RNA, 64 nt, Human
ccaggacaugcugcucccuugugugagugaccgcggccccgagccuggggcuggacgcaggucc

SEQ ID NO: 8521 - RNA, 64 nt, Human
guuagucgcuccuugcuaaccggugagugaccgcggccccgagccuggggcuggacgcaggucc

SEQ ID NO: 8522 - RNA, 64 nt, Human
acaucaccccagugguggcccuguggcagccuauggccccgaaccaaggacugccgcgccuccu

SEQ ID NO: 8523 - RNA, 64 nt, Human
gcgcccugcagcugucuccucggccauccuguggggccccgaggccuugcccucacuucagugc

SEQ ID NO: 8524 - RNA, 64 nt, Human
gguugccagugaagacagaagcucuuacugacuuggccccgaggccaucacccccuccagcagu

SEQ ID NO: 8525 - RNA, 64 nt, Human
uggguggccccagggagucacacagucuguacccggccccgagauccucugcuguaacugcagg

SEQ ID NO: 8526 - RNA, 64 nt, Human
aaugccaccucuucucagaccccgccugccccgaggccccgauccugcugcacuucccgcuggu

SEQ ID NO: 8527 - RNA, 64 nt, Human
aaggcacuuaaauuaaaaugagcucacugauaugggccccgaugcaauauaauugguguccuua

SEQ ID NO: 8528 - RNA, 64 nt, Human
cccccauuugcucccugagcuccaagauaagaauggccccgagagaacugcugaacauuuguuc

SEQ ID NO: 8529 - RNA, 64 nt, Human
gguggggcucggcugggccuugcagaaucgagguggccccgacuggcccugccgugcgggcuca

SEQ ID NO: 8530 - RNA, 64 nt, Human
cacuaaggggccgaccccauggaguaacgcgcccggccccgaugcgaaucaggccuccccuaca

SEQ ID NO: 8531 - RNA, 64 nt, Human
cccugcgcucgcucaucuccgcucucugacucugggccccgaggguccgcugggcccgccgccg

SEQ ID NO: 8532 - RNA, 64 nt, Human
gcuuucccccgccaaggacgccuaccccgaaaccggccccgacgccccgcagaggcccgccuga

SEQ ID NO: 8533 - RNA, 64 nt, Human
ccaggaagccuucccugccuucucugggcugugcggccccgagucugcguccauuagagcacag

SEQ ID NO: 8534 - RNA, 64 nt, Human
acgcguuuugcaaaguuugugacucaccauucaaggccccgagucuuggacugugaagcaucug

SEQ ID NO: 8535 - RNA, 64 nt, Human
ccccugcacaggagacaagugcguucagggcacaggccccgacaucaccccaaggacaacggca

SEQ ID NO: 8536 - RNA, 64 nt, Human
ccccugcacaggagacaagugcauuuagggcacaggccccgacaucaccccaaggacaacggca

SEQ ID NO: 8537 - RNA, 64 nt, Human
aggccugggccgcccagaggcuccucucaggcugggccccgacguuugcggcaguguuccuugu

SEQ ID NO: 8538 - RNA, 64 nt, Human
caucgccugacugagaacucugggccuuagagcaggccccgaacuguggucgccaggcccagga

SEQ ID NO: 8539 - RNA, 64 nt, Human
gcaaggugggugauuccucccaggaggugcuugaggccccgauggacuccugaccauaauccua

SEQ ID NO: 8540 - RNA, 64 nt, Human
guggggaaaggaaucaauuauuuaugaacuguccggccccgagucacucagcguuugcgggaaa

SEQ ID NO: 8541 - RNA, 64 nt, Human
cuucgugccacacgcccgcggugaucccagccagggccccgagcgcagaggcggagcugugcuc

SEQ ID NO: 8542 - RNA, 64 nt, Human
agggaacgcccuccccagucccgcuguccagcaaggccccgagacuuuucuucugugauuucca

SEQ ID NO: 8543 - RNA, 64 nt, Human
agugagaagcagcuuauuguauaugagggagccaggccccgagggugagcgagauggagaaggg

SEQ ID NO: 8544 - RNA, 64 nt, Human
aacagccccucuccccagucacagccugaagggaggccccgagagcuuccuccuuccccccacc

SEQ ID NO: 8545 - RNA, 64 nt, Human
cuccuucccccagaggagcgcagucacuccacuuggccccgaccccgagcuuagccccuaagcc

SEQ ID NO: 8546 - RNA, 64 nt, Human
uugcugcuggcuaccacucuuccccagagcagcaggccccgagccccuucaggcccagcacugc

SEQ ID NO: 8547 - RNA, 64 nt, Human
acucccucacuguguugacacuuggcacuuugcuggccccgagaaaggucgaugacacagccgc

SEQ ID NO: 8548 - RNA, 54 nt, Human
ggcugguccagaguuccuagcacuggccccgaggacagccaagggccauuucuu

SEQ ID NO: 8549 - RNA, 64 nt, Human
uuuuauaucuaggcuaccuguugguuagauucaaggccccgagcuguuaccauucacaauaaaa

SEQ ID NO: 8550 - RNA, 64 nt, Human
guuugugcucagcggggacagccaggguugaucuggccccgaggguuuuggauguuuuuaggau

SEQ ID NO: 8551 - RNA, 64 nt, Human
ucuggcggggaccacgggccacugcucacccacuggccccgagggggguguagacgccaagacu

SEQ ID NO: 8552 - RNA, 64 nt, Human
cuguauuuauugugaaucuaguuugugaggcuguggccccgagcuggcggagggagggaagagg

SEQ ID NO: 8553 - RNA, 64 nt, Human
cauggggcgggcagcccccagaaagcgggcagcaggccccgauaccgggaagagccgacacagc

SEQ ID NO: 8554 - RNA, 64 nt, Human
aggguauaaguaugcugagaugcaggcugcucugggccccgagcaaccucuccaguuauccuca

SEQ ID NO: 8555 - RNA, 64 nt, Human
cagagcuccccugccgcagaauggggccccagccggccccgaccggguccaggagcacugcucg

SEQ ID NO: 8556 - RNA, 64 nt, Human
caccaguagccaggugaagggccacagcgggccaggccccgacccuguugugacccaccugggc

SEQ ID NO: 8557 - RNA, 64 nt, Human
gauagagaaauuggcccgcuuuguggcagaaggaggccccgaguuagaaaaaguagcuauggag

SEQ ID NO: 8558 - RNA, 64 nt, Human
gaggcgcaugcgcauccgcgauucccugcgaccaggccccgagagggcgagaccagaggggacg

SEQ ID NO: 8559 - RNA, 64 nt, Human
uuucuucuaggcaauuucuugcaaccaccaccgaggccccgaaaagcacuggucgucagggagc

SEQ ID NO: 8560 - RNA, 64 nt, Human
accugaaggcccaggggguccagggcggaccuggggccccgaccaccaaggacagcucacgacu

SEQ ID NO: 8561 - RNA, 64 nt, Human
auuacuccuugucgugcggucaaggauacaccuuggccccgauuccggaucucuccguucucag

SEQ ID NO: 8562 - RNA, 64 nt, Human
agggucuucaggggaggccagaggagagcugcugggccccgagccacgaacuugcugggugguu

SEQ ID NO: 8563 - RNA, 64 nt, Human
uugugccauaugcuggauauccagguucucgccaggccccgauacaugaauaacaaacccaaga

SEQ ID NO: 8564 - RNA, 64 nt, Human
gcacauuccuggcagagaaaacagcacgugcaaaggccccgagacuggaguguguuccugaaga

SEQ ID NO: 8565 - RNA, 64 nt, Human
auuugcgggcaggguucucuguccuuccaaguggggccccgacacuuugguuccagucaucgag

SEQ ID NO: 8566 - RNA, 64 nt, Human
gucugugugucaccucuccuccuucagccaugcuggccccgagcuuagggaugugcuugcaaac

SEQ ID NO: 8567 - RNA, 64 nt, Human
agggaaggugguauagauggcccucagauugcggggccccgagcagcuccccacucugcccguc

SEQ ID NO: 8568 - RNA, 64 nt, Human
ccccagucccuggagccaccgcggguccuuccccggccccgagggccaaggggguccccgcccg

SEQ ID NO: 8569 - RNA, 64 nt, Human
gcacagagaagcccuauaaucacaggucugugguggccccgaaauggggggccugcuagucagg

SEQ ID NO: 8570 - RNA, 64 nt, Human
ggggacucuggccggacggccaaugggcugccugggccccgaagccaagcccuuuccagcuccu

SEQ ID NO: 8571 - RNA, 64 nt, Human
agcccauuucacaggugaggaacccgaggcucagggccccgagacuuggccucaguucuuccuu

SEQ ID NO: 8572 - RNA, 64 nt, Human
gggaaucagcuucaggauggaaggacccaggagaggccccgaggugggaggguucuguaaauac

SEQ ID NO: 8573 - RNA, 64 nt, Human
uccugacuccagcacccaggccugggaagagcucggccccgaucagccugaguuccgccagcgc

SEQ ID NO: 8574 - RNA, 64 nt, Human
gcccaguuccagaaaggccuccagcugagcagacggccccgaucccgccagaacggccuuuugc

SEQ ID NO: 8575 - RNA, 64 nt, Human
ccauguuuacagccccggcccucgacaguauugaggccccgagcccccagcacuuguguguaca

SEQ ID NO: 8576 - RNA, 64 nt, Human
gaccggccagggaucacccccgccgacggccccgggccccgacggcccggaaguuccgcguguc

SEQ ID NO: 8577 - RNA, 64 nt, Human
ggguuguauaccacacccugggccccuaaucccaggccccgagauaggaaagccagcuagucuc

SEQ ID NO: 8578 - RNA, 64 nt, Human
gagggggacccguggagaauuggccagagccuguggccccgaggcugggacacuguguggcccu

SEQ ID NO: 8579 - RNA, 64 nt, Human
uugauccgcugguccccucuuuugggguagaugcggccccgaucaggccugacucgcugcucuu

SEQ ID NO: 8580 - RNA, 64 nt, Human
uggauucaagugccagcucugccacugacccuggggccccgacccagcccugccuccucagcca

SEQ ID NO: 8581 - RNA, 64 nt, Human
gaguuucagcgucauccuugaacgcaggauccgggaccuucagacccagggaaagggugaggga

SEQ ID NO: 8582 - RNA, 64 nt, Human
gggggcaacuccaccuggacugaugggcacaggaggcaccaauagcgauuauugggggcaaugc

SEQ ID NO: 8583 - RNA, 64 nt, Human
gcugccacugccucuggccauuuaaagugagaggggcaccaacagacaauucggggaccuuagg

SEQ ID NO: 8584 - RNA, 64 nt, Human
ugcccaggcugaaguccucacccucucuuaaagcggcaccaacgugagagagacaggcagacag

SEQ ID NO: 8585 - RNA, 64 nt, Human
uagagaugaggcuuuaccucagacaagaagagcuggcaccaaaacuagccaugcucccacccuc

SEQ ID NO: 8586 - RNA, 64 nt, Human
aggaauggccuuggaggcuggccuguguggauauggcaccaauucuacccugcuccucuuuucc

SEQ ID NO: 8587 - RNA, 64 nt, Human
ucccccaccacuauucauaaaguauuaaccaacuggcaccaaggaauugccuccagccugaguc

SEQ ID NO: 8588 - RNA, 64 nt, Human
ucuuccauuaucccuaaauauugauaaacucccaggcaccaaagaaaacauuugcuuaauuguc

SEQ ID NO: 8589 - RNA, 64 nt, Human
ccuccuccaggccgccgccccuucugaggacccaggcaccaaggugcugcuggucuccuggacc

SEQ ID NO: 8590 - RNA, 64 nt, Human
uauuuauugccgaaaccaggcaggcaaccccaagggcaccaaccagggccuccccaaagccugg

SEQ ID NO: 8591 - RNA, 64 nt, Human
uaaaaugaguucuuugaaauggaugaucucuaagggcaccaaaucugguauucuaagguucucc

SEQ ID NO: 8592 - RNA, 64 nt, Human
gagaaggggccaggccaagggccggguggggaugggcaccaagaaucucucccaccaccugaau

SEQ ID NO: 8593 - RNA, 61 nt, Human
gccagggccccucagacugacugcucagccaggcaccaacuggggcaugaacaggaccugc

SEQ ID NO: 8594 - RNA, 64 nt, Human
gaugucacggaaaaagcuaguucuguggucaggcggcaccaaugagaaaggaaugcagacccuc

SEQ ID NO: 8595 - RNA, 64 nt, Human
ugcucacugugcugcuuuuccaugagcucuuggaggcaccaagaaauaaacucguaacccuguc

SEQ ID NO: 8596 - RNA, 64 nt, Human
guuuugcuaaaggaaaaaaccauccaggucacggggcaccaaauuugagacaaauagucggauu

SEQ ID NO: 8597 - RNA, 64 nt, Human
gcccacagggccaccagcacacccccgcacgcugggcaccaacagagccacggagcgcgagcac

SEQ ID NO: 8598 - RNA, 64 nt, Human
aaauagaucaaugaauauaauucagucuuuuaggggcaccaaguaaagcauaaggucauauaua

SEQ ID NO: 8599 - RNA, 64 nt, Human
auauuugcuuuaauaaugucuuuuuaaaaauacuggcaccaaaagaaauagauccagaucuacu

SEQ ID NO: 8600 - RNA, 64 nt, Human
uaucacacccaaauuucacaagcacugacccccuggcaccaacacccgccaguacugugacuuc

SEQ ID NO: 8601 - RNA, 64 nt, Human
agaucugaugcuucaagaggcuguaaccucagagggcaccaaggaggguggcagagccugcuua

SEQ ID NO: 8602 - RNA, 64 nt, Human
gggugccuuuguggcuucgcugauuaaagagaguggcaccaaggauagcaaugucuggauuggc

SEQ ID NO: 8603 - RNA, 64 nt, Human
ggacccaucuccuagcacacgugcccacugaaguggcaccaacagaaguuuggcuugaacuaaa

SEQ ID NO: 8604 - RNA, 64 nt, Human
aaaugcccauguuggccuuuuacagcagugccacggcaccaagcgagcugccacaucucacacu

SEQ ID NO: 8605 - RNA, 64 nt, Human
uuucaaaguagaaucacucuaugcuuagaguuuuggcaccaaugcuguagggcagcagaaucua

SEQ ID NO: 8606 - RNA, 64 nt, Human
uuuaagugacuccuguugccugagcacaaaaaugggcaccaauggaggaaaaugacccuugggc

SEQ ID NO: 8607 - RNA, 64 nt, Human
cucaucuugccaucucccggccaggcugggaacgggcaccaagcagccgccucuaacaaacacc

SEQ ID NO: 8608 - RNA, 64 nt, Human
ggaaguuccacggcagguggugcguucccacgcaggcaccaaguggaagcuugcacggugggcc

SEQ ID NO: 8609 - RNA, 64 nt, Human
caaaauuggccugaauauucucuuggggaaagagggcaccaaagaaaaggguaagugcaucuga

SEQ ID NO: 8610 - RNA, 64 nt, Human
cagcaggcccagggaucccugaccugcaccagguggcaccaaggguccugaguccuggagaugu

SEQ ID NO: 8611 - RNA, 64 nt, Human
gcugcacacaggcacauuccuucuuccacaguggggcaccaaggauucuguccucauugcuggg

SEQ ID NO: 8612 - RNA, 64 nt, Human
cuacucgcugcacgggggcugccuggucacgcgcggcaccaaguggauugccaacaacuggauu

SEQ ID NO: 8613 - RNA, 64 nt, Human
agggugguguaccugcuggcacuauccagauggaggcaccaaacacccacauaccuggcccaac

SEQ ID NO: 8614 - RNA, 64 nt, Human
caggguaaccaacucgauuugggaugaaucuuagggcaccaaagacuaagacaguaucuuuaag

SEQ ID NO: 8615 - RNA, 64 nt, Human
gcccagccuaauugcaguaagacaaaaauucuagggcaccaagaggcuaaagucagcacagcuu

SEQ ID NO: 8616 - RNA, 64 nt, Human
cagggcaguguccacagccagaaaacuccugcugggcaccaaccacuacgagcauaccccaugc

SEQ ID NO: 8617 - RNA, 64 nt, Human
gucuugaaauuuggugugucuugggguggggaggggcaccaacgccugccccugggguccuuuu

SEQ ID NO: 8618 - RNA, 64 nt, Human
uaugcugcugcagaaugagcucuuccugaacgugggcaccaaggacuucccagacggagagcuu

SEQ ID NO: 8619 - RNA, 64 nt, Human
gagaguggugcagcgccagacauuuugcacauaaggcaccaaacagcccaggacugccgagacu

SEQ ID NO: 8620 - RNA, 64 nt, Human
gggugguuauuaaaaugcuuuuaaagucaacuguggcaccaauucuaauguaauccaacuugug

SEQ ID NO: 8621 - RNA, 64 nt, Human
gaguugauuuagguaagcaccuagcacaugccguggcaccaaguaagcacucaauaaaucacuc

SEQ ID NO: 8622 - RNA, 64 nt, Human
cacagaucagcaccaacguugaacagcuaaugaaggcaccaagucugaaggaggcagaagggaa

SEQ ID NO: 8623 - RNA, 64 nt, Human
uucccuggacccuuaacugccucacccugagcugggcaccaagguuagaaggcaaaaguggggu

SEQ ID NO: 8624 - RNA, 64 nt, Human
uccgacacugaggcugcagcgggaauucgcacucggcaccaaucagagccccaugccgcggccc

SEQ ID NO: 8625 - RNA, 64 nt, Human
auuugcucuucacagcaugagcaugaagcccaguggcaccaaauggcuggguacaaucaaguga

SEQ ID NO: 8626 - RNA, 64 nt, Human
aacuguaaugcaagaaccaaaugcacugugauguggcaccaacuaauuagcaagcaugaauuuu

SEQ ID NO: 8627 - RNA, 64 nt, Human
acagcuccuccccgacuagguggaaggcuggccaggcaccaagcaugugugugcacuuguaccu

SEQ ID NO: 8628 - RNA, 64 nt, Human
gagcaacgccaguggcaacguagugacucaggcgggcaccaaggcaacggcaccauuggucucu

SEQ ID NO: 8629 - RNA, 64 nt, Human
aggauauugcccugccauccaugaaaacuguucuggcaccaaaaguaaugacaaauguuaagug

SEQ ID NO: 8630 - RNA, 64 nt, Human
auuuuaaugucaaaauagugcucuuuaaaauucuggcaccaaauacaacuuacccugaaucaca

SEQ ID NO: 8631 - RNA, 64 nt, Human
aaacuuuaaagcguuugcacagaucaacuuaccaggcaccaaaagaaguaaaagcaaaaaagaa

SEQ ID NO: 8632 - RNA, 64 nt, Human
aggauguuggguuugcucaaggagucaagaggagggcaccaaguuuuccuuuuuucuaaauagc

SEQ ID NO: 8633 - RNA, 64 nt, Human
aggcugggccuucgacccuggggaugggccacagggcaccaaacacaucauaugucucucucuu

SEQ ID NO: 8634 - RNA, 64 nt, Human
cacuggguccguguucccgcuaugacaaugaccuggcaccaaugggcaguguuccccuuuagag

SEQ ID NO: 8635 - RNA, 64 nt, Human
acacgacauagcugaaauuuguucuguaggcggaggcaccaagcccuguuuucuugguguaauc

SEQ ID NO: 8636 - RNA, 64 nt, Human
gcuggccaguacagccaguggggagugggugggaggcaccaaaacuuggcagcugugccagaaa

SEQ ID NO: 8637 - RNA, 64 nt, Human
aucacacuucccauuaaaccuugcuuaugauauaggcaccaaccaaaccucuugcucugcuaua

SEQ ID NO: 8638 - RNA, 52 nt, Human
gcucgcuggagaacaacuaaggggcaccaaacccucugagguuuuacuuuaa

SEQ ID NO: 8639 - RNA, 64 nt, Human
cuuccuauuccugcauuuguaucuaagacuccaaggcaccaaggucucuucuccauuguugcuc

SEQ ID NO: 8640 - RNA, 64 nt, Human
uugggaagggggugcaggaagcucaaccccucugggcaccaacccugcauugcagguuggcacc

SEQ ID NO: 8641 - RNA, 64 nt, Human
ucuuggcaccagguuggggggcaugugcuuguugggcaccaaagugauggaacccucaggugcu

SEQ ID NO: 8642 - RNA, 64 nt, Human
agaaugaaaagguguuugauggacauguugugggggcaccaaugcagaacacugcacugagucc

SEQ ID NO: 8643 - RNA, 64 nt, Human
uccgccacucagccauuucccccuccucagauggggcaccaauaacaaggagcucacccugccc

SEQ ID NO: 8644 - RNA, 64 nt, Human
gaauagucuuuuacauuuuuguaugcugaauaugggcaccaaagaaccuguaaaaguuaucuuu

SEQ ID NO: 8645 - RNA, 64 nt, Human
ugcauuccgcuugagaccauaguguuuaaucuauggcaccaagcaucguuuccucagauuaaug

SEQ ID NO: 8646 - RNA, 64 nt, Human
ucaauauuugcuuguuguucauuuacaugcucuuggcaccaauccuagacucacgugugcccca

SEQ ID NO: 8647 - RNA, 64 nt, Human
uagacacuuauugccaggguuaaacauaugcucuggcaccaaguucaaaucuuuccuccccauu

SEQ ID NO: 8648 - RNA, 64 nt, Human
agccuuugguccauuucuuaugauuuccuuuaaaggcaccaaaucuuaucuggaaauaaauugu

SEQ ID NO: 8649 - RNA, 64 nt, Human
uccaggccuguccaucaggaaguaaauuuuacagggcaccaagcuuugcccccuaaaaucccuu

SEQ ID NO: 8650 - RNA, 64 nt, Human
guaaguccucuuuguagaugauguauuuugcuugggcaccaacagaauuaaaaacgaaaaacaa

SEQ ID NO: 8651 - RNA, 64 nt, Human
aaugguuccauuauggcugcguuggauugacagaggcaccaaaaggcaaaugguacuguccaca

SEQ ID NO: 8652 - RNA, 64 nt, Human
ucuguuacgucauuaacagugccuuacugugcaaggcaccaaaggacauaaauacguacuugca

SEQ ID NO: 8653 - RNA, 64 nt, Human
cucacacgccuucauccugaaacaggaagaggacggcaccaaguugggggugcuggaugaaaga

SEQ ID NO: 8654 - RNA, 64 nt, Human
auaugcugcacaagaacaaaauauaaaucuguauggcaccaaaaaucaaagugaaaaccaaacc

SEQ ID NO: 8655 - RNA, 64 nt, Human
auuuauuuucacugucacacgcauagauccacgaggcaccaaggccugggagcaucgacgugaa

SEQ ID NO: 8656 - RNA, 64 nt, Human
uucagccuccugcuggguccuucugcuggauacaggcaccaagaggcggucguggagcagggag

SEQ ID NO: 8657 - RNA, 64 nt, Human
gcaaaagcugucuacuuucucuuuuauucacuguggcaccaaucugguaaauuguagaacaauu

SEQ ID NO: 8658 - RNA, 64 nt, Human
cagccccuccucgacaggcccacccugcagcucaggcaccaagaaaacagccgauacuggcagc

SEQ ID NO: 8659 - RNA, 64 nt, Human
cggaggggcggggcgggggggggcuggggggacaggcaccaaguaugaagaggauggggccagc

SEQ ID NO: 8660 - RNA, 64 nt, Human
cauggccccuuuaguccucccgcccccgccaaggggcaccaaggccacguuuccgugccaccuc

SEQ ID NO: 8661 - RNA, 64 nt, Human
gugcucauagugaucagcugugcaggagccaugaggcaccaaccucuccccgcagggcaaagcc

SEQ ID NO: 8662 - RNA, 64 nt, Human
uuugaacccugugagccugagacagagagggccaggcaccaaccacaaggcgggaaaguccaug

SEQ ID NO: 8663 - RNA, 64 nt, Human
gaugcugaguggagggagccacugagcacagcaaggcaccaaagccccuggagaaaccgccagg

SEQ ID NO: 8664 - RNA, 64 nt, Human
acuacuccaaagguggcuaugcuggaucaucgcaggcaccaaacaagucugcagguucugggcc

SEQ ID NO: 8665 - RNA, 64 nt, Human
gccuaugaccgucacugacccuuggagccaggcgggcaccaaacacugauggcaccuauugagg

SEQ ID NO: 8666 - RNA, 64 nt, Human
ccuguucucuuguccccaccaccaaccuauagcaggcaccaaagcaagugcccgguaaauacca

SEQ ID NO: 8667 - RNA, 64 nt, Human
gugggaugagaggaguuguggcuuugugucugcuggcaccaagagggcugagggugaggugugg

SEQ ID NO: 8668 - RNA, 64 nt, Human
aauugagaauuaacuauacuacuagccauuuuagggcaccaaaacuugggauuaaacacuuccu

SEQ ID NO: 8669 - RNA, 64 nt, Human
cuuugcaguucaaucgaccacauaggaauuuccaggcaccaaaaugauauaacuuccuugcuuc

SEQ ID NO: 8670 - RNA, 64 nt, Human
cacucuguauuggacaaaggcuagcacagggcuaggcaccaauaaagauuucuaaugaugcaca

SEQ ID NO: 8671 - RNA, 64 nt, Human
gaaggaaaaggccaacuaggguguuagcccucugggcaccaaggaaacuaacagcuuucucaaa

SEQ ID NO: 8672 - RNA, 64 nt, Human
agaacaaugaagcuccaggcucucucuucuccagggcaccaagaggcugggcuuaguuuuggga

SEQ ID NO: 8673 - RNA, 64 nt, Human
cagcgcgacuguccgcauggcucccucccguccuggcaccaauuucugaauaaaguccuuucua

SEQ ID NO: 8674 - RNA, 64 nt, Human
uucuuuuuggaaacugagcgaaauccaagaugcuggcaccaagcguauuccguguggcccuuug

SEQ ID NO: 8675 - RNA, 64 nt, Human
aaucacagggagggcgcugugaccagcgcacucaggcaccaagugucggcauggcucacugugc

SEQ ID NO: 8676 - RNA, 64 nt, Human
ucauucucuugaguaauaaaucuuaucuuuucaaggcaccaacaaacaaaacugugauauugga

SEQ ID NO: 8677 - RNA, 64 nt, Human
gucccaacucagaggaaaagggccagugccaaggggcaccaagaaccugcucaggaagccuuuu

SEQ ID NO: 8678 - RNA, 64 nt, Human
cacuaagaacaaaagcucugaaguucuuccugcuggcaccaaauauuaggauuacaagcugucu

SEQ ID NO: 8679 - RNA, 64 nt, Human
uaagccugcucguaaagcucaauccuucuaucauggcaccaaucacaagaaccuuggacguuug

SEQ ID NO: 8680 - RNA, 64 nt, Human
cuuaccauguaaauccaaaucucugcaauccuguggcaccaaccaguggugcucauucuauugu

SEQ ID NO: 8681 - RNA, 64 nt, Human
ccacuaaucaguucuuagauucaggggaagggcaggcaccaacaacucagaaugggggcuuucg

SEQ ID NO: 8682 - RNA, 64 nt, Human
uuggcaucuccaucugagccuaaaguugcccacuggcaccaauagauucuguuugaccugcugu

SEQ ID NO: 8683 - RNA, 64 nt, Human
ggcaggaugggggagagggggaggggugguacuuggcaccaauaaaggaggaaucagacccaga

SEQ ID NO: 8684 - RNA, 64 nt, Human
cuccccacagcuucucgacugcaguggggcggggggcaccaacacuuggagauuuuuccggagg

SEQ ID NO: 8685 - RNA, 64 nt, Human
uccaguguucacauucacacuuaaugacuuccuuggcaccaaucauguauuucaccguuugcac

SEQ ID NO: 8686 - RNA, 64 nt, Human
uuugcaggccaguggccacuguccgggcugugauggcaccaaggcagguggagcaccagguacc

SEQ ID NO: 8687 - RNA, 64 nt, Human
gugauuaugcuauaauccaaucauguauuaauugggcaccaacuaugcacuaggcaugguauca

SEQ ID NO: 8688 - RNA, 64 nt, Human
aguccccccucccaccuccagucccccuauccuuggcaccaaagaugcagccgccuuccuugac

SEQ ID NO: 8689 - RNA, 64 nt, Human
guucaugguuacuggacuucuuauuccaagccauggcaccaaaggagaaggggcauuuuguggg

SEQ ID NO: 8690 - RNA, 64 nt, Human
agaacuacgaggaacaggugcccggaaccuucuuggcaccaaacacuacaaacuucaucccaac

SEQ ID NO: 8691 - RNA, 64 nt, Human
ucuccucucuucauucccucacagcagauuggccggcaccaaucuuagucaagaguggcuguga

SEQ ID NO: 8692 - RNA, 64 nt, Human
aaggacagacuugaggaauaaaaaugaccuugagggcaccaaucugugagggaaguuaggaacc

SEQ ID NO: 8693 - RNA, 64 nt, Human
ugacaaccacccgaugaacaggguccugggcuuuggcaccaaguaccugaaagagaacuucucg

SEQ ID NO: 8694 - RNA, 64 nt, Human
gguagggaagggugagcagauuccuauguuggugggcaccaauauuccaagggcagcucucuuu

SEQ ID NO: 8695 - RNA, 64 nt, Human
cuugagauccugauaccaccuucaaggaaccucaggcaccaacagugagcccacgaggaugguc

SEQ ID NO: 8696 - RNA, 64 nt, Human
cccacuucccaaauaugccucagccccacuagcuggcaccaacuuaauuccacgggaccaucug

SEQ ID NO: 8697 - RNA, 64 nt, Human
ucuucuuuacauuuucuacagcauucuguaugagggcaccaaauaaauccaucuagcugguagu

SEQ ID NO: 8698 - RNA, 64 nt, Human
auaaaguggagggagggagccguccggucaguagggcaccaaucccaccuccuucauuaccucc

SEQ ID NO: 8699 - RNA, 64 nt, Human
gcacuggcccucuuugaaagggcuuuacagugggggcaccaagaccccaaagggcccaggccag

SEQ ID NO: 8700 - RNA, 64 nt, Human
cuggaagcagaaagaagaaaggccaauuucacagggcaccaaacaaguaugaaauguaaaucag

SEQ ID NO: 8701 - RNA, 64 nt, Human
agaauucauaaucaaaccuaaccuuuuuguuuggggcaccaaaucugaagacaaaauuaauuug

SEQ ID NO: 8702 - RNA, 64 nt, Human
uggagagaaagccaaggcugcgucgaacuguccuggcaccaaaucccauauauucuucugcagu

SEQ ID NO: 8703 - RNA, 64 nt, Human
ggaaccaggggaaaaaaacuuucuuagacacacuggcaccaagguaagagguggggcugcccag

SEQ ID NO: 8704 - RNA, 64 nt, Human
guguuuggaaacaucuguggacucuguuagaugaggcaccaacaaggcaaggucaccugccucu

SEQ ID NO: 8705 - RNA, 63 nt, Human
ccaccacccccaucuacugaauagccaggggagggcaccaaugaacagcacaguaugggagac

SEQ ID NO: 8706 - RNA, 64 nt, Human
cuuuuccccagcaucacaaacagccauuuccucgggcaccaaaguagguucccuuuguuggaac

SEQ ID NO: 8707 - RNA, 64 nt, Human
uacauaccaccccuucugccgcgccuccaccccuggcaccaaggucuucugcugcuuaugucua

SEQ ID NO: 8708 - RNA, 64 nt, Human
ccucgggcuggagccuccgacgcugccucucauuggcaccaagggacaggagaagagaggaaau

SEQ ID NO: 8709 - RNA, 64 nt, Human
uugaucccaguguuacgggauucucuugauuccuggcaccaaaaucagauuguuuucacaguua

SEQ ID NO: 8710 - RNA, 64 nt, Human
uaguuuugucaaugguagugacuuacugaacaugggcaccaacuaauuuuguuguuguucuacc

SEQ ID NO: 8711 - RNA, 64 nt, Human
aguauaacuuccauagaugagcuguuguuaggaaggcaccaaagaaccuccucugcacuaaaca

SEQ ID NO: 8712 - RNA, 64 nt, Human
cuuggcugacuuuccagagcccagucccaagccuggcaccaagccugaggggccucuuggagga

SEQ ID NO: 8713 - RNA, 64 nt, Human
uggccaccugaccuguguguggcuggugcagccuggcaccaagugggcuaccuguuaggaacau

SEQ ID NO: 8714 - RNA, 64 nt, Human
agagacucggccuggacaccaugcgaugcacucuggcaccaaggcuuuaugugcccaucacucu

SEQ ID NO: 8715 - RNA, 64 nt, Human
gaaguaaaacuuggccuccuccagccccucucauggcaccaauggaaguguccuccuguucucu

SEQ ID NO: 8716 - RNA, 64 nt, Human
gcgguaagaggagggggagccaggcucaaguauuggcaccaaguuaggucucagaggaaagaau

SEQ ID NO: 8717 - RNA, 64 nt, Human
ccccgcuccaccggcaccagugccucgcuccauuggcaccaacgcccagcuccaccgguacugg

SEQ ID NO: 8718 - RNA, 64 nt, Human
ucgguuguagcuaauguucuccuagaaucacugaggcaccaauggcugagcaggaagggcgagg

SEQ ID NO: 8719 - RNA, 64 nt, Human
ucugcuggccucugcgagugguuucuugugcacuggcaccaagugcggguccggcagcuucugc

SEQ ID NO: 8720 - RNA, 64 nt, Human
cugcuacauaccccuguuccagcauuaacuaccaggcaccaaaacaguaggcauuagugccuuu

SEQ ID NO: 8721 - RNA, 64 nt, Human
guuuucuaaagaaacaggauaggaguuuagagaaggcaccaaagcuuucacuuugguuuggcac

SEQ ID NO: 8722 - RNA, 64 nt, Human
aaugccaagaaaagggcugacauuuucuuucaugggcaccaaccugcauuuguaugugucccga

SEQ ID NO: 8723 - RNA, 64 nt, Human
aagguuccucccucuccugcagaguaggcaucugggcaccaagaccuucccucaacagaggaca

SEQ ID NO: 8724 - RNA, 64 nt, Human
uggugggcccuucuuuccuggacuuuguggaggaggcaccaagugucucaggcagcgaggaaau

SEQ ID NO: 8725 - RNA, 64 nt, Human
gacccaagaaccauggggacugggguggguugguggcaccaauggcagcccuccccgccccucu

SEQ ID NO: 8726 - RNA, 64 nt, Human
ggggagcagccuucccuacucacuuuccccuugcggcaccaaauggucacuccuuccagagcaa

SEQ ID NO: 8727 - RNA, 64 nt, Human
cgccaaucacgagacugggggaccggccgggccuggcaccaaucugcgcugcggucgggcggag

SEQ ID NO: 8728 - RNA, 64 nt, Human
gcacaggcucuggcagccgucucaggcaggacugggcaccaagcuugcagccgaaggccuugcc

SEQ ID NO: 8729 - RNA, 64 nt, Human
aaggauacacauguguaaucuuuucugaacuccuggcaccaaguucuguccauucaucugaccc

SEQ ID NO: 8730 - RNA, 64 nt, Human
ggucccaggccguucagccugaccucaggcagcaggcaccaagcugccagaagcccaggggcuc

SEQ ID NO: 8731 - RNA, 64 nt, Human
cuucugcccucaccggacucugggcugugacuggggcaccaaacucagcacaugagucuccccu

SEQ ID NO: 8732 - RNA, 64 nt, Human
gaggccucugggccuccucuaacaggggcuggugggcaccaagagccaauggaguagaccccug

SEQ ID NO: 8733 - RNA, 64 nt, Human
ggagcacaaaagccucucaucccccauuaaccagggcaccaagcccacagguguccccagccca

SEQ ID NO: 8734 - RNA, 64 nt, Human
cacgggggagacggagagauauaaaggucccagcggcaccaacaucaucauuggcuccauugcu

SEQ ID NO: 8735 - RNA, 64 nt, Human
uccccaccccagccugguggcagaggaagcagguggcaccaacucaccaaagggacuugggagc

SEQ ID NO: 8736 - RNA, 64 nt, Human
uccacagaagacguuggcaugugaggccagggugggcaccaaagaccaggcccagagccagggg

SEQ ID NO: 8737 - RNA, 64 nt, Human
gccacugcgcccugccuguuuguaguaauuuuuaggcaccaaaucucccucaucuucuagugcc

SEQ ID NO: 8738 - RNA, 64 nt, Human
caaauagcuaugcagagcagagaugccuucaccuggcaccaacuugucuuccuuucucucuucc

SEQ ID NO: 8739 - RNA, 64 nt, Human
gccuucgcauagcacacugcuugaggcccugccaggcaccaagcacugcccugggcccauggga

SEQ ID NO: 8740 - RNA, 64 nt, Human
cgaguggcugucaucagccuguguaggcagucauggcaccaaagccaccagacugacaaaugug

SEQ ID NO: 8741 - RNA, 64 nt, Human
cgaguggcugucaucggccuguguaggcagucauggcaccaaagccaccagacugacaaaugug

SEQ ID NO: 8742 - RNA, 64 nt, Human
acucccucccuugcuuucuuucucuuccagucauggcaccaaauaugaaauaauuuguaaucca

SEQ ID NO: 8743 - RNA, 64 nt, Human
gccugcccuccugagccuccgccuucccagcagcggcaccaaggggccuuagggagccccaaaa

SEQ ID NO: 8744 - RNA, 64 nt, Human
ugacaucagaagaggaaaaagcagaaagagaaauggcaccaaacuccuccuucaccccuccucu

SEQ ID NO: 8745 - RNA, 64 nt, Human
cccgcacacgucagccaacagcagugccucugcaggcaccaagagagcgaugauggacuugagc

SEQ ID NO: 8746 - RNA, 64 nt, Human
cacaggaacaacagcaucuuucaccaagauggguggcaccaaccuugcugggacuuggauccca

SEQ ID NO: 8747 - RNA, 64 nt, Human
uggauggguggagaggcugagggacucacuggagggcaccaagccagcccacagccagggaagu

SEQ ID NO: 8748 - RNA, 64 nt, Human
cacccguggggugcugcccuuaugcccggcgccgggcaccaacuccauguuugguguuugucug

SEQ ID NO: 8749 - RNA, 64 nt, Human
cccucagagcuacucuucacuugucccugcuuccggcaccaaguucauaauagagaucuucugg

SEQ ID NO: 8750 - RNA, 64 nt, Human
uccccacugggcguccuaccccagugagguugaaggcaccaauuccaagaaucccuccaaccuc

SEQ ID NO: 8751 - RNA, 64 nt, Human
gguugagcccagaguggccgaggcuggacccuguggcaccaaguggggucggcugaccgugugg

SEQ ID NO: 8752 - RNA, 64 nt, Human
caucuaugcagcaggggucuaucgccuuguggauggcaccaaauuauccaaguguauuaggaga

SEQ ID NO: 8753 - RNA, 64 nt, Human
auuuaguugcuaaggcuuuuaauacauuuugaauggcaccaaaacaaaauaagucaaaauggac

SEQ ID NO: 8754 - RNA, 64 nt, Human
gcggcauagcagaugcucguucuugccuccuucaggcaccaaucaggagaaggguucugccucc

SEQ ID NO: 8755 - RNA, 64 nt, Human
auucucauuccugggcagcccuuccuuccacccuggcaccaaaauaauuucuccuccauccgua

SEQ ID NO: 8756 - RNA, 64 nt, Human
aaagcccauguagggcaggccuucuauaagugcgggcaccaagggcgccuacauccccaggccu

SEQ ID NO: 8757 - RNA, 64 nt, Human
agaagcaaguggcuuucaacacacaacagcagauggcaccaacgggacccccuggcccugccuc

SEQ ID NO: 8758 - RNA, 64 nt, Human
gugugccaccaggagggaguggcagcuauagucuggcaccaaaguccaggacacccaguggggu

SEQ ID NO: 8759 - RNA, 64 nt, Human
agcacucccuguccccaugucccgggcuccacugggcaccaacauaaccuuguucucuguccuu

SEQ ID NO: 8760 - RNA, 64 nt, Human
gggagaguuuuuagccaaaauucccaccucauucggcaccaaaaaguucacacuagggaaagaa

SEQ ID NO: 8761 - RNA, 64 nt, Human
ccagagaaggacacaaacguguuucguaagcccaggcaccaaugggaauggaccaaagaguuuc

SEQ ID NO: 8762 - RNA, 64 nt, Human
ugucugccugcagguggcccgggcgggucgcuuuggcaccaaaggccuagccaucacuuuugug

SEQ ID NO: 8763 - RNA, 64 nt, Human
caacacacaccaugacaacgacaccuauagauauggcaccaacaucacaugcacgcaugcccuu

SEQ ID NO: 8764 - RNA, 64 nt, Human
gacuucagaagagcaggacacaaugcuguggacaggcaccaauuucuuuaaagaaauucaaugu

SEQ ID NO: 8765 - RNA, 64 nt, Human
agaagauaaacacaaaauccauuccagguagcucggcaccaacuaagaaaaaaagcacaaaguu

SEQ ID NO: 8766 - RNA, 64 nt, Human
gcauccccauugugugauguguucagaugcaucuggcaccaauuagguauuucuuaaaacagga

SEQ ID NO: 8767 - RNA, 64 nt, Human
ugggcugggcaggcaugugccccccuagucagagggcaccaacccaccuacucugccccugggu

SEQ ID NO: 8768 - RNA, 64 nt, Human
caggacagacacguugagaagcugcagggagcagggcaccaagggagugugcacugugcuugcu

SEQ ID NO: 8769 - RNA, 64 nt, Human
uucuggggacaugggcuggagggcaggaccuagaggcaccaagggaaggccccauuccggggcu

SEQ ID NO: 8770 - RNA, 64 nt, Human
uuuauacugauauuaguuuggaugugccacuuuuggcaccaaacguguaugucauuuuuauuuc

SEQ ID NO: 8771 - RNA, 64 nt, Human
gacccugcagaagcagaccaggguuggcaaggcuggcaccaacaagccccccaggugccgggga

SEQ ID NO: 8772 - RNA, 64 nt, Human
gcccaggccccaccucuccucccuaagagcuaauggcaccaacuuugugauugguuugucagug

SEQ ID NO: 8773 - RNA, 64 nt, Human
aauuuuguuaagaauuucaauaucaagacugacuggcaccaacacuuugguauucaauuugauu

SEQ ID NO: 8774 - RNA, 64 nt, Human
aacacaugccuagugggggaaggcucacuaagagggcaccaaguggggcaaauaccccugguaa

SEQ ID NO: 8775 - RNA, 61 nt, Human
gguucaaaaugucccccugauaagggagaaaggcaccaagcuaacaucugacguccagaca

SEQ ID NO: 8776 - RNA, 64 nt, Human
gaagguggcgcugggcuagcccacccugcacgccggcaccaaacccuguccucccaccccuccc

SEQ ID NO: 8777 - RNA, 51 nt, Human
uuuugcagacaaagcucugauggcaccaaaucuugacuccuuuggacgcga

SEQ ID NO: 8778 - RNA, 64 nt, Human
cguccccauucccagggccccuccaagcccagcuggcaccaaagagcuugggcccgugcugacc

SEQ ID NO: 8779 - RNA, 64 nt, Human
gugggcugugauugugccacugcacuccagccugggcaccaaugugagaaccugucuuggaaaa

SEQ ID NO: 8780 - RNA, 64 nt, Human
cacaggcucugaccagcagccuaugaggggguuuggcaccaagcucuguccaaucagguaggcu

SEQ ID NO: 8781 - RNA, 64 nt, Human
gaccccaucuuacagacgagaaaaccagcacacaggcaccaaggaacuguccggaacuaacagc

SEQ ID NO: 8782 - RNA, 64 nt, Human
ggccaugcagaggaaggacagagggugggcgcagggcaccaacucagggacauccccucuccug

SEQ ID NO: 8783 - RNA, 64 nt, Human
uagucuuugauacucuguaagugcuaguuccuaaggcaccaacauugcauuccuugguuuauac

SEQ ID NO: 8784 - RNA, 64 nt, Human
ccuugugcaaauuuagauugggccaacuucuagaggcaccaaugccuucuuaguguggaaucau

SEQ ID NO: 8785 - RNA, 64 nt, Human
cagcuagagaacucuuugggaucccuuuuauaagggcaccaaucccauucaugaguucuccacc

SEQ ID NO: 8786 - RNA, 64 nt, Human
gcuggucccaggguggcaccacccaggcccccugggcaccaagggagcgagggggaauaagagc

SEQ ID NO: 8787 - RNA, 54 nt, Human
acagcugcaaaauuucuuaaggaaggcaccaaaaggaaacaagcuggaaucgcu

SEQ ID NO: 8788 - RNA, 54 nt, Human
cugaugagcaacaguugugacaguggcaccaaaggucauuugugguuguuuuug

SEQ ID NO: 8789 - RNA, 64 nt, Human
cacuguguuggggagagguguucgguuuccccagccuguuaaugaacagccauacguguaagcu

SEQ ID NO: 8790 - RNA, 64 nt, Human
cucuauggcggauuuuuuuuuuaacuuucuucuuccuguuaaaacauaggucacuaacugugau

SEQ ID NO: 8791 - RNA, 64 nt, Human
ugauuuuuucaaaaaagucaacaaacugcaagcaccuguuaauaaaggucuuaaauaauugucu

SEQ ID NO: 8792 - RNA, 64 nt, Human
aaaauucugcuuuuuuuucaucccuuuguguaaaccuguuaauaaugagcccaucacuaauauc

SEQ ID NO: 8793 - RNA, 64 nt, Human
aauguuuuucucgaagaaugugaaaauaauuagaccuguuaaauuauaauauucaaauaucuau

SEQ ID NO: 8794 - RNA, 64 nt, Human
guccuaaauuaauauacaccagugguuccuccucccuguuaaagacuaaugcucagaugcuguu

SEQ ID NO: 8795 - RNA, 64 nt, Human
uacucugcacguauaucucuucugucuugaagacccuguuaacuuugugaaauaacuuccacau

SEQ ID NO: 8796 - RNA, 64 nt, Human
aaguaugcuuugccuuauuuccacauuuaaacuaccuguuaauauaagggauuuguaguaucag

SEQ ID NO: 8797 - RNA, 64 nt, Human
ucagcgguucaacuuuauaauaauuauaaauaaaccuguuaaauuuuucuggacaaugccagca

SEQ ID NO: 8798 - RNA, 64 nt, Human
ucuaaacaaaaaauaaaaugaacaucucuugaaaccuguuaaaacaaccaguuaaagccacaga

SEQ ID NO: 8799 - RNA, 64 nt, Human
aauaagauaaauguaaaguuguuuuauaaacgauccuguuaauuaaaccacagacaccauauau

SEQ ID NO: 8800 - RNA, 64 nt, Human
gaggauucagggcgggagacaggagccuugggguccuguuaaaccacagacaguuaugaacuga

SEQ ID NO: 8801 - RNA, 64 nt, Human
uuuuguucuuucuugcucuuaaggauuuuaaaaaccuguuaaucuuuuuauuuguauacuuucc

SEQ ID NO: 8802 - RNA, 64 nt, Human
aaggcccaugcuuguccgggcacaguggcuuacgccuguuaaugccaguacuuugggaggccga

SEQ ID NO: 8803 - RNA, 64 nt, Human
auugcguaaagugaggcucgccugcauagcuaauccuguuaaagacaacuucucaaagcacaac

SEQ ID NO: 8804 - RNA, 64 nt, Human
uacauaagagaugcugcuacccaagcaccaaagaccuguuaagcaugugcacuacugaccacga

SEQ ID NO: 8805 - RNA, 64 nt, Human
cugauggcccaaaaacuaccucaagagaccuggcccuguuaagacggcuuaaccacugagaucc

SEQ ID NO: 8806 - RNA, 64 nt, Human
cauuauggguuuuauugcuuucuuuuaugguagaccuguuaauggggaaaaaauacaucaaauc

SEQ ID NO: 8807 - RNA, 64 nt, Human
uaaaaggaaaaauuguguuaccuuuuuuaaauucccuguuaagucccuuccguaauuuuuaugu

SEQ ID NO: 8808 - RNA, 64 nt, Human
gagaaaaagauucugggguuacuugaccuucucuccuguuaagugcaguagggcuuccccucuu

SEQ ID NO: 8809 - RNA, 64 nt, Human
gacauuacaguuuggaaguguuaacuauuuauucccuguuaaaauuuaaccuacuagacaauga

SEQ ID NO: 8810 - RNA, 64 nt, Human
agaaccaaccaagcuaggaacaucagccuggugcccuguuaaccccuuaaagcugugguuuaca

SEQ ID NO: 8811 - RNA, 64 nt, Human
gaaaacauagacuuacuggcuguagcaaugcuggccuguuaacugauaacuagaacuuagguuc

SEQ ID NO: 8812 - RNA, 64 nt, Human
cuuucacugccaugacacuaggcaaaaaauauuuccuguuaaaagaaagagaaaaagagaggga

SEQ ID NO: 8813 - RNA, 64 nt, Human
cuccaccuggucauucauugugugugacuugauaccuguuaacuugccccuuaguaucagcugu

SEQ ID NO: 8814 - RNA, 64 nt, Human
uccuuaaacaaaaugauccaccuaagaucuugccccuguuaaguggugaaaucaacuagaggug

SEQ ID NO: 8815 - RNA, 64 nt, Human
uauauauauaugccuuuuuccuagccuguuucuuccuguuaauguauuuguucauguuuggugc

SEQ ID NO: 8816 - RNA, 64 nt, Human
uuaauaucgucuuugaaaauguuaaauugagaaaccuguuaacuuacauuuuaugaauuggcac

SEQ ID NO: 8817 - RNA, 64 nt, Human
augaccacaccaaacuugguuauucauaauuuuuccuguuaaauauaaaacacuguaaguuaaa

SEQ ID NO: 8818 - RNA, 64 nt, Human
uaaaucaacagacaauggcauugucgaagagcaaccuguuaaugaaucauguuaaaaaucaagg

SEQ ID NO: 8819 - RNA, 64 nt, Human
ucauuugggacuuggagacugcuuuuauccagaaccuguuaagagaacaggggauuuaaauaca

SEQ ID NO: 8820 - RNA, 64 nt, Human
gguucugucauuugacugcacaguaucagaggagccuguuaaccucucugugccuuaguuucuu

SEQ ID NO: 8821 - RNA, 64 nt, Human
cacccugcucucagcaggcagugagugucacacaccuguuaauccaucuugagcaggacaguac

SEQ ID NO: 8822 - RNA, 64 nt, Human
cuauauaucagcagcaagugugcaaaauaaaggaccuguuaacucagauuucuggauauuuugg

SEQ ID NO: 8823 - RNA, 64 nt, Human
uuaaaacuuuuaaggguuuucuauguucuuccuaccuguuaaaccucuucccuuucuguguguu

SEQ ID NO: 8824 - RNA, 64 nt, Human
gcagcaucccuggccuguugucaugcagucauuuccuguuaauucugggagacaaugauuucac

SEQ ID NO: 8825 - RNA, 64 nt, Human
uuuuaaauaagauuaguauuaucuguuuauaaugccuguuaauaaaagaauuuacaguuuggua

SEQ ID NO: 8826 - RNA, 64 nt, Human
ccuaaaaaauucuguaguacguaguuuugucuuaccuguuaacuuuccccaauugagauaaaag

SEQ ID NO: 8827 - RNA, 64 nt, Human
cacaaaucagauuaauuugggauuuaaauuuucaccuguuaagguggaaaauggacuggcuugg

SEQ ID NO: 8828 - RNA, 64 nt, Human
aaaaguugcaguaaauuuuauuuggauauuuuaaccuguuaaguguguguguguuuucuguacc

SEQ ID NO: 8829 - RNA, 64 nt, Human
cugcgucugcucuacugaguacuuucugcaggggccuguuaaggacgaggccuccccagcccug

SEQ ID NO: 8830 - RNA, 64 nt, Human
uuucucuauaucaauguguccuuaguuuucuuagccuguuaauuuaaaaauccagacuuggggg

SEQ ID NO: 8831 - RNA, 64 nt, Human
acaaggucgcuucucuuuuccucuucucucccaaccuguuaaccuagugcuagauagucagcug

SEQ ID NO: 8832 - RNA, 64 nt, Human
uguuaggaaaucuagucaucuucccugugauugcccuguuaaguauuuaaccauagcuaucaug

SEQ ID NO: 8833 - RNA, 64 nt, Human
gaggguuguaguagaugcuuccagugucaguaugccuguuaauuuuaagagcuucccuuucuug

SEQ ID NO: 8834 - RNA, 64 nt, Human
aaccacucauaauucuucaccuuaggaauaaucuccuguuaauaugguguacauucuuccugau

SEQ ID NO: 8835 - RNA, 64 nt, Human
uuaacuugacucaaacauuuuucaauuaugacagccuguuaauaugacuuguacuauuuuggua

SEQ ID NO: 8836 - RNA, 64 nt, Human
cauagugagcugccuucuugcguucgggugcaccccuguuaaaccugaucugugucauaaguga

SEQ ID NO: 8837 - RNA, 64 nt, Human
agcggcacugaucgccuugugaccggaagagugaccuguuaaaagccacgcagcagacucaugg

SEQ ID NO: 8838 - RNA, 64 nt, Human
agcuugaaacugagaugugaacacaucagcuugcccuguuaaaagaugaaaauauuuguaucac

SEQ ID NO: 8839 - RNA, 64 nt, Human
acugagacaauagugagauggcuuauauguuuccccuguuaauaucugguuaaauuauguaucc

SEQ ID NO: 8840 - RNA, 64 nt, Human
ucccaacauuucucuucaguguguugacuucuauccuguuaacacuguaauaucuuuaaaugau

SEQ ID NO: 8841 - RNA, 64 nt, Human
augaauuuagagcauuccacccaauauaauaaaaccuguuaagaaugucagucuuuguucaaac

SEQ ID NO: 8842 - RNA, 64 nt, Human
cacuucaguguuucucuccuguucaauaaaaugcccuguuaaggauauaauuugaagugagaag

SEQ ID NO: 8843 - RNA, 64 nt, Human
ccgcgagcaagucccuuccuuuuagagcguguuuccuguuaaguaaaaucauaaacaccgaucc

SEQ ID NO: 8844 - RNA, 64 nt, Human
auuaaacucacaauaggguaaguaaauauagccaccuguuaacauguaaauaagcauaauuugu

SEQ ID NO: 8845 - RNA, 64 nt, Human
uaaauuuaaaaguuucaauuuauugcucaguguaccuguuaacauuauauuuaacaauugcuua

SEQ ID NO: 8846 - RNA, 64 nt, Human
acuuugaaaggugcucuugcuaagcuuauaugugccuguuaaugaaagugccugaaagaccuuc

SEQ ID NO: 8847 - RNA, 64 nt, Human
cucaaagucacugguauauuggauuaaguuuuuuccuguuaaugcaauuauagaaauacaucgg

SEQ ID NO: 8848 - RNA, 64 nt, Human
cuuuaagguguuaugguggcacaguuacugcucgccuguuaaauuucaaauguccuguuugaua

SEQ ID NO: 8849 - RNA, 64 nt, Human
gcuguccuucaaaugcagccagucuacuccauguccuguuaacagaaagcuauggauucccugg

SEQ ID NO: 8850 - RNA, 64 nt, Human
cuggugcucuuucccuuuaucaguuugacuguggccuguuaacugguauauacauauauauguc

SEQ ID NO: 8851 - RNA, 64 nt, Human
cacauucauguauauuuauuccuggaauuauuugccuguuaaacagugucuuucauguucucuc

SEQ ID NO: 8852 - RNA, 64 nt, Human
guauuugggucucccuuugacuucauguguucucccuguuaaugcguuuguauauagauuuggu

SEQ ID NO: 8853 - RNA, 64 nt, Human
ugagacuuucccagggaagccugauuucacuuugccuguuaauuucacucugccuguuaggugg

SEQ ID NO: 8854 - RNA, 64 nt, Human
guuugauuuuuuacugaaucaaaugcaaauguuaccuguuaaagauauuacagagaaauuuuau

SEQ ID NO: 8855 - RNA, 64 nt, Human
caaaauaauaacaggcugggugcaauggcucacaccuguuaaucccagcacuucgggaggccaa

SEQ ID NO: 8856 - RNA, 64 nt, Human
uauagucugcuuucuguuccuccagaauuugaguccuguuaauguaguagaaaaaaaaaaaaga

SEQ ID NO: 8857 - RNA, 64 nt, Human
ugaaauugagccacuuccuugaagaaucaaaauuccuguuaauaaaagaaaaacaaauguaauu

SEQ ID NO: 8858 - RNA, 64 nt, Human
accauuuugcuucuaauuuugacaguaucacuuuccuguuaaaacauacaauaauuuuaaaagg

SEQ ID NO: 8859 - RNA, 64 nt, Human
agacagacucugaaugcaugaccuuugguacaugccuguuaauauucauguucugaaaauauuu

SEQ ID NO: 8860 - RNA, 64 nt, Human
ugaucuucuuaggaacuucaagaaaaggaauuuuccuguuaaauuaaacauuggcaaaaggaaa

SEQ ID NO: 8861 - RNA, 64 nt, Human
uguauguacacagcuaacacagcucuuuagauucccuguuaagugacucauucacauuccuuuc

SEQ ID NO: 8862 - RNA, 64 nt, Human
uuuuccugcgacaaaacgucuuuucacaacuuacccuguuaagucaaaauuuauuuuccaggaa

SEQ ID NO: 8863 - RNA, 64 nt, Human
ugcugcacauuuuguuuaaguguuacuguuucugccuguuaaugcugggaacacaaauagugca

SEQ ID NO: 8864 - RNA, 64 nt, Human
uggcccucuggacauuaucacuaaauugcuugugccuguuaacaagaauacugaccagaaugcu

SEQ ID NO: 8865 - RNA, 64 nt, Human
gugauggcuuauggaaggcuguuaaauuaauauuccuguuaaaggaaauuaaaguuugucuauu

SEQ ID NO: 8866 - RNA, 64 nt, Human
cugguuacgaagaaaacucaccaaucaucuccuuccuguuaaucacauguuaaugaaaauaagc

SEQ ID NO: 8867 - RNA, 64 nt, Human
agagacaagggggucuaugagcauuuacugacuuccuguuaaaacuucauuuuuucaaacuuuu

SEQ ID NO: 8868 - RNA, 64 nt, Human
caaaccaugucaagauuauuaguucagacucuagccuguuaauuuucuuaguugauuucugaag

SEQ ID NO: 8869 - RNA, 64 nt, Human
gacugugcaugguguguauauuucauugcgauuuccuguuaagaugaguuuguacucagaauug

SEQ ID NO: 8870 - RNA, 64 nt, Human
gcuaacugagagaaguacuaagacccacaaacugccuguuaagucugagaaggcuaaagaagac

SEQ ID NO: 8871 - RNA, 64 nt, Human
aaaaguacauuugaugacaauagcugcuuaguuuccuguuaagagaagaaacuuuaucuuuuaa

SEQ ID NO: 8872 - RNA, 64 nt, Human
uuuuacuuccauuauacaucaauuggaaaucaauccuguuaagagauaauucuuaaaagggaaa

SEQ ID NO: 8873 - RNA, 64 nt, Human
uuaagauauucagaaguauauuuuagaaucccugccuguuaaggaaacuuuauuugugguaggu

SEQ ID NO: 8874 - RNA, 64 nt, Human
acuaaagauguacagcaaacugcccguuuagaguccuguuaauauugauguccuaacacugggu

SEQ ID NO: 8875 - RNA, 64 nt, Human
agagacccagaucucauggaaacuggccagggguccuguuaacgucaucucaggguccagaccc

SEQ ID NO: 8876 - RNA, 64 nt, Human
auucuguauaaacaaaucagagguuccugagguuccuguuaaauuuuuaauggcuaauagccca

SEQ ID NO: 8877 - RNA, 64 nt, Human
ggcaucagacaucagcaggucugugugccucagcccuguuaaggggcagguuucucuuuagccc

SEQ ID NO: 8878 - RNA, 64 nt, Human
cauggauccuggauugagacgaaugccauuggaaccuguuaaaugaguaguuuguuaugugucu

SEQ ID NO: 8879 - RNA, 64 nt, Human
ccuuuacuuuuaauacaggcuuuaaugaacuauaccuguuaaguuccaaaggucaaaauggagg

SEQ ID NO: 8880 - RNA, 64 nt, Human
agcugcuuuuaaaauaagaucucuuuguagccauccuguuaaauuuguaaacaaucuaauuaaa

SEQ ID NO: 8881 - RNA, 64 nt, Human
auacagaguucguauuucagcuuuguuuauccuuccuguuaagagccucugaguuuuuaguuuu

SEQ ID NO: 8882 - RNA, 64 nt, Human
uuuaauauuaacagcuauuaugaacaaaauuuuuccuguuaaauagcgacuucaguauuguguu

SEQ ID NO: 8883 - RNA, 64 nt, Human
acuuugguacaauuuagaugucuauuugguggcuccuguuaaagacgcaccaguguaaaauguu

SEQ ID NO: 8884 - RNA, 64 nt, Human
ucugguuauuucucaaaguaaguauuuuaaacagccuguuaauuauaagaaacucagaauaaug

SEQ ID NO: 8885 - RNA, 64 nt, Human
uuauaacuuuuucucaaagucacugauguuuguuccuguuaaauguauagcauuguaaugagag

SEQ ID NO: 8886 - RNA, 64 nt, Human
acaaccagggagggagguuauaauaauagagcauccuguuaaucagaaucaugggggagaacau

SEQ ID NO: 8887 - RNA, 64 nt, Human
ucuagagagaaggaaauuaauguuucuuaauaauccuguuaaauguuugauuguuuuuggaaug

SEQ ID NO: 8888 - RNA, 64 nt, Human
uuuaaaauugugugcucucuucuucacguaggcuccuguuaaaaacaaagugcagucagauucu

SEQ ID NO: 8889 - RNA, 64 nt, Human
ugguuccuucguguggggcuugaucguguugcugccuguuaacaugaugccuuugaaacucucc

SEQ ID NO: 8890 - RNA, 64 nt, Human
acuugaaugccaaagaacuuguccagaagaaaaaccuguuaaauucaaguauuaaaauuuuuag

SEQ ID NO: 8891 - RNA, 64 nt, Human
agggaguugccccuucccaguaaaagaguugcagccuguuaaacaauguggucuaauuuagugu

SEQ ID NO: 8892 - RNA, 64 nt, Human
uugucagcuacauuguuuucuuagauggauuucuccuguuaauccucaaauaucugaacuucug

SEQ ID NO: 8893 - RNA, 64 nt, Human
ccuugaguuaucaucugagugauauguuucuugaccuguuaaacuucgcagcugagacccucgu

SEQ ID NO: 8894 - RNA, 64 nt, Human
ugcauuuuaacaagaugcccaggugaucugcaugccuguuaaagucugagcucuguugcagaua

SEQ ID NO: 8895 - RNA, 64 nt, Human
aucugaaguuugcucuucaaggaaugggaaccuuccuguuaaauucgguguauggauuuuaaga

SEQ ID NO: 8896 - RNA, 64 nt, Human
cugaagauugcauggaggaugaacaucugggaauccuguuaaugagaaggcugaaucacaggca

SEQ ID NO: 8897 - RNA, 64 nt, Human
gucauuucaugaaauuuuuguuuagcauuuagaaccuguuaaacuagcuucaggaaguaauuuu

SEQ ID NO: 8898 - RNA, 64 nt, Human
uuuuuccccccugagcucuaguuuuaaacuuucuccuguuaaaaaaauuguacuuuuauuucau

SEQ ID NO: 8899 - RNA, 64 nt, Human
acauaauggauguggaugugauagguggucuuuuccuguuaacaagcuggcagcaaagcuucag

SEQ ID NO: 8900 - RNA, 64 nt, Human
aagaaggaacagacaaagguuugaaaaugauaagccuguuaagacaccaaaaacuccugucccg

SEQ ID NO: 8901 - RNA, 64 nt, Human
aggacgucgacggugaauguucuggugguuguugccuguuaaguaaacuuuaguguguaaguug

SEQ ID NO: 8902 - RNA, 64 nt, Human
gccaccaccggggcacuggcugcucugucuugguccuguuaacccuccaccuccucucuuggac

SEQ ID NO: 8903 - RNA, 64 nt, Human
uacauaaucaaagcuaccuguggugauguugccaccuguuaaaauguacacuggauauguuguu

SEQ ID NO: 8904 - RNA, 64 nt, Human
ccugcaguaaggagcccagaaggaacauguguuuccuguuaaaacuccucuuguucucuuuucu

SEQ ID NO: 8905 - RNA, 64 nt, Human
aauaaauauuugcaauuuucuacagaauugaauaccuguuaaagaaaaauuacagaauaaacuu

SEQ ID NO: 8906 - RNA, 64 nt, Human
cuugcuuucuccucagauacuguucuggacugugccuguuaaguugcucaguuuugagcugucu

SEQ ID NO: 8907 - RNA, 64 nt, Human
uguucuguaagauaaacuguauauuucauauguaccuguuaagguacuuuuuaaagcuuguaca

SEQ ID NO: 8908 - RNA, 64 nt, Human
aaaaaauauggaaaacauuuugauaaaauuuuuuccuguuaaaaccaugaacauuggcuaugau

SEQ ID NO: 8909 - RNA, 64 nt, Human
acaagaacauaaaauguuaauaucacuaauauagccuguuaaaucuuuuguggagacaggugca

SEQ ID NO: 8910 - RNA, 64 nt, Human
gcaauauuuucauuuucgcaguauaauaauugcaccuguuaaauaaaguuuuguaaacauuuaa

SEQ ID NO: 8911 - RNA, 64 nt, Human
ucguacugguuuuaaaccuugugcucuacuccuuccuguuaaugaauuaagaacacauucuaac

SEQ ID NO: 8912 - RNA, 64 nt, Human; identical to SEQ ID NO: 8911

SEQ ID NO: 8913 - RNA, 64 nt, Human
gugaauuacuaucuguguccaucaggaaguuuguccuguuaaccaaaugguuacugcacuacca

SEQ ID NO: 8914 - RNA, 64 nt, Human
ccugauugauaaaauugcugaaugcucaaauaaaccuguuaaaauuguaaugugccuaagugua

SEQ ID NO: 8915 - RNA, 64 nt, Human
auaaaguugcauuugccaaaauuuacccguguagccuguuaauuuucuugaaauaaguuuuaca

SEQ ID NO: 8916 - RNA, 64 nt, Human
uuuguccuguauagcaucauuauuuuuagccuuuccuguuaauaaagcuuuacuauucuguccu

SEQ ID NO: 8917 - RNA, 64 nt, Human
aauacuuuguuuuuaguuuuuuccuccuuuccauccuguuaaccacagugaaacgcugcaguau

SEQ ID NO: 8918 - RNA, 64 nt, Human
agaccucugccuaugcaagugucuaacuucugugccuguuaaucaugggagggugagacagaac

SEQ ID NO: 8919 - RNA, 64 nt, Human
ggacucuagguuuaacauuuuguacaaaauggaaccuguuaaucauauuaaagcacauauguau

SEQ ID NO: 8920 - RNA, 64 nt, Human
aaggcccccucguauacccucccuaacccacaaaccuguuaacauugucuuaaggugaaauggc

SEQ ID NO: 8921 - RNA, 64 nt, Human
auuugugaucuccuaucaaccuuucauguuuuacccuguuaaaauggacauacauggaaccacu

SEQ ID NO: 8922 - RNA, 64 nt, Human
uauaauaaaaaauguuggggggaguugaugaauuccuguuaaaagcuguucuuguguguuacau

SEQ ID NO: 8923 - RNA, 64 nt, Human
gaaauagaaacaaacaauaaccguaugaagauguccuguuaaauuuacaacacuaacgauguag

SEQ ID NO: 8924 - RNA, 64 nt, Human
uaguuucuuguaugauuuuuuguacucauucauuccuguuaagcugccaaaaauuaaagugcaa

SEQ ID NO: 8925 - RNA, 64 nt, Human
ugaguagaaugggcucaugggcaaugugauguucccuguuaaccuucuguuacucccugggaga

SEQ ID NO: 8926 - RNA, 64 nt, Human
ugcuauuggauuacuaaugccgccucuucagaccccuguuaaucucucaguuuucugugaccac

SEQ ID NO: 8927 - RNA, 64 nt, Human
gugcauuguggcuuaugaugagccauauuaauugccuguuaaauauacacuagcuugaacuuag

SEQ ID NO: 8928 - RNA, 64 nt, Human
auuuccaaacaacaacaacaaaauaacauguuugccuguuaaguuguauaaaaguaggugauuc

SEQ ID NO: 8929 - RNA, 64 nt, Human
ggaaacaagacuuuauugagaucaguuugguuuuccuguuaauuuaccuguuugacuuuauaau

SEQ ID NO: 8930 - RNA, 64 nt, Human
acacaaggccaaccacaacacagaacgauguugaccuguuaaguauucucugaaacauggccaa

SEQ ID NO: 8931 - RNA, 64 nt, Human
uaguaacugguuguucuacuugguaauuugacacccuguuaauaacgcaauuauuucuguguuc

SEQ ID NO: 8932 - RNA, 64 nt, Human
gggagccaggucuggaauauucaguuucccugccccuguuaaagaaucagagguugggcaguca

SEQ ID NO: 8933 - RNA, 64 nt, Human
auauucccaacauacuuaacacagauguuuuuuaccuguuaacaucucacccagcuaguguucc

SEQ ID NO: 8934 - RNA, 64 nt, Human
uagugaccauuauucacagguggacaaauguuguccuguuaauuuauaggcguuuuuuggggau

SEQ ID NO: 8935 - RNA, 64 nt, Human
agaauggaagaugguaaacaaucacuuuuuaaaaccuguuaagucaaaaccaucuuggcuaaua

SEQ ID NO: 8936 - RNA, 64 nt, Human
aacacuucuuuccaucaguaacacuggcaaucuuccuguuaaccacucuccuuagggaugguau

SEQ ID NO: 8937 - RNA, 64 nt, Human
aagauagucuugcaacaaaaugucuuuuaaguuuccuguuaaaauuauaaaaagauuuucaugg

SEQ ID NO: 8938 - RNA, 64 nt, Human
ucagucugcuagaacuuuaaaaugaaggacaaauccuguuaaagaaauauuguuaaaaaucuuu

SEQ ID NO: 8939 - RNA, 64 nt, Human
aucagaagcaguaggaauggccguauacaaccauccuguuaaacauuuaaauuuagcucugaua

SEQ ID NO: 8940 - RNA, 64 nt, Human
gaagcagugucugcaggcguucagugcugcggagccuguuaaaggucacucagaugugcaggug

SEQ ID NO: 8941 - RNA, 64 nt, Human
gauauaauaccaaccagaaauuggcauuuauaaaccuguuaagagacuuuaagcaugcuucaag

SEQ ID NO: 8942 - RNA, 64 nt, Human
uaauggaguuggaauaaagagcuguuugccuaucccuguuaaugaugguuguguuuaagaaucu

SEQ ID NO: 8943 - RNA, 64 nt, Human
guuaacacuuuaaccuacauugaaucugauucuaccuguuaacuuuuaaaaagucguaaguuug

SEQ ID NO: 8944 - RNA, 64 nt, Human
uagcuccauuguggaauacagaaaauuaaauauaccuguuaaguucguaucuaaaccuaagaca

SEQ ID NO: 8945 - RNA, 64 nt, Human
aagucucaccuuguugacuuccaccagaacaaaaccuguuaauucagcuugacuucucauaugu

SEQ ID NO: 8946 - RNA, 64 nt, Human
uguagcuggaaacaaaaaugagcguguuuucucuccuguuaaucuagagugugcaguuacacau

SEQ ID NO: 8947 - RNA, 64 nt, Human
uuuaguagauauguaaaaagauuccuuuuucuaaccuguuaaaaacuaaagcucaaguucacua

SEQ ID NO: 8948 - RNA, 64 nt, Human
ccauucuuucagcaaagcuucauugacaccugcaccuguuaacuguguucgacauugaagggag

SEQ ID NO: 8949 - RNA, 64 nt, Human
guagcauguuacaguucaaacaugucuccacuacccuguuaagagcagccugggaacguacagg

SEQ ID NO: 8950 - RNA, 64 nt, Human
cuuguuuguauaaauuauugaaauccauuugcacccuguuaagaauggacuuaaaaguacugcu

SEQ ID NO: 8951 - RNA, 64 nt, Human
ggaaacaguguagucgcuucccuuuuuaggaagcccuguuaauaugcucauugaaaacauggca

SEQ ID NO: 8952 - RNA, 64 nt, Human
gggaugcagcuucaagcccagugcccagugucucccuguuaacugcaggaaugccaagcaccug

SEQ ID NO: 8953 - RNA, 64 nt, Human
uguauauauaugggaggaaaggccacauuuuguaccuguuaauuuuugugggauguuguuccca

SEQ ID NO: 8954 - RNA, 64 nt, Human
cauuuguuuugccuuuccuccuauuuuuuuuuaaccuguuaaacucuaaagccauagcuuuugu

SEQ ID NO: 8955 - RNA, 64 nt, Human
guccuggcaccuccauuuccuuaguuucuguaagccuguuaacagaaaguagaggcuauucaag

SEQ ID NO: 8956 - RNA, 64 nt, Human
uucgugaaaacugcucauaaagacuaaaaguugaccuguuaaaacguuaauguacuaagauagu

SEQ ID NO: 8957 - RNA, 64 nt, Human
aagauuugaugugguuccuccuuaagcuaugcguccuguuaauaauagguacuguacugggcuc

SEQ ID NO: 8958 - RNA, 64 nt, Human
acaguuugagagaauauuauauaagaugaugugcccuguuaaaaggaggaggcaaaauagucaa

SEQ ID NO: 8959 - RNA, 64 nt, Human
gugagaaacuaacuacuuaauucccuggauuuauccuguuaagcuugaguagaaugaaggccug

SEQ ID NO: 8960 - RNA, 64 nt, Human
ccuacuucaggacuuuaagacucacagucuucagccuguuaaugaugucuucauguugaguuuu

SEQ ID NO: 8961 - RNA, 64 nt, Human
aagauguacauuuaauaauaucaaagagaagaugccuguuaauuuauaauguauuugaaaauua

SEQ ID NO: 8962 - RNA, 64 nt, Human
uguguuacaaaauuggagaaaguauuuaauaaaaccuguuaauuuuuauacugacaauaaaaau

SEQ ID NO: 8963 - RNA, 64 nt, Human
caaacucagcccuccaguuucuucagauguaaacccuguuaacgucacuguuuccaaaaggaaa

SEQ ID NO: 8964 - RNA, 64 nt, Human
uguugguuccaauauucucccacugcuagagcuuccuguuaagcaagugugaucugcaacauuu

SEQ ID NO: 8965 - RNA, 64 nt, Human
acaaggaagaguuguuuuuaccuuuuaagaauuuccuguuaagaucgucuccauuuuuaugcuu

SEQ ID NO: 8966 - RNA, 64 nt, Human
guuuuggaauuguuaacguuucuuucaacaagcuccuguuaaaaguauaugaaccugaguacua

SEQ ID NO: 8967 - RNA, 64 nt, Human
ucauagaagccauugcaucuauaaagcaacggcuccuguuaaaugguaucuccuuucugaggcu

SEQ ID NO: 8968 - RNA, 64 nt, Human
cccucuaccaugugggccuuccccaggagaugauccuguuaaguguucggcaguaaccuacuuu

SEQ ID NO: 8969 - RNA, 64 nt, Human
uuuuuaaaggaaacacugcaacuuuccuuaacagccuguuaauaaaggcuuugugacaagcucu

SEQ ID NO: 8970 - RNA, 64 nt, Human
ucuucucuuccuuuccccaagacagaguccugaaccuguuaaauuaagucauuggauuuuacuc

SEQ ID NO: 8971 - RNA, 64 nt, Human
uaauagaccaggcagcuucucaucucagcauuuaccuguuaauauuuuugugaauagugcucuc

SEQ ID NO: 8972 - RNA, 64 nt, Human
uaacuccauguuccaugcaacuggauuuuuggacccuguuaauagcauuaagguagagguuuac

SEQ ID NO: 8973 - RNA, 64 nt, Human
aggcuggggguuuuguaaaguguccacugcucguccuguuaauuuuccucaauuuuucuucuuc

SEQ ID NO: 8974 - RNA, 64 nt, Human
cuuuuuggugacuaacccuucaauucuuucaacuccuguuaauacccauaaucaguaaccuauc

SEQ ID NO: 8975 - RNA, 64 nt, Human
uggaugacacccgccucacuguggcaguguauugccuguuaauugcugcuaauucuaauucuga

SEQ ID NO: 8976 - RNA, 64 nt, Human
ccaucaucgacacuggucuagccucagaguaaccccuguuaacaaacuaaaauguacacuucaa

SEQ ID NO: 8977 - RNA, 64 nt, Human
accccugauaagcaaauuaguaauugucaauaccccuguuaagcaauuccuuuuugcaguauau

SEQ ID NO: 8978 - RNA, 64 nt, Human
ggcauagaucuaucuuuacagucuggaguuaauuccuguuaacucauuuuauccauuccuuaca

SEQ ID NO: 8979 - RNA, 64 nt, Human
cucuggcuugagaacuuacuaaaggcacuuccuuccuguuaaaccccuguuaacucuccauaaa

SEQ ID NO: 8980 - RNA, 64 nt, Human
gaacuuacuaaaggcacuuccuuccuguuaaaccccuguuaacucuccauaaauuuggugauuc

SEQ ID NO: 8981 - RNA, 64 nt, Human
ggcugcuaguggcugucucacauacaccaguaauccuguuaaagggcugaagaaguaucuuagc

SEQ ID NO: 8982 - RNA, 64 nt, Human
gaaguucugaaguuugauguaaucuguuacuuguccuguuaaaaaaaggaaaaaauucuaauua

SEQ ID NO: 8983 - RNA, 64 nt, Human
ucuauucuaccaucaaagaagcuuuugaguaccaccuguuaaugagcuuuccuauucuaaauug

SEQ ID NO: 8984 - RNA, 64 nt, Human
aaaaacaguauuuuuuuuuccuuugaauacuuggccuguuaagaauuucagcuuucacucuaug

SEQ ID NO: 8985 - RNA, 64 nt, Human
agauaaauuacuauaaagacuccuaauagcuuuuccuguuaaggcagacccaguaugaaauggg

SEQ ID NO: 8986 - RNA, 64 nt, Human
uuaaaugaauaccaauuuaauuuuuuaguauuuaccuguuaagagauuauuuagucuuuaaauu

SEQ ID NO: 8987 - RNA, 64 nt, Human
ugccaccgcaggauccuuugcucugcacgaguuaccuguuaaacuuuggaacaccuaccaaaaa

SEQ ID NO: 8988 - RNA, 64 nt, Human
gugcccauuaacaguguuuacacuguucaucgugccuguuaauguaguuuuaguuacuggagcu

SEQ ID NO: 8989 - RNA, 64 nt, Human
aauaagugugaaugcagaagcaaauauugucugcccuguuaaacuuggugcccauuaacagugu

SEQ ID NO: 8990 - RNA, 64 nt, Human
guugcccucugcaguugaucuccaaaguuuuaaaccuguuaaauuaauuuugacaaauaaguua

SEQ ID NO: 8991 - RNA, 64 nt, Human
cucugcugaauuuuuaaauguucacucuggcuuaccuguuaauggaagaauuugcauaauaucu

SEQ ID NO: 8992 - RNA, 64 nt, Human
aauuaguggcacuuuauucauaaauauucaugagccuguuaauuguuaguugucuuccuguagc

SEQ ID NO: 8993 - RNA, 64 nt, Human
gguuacguggaauauaucacuuaacucaaaaagcccuguuaagccaggacuguuaucuccauuu

SEQ ID NO: 8994 - RNA, 64 nt, Human
gacaaagaaauauuucaucuggccuuuacugacuccuguuaaaugcaguuuuaaauuuauaucg

SEQ ID NO: 8995 - RNA, 64 nt, Human
uugaucauuuauaugaaugaaacucccuuuuaaaccuguuaacuugaaggagaacagaaauggu

SEQ ID NO: 8996 - RNA, 64 nt, Human
aaauggaagcuuucaacagagcauuccauuuuguccuguuaaaaccuuuuguuuucaccuaaac

SEQ ID NO: 8997 - RNA, 64 nt, Human
cagugaagguagguuucagguuugguuuuacaaaccuguuaacuaccuccuguccagcuugaca

SEQ ID NO: 8998 - RNA, 64 nt, Human
guuaaauggagacacauaagccacacuccgccuuccuguuaaaaagggcugccuuccuucaaau

SEQ ID NO: 8999 - RNA, 64 nt, Human
uuuaagcauuuguaaaguuacagcaaaagauguaccuguuaauacacagaauguguacagauua

SEQ ID NO: 9000 - RNA, 64 nt, Human
caugccauagguguucuggucuggaugaugggugccuguuaaaucagguugugcugccagugag

SEQ ID NO: 9001 - RNA, 64 nt, Human
uuucuaagggggggggggaagaaauuaaaaaacaccuguuaauuuuaaacacauuuuuuaagaa

SEQ ID NO: 9002 - RNA, 64 nt, Human
guuggugaaguguaauauaauuguguaaacaaauccuguuaauagagagauguacagaaucguu

SEQ ID NO: 9003 - RNA, 64 nt, Human
agauuuuuagggacuauuuuucaguaucucuguaccuguuaaagggggugcuuuucgaucuaaa

SEQ ID NO: 9004 - RNA, 64 nt, Human
agggccgagaggacagaauggauauaaucugaauccuguuaaauuuucucuaaacuguuucuua

SEQ ID NO: 9005 - RNA, 64 nt, Human
uguugaaauuucuaacauuaaaucuagucucuauccuguuaauuuaauuuuuaaaugcuuuauc

SEQ ID NO: 9006 - RNA, 64 nt, Human
ugccuaccuguaaaaccuaagaaucaacugaagaccuguuaagaguauucuguaagucaaccca

SEQ ID NO: 9007 - RNA, 64 nt, Human
uguuccgaaucauguuuuugaaaaaucaagaccuccuguuaagggcccacuugacccuagaaua

SEQ ID NO: 9008 - RNA, 64 nt, Human
ccgcacaaguuuauaugauggucguauauauaucccuguuaaaaacugggaugaagaugugcaa

SEQ ID NO: 9009 - RNA, 64 nt, Human
gcugcaugaguggacgucagaagaaucucuaugcccuguuaaauggggagacaaagggguggug

SEQ ID NO: 9010 - RNA, 64 nt, Human
cuuguagguauuacaucccuggugucguauuuugccuguuaaaucguaacaagcaauaaacaac

SEQ ID NO: 9011 - RNA, 64 nt, Human
ccccaaguaauaacugaaggagcuaacuacccaaccuguuaauaacaggcaguaugccuaaaua

SEQ ID NO: 9012 - RNA, 64 nt, Human
gagaacacauuuagucaguuuggguuuuaucaauccuguuaaugcuuguccuuggaacaucuuu

SEQ ID NO: 9013 - RNA, 64 nt, Human
acucggcauccuccauuccccaaacucccuccucccuguuaaaugucaaccuagaccuggaccu

SEQ ID NO: 9014 - RNA, 64 nt, Human
gcacaaguguuuuggguuguggacugaagcucagccuguuaaucagaccagcccaugaguguau

SEQ ID NO: 9015 - RNA, 64 nt, Human
cguuucauuuauuuuuuaaguguacaaaaaauaaccuguuaauuguugaaggcuacuuuucugu

SEQ ID NO: 9016 - RNA, 64 nt, Human
cuguuuguugaaguagaaccagaaauccugaccuccuguuaaaugacaucaguuucccccucug

SEQ ID NO: 9017 - RNA, 64 nt, Human
cuguucucacaguagugagcaaugauugcgcagcccuguuaacaguuuuuuuagggaucuuuca

SEQ ID NO: 9018 - RNA, 64 nt, Human
ugaagucuauuaggagccacuugugacuccaugaccuguuaaaaccagcaaugugaguauuauu

SEQ ID NO: 9019 - RNA, 64 nt, Human
ccauaggaucaguguguaccagguacacauuguuccuguuaacagcagcuucuugaaacauuug

SEQ ID NO: 9020 - RNA, 64 nt, Human
gcucucagcugauggcuguauucugacuuugaagccuguuaagagguagcaagggggcuagagg

SEQ ID NO: 9021 - RNA, 64 nt, Human
ccacaccacugccccaaggaccuuacaggcccucccuguuaauaaacagcucuaacacggccag

SEQ ID NO: 9022 - RNA, 64 nt, Human
ggaagcuggaucugucagccucggcccugaggccccuguuaacucaagacugugagcugccucu

SEQ ID NO: 9023 - RNA, 64 nt, Human
ugccccuucccgggacugugggggcuucugugugccuguuaaugcaguccuguuccucagccca

SEQ ID NO: 9024 - RNA, 64 nt, Human
uauuuuuggucacuugcuuuaugacguuuauuuuccuguuaaagcugaauaaauaaaaacuaca

SEQ ID NO: 9025 - RNA, 64 nt, Human
cuccaucaagaggaauugugucuaagaggauaccccuguuaaucuccuuuuuucuuggauugga

SEQ ID NO: 9026 - RNA, 64 nt, Human
auaaguuucaccacauaaugugugagcauuuuuuccuguuaacuuuauauuacaaaauccguuc

SEQ ID NO: 9027 - RNA, 64 nt, Human
cagauguuuuaagugcaauuaacacugaaagagaccuguuaaaccauucagaaaaagcuuaaga

SEQ ID NO: 9028 - RNA, 64 nt, Human
uuagccuguucuauucagcggcaaccccaaagcaccuguuaagacuccugacccccaaguggca

SEQ ID NO: 9029 - RNA, 64 nt, Human
auuucaacagauugugugguuugugcauuuauauccuguuaagcauuaauagcuaaucacuggg

SEQ ID NO: 9030 - RNA, 64 nt, Human
ugaauugcacauccaucuccaucagagcugauagccuguuaauaagcacuggucuaacacagcc

SEQ ID NO: 9031 - RNA, 64 nt, Human
cuaguggaugacuguugaugaaguauacuuuuccccuguuaaacaguaguuguauucuucugua

SEQ ID NO: 9032 - RNA, 64 nt, Human
auucugagaaaggaaaggccuuguuggcaguacuccuguuaagccauuagucucuaaauuccag

SEQ ID NO: 9033 - RNA, 64 nt, Human
gucaucuauuauuuuaacaggaguuaaaauaacuccuguuaaacuuucugacaauaucauaaga

SEQ ID NO: 9034 - RNA, 64 nt, Human
gauacccaaugugcaaagugaaaacacugggcucccuguuaaacgaugaagaauucaagacagu

SEQ ID NO: 9035 - RNA, 64 nt, Human
cucauccugucucuuuuucccuuguuucucuguuccuguuaauguguuucuccccaugguccua

SEQ ID NO: 9036 - RNA, 64 nt, Human
gcauuuuuuagcuuccaccacuuaccaggaacugccuguuaacuggcuugugcaaugauaaagg

SEQ ID NO: 9037 - RNA, 64 nt, Human
gugguuguggaggacauuucugugagaagucaaaccuguuaaacaccauugaaaucauguuggg

SEQ ID NO: 9038 - RNA, 64 nt, Human
ugccagagcuacacucgccuucugcuuccacgguccuguuaauucuagaucagagagcaagaaa

SEQ ID NO: 9039 - RNA, 64 nt, Human
acaaguaaauuugaguguauaauuuaauuuuuaaccuguuaaauaaaccuugucccuccaagga

SEQ ID NO: 9040 - RNA, 64 nt, Human
gaaucguugccaaguuucugagaagugucgauucccuguuaacauggauaucaguucugccuca

SEQ ID NO: 9041 - RNA, 64 nt, Human
uuuuucuuuguaagcauuguaaaugcuaauaaauccuguuaauuuuuuuuuuuuuuuuuuuuuu

SEQ ID NO: 9042 - RNA, 64 nt, Human
aaaaaggccuuguuuuucagaaauuccuggguuuccuguuaaaaaaucuuaaagcccaaccuua

SEQ ID NO: 9043 - RNA, 64 nt, Human
gucuaacaaaaaauacagcugcaacauuuugauuccuguuaauuuuguucuuuaauuaaaugac

SEQ ID NO: 9044 - RNA, 64 nt, Human
guuguaaguuuccugaggccucccagucaugcuuccuguuaagccuguggaacugugaguccaa

SEQ ID NO: 9045 - RNA, 64 nt, Human
gacaucaggaauguuugugugcauggucugccucccuguuaauaugugagcaucaugggggucc

SEQ ID NO: 9046 - RNA, 64 nt, Human
ucuacugagcagauuucugcauugguuuuccaguccuguuaaaaguuuagaaacuucauaugug

SEQ ID NO: 9047 - RNA, 64 nt, Human
auguugugugaugaucagcacuaaguccugcauuccuguuaaagccacuugggucauaagaagg

SEQ ID NO: 9048 - RNA, 64 nt, Human
uuauauaacaaauuuacauucacaaauucaguauccuguuaagugucauauucuuguaaucugc

SEQ ID NO: 9049 - RNA, 64 nt, Human
gauagagugcaacaagucauuguagaacuuuucaccuguuaauguugaaguuauaccucugaau

SEQ ID NO: 9050 - RNA, 64 nt, Human
aagagaugaauaccuuaucagcuguugcuugaaaccuguuaaaaauguucauaacauuggauag

SEQ ID NO: 9051 - RNA, 64 nt, Human
gggugaugcugucugcugggugugggucccuuucccuguuaagcagacaggaugcagcgcugac

SEQ ID NO: 9052 - RNA, 64 nt, Human
aaaucuucaaaauauuuaaaacaaauuuaaagggccuguuaauucuuauauuuuucuuuacuaa

SEQ ID NO: 9053 - RNA, 64 nt, Human
caaaaggauaaaugucuuuccaaaaguguguauuccuguuaaauuaagcucuugcuaacuugaa

SEQ ID NO: 9054 - RNA, 64 nt, Human
gaacaaguagaaaauuauuuuuuaagccucaagcccuguuaaauggucguggccaauuauguca

SEQ ID NO: 9055 - RNA, 64 nt, Human
uuauguuuuaucucugucaguuaucaacauuguuccuguuaagugaagguuuauuuugcuucag

SEQ ID NO: 9056 - RNA, 64 nt, Human
cuuaggcagauucuuuacuuuguaauucaaaaggccuguuaaccuuuguucuuguuaugcauga

SEQ ID NO: 9057 - RNA, 64 nt, Human
cuagagagaucaucauauauaucuccuuuguguuccuguuaaacauuaguaucuuucaaguguu

SEQ ID NO: 9058 - RNA, 64 nt, Human
caugacauauacuugauuaaaagguuauuacuaaccuguuaaaaaucagcagcucuuugcuuuu

SEQ ID NO: 9059 - RNA, 64 nt, Human
ugaaagucaguuuaagaggcugauagaucuuggcccuguuaaggcauccacuucacaguucuga

SEQ ID NO: 9060 - RNA, 64 nt, Human
ccgucccccagaaggcucgccucuccccguggacccuguuaaucccaauaaaauucugagcaag

SEQ ID NO: 9061 - RNA, 64 nt, Human
uugugcauucuagagugcauauauuuauauuuugccuguuaaaaagaaagugagcaguguuagc

SEQ ID NO: 9062 - RNA, 64 nt, Human
uuaccuaaaccuuuaucgccaaugcacagcuuggccuguuaaguuaaaugugggugucaaccag

SEQ ID NO: 9063 - RNA, 64 nt, Human
auuaugcuauaguuaaauggcuuaaaauauuuaaccuguuaacuuuuuuccacaaacucauuau

SEQ ID NO: 9064 - RNA, 64 nt, Human
uggaucuauuuggccucucaaaugaacugagauuccuguuaaaaaagauugauguuauugucuc

SEQ ID NO: 9065 - RNA, 64 nt, Human
uccuuggcuggagugucuagaggcuccagacucuccuguuaacccuccaucuagauggggggcu

SEQ ID NO: 9066 - RNA, 64 nt, Human
uuccaagaaguaugcuaaagcuuuucauuugguuccuguuaaaguuguucucacugaccagcau

SEQ ID NO: 9067 - RNA, 64 nt, Human
caaagcaagggaagacuucucauugucaguuaaaccuguuaaaacaugaaaauauucauugagc

SEQ ID NO: 9068 - RNA, 64 nt, Human
ucuucauaauacagcacagcgguuaagcccacccccuguuaacugccuauuuauaacccuagga

SEQ ID NO: 9069 - RNA, 64 nt, Human
uuaacgaaugguacgucugaggacaaacacaaacccuguuaauuauagaauggaccaaauacau

SEQ ID NO: 9070 - RNA, 64 nt, Human
ggcuugugacauuugaauaaggaaaaacagaguuccuguuaagugaauaacuuuagcuuuuaca

SEQ ID NO: 9071 - RNA, 64 nt, Human
uguucaugcuguaugugcccgugccuguagcuucccuguuaaucagcuucuuacacuacuauau

SEQ ID NO: 9072 - RNA, 64 nt, Human
cagagcaguuggguuuuaccccuuaguuuuuaugccuguuaagcuuuacugugcuuuugacagg

SEQ ID NO: 9073 - RNA, 64 nt, Human
ccucuccaggaaggaaacugcaccagugucuauuccuguuaaauagcaacuuuuagucucagcu

SEQ ID NO: 9074 - RNA, 64 nt, Human
uaaaaggaaaaauuguguuacuuuuuuuaaauucccuguuaaguuccccuccauaauuuuuaug

SEQ ID NO: 9075 - RNA, 64 nt, Human
acagucuugugacaucuuaaggaaaagaagaguuccuguuaaaugaauagcuuuagcuuuuaca

SEQ ID NO: 9076 - RNA, 64 nt, Human
aaaugccuuaaacugcaacgucccgucccuuccccacccccaucccauccccacccccagcccc

SEQ ID NO: 9077 - RNA, 64 nt, Human
acgucccgucccuuccccacccccaucccauccccacccccagccccagcccaguccuccuagg

SEQ ID NO: 9078 - RNA, 64 nt, Human
uucacggaaggaagaucacauguccccagagaggcacccccaggcaagcucgagggggccacac

SEQ ID NO: 9079 - RNA, 64 nt, Human
ccuaccaagcucgagcuggcccuugacccccacccacccccacccuugcuggcaggggcaggga

SEQ ID NO: 9080 - RNA, 64 nt, Human
uuugggguuuucugugcccaugacuugggggcugcacccccacagcacccccacaauguaggaa

SEQ ID NO: 9081 - RNA, 64 nt, Human
cugugcccaugacuugggggcugcacccccacagcacccccacaauguaggaaaagaccucagg

SEQ ID NO: 9082 - RNA, 64 nt, Human
uugcagaccacgcggggcagggcuccacugaagccacccccaccccucgccagcuagcuccaua

SEQ ID NO: 9083 - RNA, 64 nt, Human
ugccucauggaagccuuugaggguaucacacagacacccccaccuuccuccagccugugcgcac

SEQ ID NO: 9084 - RNA, 64 nt, Human
ccuguugugcccuuuaagagacauguuuccaccccacccccaaccuugucccaagugcccugga

SEQ ID NO: 9085 - RNA, 64 nt, Human
aggagaggggcuugggagcccacuuuuaauuucucacccccauuuuacaaagagugcuuagauu

SEQ ID NO: 9086 - RNA, 64 nt, Human
uccucugcagcuuccuccucagccucccuccuugcacccccacagguuuggcuugugguuuuug

SEQ ID NO: 9087 - RNA, 64 nt, Human
gaaggcucugggggucggagacaccgcugcuuagcacccccagccagaacacccugagggucuc

SEQ ID NO: 9088 - RNA, 64 nt, Human
cggcccagccuguccaggauacaguggggcugagcacccccaggccuuccacuccucuacccuc

SEQ ID NO: 9089 - RNA, 64 nt, Human
ucugggcaccagaaggcuccuggaccaugagcuucacccccagaauucccugcugacccugccc

SEQ ID NO: 9090 - RNA, 64 nt, Human
ggggucaaggaacauuucauugguuuuuuuuguccacccccaucucccuugcucauuuggaugc

SEQ ID NO: 9091 - RNA, 64 nt, Human
gauuucaaaacacaaaugaaaacucacacccacccacccccaagugcaugucuccaucacuuaa

SEQ ID NO: 9092 - RNA, 64 nt, Human
cccaaaggggacccaaggcugugacacuuaccuccacccccauccagcacccuucagcugugug

SEQ ID NO: 9093 - RNA, 64 nt, Human
gauggacuucuccuccagggagcccacccugacccacccccacugcacccccuccccauggguu

SEQ ID NO: 9094 - RNA, 64 nt, Human
cuggacugagguucaggucuccccccagcugucucacccccacuuuguccccacucuagagcag

SEQ ID NO: 9095 - RNA, 64 nt, Human
aaaacuugucuucuacccugcccucuuuucuguucacccccaaaagaaaacuuacacacccaca

SEQ ID NO: 9096 - RNA, 64 nt, Human
ccacacaguacugauugcucacugaaagacucagcacccccaauggugcgcggaagccaggcgg

SEQ ID NO: 9097 - RNA, 64 nt, Human
uauccaggccauaccaggguaucccuugucccuucacccccauuucugaccucaguuccuggag

SEQ ID NO: 9098 - RNA, 64 nt, Human
aucacacugcaugggagauuuuguuaacgucugccacccccacucucacccccaagcucuaagc

SEQ ID NO: 9099 - RNA, 64 nt, Human
gggagauuuuguuaacgucugccacccccacucucacccccaagcucuaagcccccgggaggcc

SEQ ID NO: 9100 - RNA, 64 nt, Human
cucccgcguggaguucuccucaggucgugcgaaacacccccagauucuucgcacagugucuaga

SEQ ID NO: 9101 - RNA, 64 nt, Human
agccagugucuccugggugccuucugaggacucccacccccaucccaguaucucaucugucccc

SEQ ID NO: 9102 - RNA, 64 nt, Human
gggugggaaggucucuuuaaaauggggcaggccacacccccauuccgugccucaauuuccccau

SEQ ID NO: 9103 - RNA, 64 nt, Human
agaccagcuguggagcugaaggcacagucugccccacccccaccuccccacugugguuagucag

SEQ ID NO: 9104 - RNA, 64 nt, Human
cuuuggcuucauggguuuuucugcuuccugcccccacccccacaugugcaauccucaagauuug

SEQ ID NO: 9105 - RNA, 61 nt, Human
cuccaggucccaagcgauaacacugucuaagcacccccaagccacuauccacuuugaaucc

SEQ ID NO: 9106 - RNA, 64 nt, Human
gcauuguguggccacacuugggguuugccucaugcacccccaaguccugguccucucagcccug

SEQ ID NO: 9107 - RNA, 64 nt, Human
ggagcuuacccaagcuguggcagccgucccaggccacccccauggaagcaauaaagcucuuccc

SEQ ID NO: 9108 - RNA, 64 nt, Human
cugcucugguccccucucuucguccugaucccuccacccccauguggcagcccauggguaugac

SEQ ID NO: 9109 - RNA, 64 nt, Human
acaacuacccuccaaaccaccacagucucugucacacccccacuaccgcugccacgcccucuga

SEQ ID NO: 9110 - RNA, 64 nt, Human
uguuaauagugauuuagucuccccgccucauucccacccccaacaaagcacuaucauuuucauu

SEQ ID NO: 9111 - RNA, 64 nt, Human
uuugcuacuaacauaggaaacacacacauacagacacccccacucagacaguguacaaacuaag

SEQ ID NO: 9112 - RNA, 64 nt, Human
aggaccagguccccaagucccuucacaggguccccacccccacuggcuuuggugcuguccacac

SEQ ID NO: 9113 - RNA, 64 nt, Human
uaccaggcggaggggcugcuuuucugcccuuccucacccccacgccccaccccacucccccaga

SEQ ID NO: 9114 - RNA, 64 nt, Human
uuagcccauaccccaaauaacugucuauauuagacacccccagccaguuucuggcugccugucu

SEQ ID NO: 9115 - RNA, 64 nt, Human
caccuagccuuuccuuauccccuucccuucccuucacccccauccucuuacuccuuucaugucc

SEQ ID NO: 9116 - RNA, 64 nt, Human
caauuccagguuaacuuuguuggagaauuucccccacccccauccagugggucacccaggagua

SEQ ID NO: 9117 - RNA, 64 nt, Human
uuaucccucuccauaaccccacccuugcccaccccacccccacccccaccaagggcgcaagagu

SEQ ID NO: 9118 - RNA, 64 nt, Human
cucuccauaaccccacccuugcccaccccacccccacccccaccaagggcgcaagaguagcggu

SEQ ID NO: 9119 - RNA, 64 nt, Human
agagaaaggaaugugggggguuuccgcugccccccacccccagcggcccaccccaugccucagc

SEQ ID NO: 9120 - RNA, 64 nt, Human
ugcccccagagagagcaaaucgaagcgugggaggcacccccauugcucuccuccaggggcagaa

SEQ ID NO: 9121 - RNA, 64 nt, Human
ccccguucucuccauugcuuguuagccaggcccccacccccacugagucugcccuaugaccugc

SEQ ID NO: 9122 - RNA, 64 nt, Human
uuuuccuuccugcccuguaccucucucugcuccucacccccaccccuguacccagccaccuucc

SEQ ID NO: 9123 - RNA, 64 nt, Human
gacuugacuucugugaguuuagaccugccccucccacccccacccugccacuaugagcuagugc

SEQ ID NO: 9124 - RNA, 64 nt, Human
cagaggcuuguuugcuuugcccucuuuuccuggucacccccacucccuaccccugacucauaua

SEQ ID NO: 9125 - RNA, 64 nt, Human
uacuccaggcuucuucagauagguucagcccacccacccccaugauuguaugaaguuuuaaaaa

SEQ ID NO: 9126 - RNA, 64 nt, Human
auggauguucuagaaaugaguaagacacagugcccacccccaaguuaggaugaaaaaaguucca

SEQ ID NO: 9127 - RNA, 64 nt, Human
gaaaaagaaagcaaugauaauagcgguggauacccacccccacaaaugcacccaagagacaagc

SEQ ID NO: 9128 - RNA, 64 nt, Human
uaggagggucucaaacuccugaccucaggcgauccacccccaccucggcuucccaaagugcuga

SEQ ID NO: 9129 - RNA, 64 nt, Human
cccucccuuacucuccccccccaccaccacccuccacccccaacucaugaaaagauucuaugga

SEQ ID NO: 9130 - RNA, 64 nt, Human
uuggagggaaguuuauaauagccuaacacuaccccacccccaacuaggaggaaccucuguuuuc

SEQ ID NO: 9131 - RNA, 64 nt, Human
ggaaguaaugggguguggggugccaccagaccaacacccccagacuuccccaccuucagccacc

SEQ ID NO: 9132 - RNA, 64 nt, Human
uuccugccagcacauguuucugggucuuggaggucacccccaccccgcggaucacagcucaccc

SEQ ID NO: 9133 - RNA, 64 nt, Human
agguuggcgacugucuacacuccucccccgagaccacccccacccuggggaagcguugacuacu

SEQ ID NO: 9134 - RNA, 64 nt, Human
gaccugggaucagggaagcugcuggcaucguccccacccccagccugggggucugggcuggggc

SEQ ID NO: 9135 - RNA, 64 nt, Human
aggcgguccccauccccaccagcucguuuuucagcacccccacccaccuccacccagccccugg

SEQ ID NO: 9136 - RNA, 64 nt, Human
ccaccagcugggcgacgucacccugcucccaccccacccccaaguucuaaggucucuucagagc

SEQ ID NO: 9137 - RNA, 64 nt, Human
ggugggcugaggucagagguugguggggugucaucacccccauugucccuagggugacaggcca

SEQ ID NO: 9138 - RNA, 64 nt, Human
acacagauuugagucagaacuggaaagugucccccacccccaccacccucgagcgggguucccc

SEQ ID NO: 9139 - RNA, 64 nt, Human
ugcagccacauccuuguacagaggcauagguuaccacccccaccccggcccgggauacugcccc

SEQ ID NO: 9140 - RNA, 64 nt, Human
guccuaggguugccugagagccaaccucuccugccacccccacaccaagaacuauaugguuccu

SEQ ID NO: 9141 - RNA, 64 nt, Human
ggcaccuuucugagcuuauucuauuccccacccacacccccaggcaggguuggaaaugaaggac

SEQ ID NO: 9142 - RNA, 64 nt, Human
aaggaauccacagcccacacgugagcucccuccucacccccaggcagggaagccccuccugcca

SEQ ID NO: 9143 - RNA, 64 nt, Human
cccaaggaugcgccucucuggaguucacgugcugcacccccagggaggggccuggggaaagcug

SEQ ID NO: 9144 - RNA, 64 nt, Human
ggaucuggcugagggcucaggacacaggcccagccacccccaggggccuccacaggccgcugca

SEQ ID NO: 9145 - RNA, 64 nt, Human
caucaccuccagccugacucccugucugcccuuucacccccaagauuuugcacagguuaaggcc

SEQ ID NO: 9146 - RNA, 64 nt, Human
cuuuucucacugcuuugacucugccggacuuugucacccccacgaccugguguugggucugaac

SEQ ID NO: 9147 - RNA, 64 nt, Human
aaaauuugauucuaaguugaauugcuucauucaacacccccacccucccuccccucgagguggu

SEQ ID NO: 9148 - RNA, 64 nt, Human
agaagccuaaauucagcaucuccccuuccacccucacccccaggucccagccucccacucagca

SEQ ID NO: 9149 - RNA, 64 nt, Human
gaugagaaguacaggcaagugguuugucuuuauccacccccacuguuguggucagccccagaga

SEQ ID NO: 9150 - RNA, 64 nt, Human
gucauuaaacaugacauuagcauugugguuuuagcacccccauggguuuugcuuaggcacucau

SEQ ID NO: 9151 - RNA, 64 nt, Human
agcuccuuggggcaaagguacuaaucccuuucagcacccccacuccauuccccuuuuuaaugua

SEQ ID NO: 9152 - RNA, 64 nt, Human
gaacacaggcucucacaagaucagaacccccacucacccccaagaucuuaucuagcaagccugu

SEQ ID NO: 9153 - RNA, 64 nt, Human
cccucacacuaaaacggcguagauggcaaccccccacccccaccccgcugcucaacucuugugu

SEQ ID NO: 9154 - RNA, 64 nt, Human
gaagggaggggcaggaugggccauggaggugccccacccccacaccugacaaucacccacacuc

SEQ ID NO: 9155 - RNA, 64 nt, Human
cgugccacaccugcgcugauucuugugugugcugcacccccaaggugugugggugcuggcugag

SEQ ID NO: 9156 - RNA, 64 nt, Human
ggugccgagcccugcauguggagcccucccaccccacccccagauagagggaaauaaccaaaaa

SEQ ID NO: 9157 - RNA, 64 nt, Human
gcugugguugcuguucugaguacugcucucaucacacccccacagagggggucuuaccacacaa

SEQ ID NO: 9158 - RNA, 64 nt, Human
aaauuauaugaguguaugaauuugucacauguaucacccccaaaaaaagagaaaaagaaaaaua

SEQ ID NO: 9159 - RNA, 64 nt, Human
uuuuuuaaaaguuuaugacaguuggcuccccccccacccccagcaaccccaucccagaauccua

SEQ ID NO: 9160 - RNA, 64 nt, Human
acacacaauguggacgugcacugacagccuugcccacccccaccaugcagccccugggcccuug

SEQ ID NO: 9161 - RNA, 64 nt, Human
ggagauuuuagcucaucuugggggccuccuuaaacacccccauuucuugcggaagaugcucccc

SEQ ID NO: 9162 - RNA, 64 nt, Human
gagggcugugcugcuaguggguaccucagucacacacccccaaccccaggcagccucuagagcc

SEQ ID NO: 9163 - RNA, 64 nt, Human
agacuuagcugucagugugacuuccuuucccacccacccccagaaaaacagaaagagcaucugg

SEQ ID NO: 9164 - RNA, 64 nt, Human
cuacccuccuuccccacaagcccccuccaacccccacccccaugcucuggaccucauggcuccu

SEQ ID NO: 9165 - RNA, 64 nt, Human
acucccacaaccggccaaguuaugucuuauuauacacccccagaaagagagaaagcugccuucu

SEQ ID NO: 9166 - RNA, 64 nt, Human
ugccucccucacccugagccccuuccuugcucugcacccccauauggucauagcccagaucagc

SEQ ID NO: 9167 - RNA, 64 nt, Human
gcagauaacaaccccggacaaaucagcgaugugucacccccagucucccaccuuuucuucuaau

SEQ ID NO: 9168 - RNA, 64 nt, Human
accccgcacaacaucccucaccacucucccccagcacccccaucuccgacugugccugcuugca

SEQ ID NO: 9169 - RNA, 64 nt, Human
aaugcuggaccagggggauuacuucccccacccacacccccauuuggacaucuggggaagugga

SEQ ID NO: 9170 - RNA, 64 nt, Human
uugcuuccccagccagccucuccucacugugacccacccccaugggcccccgucccaggcagcc

SEQ ID NO: 9171 - RNA, 64 nt, Human
cacguccaaaggagugcauggccacagccaccuccacccccaagaaaccuccauccugccagga

SEQ ID NO: 9172 - RNA, 64 nt, Human
caaagagauggugcuaaaccauucaugaugaacucacccccaugauccaaucaccucccaccag

SEQ ID NO: 9173 - RNA, 64 nt, Human
ccugaagcuuuccuaauauugcugugcuccccaccacccccauggcagucccuccgcagcccca

SEQ ID NO: 9174 - RNA, 64 nt, Human
ugcugugguggguucgauuuaucccugcccaccccacccccacaacuucccuuuugcuacuucc

SEQ ID NO: 9175 - RNA, 64 nt, Human
cccugcugaacagauacacagaguucucagaccccacccccacccucaggugggcuggcuggcu

SEQ ID NO: 9176 - RNA, 64 nt, Human
cauguuucugaaaagugcuguaguuuaguccccucacccccagcacugcccaaacaggggccaa

SEQ ID NO: 9177 - RNA, 64 nt, Human
guauccagacagccaccaggauggucccucgccccacccccaccgccucuccccaccuuuucca

SEQ ID NO: 9178 - RNA, 64 nt, Human
ucucuuggacucaccaggcuccuauugaaggaaccacccccauuccuaaauaugugaaaagucg

SEQ ID NO: 9179 - RNA, 64 nt, Human
cucugcauuuuguccuggagugccagcgagugugcacccccaguuuccuucccuggaccccugc

SEQ ID NO: 9180 - RNA, 64 nt, Human
ccucaggucccagaggguggaaggagccaggacgcacccccacugcugcugcaggagccgcugc

SEQ ID NO: 9181 - RNA, 64 nt, Human
gucagagacccccgggauggggccucacacuugccacccccagaaccagcucaccuggccagag

SEQ ID NO: 9182 - RNA, 64 nt, Human
gucggcacugaccggcccaccugguagcagaggacacccccagccccccaagcauugaagacau

SEQ ID NO: 9183 - RNA, 64 nt, Human
gaagggacugggcccugcagggucagaaccuccccacccccaggggaggccaggcagaagccug

SEQ ID NO: 9184 - RNA, 64 nt, Human
uugcccccauucuacuacccaccacugcccaccccacccccacaucacacacucuucgaugcuu

SEQ ID NO: 9185 - RNA, 64 nt, Human
acauggagggcuuucuaaaacagacugcucagcccacccccaggguuucugaguucauagguua

SEQ ID NO: 9186 - RNA, 64 nt, Human
ugcccccaagcaccuccagcggugaugagcuccacacccccacacccauugcagcuguggcgcc

SEQ ID NO: 9187 - RNA, 64 nt, Human
cagccucaucucuuuguucuaaagauggaaaaaccacccccaaauuuucuuuuuauacuauuaa

SEQ ID NO: 9188 - RNA, 64 nt, Human
cuguccaguggucagguuuccccugaccuucccucacccccagaaacacuugcuuacagaccga

SEQ ID NO: 9189 - RNA, 64 nt, Human
cauccucccugguggcccugggcaggugcacugacacccccaccuucccauccccugcugaacc

SEQ ID NO: 9190 - RNA, 64 nt, Human
cagucuuuccauuuuccuugcuucucuuauugcacacccccagcccauuuugcuucucucuugg

SEQ ID NO: 9191 - RNA, 64 nt, Human
cacagaauuacagucaacguugguacauuuucaucacccccaguaaaaccccguacccuugguc

SEQ ID NO: 9192 - RNA, 64 nt, Human
uauguuggcacuguguucacacgcaugguccccacacccccagguuggguggguuuuuuuguuu

SEQ ID NO: 9193 - RNA, 64 nt, Human
uauguacuugaaggaaggagguggagugaaaguucacccccaugucuguguaaccggagucaag

SEQ ID NO: 9194 - RNA, 64 nt, Human
ugagggcccggagcaggguggggaggugcaguggcacccccagagccaacagagggagcaggca

SEQ ID NO: 9195 - RNA, 64 nt, Human
ugcguccccccccaaccuuucccucacccccucccacccccagccccgacuccagccagcgccu

SEQ ID NO: 9196 - RNA, 64 nt, Human
aagggaacuggagaacucagccuucaucuucccccacccccauuugcugguucagcuaugauuc

SEQ ID NO: 9197 - RNA, 64 nt, Human
gucugauuuaccggccuacucucgaccugccccccacccccagcucaggggaccuuuugucuga

SEQ ID NO: 9198 - RNA, 64 nt, Human
ggacggggugcuauuccaucgcagggugcucacacacccccacacccacccacccacacacaac

SEQ ID NO: 9199 - RNA, 64 nt, Human
aagcaaaccuuuaacuaauuauguaucugaaagucacccccacauaccaacucaacuuuuuucc

SEQ ID NO: 9200 - RNA, 64 nt, Human
gauuuugugguuccggggaguaugugaugauaaucacccccagcagauuccauuaccucagcag

SEQ ID NO: 9201 - RNA, 64 nt, Human
agguacuauaccuuucaaauccccagggcagacacacccccacccagccccuauuuggaccuaa

SEQ ID NO: 9202 - RNA, 64 nt, Human
aacagugggcugcuagaagcacgauccgccaaugcacccccaaccuccaucgccuugcagguuu

SEQ ID NO: 9203 - RNA, 64 nt, Human
caaggucauuuguauucagaguaaaucagugguccacccccauaaaacuguaagacaagccucc

SEQ ID NO: 9204 - RNA, 64 nt, Human
ucaucuuggaggguuuggggagaaguuggcgugccacccccacaaccccugaggagguguagac

SEQ ID NO: 9205 - RNA, 64 nt, Human
ucucugcacgucccaccccauuuugcugugugcucacccccaggauguguacccgguuguagua

SEQ ID NO: 9206 - RNA, 64 nt, Human
ccugcccuguugucccgucugcucuccucuuacccacccccaugcuguaaauacuugucaucau

SEQ ID NO: 9207 - RNA, 64 nt, Human
agggagccagagaggcuugcacucaggagagaaccacccccaagucuccguucuacugccguga

SEQ ID NO: 9208 - RNA, 64 nt, Human
aguuugguauuagaaguaggaggcuggacgacuucacccccaaaggguccugaagccccagaac

SEQ ID NO: 9209 - RNA, 64 nt, Human
ucacuagcacugcuuuaccgcuccucaucgccaacacccccaugcucuguggccuucuuacacu

SEQ ID NO: 9210 - RNA, 64 nt, Human
gcuagcauuccucaggaaggacaugggugccccccacccccaguucagucuguagggagugaag

SEQ ID NO: 9211 - RNA, 64 nt, Human
guucggccuucuucuuccccaaaaucuuuauccccacccccaccucuaucuuucucucucucuc

SEQ ID NO: 9212 - RNA, 64 nt, Human
ccuaaugcaacuggcuaaaggauaguaccacccucacccccaccauaggcaggcuggaucgugg

SEQ ID NO: 9213 - RNA, 64 nt, Human
cagucucucccugcaguccugcagcagcagcccccacccccaagcuuggugcugagcccuggug

SEQ ID NO: 9214 - RNA, 64 nt, Human
ccccaaccuggcaggauucuccauguguaaacuucacccccaggacccaggaucuucuccuuuc

SEQ ID NO: 9215 - RNA, 64 nt, Human
gauguuauuuucugcuguuugaauuuugucuccccacccccaacuuggcuaguaauaaacacuu

SEQ ID NO: 9216 - RNA, 64 nt, Human
ccaaauguauaucauuucacuccccuccccuccccacccccaauagauucaaauaaauaaaauc

SEQ ID NO: 9217 - RNA, 64 nt, Human
caaaggacucgccuugcaaccgacaggccauucccacccccacacacaaccuccccuguuuuca

SEQ ID NO: 9218 - RNA, 64 nt, Human
uucucuuucccucucaacaguggggucgggggcccacccccagcugggggaccccaugcaggcu

SEQ ID NO: 9219 - RNA, 64 nt, Human
cagugccuuugcuccucuguccugccucuacucccacccccacuaccucugggaaccacagcuc

SEQ ID NO: 9220 - RNA, 64 nt, Human
aucucgugacuauacuggcauuucagauccaccccacccccagacucaucccacucucucccag

SEQ ID NO: 9221 - RNA, 64 nt, Human
guucccggaggaugggucucagccgagccucgugcacccccaagauggaacaucccugcugcau

SEQ ID NO: 9222 - RNA, 64 nt, Human
uuuuauucuggaaagacaucuccaaggugagguccacccccacagcagaccucaaguagaaauu

SEQ ID NO: 9223 - RNA, 64 nt, Human
ugagagagagagaaauuauauacuaugaaaagugcacccccacacucugcuagaggaaugaauu

SEQ ID NO: 9224 - RNA, 64 nt, Human
cccuccaucucugaccacccccacccuaaccccccacccccaccauccuauuaaacauuuuuaa

SEQ ID NO: 9225 - RNA, 64 nt, Human
cucauuuucuucccucucucccuccaucucugaccacccccacccuaaccccccacccccacca

SEQ ID NO: 9226 - RNA, 64 nt, Human
gcuuuuucagggaaaaauauuuuacuaguccaaucacccccaggaccucuucagcugcugacaa

SEQ ID NO: 9227 - RNA, 64 nt, Human
aucccccaugccacucagcccugcccuauccccucacccccaucccggcuccaucuguagccgu

SEQ ID NO: 9228 - RNA, 64 nt, Human
gggcaugggcucugguucugccaggagccugugacacccccaggaaggggguggaacugaggaa

SEQ ID NO: 9229 - RNA, 64 nt, Human
uauaaguuaucggacagaaagcuaggugcucugucacccccaggaggcgcugugguacuggggc

SEQ ID NO: 9230 - RNA, 64 nt, Human
gaugggugggacacaugccuuccucccccuauuccacccccaaguugaucugaguaucgucagg

SEQ ID NO: 9231 - RNA, 64 nt, Human
ccccuggccagugagcuggaccucaugcccuacacacccccacaggugaaggugacagguuccu

SEQ ID NO: 9232 - RNA, 64 nt, Human
ggggguaaaugaagucaucccuucucccccaguccacccccaagugcucuuagauacugaagga

SEQ ID NO: 9233 - RNA, 64 nt, Human
cacuauauauuauaguaaaacccucgaaagggaucacccccacacuccuuucccuuccccucuc

SEQ ID NO: 9234 - RNA, 64 nt, Human
uaugauuugaaagcuuuaaaggagauucuucucccacccccaacuuuauuugcaaugggauuuu

SEQ ID NO: 9235 - RNA, 64 nt, Human
gucagucccaggaguccacacugguccauccugccacccccaaccauuugcacuacaagggcgg

SEQ ID NO: 9236 - RNA, 64 nt, Human
ggagcacucggugacccagagcagggacuggaggcacccccagcccugccccaggccacagcag

SEQ ID NO: 9237 - RNA, 64 nt, Human
gccugugugggccaguguccccccaccaugggcacacccccaaguggugcuuguuggaagagug

SEQ ID NO: 9238 - RNA, 64 nt, Human
accccaggggagaggagagcugugagagcaccggcacccccagaagacucugcuucuuagccca

SEQ ID NO: 9239 - RNA, 64 nt, Human
ccucuuugcacagcaugaggcaaaaauguccagccacccccaggcaucuguuagcagagucugu

SEQ ID NO: 9240 - RNA, 64 nt, Human
aaaauucucucuuugagaugggguggacuaagaccacccccaaaguuuaaaaauaugcucauuc

SEQ ID NO: 9241 - RNA, 64 nt, Human
uaauauuguguaaaaagggaaggaaaaaaaaaaccacccccagcuucuuucuuuuucaagccaa

SEQ ID NO: 9242 - RNA, 64 nt, Human
ggcuugggaaaagggccccaguggcuuugggaagcacccccagcccagggugaaacaugcuucu

SEQ ID NO: 9243 - RNA, 64 nt, Human
cucagaacaccccgcucuggcaguaggugucccccacccccaaagaccugccugugugcuccgg

SEQ ID NO: 9244 - RNA, 64 nt, Human
caucugcugcacaguugaacgaugggcaguggcucacccccacuccuuuauuucagcaaaagcu

SEQ ID NO: 9245 - RNA, 64 nt, Human
ccgugcuuggcuugaguaacugucucucuuuccccacccccaucacagggcuuucaguuuggca

SEQ ID NO: 9246 - RNA, 64 nt, Human
cuguuuuguaagaucaaauggggugugucuuccccacccccauuccuucauucuagagcuagag

SEQ ID NO: 9247 - RNA, 64 nt, Human
cuguuucaaaaaguguggccucagcucuggaggccacccccaggaaggaguuugagguucauug

SEQ ID NO: 9248 - RNA, 64 nt, Human
ucucucgcccaacacgaucuuguaagauggauuucacccccaggccaaugcagcuaauuuugau

SEQ ID NO: 9249 - RNA, 63 nt, Human
ugagcucuccuccuguuuaaaaggaagcauccacacccccaacuccuggacaucacaugagag

SEQ ID NO: 9250 - RNA, 64 nt, Human
gugaagaaccaucgaaaccuguuuguucccagcccacccccaguggaugggaugcauaaugcca

SEQ ID NO: 9251 - RNA, 64 nt, Human
cgcaggucaccuuaguucaccuacccugagugaacacccccagcugggugguccaccaaguucu

SEQ ID NO: 9252 - RNA, 64 nt, Human
ccccaaggccgcccuuucccucgcacacaggccccacccccacaguuccacgccccccccccaa

SEQ ID NO: 9253 - RNA, 64 nt, Human
ucuuccaaucaaaugucuaggcuuguuugacuuccacccccaaugguuuuucacucuuuuuauu

SEQ ID NO: 9254 - RNA, 64 nt, Human
guuuuguggcaugggguaguggagcuucccuccccacccccauauguaucagugaagccuuuga

SEQ ID NO: 9255 - RNA, 64 nt, Human
uguggguuugguuaaggaaaugcuuaccaucccccacccccaaccaaguucuuccagacuaaag

SEQ ID NO: 9256 - RNA, 64 nt, Human
aauucuugacacucuuucuauaauuagcguucuucacccccacccccacccccaccccccuuau

SEQ ID NO: 9257 - RNA, 64 nt, Human
ugacacucuuucuauaauuagcguucuucacccccacccccacccccaccccccuuauuuuccu

SEQ ID NO: 9258 - RNA, 64 nt, Human
ucuuucuauaauuagcguucuucacccccacccccacccccaccccccuuauuuuccuuuuguc

SEQ ID NO: 9259 - RNA, 64 nt, Human
uguagauccguguucuaaaccugggguccacagacacccccaagaagagcggauugaaugcaag

SEQ ID NO: 9260 - RNA, 64 nt, Human
ggaggaaccccagguagggacgccccuuguuccucacccccaccccacuuagguccugggcccc

SEQ ID NO: 9261 - RNA, 64 nt, Human
ugccauuggaucuaguaugucugucuugaccccucacccccaccccauucagaccucaguaguc

SEQ ID NO: 9262 - RNA, 64 nt, Human
ccacagcugccaccgccuugucccucaacaagcucacccccaaucccuugcagccaggccacaa

SEQ ID NO: 9263 - RNA, 64 nt, Human
guaguggggagggcugaacaggacaaccucucaucacccccacuuuuguuccuuccugcugggc

SEQ ID NO: 9264 - RNA, 64 nt, Human
uuguucaccccucgcccugcccuccuuugccuuccacccccaccauccagguggagacccugag

SEQ ID NO: 9265 - RNA, 64 nt, Human
gcguucuccuagaucugagcaagcugucaguucucacccccaccguguauauacaugagcuaac

SEQ ID NO: 9266 - RNA, 64 nt, Human
auagcacaucacaauacugcugcuacucuguagccacccccauggcuacaugaugcccuauucc

SEQ ID NO: 9267 - RNA, 64 nt, Human
cacaauuugucagagcugaagccagcccacuacccacccccacuacagcauugugcuugggucu

SEQ ID NO: 9268 - RNA, 64 nt, Human
ucgaagcugcucuuucugguccuccccaccaccccacccccaagacuuguguuuguuaauagaa

SEQ ID NO: 9269 - RNA, 64 nt, Human
aacuuguuccugccucccucaccccaccccgccccacccccagcccuggcccuuggcuucucuc

SEQ ID NO: 9270 - RNA, 64 nt, Human
gagaccugugucaaaacuuacauccacauuccuacacccccacaacccaucacuucugguguua

SEQ ID NO: 9271 - RNA, 64 nt, Human
acaugagccaaaagcacauaccuaccccaucccccacccccacacacacacacacacacacaug

SEQ ID NO: 9272 - RNA, 64 nt, Human
gucagacugcugccuggguuagaauucuuguccccacccccacuuacuauaguucugugauccu

SEQ ID NO: 9273 - RNA, 64 nt, Human
uugggcuuccaugccuguagcuuuccuggucccucacccccauggccccaggcccacagcgugg

SEQ ID NO: 9274 - RNA, 64 nt, Human
ugacccagugaucuuccauggccguuccuugucccacccccacccgaucauaccuuccccccuc

SEQ ID NO: 9275 - RNA, 64 nt, Human
aaaauaauaauaaaacaacuuguuuccuuuuggccacccccaggaagggcugauuucaaaaucu

SEQ ID NO: 9276 - RNA, 64 nt, Human
uggaaggcuuguuaaaacccaaggcugcuaggcccacccccagaguuugauacaguagaccuca

SEQ ID NO: 9277 - RNA, 64 nt, Human
auacgccgccuucacuccacagccucaccccucccacccccauacugguacugcuguaaugagc

SEQ ID NO: 9278 - RNA, 64 nt, Human
cuaauuaaugcuggaggcugagccaaguacaggacacccccagccugcagcccuugcccagggc

SEQ ID NO: 9279 - RNA, 64 nt, Human
acuucagagcgaacggccacaucuccccaccucucacccccacccucuccccugccaggcuggg

SEQ ID NO: 9280 - RNA, 64 nt, Human
aauacauuaagagaaagagaaauauauauauauccacccccagcccaaccgagggcggcccuug

SEQ ID NO: 9281 - RNA, 64 nt, Human
gguucuguagaauccaagcccacauuuccaaagucacccccaacgcguccucucacaccgucca

SEQ ID NO: 9282 - RNA, 64 nt, Human
auuaaaauucagcuuuagcuuccauggcaguccucacccccaccucucuaaaagacacaggagg

SEQ ID NO: 9283 - RNA, 64 nt, Human
ccccagccugccguggggcccgucagccuggucccacccccauggagaacccaaagucuuacug

SEQ ID NO: 9284 - RNA, 64 nt, Human
ccucccccuuccaacgagcuuccggacuugucugcacccccagcaagaaggcgaguuaguuuuc

SEQ ID NO: 9285 - RNA, 64 nt, Human
cucccaaguagcugggacuacaggcaccugccaccacccccaguuaauauuuuuuuuaauuuuu

SEQ ID NO: 9286 - RNA, 64 nt, Human
ugcuuuauucucuucuuuuucuuuauuucgcccccacccccauccccugccuuuuuuuuuuuuu

SEQ ID NO: 9287 - RNA, 64 nt, Human
auugagucauugagcaucuguacauauccuucaccacccccagucccagcaccugugucaguaa

SEQ ID NO: 9288 - RNA, 64 nt, Human
guaggcauaaugugaggagguggggagaccaccccacccccauguccaccaugacccucuuccc

SEQ ID NO: 9289 - RNA, 64 nt, Human
uggaccuggggguagccccgccccagcccucagucacccccacuucccacuugcagucuuguag

SEQ ID NO: 9290 - RNA, 64 nt, Human
aggcucaucucugaguucucaggacccuugcccccacccccauuuuuuuaaugaaaaaaaaaaa

SEQ ID NO: 9291 - RNA, 64 nt, Human
cccgaaugccucccugggaggcacacugauugcccacccccaccacugcaccauuuccaggagg

SEQ ID NO: 9292 - RNA, 64 nt, Human
ucaucguuccccugagcacugggggacagacccucacccccacccuggggguguggcaccucca

SEQ ID NO: 9293 - RNA, 64 nt, Human
ccccaggcccaccaucaccaccgccucuggccgccacccccaucuuccaccugugcccucacca

SEQ ID NO: 9294 - RNA, 64 nt, Human
gcacaugcguauaugugcgucucucuuucucccucacccccagguguugccauuucucugcuua

SEQ ID NO: 9295 - RNA, 64 nt, Human
cucucagcuccagguggcucugaggugccugucccacccccacccccagcucaauggacuggaa

SEQ ID NO: 9296 - RNA, 64 nt, Human
gcuccagguggcucugaggugccugucccacccccacccccagcucaauggacuggaaggggaa

SEQ ID NO: 9297 - RNA, 64 nt, Human
ccugacaaaaacacguaggggcagggacgguccccacccccagggacacaaccccuggucuugg

SEQ ID NO: 9298 - RNA, 64 nt, Human
caaccugagacagaaccaggcugagccaggccuccacccccacccccguuugcugggggcuccu

SEQ ID NO: 9299 - RNA, 64 nt, Human
auucaacccggcccccaggucugcuggguccccccacccccacagcccucacagcauuccccau

SEQ ID NO: 9300 - RNA, 64 nt, Human
ggaggggcccuggaggccacauccugccccaccccacccccacucccacggacacuaaaacgcu

SEQ ID NO: 9301 - RNA, 64 nt, Human
cggcagcagcuccgcucccggcgccacccaccgacacccccagaacccucugggggccugccca

SEQ ID NO: 9302 - RNA, 64 nt, Human
gcauggguccuggcgauuauuuuaaugcuggcuacacccccacaggugacuuggauucagaaau

SEQ ID NO: 9303 - RNA, 64 nt, Human
ucccucuacuguguggaaaugguccauugaguaacacccccaucagcuucucaacugggaaacc

SEQ ID NO: 9304 - RNA, 64 nt, Human
aagaugcugugauccaccacccagcuucaccccucacccccagcggcucaccauggggauggca

SEQ ID NO: 9305 - RNA, 64 nt, Human
gugacagcuccggcccugauccaggacugcaccccacccccaccguccagccauccaaccucac

SEQ ID NO: 9306 - RNA, 64 nt, Human
gaauccaguuccucaggaaccccuccaaaacccacacccccagggacgccgcuuuccgggaucc

SEQ ID NO: 9307 - RNA, 64 nt, Human
agggugcuguugcagggucaccugccuguuaccacacccccauccagcuggguggugggugagg

SEQ ID NO: 9308 - RNA, 64 nt, Human
ccaacaugugaagacagugaugggcacgugcccacacccccacuucucuagccguuugcagagg

SEQ ID NO: 9309 - RNA, 64 nt, Human
gugccugucuggcagccuguggggucaggagaagcacccccagggcagcccucuugacuggcgc

SEQ ID NO: 9310 - RNA, 64 nt, Human
aagacccacacucacgcacacgcgcuucuucucccacccccacccccuucaaacuuuauucgga

SEQ ID NO: 9311 - RNA, 64 nt, Human
cuuucaaguuggcugucccccccgccgccccccccacccccauauguacagaugauaauagggu

SEQ ID NO: 9312 - RNA, 64 nt, Human
cauucucucugaacacacauugcuauucccaucccacccccaaugcacagggcugcaacaccac

SEQ ID NO: 9313 - RNA, 64 nt, Human
cugugaggcaucauagacacugagcaaccaggaccacccccacguucagaaaucagcuggccaa

SEQ ID NO: 9314 - RNA, 64 nt, Human
aaugcuuaugcaagugacggugcugcucuuguuccacccccacccagauggucucugagugcgc

SEQ ID NO: 9315 - RNA, 64 nt, Human
acugcucugggagggcccugaggacucccacccucacccccacccccacagggucagcaacugc

SEQ ID NO: 9316 - RNA, 64 nt, Human
cugggagggcccugaggacucccacccucacccccacccccacagggucagcaacugcuuccgg

SEQ ID NO: 9317 - RNA, 64 nt, Human
ccugcuguccccccuugggacuaaccacuaaccucacccccaaacuccacgggugccccuagcu

SEQ ID NO: 9318 - RNA, 64 nt, Human
acucagcugccccuguccccaccucuggagaauccacccccaccagauuccuccgcgggaggug

SEQ ID NO: 9319 - RNA, 64 nt, Human
cgugggaccaugacuuagggaggugggacccacccacccccauccaggaaccgugacguccaag

SEQ ID NO: 9320 - RNA, 64 nt, Human
uccucuaaacuuaucuggugcauucuccccaccccacccccauuauauaagggcuauuuuagau

SEQ ID NO: 9321 - RNA, 61 nt, Human
cuguugaguuaucugccuaguggaaaugagccacccccacugcagcccccaccuuuguguc

SEQ ID NO: 9322 - RNA, 64 nt, Human
agauuccacaaagccucucuccccucccucgucccacccccacccaggcaggaagcccaggagg

SEQ ID NO: 9323 - RNA, 56 nt, Human
uccucaagaucuggaacuaauggccccacccccacugggcccaggccaggaggggc

SEQ ID NO: 9324 - RNA, 64 nt, Human
cgcuuccuuccaggacagcaggcuuugaguccagcacccccagccugccuuugccaccagcccc

SEQ ID NO: 9325 - RNA, 64 nt, Human
ucucugaaauauuuagaagugcuaauuucuggcccacccccaacaggaauucuauaguaaggag

SEQ ID NO: 9326 - RNA, 64 nt, Human
cgcugacacagaaggcugccggguggggggagggcacccccaaauucaaagaaaacccuaagug

SEQ ID NO: 9327 - RNA, 64 nt, Human
uuuccugcccuuuuccugggccuucucagcucuccacccccaccacucuugacucagguggugu

SEQ ID NO: 9328 - RNA, 64 nt, Human
uucuauuuacaacugugcuuaucaaaauugugaacacccccacccccgcauuuuuguguguuga

SEQ ID NO: 9329 - RNA, 64 nt, Human
ggcaaucacuagaccggacuugaggcacgcggugcacccccagacgcuggcgcuccaccgugcu

SEQ ID NO: 9330 - RNA, 64 nt, Human
aaaaagcaacccaguccccaaccugcacucuacccacccccaucaccuacuccagcucccaacu

SEQ ID NO: 9331 - RNA, 64 nt, Human
acuguccgucccccuuccgccuucucccuucucucacccccacccuagccuccaccauccccgc

SEQ ID NO: 9332 - RNA, 64 nt, Human
ccccaccacacccucccucuacugggagccuacccacccccaggaccccugaguaaaaaagcug

SEQ ID NO: 9333 - RNA, 64 nt, Human
aggcggcuguguugccuauguagagaacacgcuucacccccacuccccguacagugcgcacagg

SEQ ID NO: 9334 - RNA, 64 nt, Human
cauccagcgugcagccuugccucggaggccagcccacccccagaagccaggaagcccccgcgcu

SEQ ID NO: 9335 - RNA, 64 nt, Human
uuggcuucucugcuucucauaggacuaucuccaccacccccaguuagcaccauuaacuccuccu

SEQ ID NO: 9336 - RNA, 64 nt, Human
uuggcuccucugcuucucacgggacuauuuccaccacccccaguuagcaccauuaacuccuccu

SEQ ID NO: 9337 - RNA, 64 nt, Human
gacuuggacccaaaaaaucaucucaccuugagcccacccccaccccauugucuaaucuguagaa

SEQ ID NO: 9338 - RNA, 64 nt, Human
cuugggggagucggaggcuccccggcagacaccccacccccaucuuguucccuugaggugccuc

SEQ ID NO: 9339 - RNA, 64 nt, Human
agcgccggagcggacgcccccagggagcuggggacacccccaugggacaggugaggggcucgga

SEQ ID NO: 9340 - RNA, 64 nt, Human
uacacauuguagacagguagcaaaauaucacauacacccccaaaauauguacaaauauuauaua

SEQ ID NO: 9341 - RNA, 64 nt, Human
ugaauuugagcacaguccagaaauggagacaucccacccccaguugaauaauggcccauucaug

SEQ ID NO: 9342 - RNA, 64 nt, Human
cucugucucuccuucucucucuccccccaccacccacccccacacacgucaucugcauuguuau

SEQ ID NO: 9343 - RNA, 64 nt, Human
uuggcucucacauacuaaaugcuaguagcgcccccacccccacgcccagucacggugacaacca

SEQ ID NO: 9344 - RNA, 64 nt, Human
cuuuguuucucagcucuguacaaacacaaauacacacccccacaaaacuaaaaucaaaguuuca

SEQ ID NO: 9345 - RNA, 64 nt, Human
cggcuguuccuccccuguaggguuuggacagacccacccccagccuugcccagcuuucaaagga

SEQ ID NO: 9346 - RNA, 64 nt, Human
acagggguguugcgggggcaacaugagagccccucacccccaacucuccacuuucaggaggccc

SEQ ID NO: 9347 - RNA, 64 nt, Human
cacuccucacauuccacgacccaggccugcaccccacccccaacucccagccccggaauaaaac

SEQ ID NO: 9348 - RNA, 64 nt, Human
agcugcuuuccucaccugccccugcccuaccuuacacccccagcuugacuucuuuccaguccac

SEQ ID NO: 9349 - RNA, 64 nt, Human
uccaggccuuauugagaccagaccccaagucccccacccccauccugcuccagcguuuccucua

SEQ ID NO: 9350 - RNA, 64 nt, Human
gcucuuuaaacucuggggagucggauucaggaaacacccccaggaggccaagccugaaaacaga

SEQ ID NO: 9351 - RNA, 64 nt, Human
uaaauuuguugaacccugccacauuuaguauccccacccccaaauccuguuccaaugaaaaaau

SEQ ID NO: 9352 - RNA, 64 nt, Human
cucagccuccaaaguagcuggcacuacaaguguacacccccacacaaggcuaaguuuuguauuu

SEQ ID NO: 9353 - RNA, 64 nt, Human
gcuuggcccggccggccuggcaccguuuuuuaaacacccccaucccucgggaagcagccagcuc

SEQ ID NO: 9354 - RNA, 64 nt, Human
cccugccccaaauccagccaguccugccccagcccacccccacauuggagcccuccugcugcuu

SEQ ID NO: 9355 - RNA, 64 nt, Human
gggggccaggagacccugacccacggccccuccccacccccacccggcucacccccggcccugc

SEQ ID NO: 9356 - RNA, 64 nt, Human
uauuucucauccuuuucaggcugguagagcagaucacccccaaagcaagaaguuccagaugaaa

SEQ ID NO: 9357 - RNA, 64 nt, Human
uccuagaggccccggaggagcugggccagccgcccacccccacccccagugcagggcuggucuu

SEQ ID NO: 9358 - RNA, 64 nt, Human
aggccccggaggagcugggccagccgcccacccccacccccagugcagggcuggucuuggggag

SEQ ID NO: 9359 - RNA, 64 nt, Human
cuugccucucugcuuggagggggcccccucugcucacccccagcgugccccccccggaacugau

SEQ ID NO: 9360 - RNA, 64 nt, Human
ucacauaaaagucugugacuugaaguuuagucagcacccccaccaaacuuuauuuuucuaugug

SEQ ID NO: 9361 - RNA, 64 nt, Human
uaaguuagacucuuccccucccucccacacuucccacccccaggcaaggcugacuucucugaau

SEQ ID NO: 9362 - RNA, 64 nt, Human
ccucugccauguuuuuccccugcuccccugagaccacccccaaacacaaaacauucauguaacu

SEQ ID NO: 9363 - RNA, 64 nt, Human
uggaguauuucucugaggcccacacaaagcuggacacccccaggcucuacuccaucccauugga

SEQ ID NO: 9364 - RNA, 64 nt, Human
uuaauuuucauguguacaccucuuugccuguucccacccccagacuugaaauaacacuucagag

SEQ ID NO: 9365 - RNA, 64 nt, Human
ucccucuccgccccgcuccugcuccuaccugcagcacccccagcuccgacuccagacucucugc

SEQ ID NO: 9366 - RNA, 64 nt, Human
uaaucaaguaaggauguauguggugaaaacuuaccacccccauacuaugguuuucauuuacucu

SEQ ID NO: 9367 - RNA, 60 nt, Human
ucuugagccuccgacuguagaguccccgcccacccccauggcccuaugcggcccagcccc

SEQ ID NO: 9368 - RNA, 64 nt, Human
ucuuaagacaggggccacuccucccucccgcucccacccccaccuuguugacagggagccaagg

SEQ ID NO: 9369 - RNA, 64 nt, Human
aaacaaaggugccaugaugggcuguucuaacccccacccccacugccagguaagggugucaggg

SEQ ID NO: 9370 - RNA, 64 nt, Human
aguccuuaucaccagccucacaaucccacaggcccacccccagugggccuguggcauucauauu

SEQ ID NO: 9371 - RNA, 64 nt, Human
gaaaagacuagaaaggacauugcuuucucagccccacccccagguccacaguguccaagguaau

SEQ ID NO: 9372 - RNA, 64 nt, Human
guuuuuccccacaccucugaacucagggccuagccacccccaaacuuccaaaucccacuuuugu

SEQ ID NO: 9373 - RNA, 64 nt, Human
uuuccagcccuuuuaugccugugugaucccaccccacccccauaguuguauaaaggucauagug

SEQ ID NO: 9374 - RNA, 64 nt, Human
ccugguagcacuuugcucugucauccuuuuuguucacccccauccccgcaucuaaaaccaagga

SEQ ID NO: 9375 - RNA, 64 nt, Human
ggaaaaggaagccaguauauugaagagguaucugcacccccauguuuauugcagcacuguucac

SEQ ID NO: 9376 - RNA, 64 nt, Human
guuugggggcucuucaggcagcaccucagccuggcacccccacuccccugcgcagcccccaggc

SEQ ID NO: 9377 - RNA, 64 nt, Human
gcuuacgaaaaacuuugccucugaugcucagccccacccccaaauagcacacaagcuuguuaac

SEQ ID NO: 9378 - RNA, 64 nt, Human
cguagccccagagcugcccaaguucacugggcuccacccccaccuccaggaggggaggagagga

SEQ ID NO: 9379 - RNA, 64 nt, Human
ccgccggguguacauacgcgucucugccacuccccacccccagccucugccggcuccccuaggc

SEQ ID NO: 9380 - RNA, 51 nt, Human
cgugccugacaggugacugaccacccccacacuccucccacggcuuguggc

SEQ ID NO: 9381 - RNA, 64 nt, Human
agagccccggagcaccacggggucgggggaggagcacccccagccucccccaggcugcgccugc

SEQ ID NO: 9382 - RNA, 64 nt, Human
gcccacaacgacuuuauuuucuuacccaauuucccacccccacccaccuaauucgaugaaggcu

SEQ ID NO: 9383 - RNA, 64 nt, Human
cauucaagccccuucuccacuguagcaaaauaagcacccccaccccaucugccuucaggucuuc

SEQ ID NO: 9384 - RNA, 64 nt, Human
gggccccuggccucgggagcggccccuggcuaugcacccccaccauuccuacacaucuugccag

SEQ ID NO: 9385 - RNA, 64 nt, Human
agcagggccgcgcccuuggugaccucaggcaaagcacccccaaacuuaccucagggggugccuc

SEQ ID NO: 9386 - RNA, 64 nt, Human
cgagagggugaguguggucagaguaaagcugcuccacccccagauugcaaugcuaccaauaaag

SEQ ID NO: 9387 - RNA, 64 nt, Human
gcucucuucaccguuuuuugauacuaucuucccccacccccagcuacccauaggggcugcagag

SEQ ID NO: 9388 - RNA, 64 nt, Human
ucgagaucaccgcgucacgacuuuuggggagacucacccccaccaacaccguccagagaggccu

SEQ ID NO: 9389 - RNA, 64 nt, Human
agucauuuuaaaaugguggcugaauuucccaacccacccccaaacuaaacacuaaguuuaauuu

SEQ ID NO: 9390 - RNA, 64 nt, Human
gcuccacgcguauucacgccccgcuccucgccugcacccccaccccgucuggggccugcccucc

SEQ ID NO: 9391 - RNA, 64 nt, Human
cuucugaccaacacacacacgaccccucccccaacacccccaaauucaagaguggauguggccc

SEQ ID NO: 9392 - RNA, 64 nt, Human
ucugaagcaaagaggccaaagauuggaaaccccccacccccaccucuuuccagaacugcuugaa

SEQ ID NO: 9393 - RNA, 64 nt, Human
gauauaggggggccagacgugugccccguucacccacccccaggcaagcaucugaccugucccc

SEQ ID NO: 9394 - RNA, 64 nt, Human
auuacuugauuuaucuucucaggacucauuguuccacccccaaccaauuugaaugccuacaaua

SEQ ID NO: 9395 - RNA, 64 nt, Human
uagcacacaucugcugacucuccuucaacauccucacccccaccccugggcaccauuuaggaca

SEQ ID NO: 9396 - RNA, 64 nt, Human
cuagaggugagcucagaaaccuacuguuaaccaacacccccaagugacugacacagguggucua

SEQ ID NO: 9397 - RNA, 64 nt, Human
ugagucucuguauggaagaacaaaugugugcauucacccccagucacaauggucuccauugcau

SEQ ID NO: 9398 - RNA, 64 nt, Human
uccuggugauggaaaaacguucucagcuuuaagacacccccauuaggcagacacuggguucugu

SEQ ID NO: 9399 - RNA, 64 nt, Human
ccccuggggaccccaaggccccagcuucccucugcacccccagccuaucccagaggccuugcag

SEQ ID NO: 9400 - RNA, 64 nt, Human
ugccacaaauaagcaucgagcaccuccccauucacacccccauuccuccuggcuccuuaucccc

SEQ ID NO: 9401 - RNA, 64 nt, Human
guuuccaauucuaaaacagacucaaugucccccucacccccaccucaaggucaggaugagaaca

SEQ ID NO: 9402 - RNA, 64 nt, Human
cccgcugccuugcagccugcacuuugcacaugcucacccccagcacagucccacuggccccuca

SEQ ID NO: 9403 - RNA, 64 nt, Human
guugggggcaggaucauucugccccuuguccacgcacccccaccagcccucucgcuucuaacac

SEQ ID NO: 9404 - RNA, 64 nt, Human
cuaacuugugaagaaugcccagaagaaccucagacacccccacaacuuuguacaaaugguuacu

SEQ ID NO: 9405 - RNA, 64 nt, Human
ggaaaagaaacaacacucaguccuuccacacuuccacccccagcuccuuucccuggaagaggaa

SEQ ID NO: 9406 - RNA, 64 nt, Human
auaagcugcaguaauuugcucuuugaaugaccgucacccccaguauaggauaugcuuguauccc

SEQ ID NO: 9407 - RNA, 64 nt, Human
ggccaccucgugggggacaagucucgccagcgcccacccccauggcucgggucaguccucaucg

SEQ ID NO: 9408 - RNA, 64 nt, Human
gcacucauuuugcggaggccaugcgggugcucaccacccccaugcacacgccaucuguguaacu

SEQ ID NO: 9409 - RNA, 64 nt, Human
cagaagcccguggcccugcugacgagagacagcccacccccagccugcaagagaggcagccaga

SEQ ID NO: 9410 - RNA, 64 nt, Human
ccgugucccagaaugcacugcugaggagcaugcccacccccacccccgcagugugcagauuaaa

SEQ ID NO: 9411 - RNA, 64 nt, Human
agcaggcaggcgggaagggccaaguacaggcaaucacccccaucuucuugguuugaagcuuuau

SEQ ID NO: 9412 - RNA, 64 nt, Human
ccaucagcccuacguccagagggagaggagccgacacccccagagccagugccccaucuuaagc

SEQ ID NO: 9413 - RNA, 64 nt, Human
uuuuugccuuggugcucaucuuaauggccuaaugcacccccaaacauggaaauaucaccaaaaa

SEQ ID NO: 9414 - RNA, 64 nt, Human
ucuuuagugacucuuaguagaggguaauggcugacacccccauucccucucuucuuccaccagc

SEQ ID NO: 9415 - RNA, 64 nt, Human
uuccaugugucuuuuccccugcugccucacuccccacccccacuugccagguguuugagccauu

SEQ ID NO: 9416 - RNA, 64 nt, Human
auucucggcacacccuagaguauuguacaaccaacacccccacauaacuuuguccccucuuccc

SEQ ID NO: 9417 - RNA, 64 nt, Human
gaaguggcaugccuccucugcugcagggcucccccacccccacacggccucuaaagauguuuau

SEQ ID NO: 9418 - RNA, 64 nt, Human
cuggcauccuggccucucgugguccucagccccucacccccaguacugcagaucucacaguuug

SEQ ID NO: 9419 - RNA, 64 nt, Human
uaugguuuuguuucacuuuucuuaauuugccccccacccccaccuugaaagguuuuguuuugua

SEQ ID NO: 9420 - RNA, 64 nt, Human
aucaaacauaccccaaguuaaaaugaagcucccccacccccacucccggccccgguucccacag

SEQ ID NO: 9421 - RNA, 64 nt, Human
guugcuuguuguucugcagcccugucuacuugggcacccccaccaccuguuagcugugguugug

SEQ ID NO: 9422 - RNA, 64 nt, Human
uucuguuucaucugacauccggauagaugccagccacccccacauuccaaggugagauuucuga

SEQ ID NO: 9423 - RNA, 64 nt, Human
gcaacaauaagauuuuuucaccucuuccugcuuccacccccaaacugagaacaucacucaauug

SEQ ID NO: 9424 - RNA, 64 nt, Human
gccaguuuaaaucugcacucugcugcuccucccccacccccaccuuccacuccauacaaucugg

SEQ ID NO: 9425 - RNA, 64 nt, Human
aacaguaaccccacacugcaagaggggaccccuccacccccaguacccuggacccccuccgcag

SEQ ID NO: 9426 - RNA, 64 nt, Human
aaagggacugaacugaccccuguuugcacuaagccacccccaccccccacucugcuuucccaag

SEQ ID NO: 9427 - RNA, 64 nt, Human
caaaccaguaucugucccgagaggaaauuccccccacccccagaaguuuacagaaaacugccuc

SEQ ID NO: 9428 - RNA, 64 nt, Human
cuguaugaaacuugacggcgcuuuuguaaggugccacccccaaacuuuaagguagcuaaaccaa

SEQ ID NO: 9429 - RNA, 64 nt, Human
cuacuguaaaccaugguuccagcagccuguuccacacccccacaccaucaggauagcacaggga

SEQ ID NO: 9430 - RNA, 64 nt, Human
ccgcuucagugggccuugcccuuuguacagccuccacccccauuaaaacugcucuggacuugcu

SEQ ID NO: 9431 - RNA, 64 nt, Human
gaggccugaugccguuucugcuuucugcugagaccacccccacccugacaccaucagucccccu

SEQ ID NO: 9432 - RNA, 64 nt, Human
ccauccuaggcugggcuggccccacccucacccccacccccagggugcccugaggccccaggca

SEQ ID NO: 9433 - RNA, 64 nt, Human
ugcugaccauccuaggcugggcuggccccacccucacccccacccccagggugcccugaggccc

SEQ ID NO: 9434 - RNA, 64 nt, Human
gcaugggacccagugucucagugccuucaaaacccacccccaccccuacccuaccccaccacac

SEQ ID NO: 9435 - RNA, 64 nt, Human
gaccagcugaggaggacaaagauaagguggcauucacccccaggcucugacuuucagcaucaug

SEQ ID NO: 9436 - RNA, 64 nt, Human
cauugguguccccaugggcagcaggcagacagcucacccccaccagcaugauggccccagcugg

SEQ ID NO: 9437 - RNA, 64 nt, Human
agcuuaagggaggcuucuugccuguggguucccucacccccaugccuguccuccaggcuggggc

SEQ ID NO: 9438 - RNA, 64 nt, Human
ggcacggaauaugaaagccuccuccaccuccaaacacccccaccuuggaaggagauaaggaggg

SEQ ID NO: 9439 - RNA, 64 nt, Human
caccauccaugcuaccuagguaguccauaggaaccacccccaugaccaccaccaacaucaacua

SEQ ID NO: 9440 - RNA, 64 nt, Human
uccggucccaaauguagcagguguaaccguaacccacccccaacccguuucccgguucaggacc

SEQ ID NO: 9441 - RNA, 64 nt, Human
aaugggaauuuccauuguagguuuuugcuagucccacccccauuuuagccuaauuuggcuuaaa

SEQ ID NO: 9442 - RNA, 64 nt, Human
aucaacgcaccccacucacagacaccccuuaccccacccccacuguacagagaccaagaacaga

SEQ ID NO: 9443 - RNA, 64 nt, Human
cuuccucugagggccccaccucaccccuuggugucacccccaccacgccuaggcagcucugggc

SEQ ID NO: 9444 - RNA, 64 nt, Human
gggcacccuccugggagcaggccuuccucccucccacccccaauguccuguugguaggaggugg

SEQ ID NO: 9445 - RNA, 64 nt, Human
ccaccccaggacgagccaucagggacagaccccccacccccaaggcugcagccacaccauguuu

SEQ ID NO: 9446 - RNA, 64 nt, Human
auggcacugggccuccaguucuuccacaugugugcacccccagcuuggccaacccucagccuug

SEQ ID NO: 9447 - RNA, 64 nt, Human
uguccuguuaggccaacugccuccuugccagccccacccccagguuuuugcccauccucccaau

SEQ ID NO: 9448 - RNA, 64 nt, Human
cagcuuuccugaauggauucccggccccaucccucacccccacccucacuuucaauccguuuga

SEQ ID NO: 9449 - RNA, 64 nt, Human
gucuccccccaccacccgugcacgacuuccucaccacccccagguucccugcagaugucgugug

SEQ ID NO: 9450 - RNA, 64 nt, Human
gucccucuucuagugguaccgcccaggccuuaaucacccccauuccgugcggugguaucuccca

SEQ ID NO: 9451 - RNA, 64 nt, Human
uuuggaacgagggcucuucugucggugucccucccacccccauguaugcugcacuggguucucu

SEQ ID NO: 9452 - RNA, 64 nt, Human
agggagcgagcccagaacggaccggacgccugugcacccccagcccugccccuuggccgcagag

SEQ ID NO: 9453 - RNA, 64 nt, Human
agcuugacccuggaaauucugggccaucccccuccacccccacccugaggcucccccugcaggu

SEQ ID NO: 9454 - RNA, 64 nt, Human
ucgucuccccucucuuaagcacccgcuuccucaccacccccacuguugggccuauaguagcagg

SEQ ID NO: 9455 - RNA, 64 nt, Human
gaagagacuguccuugggccuccucuggaagcagcacccccagaggacagggcuccuccugcuu

SEQ ID NO: 9456 - RNA, 64 nt, Human
aacaucgcuugaagucuucacaucuaccacuagacacccccaaaaucuguuauagacauuuaug

SEQ ID NO: 9457 - RNA, 64 nt, Human
uauaaaacuaggugcugcagccccugggaccaggcacccccagaaugaccuggccgcagugagg

SEQ ID NO: 9458 - RNA, 64 nt, Human
cuaauggccuaguuggguccugcccgccaauaaucacccccacgggucagagacaggcuccuug

SEQ ID NO: 9459 - RNA, 64 nt, Human
ucaugccuuuucagcgaaagccugucuccucacccacccccagcccuagcauaggaaaagcuuc

SEQ ID NO: 9460 - RNA, 64 nt, Human
aaacuggguguucaaggcccuuacacccuugucccacccccagcagcucaccauggcuuuaaaa

SEQ ID NO: 9461 - RNA, 64 nt, Human
augcacgauucucugcgcgcaaggacccucgacucacccccauguuucagugucacagagacau

SEQ ID NO: 9462 - RNA, 64 nt, Human
agaguugacuuuccucccauuuuaccacuuuaaacacccccauaacaauucccccauccuucag

SEQ ID NO: 9463 - RNA, 64 nt, Human
ccaccccagccugccugcugccucggaacugugacacccccaucuucgacuucagagucuucuu

SEQ ID NO: 9464 - RNA, 64 nt, Human
ugcccugcucuggagggagggccaggagcugccacacccccaaguccucucagggcccacccuc

SEQ ID NO: 9465 - RNA, 64 nt, Human
gcuagccccugccccaauccugcccuggccugaacacccccagggacagagcuggucucugggc

SEQ ID NO: 9466 - RNA, 64 nt, Human
guggaaaagcuggcccuguggcgugacgggggagcacccccauccagacugcgaagcugcucug

SEQ ID NO: 9467 - RNA, 64 nt, Human
gggagccccacagaggcagguccuggaaccaccccacccccacaccuggacgcucgcucuggug

SEQ ID NO: 9468 - RNA, 64 nt, Human
augggugcacccggugcccucccucuccuacccccacccccacgguugcacuuuauuuauucgg

SEQ ID NO: 9469 - RNA, 64 nt, Human
acccuccgagauggucagugugucaugggaagcccacccccagcucugccagugcucucugggc

SEQ ID NO: 9470 - RNA, 64 nt, Human
cuucugaacgcauuuguuauugaaggaaagacaccacccccaaauccugccaucuuauuggggc

SEQ ID NO: 9471 - RNA, 64 nt, Human
gauguuugauuuguaaauuacaaauauaaauuaucacccccauuuccauuuauuuucuugauau

SEQ ID NO: 9472 - RNA, 64 nt, Human
gucucaaaaugacccacccagcuagagcacuguacacccccaguggagagccaauucaguccug

SEQ ID NO: 9473 - RNA, 64 nt, Human
cccuccccuucucacucuguugauguaauccucccacccccaguguccauccuaagacaggcau

SEQ ID NO: 9474 - RNA, 64 nt, Human
ugcccauaccgaaauuuucugaaauuaaaucgcacacccccaccauuuccucucccugggaucu

SEQ ID NO: 9475 - RNA, 64 nt, Human
caagcugguuguggguuuuucaaggugccauagccacccccaaagauguuuguuuaaagcgugg

SEQ ID NO: 9476 - RNA, 64 nt, Human
gaugacagucagaggcgcaggagcccucccuccccacccccacccuguaacuccagcugccacu

SEQ ID NO: 9477 - RNA, 64 nt, Human
ccagagccucugaggcagcgcaggggucaguucccacccccacccgucccaggcccaggccgaa

SEQ ID NO: 9478 - RNA, 64 nt, Human
caucccaccugugugcagugcccuugccugccuucacccccaccaccacuucuccaauaaagcc

SEQ ID NO: 9479 - RNA, 64 nt, Human
ggugacaguggaugacgugaagccacaggagccccacccccaugcagccucuuccccacccccc

SEQ ID NO: 9480 - RNA, 64 nt, Human
aaaccaaccaugaaugaaccccuggcuccuucaccacccccacgauugguaugaugcugccggc

SEQ ID NO: 9481 - RNA, 64 nt, Human
cagagaugggaccuaagggucccaccccucaccccacccccaccucuucuguauguuugaauuc

SEQ ID NO: 9482 - RNA, 64 nt, Human
gcaccugcgggagcugcacuacagcccuggccuccacccccaccccgccgaccauccaagggag

SEQ ID NO: 9483 - RNA, 64 nt, Human
caucaggagcagaacagcaagcucucugucccugcacccccaccaucuuggggaccuacaaggg

SEQ ID NO: 9484 - RNA, 64 nt, Human
gagagcaccauggcuccuacauuggaccuuggagcacccccacccuccccccaccgugcccuug

SEQ ID NO: 9485 - RNA, 64 nt, Human
uacacuguuauuuggagcaugccauuggaaaacccacccccacccccccucaaaaaaacagaac

SEQ ID NO: 9486 - RNA, 64 nt, Human
ccccuucacucccagcccagagcccccggccaggcacccccagggaaggcucugguggagaacc

SEQ ID NO: 9487 - RNA, 64 nt, Human
caccauaucaacacuuagcccuacccauuaguaucacccccaguucuuacaguaaucccugaga

SEQ ID NO: 9488 - RNA, 64 nt, Human
gucuggucuguguccacuuuuucuaaaguaaccccacccccagcacaccauuguuggcaccucu

SEQ ID NO: 9489 - RNA, 64 nt, Human
ggugcuguaggcuacauccugauaccuauaaguucacccccaccccacagcugcuggagagaaa

SEQ ID NO: 9490 - RNA, 64 nt, Human
accuguuauccucuucuuucacccuaucucuucccacccccagcuucccuuugccccacaaagu

SEQ ID NO: 9491 - RNA, 64 nt, Human
gcuuccccacccccuccucaggcuccugcgagcacacccccacccccaaaucccucccuguucu

SEQ ID NO: 9492 - RNA, 64 nt, Human
ccacccccuccucaggcuccugcgagcacacccccacccccaaaucccucccuguucuacacug

SEQ ID NO: 9493 - RNA, 64 nt, Human
gcccugaggcucagucucucucguauuuuguccccacccccaauuccuugagugguuuuugcuc

SEQ ID NO: 9494 - RNA, 64 nt, Human
gccauccccaacucccuaucccauccccagccuccacccccauccagaugggacucacguggcu

SEQ ID NO: 9495 - RNA, 64 nt, Human
guacugcuuucugcuuuucucccaccccuccuagcacccccacaucccccaucuaguaacaucu

SEQ ID NO: 9496 - RNA, 64 nt, Human
ugggaaaccacuuccccaggcuucucccuccccccacccccauaggaacaggauuuggccuuag

SEQ ID NO: 9497 - RNA, 64 nt, Human
uuauuucuccauccccucccugccugcuccuuggcacccccaugcugccuucagggagacaggc

SEQ ID NO: 9498 - RNA, 64 nt, Human
gggacagauggccuucuuugucaucuucacucuccacccccagagaggagucagagccauaacu

SEQ ID NO: 9499 - RNA, 64 nt, Human
gucaaucaauauaaaauauuuaugaggucucccccacccccaggagguuauaugauugcucuuc

SEQ ID NO: 9500 - RNA, 64 nt, Human
gcaugcuaaucgugguuucggggugagaauaaaacacccccacauaacaugcauuugcaugggc

SEQ ID NO: 9501 - RNA, 64 nt, Human
ccugcagcgccucggucugugacaguccuccuagcacccccauggcuuugagccucggggacuc

SEQ ID NO: 9502 - RNA, 64 nt, Human
acuuggaacugaagggggcggccuaugacuugggcacccccagccugggccuauggagagcccu

SEQ ID NO: 9503 - RNA, 64 nt, Human
aaguccugaaacaggcuccccucaccaggacagucacccccaaacuugacccccaacauuucaa

SEQ ID NO: 9504 - RNA, 64 nt, Human
ucuggcacuuccucucuauugcccccaccaccaccacccccaucacugcuuucucccagaccuc

SEQ ID NO: 9505 - RNA, 64 nt, Human
gagugaguuuccauuuccagcuggaaucugcagccacccccauuuccuguuuuccauucccccg

SEQ ID NO: 9506 - RNA, 64 nt, Human
aggggguggagguuggggucaccggccugcuuggcacccccaucugaaagagcagcacuucuca

SEQ ID NO: 9507 - RNA, 64 nt, Human
uuguagugggaccagaaauuacuuaccugacauccacccccauucccccucauccugcuggggu

SEQ ID NO: 9508 - RNA, 64 nt, Human
ccccuggguuaacaaaugagccauccccagggcccacccccaggaaggccacagugcugggcgg

SEQ ID NO: 9509 - RNA, 64 nt, Human
acaauccugcugggaaccucuggagagccacaggcacccccagcuggaggccagacuccucucu

SEQ ID NO: 9510 - RNA, 64 nt, Human
ggguccacugggagggaagcucuaucugggaacucacccccagcgcacacacaucucccccagg

SEQ ID NO: 9511 - RNA, 64 nt, Human
cuacaaagacccuauacucucagucuccccaacccacccccaaggagcugugggaggcuuugug

SEQ ID NO: 9512 - RNA, 64 nt, Human
aaggguaagaaaugagccuagucaccaagaacuccacccccagaggaaguggaucugcuucucc

SEQ ID NO: 9513 - RNA, 64 nt, Human
ugggaggaaggggagccccguccuccaagggcagcacccccacuuucaacugaaucaagugagg

SEQ ID NO: 9514 - RNA, 64 nt, Human
cugaaacaugcacacugcaaauaucaaaaggagacacccccaaaucccacucuaaauuccaaag

SEQ ID NO: 9515 - RNA, 64 nt, Human
cugaaggacaaacaaccaagaguggcccaguccccacccccacaucuagcucagucucaaaucu

SEQ ID NO: 9516 - RNA, 64 nt, Human
ccaccucagcacuuggaagaagaggugacuuugccacccccaaaggugucugccacacccaagu

SEQ ID NO: 9517 - RNA, 64 nt, Human
cuccccuccgcuccccacgcccccauauuggcaacacccccagcgccaccccaugcuccccaag

SEQ ID NO: 9518 - RNA, 64 nt, Human
gaggcccccaagcugaucugguggugcauccacgcacccccacccugggacuuuggaugcuccc

SEQ ID NO: 9519 - RNA, 64 nt, Human
aaccacuggagcagcccacacuggcuugauggaucacccccaggaggggaaaaugguggcaaug

SEQ ID NO: 9520 - RNA, 64 nt, Human
gugguacccaaugucaugggaaugaugugccugucacccccauuggacaagcuggggaacagcc

SEQ ID NO: 9521 - RNA, 64 nt, Human
ucagauccaguacucuguguaccugcuccagccccacccccacagagagaacuuguggcucugg

SEQ ID NO: 9522 - RNA, 64 nt, Human
cgguugcgcugguauaguugcccagcgggagagacacccccauccccacgcgggccgggcacga

SEQ ID NO: 9523 - RNA, 64 nt, Human
cucaaacucugaauaugauuaaaccagaacaccccacccccaacugccaaaaaaaaaaaaaaaa

SEQ ID NO: 9524 - RNA, 56 nt, Human
uggcaaagauagcagccugaaggucccacccccaccccuacagaaaaaaugggagc

SEQ ID NO: 9525 - RNA, 64 nt, Human
uguugucgggacucgcaagugcccucaucacagccacccccaccacgagugucuccccagugca

SEQ ID NO: 9526 - RNA, 64 nt, Human
aagucgacugccaaagaggcccagcagagggcagcacccccaucauuuuuuugaauuucucccu

SEQ ID NO: 9527 - RNA, 64 nt, Human
cggcccaguccugccgccguguccaggcgccccucacccccacaccugcugcauggcuggccac

SEQ ID NO: 9528 - RNA, 64 nt, Human
aggggagggugugguggguucuccacuccacugccacccccagcguggcugcuuucaaguucuu

SEQ ID NO: 9529 - RNA, 62 nt, Human
gccagccuguguacguguagaugggggccaggcacccccaccacucgcugccucccagguca

SEQ ID NO: 9530 - RNA, 64 nt, Human
ccucugcaagugggagagacccgagcauccuccccacccccauagcuccagugcacgccacccc

SEQ ID NO: 9531 - RNA, 64 nt, Human
gaauaauaauacaauauuuaaacaucaucucacccacccccacaaggggagaaaaaguagggga

SEQ ID NO: 9532 - RNA, 64 nt, Human
ccugaaccgagagaacccagaggaacccccaccccacccccaccuaccacuccaugcuuucucu

SEQ ID NO: 9533 - RNA, 64 nt, Human
cccagaaaagaggaagacagauuuaaagugcccccacccccauuuguuucaaagaggucugcau

SEQ ID NO: 9534 - RNA, 64 nt, Human
guagcuccucuucccucgcccccacccucuaccccacccccaccuucgcucagacuuuaccggc

SEQ ID NO: 9535 - RNA, 64 nt, Human
gcugaaggcagaagccacaagaggccuugagugccacccccagggaagaacauaaaggguugca

SEQ ID NO: 9536 - RNA, 64 nt, Human
aggcgaaagggcagcagcauguggcccauggcaccacccccacggcccagcacaaccccuagag

SEQ ID NO: 9537 - RNA, 64 nt, Human
aggcagcucuuuugcccagagcguucccuguagccacccccaccccacuugcccuugguucuuu

SEQ ID NO: 9538 - RNA, 64 nt, Human
ggggcuuccuauccuggggccuaccccgggcaggcacccccaggggcuuauccuggacaggcac

SEQ ID NO: 9539 - RNA, 64 nt, Human
auuuuaauugaaaacaccagucauaaacuauuaccacccccacucucuuuugaucagaaauggc

SEQ ID NO: 9540 - RNA, 64 nt, Human
aaguucccuguugcaugagccugcgacaggaccucacccccaccaccaggcuucuauuugggau

SEQ ID NO: 9541 - RNA, 64 nt, Human
acuuccugugaggcccucccggggcgccuccccucacccccaggcgcacgucuggccccgccuc

SEQ ID NO: 9542 - RNA, 64 nt, Human
acccaccaggaugugugcccagccaggccuccagcacccccagugcagcucgugauuggaaacu

SEQ ID NO: 9543 - RNA, 64 nt, Human
ugcucagccacccucugccccauuccuagacccucacccccaccacuguuccugugucuucacg

SEQ ID NO: 9544 - RNA, 64 nt, Human
ccagcacccuacucacccuguccagccccauggccacccccaccccugccucgcccccuacagg

SEQ ID NO: 9545 - RNA, 64 nt, Human
ccugcacacggggccgcugggcaggugccccucacacccccaggaugucagugcucaccucgag

SEQ ID NO: 9546 - RNA, 64 nt, Human
agagugacgccacagcccaucccggugacaugcucacccccaacccccguguccgggaccccgg

SEQ ID NO: 9547 - RNA, 64 nt, Human
cagagcuaaggaccaaggagaagaacagccucuccacccccaagccaggcgguugaggaacaua

SEQ ID NO: 9548 - RNA, 64 nt, Human
gaaaauauauauuuacuaccauaauuucuaccaccacccccauuuugcucugcauuauacacag

SEQ ID NO: 9549 - RNA, 64 nt, Human
gccaaaggcuacagggugcuucuuccucuucccccacccccacugucccucaugugccaugggc

SEQ ID NO: 9550 - RNA, 64 nt, Human
aguggcaggggagcagguuccccaagggcccuggcacccccacaagcugucccugcagggccau

SEQ ID NO: 9551 - RNA, 64 nt, Human
cccucccccaacccaacucgacccucccuccccucacccccaagguguagaauugugaauauaa

SEQ ID NO: 9552 - RNA, 64 nt, Human
uacuauugcagaccugucacccugcaggacuugccacccccaguuccuaugacacaguuaucaa

SEQ ID NO: 9553 - RNA, 64 nt, Human
uuucuggcuugacggcuucucucuuuuuuuaaaucacccccaccacauaaaucucaaauccuau

SEQ ID NO: 9554 - RNA, 64 nt, Human
ccugcauccagauaccugccucguccgaggcagacacccccaccccugccuccuccagaccccc

SEQ ID NO: 9555 - RNA, 64 nt, Human
augguccuggaggugcccuaccugcauccugcugcacccccacccacgacacucgagugcaaga

SEQ ID NO: 9556 - RNA, 64 nt, Human
agccaggagaagcucagcugcauuccgcagcccccacccccaagguucuccaacaucacagccc

SEQ ID NO: 9557 - RNA, 64 nt, Human
gacagccuaguaugaaccguggaggauauaugcccacccccacuggggcgaagguggacuauau

SEQ ID NO: 9558 - RNA, 64 nt, Human
uggaaacaaugaccacuucucuaccauugucccccacccccaccccccagaauaacgcugacug

SEQ ID NO: 9559 - RNA, 64 nt, Human
ccagggguucaggugguggagcaggaagccaccgcacccccaaagucacugggcccugagaaaa

SEQ ID NO: 9560 - RNA, 64 nt, Human
uuuuuaucguagcaccaaagaaaugaaaacagaucacccccaaagccaagcaagugauugggua

SEQ ID NO: 9561 - RNA, 64 nt, Human
aaacuguaccaguucugaagaccguuuucugccacacccccacccccagcugaccagggaggca

SEQ ID NO: 9562 - RNA, 64 nt, Human
uaccaguucugaagaccguuuucugccacacccccacccccagcugaccagggaggcagaggac

SEQ ID NO: 9563 - RNA, 64 nt, Human
caacugcgucuucucucagcccuccacacacacucacccccacucccacacacauacacacaca

SEQ ID NO: 9564 - RNA, 64 nt, Human
gugcuagauguguguuuagagcuaaaccagcccccacccccacccuccaccugccccucuugcc

SEQ ID NO: 9565 - RNA, 64 nt, Human
cccguuuuccccaugacaauguuguagugucccccacccccaccccccaggccuuggugccucu

SEQ ID NO: 9566 - RNA, 55 nt, Human
auuccaauucugugaauuagcaccccacccccauaccccuucuuccacccccaga

SEQ ID NO: 9567 - RNA, 64 nt, Human
gugaauuagcaccccacccccauaccccuucuuccacccccagacuaaaggaagauacuuacuc

SEQ ID NO: 9568 - RNA, 64 nt, Human
aaaauguuucaaguacuguaacugugucaugauucacccccaaacagugacauuuauuuuucuc

SEQ ID NO: 9569 - RNA, 64 nt, Human
cugcuucucaagcugcagagaagcuuuucauucccacccccacccggaaccuccccuugccuaa

SEQ ID NO: 9570 - RNA, 64 nt, Human
ucaucucugcagggagagguuccaauguccaccccacccccagguacccgccucuucccacaga

SEQ ID NO: 9571 - RNA, 64 nt, Human
cagagcagugcucagucaagggcuaaugauugcccacccccaagguaaagagccucauugcacu

SEQ ID NO: 9572 - RNA, 64 nt, Human
uguguuucagaccuacaagaugggguacuaacaccacccccaccgcccccaccaccacccccag

SEQ ID NO: 9573 - RNA, 64 nt, Human
gggguacuaacaccacccccaccgcccccaccaccacccccagcuccugaggugcuggccagug

SEQ ID NO: 9574 - RNA, 64 nt, Human
ccaccacccccagcuccugaggugcuggccagugcacccccacucccacccucaaccgcggccc

SEQ ID NO: 9575 - RNA, 64 nt, Human
uuuuaauccucugacaaguugacucuucgacccccacccccacccaagacauuuuaauaguaaa

SEQ ID NO: 9576 - RNA, 64 nt, Human
ucugccucuguucacggggaugcuuggcuggagucacccccaggacuuauccaugcaucacuau

SEQ ID NO: 9577 - RNA, 64 nt, Human
ccccccgaccuccacccccucagacuccaucccccacccccaggagccuggcugucucuagcga

SEQ ID NO: 9578 - RNA, 64 nt, Human
uucuuucaaaagaccccaccgacagaccgcauuccacccccaacaucggcacugagggacaucg

SEQ ID NO: 9579 - RNA, 61 nt, Human
uggagcugcugggcuguuaguggccaccugccacccccaggucuuccugcuuuccaugggc

SEQ ID NO: 9580 - RNA, 64 nt, Human
ugaccuagcuagggaugcaagagugagcaagcagcacccccaccugcuggcuuggccucaaggu

SEQ ID NO: 9581 - RNA, 64 nt, Human
aaugugugaaacauccccucaggcugaagccccccacccccaccagagacacacugggaaccgu

SEQ ID NO: 9582 - RNA, 64 nt, Human
gccuggggcaggggcugugcacagacggaccccccacccccacacgcacuuuaugagggagacc

SEQ ID NO: 9583 - RNA, 64 nt, Human
gaggcccuuaugagggcagcccagcccccgcacccacccccaaccagagaagcacagaucuugg

SEQ ID NO: 9584 - RNA, 64 nt, Human
gcccaaagcugcugaggggucugaggcuggugcccacccccaagcuaguguguucucugccccu

SEQ ID NO: 9585 - RNA, 64 nt, Human
agaggaaugccucgcacaaaaggucuuccccacccacccccagcccccuagucuaauacccacc

SEQ ID NO: 9586 - RNA, 64 nt, Human
gcuuucuuucccucuuuuucugcacugccauauucacccccaaccauccaaucuguggauaauu

SEQ ID NO: 9587 - RNA, 64 nt, Human
gagacaccuugaggaggccgcuccuucccagacacacccccacgcccccacuggacggcauugg

SEQ ID NO: 9588 - RNA, 64 nt, Human
gguucccccaacauguucccguucacucugcccccacccccaaaggcucagccucuaaaucuca

SEQ ID NO: 9589 - RNA, 64 nt, Human
gaccgggccggugggcgcccauuugggacugcgccacccccaggcuuguucuuguuuuacugua

SEQ ID NO: 9590 - RNA, 64 nt, Human
cagcacgcugaccugugaaccccagccucaccaucacccccagcacugccagggacugcccugu

SEQ ID NO: 9591 - RNA, 64 nt, Human
auuagugaccucagcuuugauauuucacuuacagcacccccaacccuggcacccagggugggaa

SEQ ID NO: 9592 - RNA, 64 nt, Human
cgauccccuuuuuuauuuuuuacaaccggaccuccacccccaacuuccuccagcccagcugggc

SEQ ID NO: 9593 - RNA, 64 nt, Human
cagacagcugccugggaucccucauccucauacccacccccacccaagggccuggccugagcug

SEQ ID NO: 9594 - RNA, 64 nt, Human
ccagcaucaguuuucuccacuucuuucucccacucacccccagcaaggugccuggggagacuug

SEQ ID NO: 9595 - RNA, 64 nt, Human
cagcuaagggguggggcugcggggguuccguguccacccccauacauuuauuucuguaaauaau

SEQ ID NO: 9596 - RNA, 64 nt, Human
ccccaaguguccuggacccuggccuaaagaaucccacccccacuucaugcccacugccgaugcc

SEQ ID NO: 9597 - RNA, 64 nt, Human
cuugacuggcucaagaauuagggccccaacuacacacccccaagccacagggaagcauguacug

SEQ ID NO: 9598 - RNA, 64 nt, Human
uucuacugagcgagcugggccgguuaguguaugucacccccaccccaccccuaaguagucauca

SEQ ID NO: 9599 - RNA, 64 nt, Human
gcuauuccaggcucuaggggcuggugcucauccccacccccagcgacuuccguccuaccuggca

SEQ ID NO: 9600 - RNA, 64 nt, Human
cucuccaguccaccccgguaaaagagcuguuccccacccccagggagcuccugucccugucagc

SEQ ID NO: 9601 - RNA, 64 nt, Human
gaagucucugaguaggcaggguccuccugggaggcacccccaccuguuugaaaggucuggccag

SEQ ID NO: 9602 - RNA, 64 nt, Human
cgaggagggagggcuccuuucuagccugcccccccacccccacuucaccccuccccagcuuccc

SEQ ID NO: 9603 - RNA, 64 nt, Human
aggggaccaaggucagggccccccugccccaccgcacccccagaauauaagcuaucaagaguau

SEQ ID NO: 9604 - RNA, 64 nt, Human
ccaguuuuaggccuuucuccuucuaagugccccccacccccauagccugcauguccacucccag

SEQ ID NO: 9605 - RNA, 64 nt, Human
ugggaggggugggagcaugggaagggaggcaucccacccccaagaagaacugaauaaagauugc

SEQ ID NO: 9606 - RNA, 64 nt, Human
aacaugcagaaggcacuaagcuuccugggccccucacccccagcuggaaauuaagaaaaagucg

SEQ ID NO: 9607 - RNA, 64 nt, Human
gacaucaaggacaccugaggggucaggauauccccacccccacccugggaaagacgccuuuccc

SEQ ID NO: 9608 - RNA, 57 nt, Human
gugauggcgagaguaacugagcucugccacccccaggagggacccuugauacaugua

SEQ ID NO: 9609 - RNA, 64 nt, Human
gugugaugugugugaugcaccagagcacccccuccacccccaccuugggugugugugcgugguc

SEQ ID NO: 9610 - RNA, 64 nt, Human
ccaggcucacucccaaaacagacccaggcagccccacccccacggcagacccuggugucccugg

SEQ ID NO: 9611 - RNA, 64 nt, Human
aauccuucugccuacugaaaucugauauauuacacacccccaaccuuuuuuuuuucaguuugga

SEQ ID NO: 9612 - RNA, 64 nt, Human
ucagacucugggucccucggagcugccagccgggcacccccaaccucauggucauggacagaua

SEQ ID NO: 9613 - RNA, 64 nt, Human
gacaaaauguuggcuacaacuugaggagaaaaaucacccccaaaggaguggacauuuccuaaca

SEQ ID NO: 9614 - RNA, 64 nt, Human
uaggcaccagcacaaagaucugaaugaugcaccccacccccaccccaauaaagaaauaacagaa

SEQ ID NO: 9615 - RNA, 64 nt, Human
aagagcuaauaggaacaaauacucuccccccgcccacccccauugguuuuaaugcugagaagaa

SEQ ID NO: 9616 - RNA, 64 nt, Human
ugggugcaugugugugcacacacacacacacacacacccccacaccccuuugccgguuccucga

SEQ ID NO: 9617 - RNA, 64 nt, Human
ucugggugugggucagacccugugacccacaugccacccccacccuccacagagcccccuugcu

SEQ ID NO: 9618 - RNA, 64 nt, Human
augcagagaagccacccacguggggugugccaggcacccccagauacaaaugcagccacgcaca

SEQ ID NO: 9619 - RNA, 64 nt, Human
cugcugugcaguucuugccucccucacggggcgucacccccagcccagcuccguuguacauaaa

SEQ ID NO: 9620 - RNA, 64 nt, Human
ugugccucuccugggacaaccagacucuguaacucacccccaccaccauacacacacacaaaaa

SEQ ID NO: 9621 - RNA, 64 nt, Human
ucucaagcuggacugccagccccuguccucccuucacccccauugcguaugagcauuucagaac

SEQ ID NO: 9622 - RNA, 64 nt, Human
ggcuccucuuugcuuccuucccucucucuccucccacccccauaggaucaguguguaccaggua

SEQ ID NO: 9623 - RNA, 64 nt, Human
cugaggguccugggggagcugaggcucugugcugcacccccagcccacagcuggggcaucucac

SEQ ID NO: 9624 - RNA, 64 nt, Human
cugcagagcuggggggaaggcgauguggugaccccacccccacccguuaauuuaaagcuguuuc

SEQ ID NO: 9625 - RNA, 64 nt, Human
caccucaacccaggucuuggauuucaggucccuccacccccauucugagucucuguccuucucc

SEQ ID NO: 9626 - RNA, 64 nt, Human
ccucccagaauuagccagcuugccuccugcaccccacccccaccaaccaggggagccacuaagc

SEQ ID NO: 9627 - RNA, 64 nt, Human
aggaguucucuuccgcagccccuuuccccacgcccacccccagucuccagggacccuugccugc

SEQ ID NO: 9628 - RNA, 64 nt, Human
uuccuguccuaaaaauaggggccguuuucuuacacacccccagagagaggagggacugucacac

SEQ ID NO: 9629 - RNA, 64 nt, Human
uacucugccccuggauggugcggggugcuuucuccacccccacacucccugcucagcuccucgu

SEQ ID NO: 9630 - RNA, 64 nt, Human
ccgagcugcccccacccccggccucagccaccagcacccccauagggcccccagacaccacaca

SEQ ID NO: 9631 - RNA, 64 nt, Human
ggcccgaguuccuccauuucccuggccugccccccacccccaaccugucccacccccgugcccc

SEQ ID NO: 9632 - RNA, 64 nt, Human
gacgggccuacaggggggucuccccucaccccugcacccccagcugggggagcuggcucugccc

SEQ ID NO: 9633 - RNA, 64 nt, Human
ugcucuucccugauggagacccugagaucuuccccacccccaaucaugaugucuucaguguggg

SEQ ID NO: 9634 - RNA, 64 nt, Human
cgagcuucucaacaaccauguuacuccacuuccccacccccaccaggccucccuccuccccucc

SEQ ID NO: 9635 - RNA, 64 nt, Human
aaaacaugugaaagauagguauggaaaaagcauacacccccaaacagaaaggaguuauuaaagu

SEQ ID NO: 9636 - RNA, 64 nt, Human
ccauugguguugacauacauccaacauuaaaagccacccccaaaugcccaagaaaaaaagaaag

SEQ ID NO: 9637 - RNA, 64 nt, Human
uacccuguucugguuuuuuuccucccuuuaguuccacccccaacccccauucccugguguccuu

SEQ ID NO: 9638 - RNA, 64 nt, Human
cccacccacuggcuguuucuccguccucuccuaucacccccaaacacucacuuugaaugcugca

SEQ ID NO: 9639 - RNA, 64 nt, Human
acucaccucuugguuagcgggagugugcugcccccacccccacccccgcacccccauucuacac

SEQ ID NO: 9640 - RNA, 64 nt, Human
uagcgggagugugcugcccccacccccacccccgcacccccauucuacacaaggcagaagaggc

SEQ ID NO: 9641 - RNA, 64 nt, Human
caaccgaugcuccagccaaccccuguggagcccgcacccccacccuuuggggggggcccgccug

SEQ ID NO: 9642 - RNA, 64 nt, Human
cucuccuggcaaaaauucacugccacagacaaaccacccccacuccuacccagccagcccucaa

SEQ ID NO: 9643 - RNA, 64 nt, Human
gaggcaggggcuuuuguauuuccugccucugccccacccccaaaguaagaagaaacauguuucc

SEQ ID NO: 9644 - RNA, 64 nt, Human
cccaucuugguggcugcacacucuuccuggcccgcacccccauccccagucccuguuccccaag

SEQ ID NO: 9645 - RNA, 64 nt, Human
augccacuacucaccaguguuguucaccaacacccacccccacacacaccaacauuuugcugcc

SEQ ID NO: 9646 - RNA, 64 nt, Human
ccagucuugggaggagcgcgcugcuuuggugagacacccccaugcaagguccucagaguagccg

SEQ ID NO: 9647 - RNA, 64 nt, Human
ugucuuuauaggaggauaggccucugcccugccccacccccaccaccuguccccacccaguguc

SEQ ID NO: 9648 - RNA, 64 nt, Human
ucccuccccacccaagagaggaaggaccccucaccacccccacuggugagacaguuuacuuugc

SEQ ID NO: 9649 - RNA, 64 nt, Human
ccugaagucccucgcuuuuggggggggggucucucacccccaggccacauagggccagugguag

SEQ ID NO: 9650 - RNA, 64 nt, Human
agacccccccccgcccccgcuccacccuggagcccacccccaugggcaccgcgugccgccugca

SEQ ID NO: 9651 - RNA, 64 nt, Human
acacggacauuccaaagaccuccagagaccaccccacccccacauuccuuugaccagccuugug

SEQ ID NO: 9652 - RNA, 64 nt, Human
agcccccgaccuuauuuauuacccuccccucccacacccccaaucuaccuggugaugauuuuaa

SEQ ID NO: 9653 - RNA, 64 nt, Human
gcugagaaaugcaaaggcucauauuuauaaaucccacccccagaguggggagggucaggugcca

SEQ ID NO: 9654 - RNA, 64 nt, Human
ugaccccuguccugccccuccagaguaccccacgcacccccaggaccuucgccgucuccgugcc

SEQ ID NO: 9655 - RNA, 64 nt, Human
agaaacagcugcuucuccccccaucccagggucccacccccaacccccagagguggcccuuguu

SEQ ID NO: 9656 - RNA, 64 nt, Human
acauuccagccaggcccaggccagcccccccacccacccccaggccuccuaggggaagggggug

SEQ ID NO: 9657 - RNA, 64 nt, Human
gggcccugcaaacacaaccaucuacacacaucuacacccccaagcacacacacaugguccgugc

SEQ ID NO: 9658 - RNA, 64 nt, Human
uggggaacuuaucgacaaugcaagcuccugggcccacccccagaccuccugaaccaaaagcucc

SEQ ID NO: 9659 - RNA, 64 nt, Human
agcuggcagcauacccagagauccggggcccccccacccccaaaucacgagugcagcuggagcu

SEQ ID NO: 9660 - RNA, 64 nt, Human
ccuuuauccucuaaugccccaaucucucucugaacacccccauucuccaccuguuggugggggg

SEQ ID NO: 9661 - RNA, 64 nt, Human
auucuccacuucuuguuccccacugacagccucccacccccaucucucccuccccugccauuuu

SEQ ID NO: 9662 - RNA, 64 nt, Human
ugugccaacuaagggcccccacuguaagcccccgcacccccacccccugcccagagcaacagcc

SEQ ID NO: 9663 - RNA, 51 nt, Human
agaacagcgucuccaucuaaccacccccaaauaccacccaagaagaaagaa

SEQ ID NO: 9664 - RNA, 64 nt, Human
uguugaagagccccagggcuccugugaguggauucacccccaaggucagaauggcaacuccugg

SEQ ID NO: 9665 - RNA, 64 nt, Human
uauuccccacccccggucccccauugaggcccgccacccccauaacuuugggagcgagggccca

SEQ ID NO: 9666 - RNA, 64 nt, Human
uuuuacaggaacugagguccagagaggacauggacacccccagcucugucagagucacacgggg

SEQ ID NO: 9667 - RNA, 64 nt, Human
acuccaaguggggcagcucuccguacaugcgccccacccccaugagccaguucagcccuacugg

SEQ ID NO: 9668 - RNA, 64 nt, Human
cuugaaaaacggugucauauuuagucagaggccccacccccaggaagcauggauggggaugaag

SEQ ID NO: 9669 - RNA, 64 nt, Human
gaucacaaagccaaccaugcccagccccucccagcacccccagccccacgaccaucguucugaa

SEQ ID NO: 9670 - RNA, 64 nt, Human; identical to SEQ ID NO: 9669

SEQ ID NO: 9671 - RNA, 64 nt, Human
augaagaaacuaacaagaaagcagggggaccugccacccccagccaaacccgagcaagggucgu

SEQ ID NO: 9672 - RNA, 64 nt, Human
gaucacaaagccaaccaugcccggccccucccagcacccccagccccacgaccaucguucugaa

SEQ ID NO: 9673 - RNA, 64 nt, Human
gcacaagaagacagaaaccuguaagcucugaccccacccccaccccuugagaggucagcggacc

SEQ ID NO: 9674 - RNA, 64 nt, Human
uugccagaggcaaacagccuuccaauugccccuccacccccagcugaggcccggucaccugguc

SEQ ID NO: 9675 - RNA, 64 nt, Human
aggagggcuaaggcuuuagcauugugaagcgcugcacccccaccaaccuuacccucaccgggga

SEQ ID NO: 9676 - RNA, 64 nt, Human
cuccucuuaugcccuugauugugccagcccaugccacccccauccugggcacaguuacacccuc

SEQ ID NO: 9677 - RNA, 64 nt, Human
guuagggcgccggagcccgggccuggaacgcccucacccccaaccuccagucuccgcguuuugc

SEQ ID NO: 9678 - RNA, 64 nt, Human
cgccccccuguccccagcccccagagcgcagggacacccccauccuaccccggcgccgggcgcg

SEQ ID NO: 9679 - RNA, 64 nt, Human
ggagcugggcucuaucccacacccacccccaccccacccccacccagccuccagaagcuggaac

SEQ ID NO: 9680 - RNA, 64 nt, Human
agaggcuuggaggagcugggcucuaucccacacccacccccaccccacccccacccagccucca

SEQ ID NO: 9681 - RNA, 64 nt, Human
gacccgauccugcagcucuuucuggaccuucaggcacccccaagcgugcagcucugucccagcc

SEQ ID NO: 9682 - RNA, 64 nt, Human
ccccucggcccccucuccaaaagaagggcaugggcacccccaggagaggauggccccaaaaacc

SEQ ID NO: 9683 - RNA, 64 nt, Human
gccccacccgaucccucaaaugggcucuuggaggcacccccaggggcagcccauuucucaaagu

SEQ ID NO: 9684 - RNA, 64 nt, Human
gcccuuuuaaguaucuuuuguacgcuuuucaccccacccccaaguccugggagaaaugcaggca

SEQ ID NO: 9685 - RNA, 52 nt, Human
aggggaaguugaaacccuagggcacccccaccaccucugcucgagagguccg

SEQ ID NO: 9686 - RNA, 64 nt, Human
cccagcacccagcaacuccaacuaacaagaaacucacccccaaggggcagucuggaggggcaug

SEQ ID NO: 9687 - RNA, 64 nt, Human
guggagagccgcaugucacugucagagaugagcccacccccacccuucccugggggcgauuagc

SEQ ID NO: 9688 - RNA, 64 nt, Human
ccuacgugagucacccaugaaauccagacauucucacccccagcggaugcacaggagccacuca

SEQ ID NO: 9689 - RNA, 64 nt, Human
ccccucugcuggccagagggucugcaucucagcccacccccaaccccaccguuuggggugagaa

SEQ ID NO: 9690 - RNA, 64 nt, Human
gcccagaggagcccagcggcccaagagcccgugccacccccagcccuggccccuccaauccucc

SEQ ID NO: 9691 - RNA, 64 nt, Human
ucucuugccucccgacccccgcacucccuucuagcacccccaaaggaaaagccagaggaacaau

SEQ ID NO: 9692 - RNA, 64 nt, Human
ggcccccacccucagcccgcuccugcccgcccagcacccccaggcccugggggaccugggguuc

SEQ ID NO: 9693 - RNA, 64 nt, Human
ccucagaggcuuugcccgaauugcuucguccugucacccccaucaccaauuuugagggcagcca

SEQ ID NO: 9694 - RNA, 64 nt, Human
uacaccuggacgugugggccacuuaagcccuccccacccccauccuauuccugaauaaaaccag

SEQ ID NO: 9695 - RNA, 64 nt, Human
ucuucucccuguucucugggccugagccuggggccacccccaagugccgacuuguuucucccag

SEQ ID NO: 9696 - RNA, 52 nt, Human
ccaaggugcugugcuugugaggcacccccaggacagcacacggugagggugc

SEQ ID NO: 9697 - RNA, 64 nt, Human
gauguggccuuuuggcuggucccgucccugaugucacccccaccccaccagccccuuucauccc

SEQ ID NO: 9698 - RNA, 64 nt, Human
cuggacuucuagggaucucagccguggcugaggccacccccagaggagccccugguccacagaa

SEQ ID NO: 9699 - RNA, 64 nt, Human
ugggcagugcccuggccugaaggcccacaacccccacccccaggacugcugcuggagccuggac

SEQ ID NO: 9700 - RNA, 64 nt, Human
aggacagcggcugccugucccuucuucacccccucacccccauaauuugucuagaucuauuucc

SEQ ID NO: 9701 - RNA, 64 nt, Human
cuguugucauugaauacggccucccgcagcaucccacccccaaaccaccgacucucauugccga

SEQ ID NO: 9702 - RNA, 59 nt, Human
acugcaagcuggccuccuaaggggcugugcacccccagcgggcuggccccagcaccuuc

SEQ ID NO: 9703 - RNA, 64 nt, Human
augacuacuguuuuuauuaaaacauaagaaacuacacccccaaaauaagacuuucauucacauu

SEQ ID NO: 9704 - RNA, 64 nt, Human
uugagcuaaccuugguuuuaaaaauuagcauuagcacccccauuauauuaauuuucagggauag

SEQ ID NO: 9705 - RNA, 64 nt, Human
ugagucuacagacuccagggcaaucaaaggucaccacccccaccccucaccucuaggauccuug

SEQ ID NO: 9706 - RNA, 64 nt, Human
uacgaaaaugaucuuuacaauguaucccagcuuucacccccacauggcaaugcagaguuguauu

SEQ ID NO: 9707 - RNA, 64 nt, Human
cgcccccggccguccccccucaucgccccgcgcccacccccaucgccccugcccccggcggcgg

SEQ ID NO: 9708 - RNA, 64 nt, Human
cccaccguggccccccacgccccauuaacccccacacccccauuccgcgcaauaaacgacagca

SEQ ID NO: 9709 - RNA, 64 nt, Human
cagggccgcugugagcaaagcugaccccagcccccacccccaguuaacacugcugcuucucuga

SEQ ID NO: 9710 - RNA, 64 nt, Human
caaggugcgcaacauggcugccagccccgccucccacccccaccccgaguccugagcucacuuu

SEQ ID NO: 9711 - RNA, 64 nt, Human
ccaccucgggcaagucccagucccaguccucggccacccccagcucuggaucccagggccagcu

SEQ ID NO: 9712 - RNA, 64 nt, Human
ggacaccccaggcugccaccccuccccacccguucacccccaggaugcuguugcuguaggacgc

SEQ ID NO: 9713 - RNA, 56 nt, Human
ugaaggccaagacacagugacacagccacccccacagccggagcccccgccgcucc

SEQ ID NO: 9714 - RNA, 64 nt, Human
gccaaggccgcaggacuggagggccaggccccgccacccccacgggagacccgggacagggcgu

SEQ ID NO: 9715 - RNA, 64 nt, Human
cagggagggagggugggcacugcugggcugaguucacccccagggcuggccagauggggccagg

SEQ ID NO: 9716 - RNA, 64 nt, Human
uucggcugagaccuguguaaccugcugcccccuccacccccaacccaguccuaccugucacacc

SEQ ID NO: 9717 - RNA, 64 nt, Human
cagagagggcauggaggcuccauacaaccucuuccacccccacaucuuucuuuguccuauacau

SEQ ID NO: 9718 - RNA, 64 nt, Human
acuuuauuuucuguuuuaugaguguguguccgcccacccccacccccuucaguguuaagugggg

SEQ ID NO: 9719 - RNA, 64 nt, Human
cuuaaucccugcaccugaguugguccucccucugcacccccaccaccuccugcccgucuggcaa

SEQ ID NO: 9720 - RNA, 64 nt, Human
caugggcccucugagcaacugugcagcacccuuucacccccaauuaaacccagaaccacugcuc

SEQ ID NO: 9721 - RNA, 64 nt, Human
auucauuuauuuauguauucaacuccaagggcgucacccccauuuucuacccauccccucaaua

SEQ ID NO: 9722 - RNA, 64 nt, Human
uccaggagccagggggugacuggagagacagacccacccccaagcagggcuccucuccccaggg

SEQ ID NO: 9723 - RNA, 64 nt, Human
cgcccuugccccugccccuaccccugccagcgcccacccccagccagggccccucgccuuccuc

SEQ ID NO: 9724 - RNA, 64 nt, Human
ucccugggccccccaccuuggugacucgccccaccacccccagcccugucccugccaccccucc

SEQ ID NO: 9725 - RNA, 64 nt, Human
uggagaagggcuaacaucagcucauugucaaggccacccccaccccagaacagaaccgugucuc

SEQ ID NO: 9726 - RNA, 64 nt, Human
uuagcccccagccggccugagugggggauauugacacccccagcuaaagcacaagcaccuuagu

SEQ ID NO: 9727 - RNA, 64 nt, Human
gugggggggccagcuccugggccuggggucuucucacccccacccccuuguccuggguaggccc

SEQ ID NO: 9728 - RNA, 64 nt, Human
uggcuuugggaugucucuugagcaaccagaauagcacccccaacucugcuccccaaaacccauc

SEQ ID NO: 9729 - RNA, 64 nt, Human
ggcuuuuuagccaacaacaaaaguguuuuccccccacccccacucgcccaccagggugaugcca

SEQ ID NO: 9730 - RNA, 64 nt, Human
ccaagggcaggguggguccagccuugagccccuccacccccaaauccuuccucuccucccaguc

SEQ ID NO: 9731 - RNA, 64 nt, Human
uuuucucucccuccagagcucccacgagcugaugcacccccaggcuucaaaccaccuggaaugc

SEQ ID NO: 9732 - RNA, 64 nt, Human
augugcuuugccgggaggagcggcggccgcagcccacccccacugcuguucgaaucaagcagga

SEQ ID NO: 9733 - RNA, 64 nt, Human
cacuggggugggagggggcagggggcuuggcucgcacccccacuuucgccuccuccagcuccug

SEQ ID NO: 9734 - RNA, 64 nt, Human
agcuccugggauccgggaguccaucccggcccagcacccccagcauccccguguauggcccccc

SEQ ID NO: 9735 - RNA, 64 nt, Human
cucccccuccuucccagcugccccucccugccagcacccccacgcccucauuacggcuccucuc

SEQ ID NO: 9736 - RNA, 64 nt, Human
ucccccugcccccaccacggccacuggccaucuccacccccagcugcuugugucccuccuggga

SEQ ID NO: 9737 - RNA, 64 nt, Human
gccugggggcucccuagccccucccagagcaucucacccccacccucauguucaggguggaugu

SEQ ID NO: 9738 - RNA, 52 nt, Human
augaggaccagcuuagcugacacacccccagcuggcccuccacccccaccuc

SEQ ID NO: 9739 - RNA, 64 nt, Human
accagcuuagcugacacacccccagcuggcccuccacccccaccucaagugccuuauucucaca

SEQ ID NO: 9740 - RNA, 64 nt, Human
ccaccacaccacucaggggcuggggcuucucucgcacccccagcaccucugucccaaaaccuca

SEQ ID NO: 9741 - RNA, 64 nt, Human
caggcucucuccccugcucucccaccucuaccuccacccccaccggccugacgcuguggccccg

SEQ ID NO: 9742 - RNA, 64 nt, Human
aaugggggugcaugcugggccuggcccccuggcccacccccacuuuccagggcaaaaagggccc

SEQ ID NO: 9743 - RNA, 55 nt, Human
ccagcgggcgcaggaagugacuucccacccccaggaccugacacaucucgucucc

SEQ ID NO: 9744 - RNA, 64 nt, Human
cccuauagccauaucucggccccuucccacucaccacccccaccccaggugcugggggucccuu

SEQ ID NO: 9745 - RNA, 64 nt, Human
ccacucucccagccugugaccaccgauguccacacacccccaaccacuuguccacacagcuacc

SEQ ID NO: 9746 - RNA, 63 nt, Human
uggaucacuucgauaagugagaccugcucagcccacccccacccauccucagcuaccccgaga

SEQ ID NO: 9747 - RNA, 64 nt, Human
gaaggagaggaaugggggagaggacgugagggaccacccccacccacacagcugccgcagcauc

SEQ ID NO: 9748 - RNA, 64 nt, Human
gccaucucaguauugccugugggggccaccccuccacccccacccccaagugccuucgcucugu

SEQ ID NO: 9749 - RNA, 64 nt, Human
ucaguauugccugugggggccaccccuccacccccacccccaagugccuucgcucuguuuuuau

SEQ ID NO: 9750 - RNA, 64 nt, Human
ggaggagccgugcaaucccaaccaggaugucuagcacccccauccccuuggcccuuccucaugc

SEQ ID NO: 9751 - RNA, 64 nt, Human
gcugaaggugcccaccugggccaccagaaggugacacccccagaaucccuccccagagacugca

SEQ ID NO: 9752 - RNA, 64 nt, Human
ugacuuuggggacagggggugggaaggggauggacacccccagcugacuguuggcucucugacg

SEQ ID NO: 9753 - RNA, 64 nt, Human
aggugucagugcggagaggcucugggccagaccucacccccagugacuuccgauugaggccaaa

SEQ ID NO: 9754 - RNA, 64 nt, Human
guuggucugucucuucccaccuuccaucugcacacacccccaagguaaggguacagcccggcug

SEQ ID NO: 9755 - RNA, 64 nt, Human
caccacagggauccccaggaugcccacuucccuccacccccacaccccagccgugucccuaacc

SEQ ID NO: 9756 - RNA, 64 nt, Human
cagggacccccugggucggcuucugucccugucacacccccaaccccagggaggggcugucaua

SEQ ID NO: 9757 - RNA, 64 nt, Human
cccuuuggaaauggugcagcacucuggcauuuaucacccccaccuggguccccugcaaccuccc

SEQ ID NO: 9758 - RNA, 64 nt, Human
cguccccuccgccgugccggcggcagccccacuucacccccaacuucaccacccccugucccau

SEQ ID NO: 9759 - RNA, 64 nt, Human
agaaaaaucacucgcccuucugagaggcccaagacacccccaacagauaccagcauguacauag

SEQ ID NO: 9760 - RNA, 64 nt, Human
cauagcucugacccuggaaugggguugguuuggacacccccagggaucugagcccugacccuuu

SEQ ID NO: 9761 - RNA, 64 nt, Human
agcccugacccuuugugacugcugaccccugagccacccccacucccacagggagccccggcca

SEQ ID NO: 9762 - RNA, 64 nt, Human
caguguugugagugcaugugaaaugggggauccccacccccagugcccuuccccuuccuggggc

SEQ ID NO: 9763 - RNA, 64 nt, Human
guuuauccauuuaucuuaauugaugucuguacuccacccccauuuuuaaauauuaaaaagcugc

SEQ ID NO: 9764 - RNA, 64 nt, Human
agcugcucacuuuugccggguuugguggccacuucacccccaacccugucucacccccauuauc

SEQ ID NO: 9765 - RNA, 64 nt, Human
ggguuugguggccacuucacccccaacccugucucacccccauuaucccuccucaauuggaggc

SEQ ID NO: 9766 - RNA, 64 nt, Human
caccguuccggaagagcuggcaaaaggagccucacacccccaaggaggggacggugccacuucc

SEQ ID NO: 9767 - RNA, 64 nt, Human
acuguugcccuagcccaccuggugccgugggagccacccccaggugcugggggcacagccccuc

SEQ ID NO: 9768 - RNA, 64 nt, Human
gcugagcccagaccccggggucuggccgaauccucacccccagggcaguguuuuuggucugcca

SEQ ID NO: 9769 - RNA, 64 nt, Human
agcuacgccaggggaaaagagaguuaaggacacucacccccacccacgcacacacacaaggcag

SEQ ID NO: 9770 - RNA, 64 nt, Human
caugugagcccggaacgcccgccugcccgccgcccacccccacugacccccgcugccuccccca

SEQ ID NO: 9771 - RNA, 64 nt, Human
gggaccugggagacgccccgagguguuugugcuucacccccagacgucagccucgaaggcagga

SEQ ID NO: 9772 - RNA, 64 nt, Human
gcuccuucucaggccuccaacugugccccauuuccacccccaaauaccuccccaggaggcaccu

SEQ ID NO: 9773 - RNA, 64 nt, Human
gaacaccucccucugaacuaaucccggagcaccccacccccagcgagucccaccuggaccucuu

SEQ ID NO: 9774 - RNA, 64 nt, Human
ugccagaucccugcauuucaagcacuacgccuuccacccccaggcacuggaucccagauuccca

SEQ ID NO: 9775 - RNA, 64 nt, Human
cagagagggcauggaggcuccacgcaaccccuuccacccccacaucuuccuuugucuuauacau

SEQ ID NO: 9776 - RNA, 64 nt, Human
cccauuccucaucccucacucccacccccacccccacccccaggaguugagugcauggaucugu

SEQ ID NO: 9777 - RNA, 64 nt, Human
uucccacccauuccucaucccucacucccacccccacccccacccccaggaguugagugcaugg

SEQ ID NO: 9778 - RNA, 64 nt, Human
ccuugcuucccacccauuccucaucccucacucccacccccacccccacccccaggaguugagu

SEQ ID NO: 9779 - RNA, 64 nt, Human
cuucuaacucagagcugaugaacaaaagcccccccacccccaaugccugccuccucacuccucc

SEQ ID NO: 9780 - RNA, 64 nt, Human
aauaaaguuaucaaggacaaugccaaggguggggcacccccaaauuugacucugggagacucag

SEQ ID NO: 9781 - RNA, 64 nt, Human
cacaccccccccccaccgaggccuaggccccugccacccccaagacugggaggggacuucuuuu

SEQ ID NO: 9782 - RNA, 64 nt, Human
uuuuucggcuaaaaagaaugcagagaugugcccccacccccacccucgaccacccccgauggga

SEQ ID NO: 9783 - RNA, 64 nt, Human
agaggggcucacgcuuaacuccagcccccacccacacccccaucccacccaaccacaggcccca

SEQ ID NO: 9784 - RNA, 64 nt, Human
gccagagggccccagaguuccuugcaucuaauuucacccccaccccacccuccaggguuagggg

SEQ ID NO: 9785 - RNA, 64 nt, Human
gccaggagugucucuaagagauccaggagggagccacccccaaggacccugccagccacagacc

SEQ ID NO: 9786 - RNA, 64 nt, Human
caccaggagggcagacccagccacauaccacaaccacccccaagccucacacucccuugucuuu

SEQ ID NO: 9787 - RNA, 64 nt, Human
cuccuccagccuccuggccucccagccacuuccucacccccagugccuggacccggaggugaga

SEQ ID NO: 9788 - RNA, 64 nt, Human
uggaggagaggagugggguuuguugaugaaccuccacccccaccccacccccgcacgccuguaa

SEQ ID NO: 9789 - RNA, 64 nt, Human
ucagaggccuuaugaggguccucuacuucaggaacacccccaugacauugcauuugggggggcu

SEQ ID NO: 9790 - RNA, 64 nt, Human
ccugaaccccccccccccgccuuuuuuuaaaauucacccccauccacaguugucaguugugaag

SEQ ID NO: 9791 - RNA, 64 nt, Human
ugcauccccucugggggcaggagcccacccccagcacccccaucuguuaauaaauaucucaacu

SEQ ID NO: 9792 - RNA, 64 nt, Human
gcauccaccugcauccccucugggggcaggagcccacccccagcacccccaucuguuaauaaau

SEQ ID NO: 9793 - RNA, 64 nt, Human
ggcccacuccaguuccagaccacccuccaugcuccacccccaggcgguuuggaccccaccacug

SEQ ID NO: 9794 - RNA, 64 nt, Human
uaacagggcacaccccucuaguuucaugggcgagcacccccaucugccaccucagacugacaca

SEQ ID NO: 9795 - RNA, 64 nt, Human
gcacagaagucgcaggcagccucucagaaaguuucacccccagaggacgaagaggucaagaacc

SEQ ID NO: 9796 - RNA, 64 nt, Human
uugaaccccaguacugacagccuccuuaaaguuucacccccagagggagccgagacucggaaag

SEQ ID NO: 9797 - RNA, 64 nt, Human
gccccuuaaguccucuugaaauaaacauaggucacacccccaaagcaaaagaguaacagacauu

SEQ ID NO: 9798 - RNA, 64 nt, Human
ggcaauuuucccuucgccugccaugggcuucacccacccccacgccagggguaagugguuguga

SEQ ID NO: 9799 - RNA, 64 nt, Human
uuaaacuugccuguucagagcacucauuccuucccacccccaguccuguccuaucacucuaauu

SEQ ID NO: 9800 - RNA, 64 nt, Human
uuggcccaccugaggccccaggugggaacauggucacccccacucugcauacccucaucaaaaa

SEQ ID NO: 9801 - RNA, 64 nt, Human
caacccaggguccgaaugagcccugugaggcccacacccccaggugaaccugagccagagccgu

SEQ ID NO: 9802 - RNA, 64 nt, Human
agcaagccgggccguccguguuccauccuccacgcacccccaccuaucguugguucgcaaagug

SEQ ID NO: 9803 - RNA, 64 nt, Human
ggaaauuuccaccccaguccccuccccagggaaccacccccaguaaccauccuggggaguuuaa

SEQ ID NO: 9804 - RNA, 64 nt, Human
cuguccauuuauuuaagcccccauaggugcccuucacccccaaaaccagcuguacagaaucuuu

SEQ ID NO: 9805 - RNA, 64 nt, Human
gauggaaauaggaagcgugggaggguccaguugccacccccaaaaauuccaaugauucuugaca

SEQ ID NO: 9806 - RNA, 64 nt, Human
ccuuccccaggccccucggcucccucccagaucccacccccagccccacugguugccaaacacu

SEQ ID NO: 9807 - RNA, 64 nt, Human
cagcacuggcuuuucuuuucagccccugacaggccacccccacuccucugcaugucuuggagag

SEQ ID NO: 9808 - RNA, 64 nt, Human
cgccgagaggccugccuuuugccuggcccaggcucacccccaccuugggccucaccuccuccag

SEQ ID NO: 9809 - RNA, 64 nt, Human
ucaugaggaacaacugaccuguuuccuccaccuccacccccaccccuuaacuuggguaccccuc

SEQ ID NO: 9810 - RNA, 64 nt, Human
uuaagagaacuccaaauagcccaagaggguggugcacccccaacuucauagggguagaggcucc

SEQ ID NO: 9811 - RNA, 50 nt, Human
cugagauccgccuggagugacacccccagaccucuggaggagacaaugga

SEQ ID NO: 9812 - RNA, 64 nt, Human
uccaccccaaccaucugaaccauuccugucuucucacccccaacgaugccaaucacgacaacuu

SEQ ID NO: 9813 - RNA, 64 nt, Human
ccaggaggcuggugccagggagacaggcccaacccacccccauuugcacugagaagagaaguuu

SEQ ID NO: 9814 - RNA, 64 nt, Human
cccacgauggcccccauugcccucaucacccugacacccccacauucucuccucuggaccccca

SEQ ID NO: 9815 - RNA, 64 nt, Human
cuugcccaguagaauggacugaucuaugugcacacacccccaucacauggaaugggcuggucua

SEQ ID NO: 9816 - RNA, 64 nt, Human
aucuugagagcccuaauacuaaaagaugggcacccacccccaccaagggaagacugccccauuc

SEQ ID NO: 9817 - RNA, 64 nt, Human
accauaggaucuugacuccaacagcggcaacccccacccccauugugguccguccuuaacccau

SEQ ID NO: 9818 - RNA, 64 nt, Human
uggccaacccacugggguagggaucaaagccagccacccccaccccaacacacucggugucccu

SEQ ID NO: 9819 - RNA, 64 nt, Human
aagcaaguucucuugaaaggaaaucuaaacagugcacccccauggcugccacggaguauaagga

SEQ ID NO: 9820 - RNA, 64 nt, Human
cauucccagagagccacgggggagggaucacccucacccccaacacccucuuccugagggcugu

SEQ ID NO: 9821 - RNA, 64 nt, Human
ucuaguaggucugcacacauaacacacaucaguccacccccauugugaauguuguccuguguca

SEQ ID NO: 9822 - RNA, 64 nt, Human
ugccugagcgaguuuguagugacucacugcacagcacccccagacuagcaugugguucuauauu

SEQ ID NO: 9823 - RNA, 64 nt, Human
cccuccacgaggugugacuaacuaugcaauaauccacccccaggugcagccccagggccugcgg

SEQ ID NO: 9824 - RNA, 64 nt, Human
aaggguaggcacgaagcaauuuguugcugcuugucacccccaaguccccguggagguucuguau

SEQ ID NO: 9825 - RNA, 64 nt, Human
caauccccacguugagcugucuagcaugagcacccacccccacagcgcccugcacccggccgcu

SEQ ID NO: 9826 - RNA, 64 nt, Human
cuggugacggcacagcccucacagcucaaacgcccacccccacucccaccaucugcagguggug

SEQ ID NO: 9827 - RNA, 64 nt, Human
uccugucacccccuccgugccacgcacugaaggccacccccacccaccugggaaacuaagaacu

SEQ ID NO: 9828 - RNA, 64 nt, Human
cguguccaccuggugccggcgugauugccccgggcacccccagccagaacacgcagugccagcc

SEQ ID NO: 9829 - RNA, 64 nt, Human
aacgagaacuuguccaugugccaagaggguggcgcacccccacuccauggggacagaagcucca

SEQ ID NO: 9830 - RNA, 64 nt, Human
gcgcuuggcgcuccuccuccguccuaucccaacucacccccaaacccccaucccuuccccaccu

SEQ ID NO: 9831 - RNA, 64 nt, Human
ucaggccuuaggucuggccauucacacacacacacacccccacaccccacucccacacacaguu

SEQ ID NO: 9832 - RNA, 64 nt, Human
gaguggcaggcccuguccuggguacagguggagccacccccaggaguugcguguguuuuucuua

SEQ ID NO: 9833 - RNA, 64 nt, Human
ccuuauaucucucucuuuuucacucucuuccucccacccccaagacugaguuuuggggggcaag

SEQ ID NO: 9834 - RNA, 64 nt, Human
cccugucuucuccccuaggugguuccugagcccccacccccaaucccagugcuacaccugaggu

SEQ ID NO: 9835 - RNA, 64 nt, Human
uccagccuaggcccccugcaaggcuggcagcccccacccccaccccccaggccgccuugagaag

SEQ ID NO: 9836 - RNA, 64 nt, Human
aaagaagggaacuaagagcaggucuuucaagccacacccccaccugcggauggauggguuucuc

SEQ ID NO: 9837 - RNA, 64 nt, Human
gugaaaagcaguuuagcugcaucugucuccccaccacccccaccccgggaggggcuuauguuac

SEQ ID NO: 9838 - RNA, 64 nt, Human
aagggagaagaaauccauaacacccccaccccaacacccccaagacagcagucuucuucacccg

SEQ ID NO: 9839 - RNA, 64 nt, Human
uguugcagagacgcaagggagaagaaauccauaacacccccaccccaacacccccaagacagca

SEQ ID NO: 9840 - RNA, 64 nt, Human
ggagccuggcuccguccaggagccugugccuccucacccccagcuuugcuaccaaagcaccuua

SEQ ID NO: 9841 - RNA, 64 nt, Human
ucuugcuucucauagccccggugugcggugcauacacccccaccuccugcaauaaaauaguagc

SEQ ID NO: 9842 - RNA, 64 nt, Human
ucuugcuucuaauagaccugguacaugguacacacacccccaccuccugcaauuaaacaguagc

SEQ ID NO: 9843 - RNA, 64 nt, Human
uuuugcuucucauagcccugguacaugguacacacacccccaccuccugcaauuaaacaguagc

SEQ ID NO: 9844 - RNA, 64 nt, Human
ugcucccaacccauucacuacaggugaaggcucucacccccaucccugggggccuugggugagu

SEQ ID NO: 9845 - RNA, 64 nt, Human
gcugagcugccgggccuccucgaggccccuaagccacccccagaggucccaucugaagcuggag

SEQ ID NO: 9846 - RNA, 64 nt, Human
ccuuuacccaggaaaucuccggagccaacaccaccacccccagggggucuccccaccccacccc

SEQ ID NO: 9847 - RNA, 64 nt, Human
cuccccagguguauuucagcagaccccggggacccacccccacugggccugcuggccucccucg

SEQ ID NO: 9848 - RNA, 64 nt, Human
aagccaccccuggagucaccuguguguucaguggcacccccagccuggguccccuccucccaau

SEQ ID NO: 9849 - RNA, 64 nt, Human
gguuugggggcuucccugggccucagccuccaggcacccccaggauucccagagagacgcugug

SEQ ID NO: 9850 - RNA, 64 nt, Human
gcuccagacagcaagagcccaggugcacugcucacacccccaccugcauuuugaagucauauua

SEQ ID NO: 9851 - RNA, 64 nt, Human
ugagaauccuggaggaauacacaauucaucguugcacccccaccucagaguguaaucgcauuuc

SEQ ID NO: 9852 - RNA, 64 nt, Human
ugucccacugaagccccgcgccuccuccugccagcacccccagcaccugcuagcaggaggcacc

SEQ ID NO: 9853 - RNA, 64 nt, Human
cauugcccacaccugccucugaacugcugcuggucacccccacccccgggugccugugaccggg

SEQ ID NO: 9854 - RNA, 64 nt, Human
acgcaaugaccagcaggaaccggaagcccugggucacccccacucugccucauuucugccucca

SEQ ID NO: 9855 - RNA, 64 nt, Human
aauagaacacagcaauaacugggcuuccuguccccacccccaccccagcagugcucucuggcac

SEQ ID NO: 9856 - RNA, 64 nt, Human
ccucccucuuaacccauguaggugccagagaaaccacccccacuccaugagaagaggcucagac

SEQ ID NO: 9857 - RNA, 64 nt, Human
ucagcugccucucagggacugcacuguuccucuucacccccagguuccugcuaagaucccacgg

SEQ ID NO: 9858 - RNA, 64 nt, Human
uuccccagccucgaagccaugggggcccccucgccacccccagccccuugggcuaucgaaguau

SEQ ID NO: 9859 - RNA, 64 nt, Human
ccaccuuccuccaggugugggagccuugccuuaucacccccaucaggucugcaugccagggugc

SEQ ID NO: 9860 - RNA, 64 nt, Human
ugcugccuggguccuggcccuccucccccaucugcacccccaucauagguagagaccccacccu

SEQ ID NO: 9861 - RNA, 64 nt, Human
ggcagggcucagggagcaggaggcugcauccguccacccccaggcgugggggacaaaagccaaa

SEQ ID NO: 9862 - RNA, 64 nt, Human
cagcuucugagcuagagcuguacugccucacguacacccccaccucuguaaaugguccuugauu

SEQ ID NO: 9863 - RNA, 64 nt, Human
guagagcgggaaccuuccugagguguccuugggccacccccaaguguugggccaucugccaaga

SEQ ID NO: 9864 - RNA, 64 nt, Human
caccuccaugccaggcaacagagggccacagaaccacccccacggcucacuccuuggucugggg

SEQ ID NO: 9865 - RNA, 64 nt, Human
gagaauaagagugcacuacagcccaggcuuaugccacccccagcccaccugccucaccacccug

SEQ ID NO: 9866 - RNA, 64 nt, Human
cauaucaaguccucgaugguaucugagcugcccacacccccaccugccaaggccccacagagcc

SEQ ID NO: 9867 - RNA, 64 nt, Human
auccuucagguccccuggcccuuccuucacccaccacccccaucaucaccgauucuuccuugcc

SEQ ID NO: 9868 - RNA, 64 nt, Human
uacgcucugguucagcugccucugcacccccucccacccccagcacacacacaaguuggccccc

SEQ ID NO: 9869 - RNA, 64 nt, Human
gggguaguuggcuuggccuucucuuuggugaucccacccccagccauuugcauugcuggcccag

SEQ ID NO: 9870 - RNA, 64 nt, Human
cgcagcucgcgaggcaccucuccucguccccacccacccccacauuugcacaccuuccacaggg

SEQ ID NO: 9871 - RNA, 64 nt, Human
accuaauagcuguuccuuaggccccacuccaugccacccccaccagcuggaggacccagccuca

SEQ ID NO: 9872 - RNA, 64 nt, Human
gcucaggccacagccggagccuccgcauugcccccacccccauuuuccagggggguuguaauuu

SEQ ID NO: 9873 - RNA, 64 nt, Human
uguguguguguguguguguguggugcaggagugccacccccagggcccugucaaccucucuuuu

SEQ ID NO: 9874 - RNA, 64 nt, Human
cagaggcuccuuucugccuccauggcuauccauccacccccacagaccccguuccuccagccug

SEQ ID NO: 9875 - RNA, 64 nt, Human
cccagcuccugagcacuucugaggggguggguuccacccccaggagggcggggguggguggagc

SEQ ID NO: 9876 - RNA, 64 nt, Human
ggaggccccgcugaaaccugggcugcccuucccccacccccacggcucuccugguugaggaggg

SEQ ID NO: 9877 - RNA, 64 nt, Human
ccuccccaggcccaacucugcuagcuucccagaccacccccaucgagugcggagagagugggag

SEQ ID NO: 9878 - RNA, 64 nt, Human
gugaggccccggcggcucagggcggggcuggccccacccccaugaccacugcccuggagguggc

SEQ ID NO: 9879 - RNA, 64 nt, Human
ucucuuaucuaccuaugaccugcgagcugcccaccacccccaguuguugcgccuuuccagacag

SEQ ID NO: 9880 - RNA, 64 nt, Human
cugugucagagccugggggacgagucacccagcucacccccacaugcucaaaacagucaccaag

SEQ ID NO: 9881 - RNA, 64 nt, Human
gccagguccucccugauggacgccugccgcccgccacccccaucuccaccccaucauguuuaca

SEQ ID NO: 9882 - RNA, 64 nt, Human
cuggaagaguuuuccgccucuuugugaugcugaacacccccaagguucuccccuccccccgcug

SEQ ID NO: 9883 - RNA, 64 nt, Human
ugagaggagcugaggugcuacccggagccccauucacccccaccugcccacuugggaaucugag

SEQ ID NO: 9884 - RNA, 64 nt, Human
gacucagaccaggaagcugugggcccuccugcuccacccccaucccacucccacccaugucugg

SEQ ID NO: 9885 - RNA, 64 nt, Human
gggagcagugggcaguucaugguguuagggcacucacccccacagacuggcaaacccugcagga

SEQ ID NO: 9886 - RNA, 64 nt, Human
uuuucacugcuaggacaagcucagcuguugaggacacccccaccccaaauuucaguucuuacgu

SEQ ID NO: 9887 - RNA, 64 nt, Human
agcugggcuuccagggcuaggccccugccgcucccacccccacccaucugggccccggguucaa

SEQ ID NO: 9888 - RNA, 64 nt, Human
acucucagaugcagggcccuuggcucuggccucucacccccaaggcugucucuggcccugccga

SEQ ID NO: 9889 - RNA, 64 nt, Human
caucaacuguaucugauuucacuaauuuugacagcacccccaguaggguaggauuguguaugag

SEQ ID NO: 9890 - RNA, 64 nt, Human
gggauggagagaguugcucugggaguugggguaccacccccagggcaggauggggacaggauca

SEQ ID NO: 9891 - RNA, 64 nt, Human
uauuccucuguccuaaaccguccccuccuucccucacccccagcacagggggauucugagcagu

SEQ ID NO: 9892 - RNA, 64 nt, Human
ugcaggugccagggcccaccccagccucgccugucacccccacucccgccucagggccaggccc

SEQ ID NO: 9893 - RNA, 64 nt, Human
ucuagacaacaggcaggaaggaugaaccucagggcacccccagguggugcggaaagccaggcag

SEQ ID NO: 9894 - RNA, 64 nt, Human
ugaggcagaggaguugcucagaggcucacaugggcacccccauugguucgugugagcagcugcc

SEQ ID NO: 9895 - RNA, 64 nt, Human
gguaccggaugcagaccccacccugucugcaggccacccccaccucccugcagcuuugaggcug

SEQ ID NO: 9896 - RNA, 64 nt, Human
ccccucuccugggcgacgucaguggaccuuccugcacccccagccuggaauguaaaucagcugu

SEQ ID NO: 9897 - RNA, 64 nt, Human
auuauaaaggccugacccucuauugucccaucuucacccccauuccagagcagaggagucucug

SEQ ID NO: 9898 - RNA, 64 nt, Human
ucaaucucccaaagccaaguuuaccugcuguucucacccccaaugaggucuuaggcagauucuu

SEQ ID NO: 9899 - RNA, 64 nt, Human
ugauuuucuguuacacuguauaguaguccuauggcacccccaccccaucccuuucgugccacuc

SEQ ID NO: 9900 - RNA, 64 nt, Human
ccccaccccaucccuuucgugccacucccguccccacccccaccccaguguguauaagcuggca

SEQ ID NO: 9901 - RNA, 64 nt, Human
ugguacuguuuuguuuguuaauaaagugcacugccacccccaaugcagacucgacuccuguauu

SEQ ID NO: 9902 - RNA, 64 nt, Human
agagcugcuggggauucuggccuagucccuuccacacccccaccccuugcucucaacccaggag

SEQ ID NO: 9903 - RNA, 64 nt, Human
uuggggcaggaugauuuuggccucauuacuuuaccacccccacaccuggaaagcauauacuaua

SEQ ID NO: 9904 - RNA, 64 nt, Human
gaaaaagagaauuuaggcaacuccacucccccuucacccccaacccuguauucuacucucccga

SEQ ID NO: 9905 - RNA, 64 nt, Human
cagguggcuauuugcccugcagagcugggaguuucacccccaccccccacccuguucucuccuu

SEQ ID NO: 9906 - RNA, 64 nt, Human
ucagucaaaaauuuaaaaucuuaaauguguaagucacccccaccaaaaacaaaagagaagaaaa

SEQ ID NO: 9907 - RNA, 55 nt, Human
acuucucugagccacuguaagggaccacccccagguuucagugaacccuuaccua

SEQ ID NO: 9908 - RNA, 64 nt, Human
aagauacugagccucucaccucccagcccucagccacccccaucccugccccuucugagacuca

SEQ ID NO: 9909 - RNA, 64 nt, Human
agcuacacaguaucaaaugaaugggucaauucagcacccccaaauuuaauucuguggggaaaaa

SEQ ID NO: 9910 - RNA, 64 nt, Human
agagucccagacaccgguuuuccuagaagccccucacccccacuggcccacugguggcuagguc

SEQ ID NO: 9911 - RNA, 64 nt, Human
uagggccccguggccggcaggccggccccugccccacccccacccacgggugucccugcccacu

SEQ ID NO: 9912 - RNA, 64 nt, Human
uagccgagcugguccuaggccccgccuagugccccacccccacccacagugcugcacuccuccu

SEQ ID NO: 9913 - RNA, 64 nt, Human
uggccugcucaggcuucccacccugugcggggcacacccccaggaagggacccuggacacggcu

SEQ ID NO: 9914 - RNA, 64 nt, Human
ccuuucccgggcccucagcccucgggccgggcaccacccccaguccccccaguaaaagccucca

SEQ ID NO: 9915 - RNA, 64 nt, Human
aaaaagaaaaguguuuuuagaaaugcguacaagucacccccaaauccuauugcuuaucuugggu

SEQ ID NO: 9916 - RNA, 64 nt, Human
cugagacaguaggaaggggggcuuggcuuuggcucacccccacuagagcauuuuuucaugcauu

SEQ ID NO: 9917 - RNA, 64 nt, Human
acugauggggugacuucugcuuugguccuuccaccacccccaccaaguaaaccaccuguggcag

SEQ ID NO: 9918 - RNA, 64 nt, Human
gggaucuguacccaggaccuggagaauaccaccccacccccagcccauaauugggacccagagc

SEQ ID NO: 9919 - RNA, 64 nt, Human
uccagucagaguagaugaugaggcccaugccccucacccccacgccccgccccuacaaccuaag

SEQ ID NO: 9920 - RNA, 64 nt, Human
uagccccccuagcagcauuccaucccagccagagcacccccaccaucaggccagucaacugcac

SEQ ID NO: 9921 - RNA, 64 nt, Human
ccccauguccucccugccuugggacccguccucucacccccagcaguugccaugggguuuccuu

SEQ ID NO: 9922 - RNA, 64 nt, Human
ccggccaccagggggcuccuacucccacccccaccacccccagucaccauugucaccacacuca

SEQ ID NO: 9923 - RNA, 64 nt, Human
cccuggaucccggccaccagggggcuccuacucccacccccaccacccccagucaccauuguca

SEQ ID NO: 9924 - RNA, 64 nt, Human
gggcuuauaaugagaagcagcaguucccugcuugcacccccacauccaaaggauguggagcucu

SEQ ID NO: 9925 - RNA, 64 nt, Human
uccugaguuuugguuuguaaucuuuugucccucccacccccacagaagauuucuaaguagggug

SEQ ID NO: 9926 - RNA, 64 nt, Human
aucucgcucaucccugggcgcgccucccaccuuccacccccaacucccuuccaggguucgccuc

SEQ ID NO: 9927 - RNA, 64 nt, Human
gugagugcauguacuaucuuaucucagauauuugcacccccaaucugcccccaacucccaaaag

SEQ ID NO: 9928 - RNA, 64 nt, Human
acaguucaucaguucauucccaaguauuuauugucacccccaaacaucucuggaguacuacugc

SEQ ID NO: 9929 - RNA, 64 nt, Human
gcagaugcauccugcaucccagucccccucccagcacccccagccauccccccugucuuccccc

SEQ ID NO: 9930 - RNA, 64 nt, Human
cugcggcuaguccggcagcgaccuagaugggguccacccccauuccugcucaagcaugggcacc

SEQ ID NO: 9931 - RNA, 64 nt, Human
cuauauguauauaucugguuauucaaagcuuccccacccccagucaucuaaauuuuucagguau

SEQ ID NO: 9932 - RNA, 64 nt, Human
cuuguuccccacccccacccccacucccgccccgcacccccaaguugggacgccuuguuuagcu

SEQ ID NO: 9933 - RNA, 64 nt, Human
cggccugcgcucguccacccuuguuccccacccccacccccacucccgccccgcacccccaagu

SEQ ID NO: 9934 - RNA, 64 nt, Human
gagcaccggccugcgcucguccacccuuguuccccacccccacccccacucccgccccgcaccc

SEQ ID NO: 9935 - RNA, 64 nt, Human
ggguguggcgcauggcgcugggguuggaauggggcacccccaagucuguccccaggcucugccc

SEQ ID NO: 9936 - RNA, 64 nt, Human
ccaggcugagugccugggucagccaaaccccuggcacccccagggugacggguggcgagcuguu

SEQ ID NO: 9937 - RNA, 64 nt, Human
aucaccacacaauaggaucccccuucuugcccuccacccccauaagauugugaaggguuuacug

SEQ ID NO: 9938 - RNA, 64 nt, Human
uggcaagcagcagugauugggggaggggacaggaucuaacaaugucacuugggccagaauggac

SEQ ID NO: 9939 - RNA, 64 nt, Human
auagacauuacuugcauuaucuccuaucaguccuucuaacaaaacuucaauuaccagaugaacu

SEQ ID NO: 9940 - RNA, 64 nt, Human
uuugcaaaccaagggagauuucuuagcaaaugagucuaacaaauaugacaucugucuuuggcac

SEQ ID NO: 9941 - RNA, 64 nt, Human
uauaugacuucagaaauguuaaaauagacuaaccucuaacaacaaauuaaaagugauuguuuca

SEQ ID NO: 9942 - RNA, 64 nt, Human
aaggcuaaagucagaucuagaguucugccacaggucuaacaaucaagucuuuagauggaaggaa

SEQ ID NO: 9943 - RNA, 64 nt, Human
gaauaugguuggcauuaaauuuagcauuucauuaucuaacaaaauuaauauaaauuccaggaca

SEQ ID NO: 9944 - RNA, 64 nt, Human
gccaccaugcccagccccaaagccucuuaauugcucuaacaagaugaguggggaaaagauuaua

SEQ ID NO: 9945 - RNA, 64 nt, Human
guuagauuugggauggcgcccaauaacuugcauuucuaacaaguucccaggugaugcugugcug

SEQ ID NO: 9946 - RNA, 64 nt, Human
cauguaaguauauaaacauuuagaaguguaccuaucuaacaaacuauuaugaaauacuuucaaa

SEQ ID NO: 9947 - RNA, 64 nt, Human
uguucuuguucuauauuuuguuuugaaaaugaugucuaacaaccaugauaagagcaaggcuguu

SEQ ID NO: 9948 - RNA, 64 nt, Human
aaccccggcuauuuggagacggaaaaacuggaauucuaacaaggaggagaggagacuaaaucac

SEQ ID NO: 9949 - RNA, 64 nt, Human
aaguggcaugggcaauaguauauaaccauacuuuucuaacaaucccuggcugucugugagcagc

SEQ ID NO: 9950 - RNA, 64 nt, Human
gauucugguucugacagggccacaagcuaggaucucuaacaaacgcagaaggcuuuggcucguc

SEQ ID NO: 9951 - RNA, 64 nt, Human
guuggugaugcuucugagacucagaaugguuuacucuaacaaaacacugugcugucuaucccuu

SEQ ID NO: 9952 - RNA, 64 nt, Human
uccuauggaaaaaagagagacauguagaagaaccucuaacaagguuaaugugcaugcccaaggu

SEQ ID NO: 9953 - RNA, 64 nt, Human
uccugguuuuguuuggauuuuggcaucuuguuuuucuaacaacaaacaauggagaaaaagaauu

SEQ ID NO: 9954 - RNA, 64 nt, Human
ugaaauuaaaccuaugcucucaauucuuuuauauucuaacaauaaauaaaaaagaaaagauuac

SEQ ID NO: 9955 - RNA, 64 nt, Human
ucuucagauggcuugaacacgugccauuauaguaucuaacaaaaaguggcauaaaauauuacaa

SEQ ID NO: 9956 - RNA, 64 nt, Human
aaguuguuugugcuuuaggcaaacauuaaccagcucuaacaagaaaaaugucuagauuuacaca

SEQ ID NO: 9957 - RNA, 64 nt, Human
uaaaguuaugcuggcagauucgccaagagaagaaucuaacaaacggcaaagaacuuacugauuc

SEQ ID NO: 9958 - RNA, 64 nt, Human
cuaagagagcugccaucgcugugaugcugggaguucuaacaaaacaaguuggaugcggccauuc

SEQ ID NO: 9959 - RNA, 64 nt, Human
acaacacuguuuacauaaaaaccauuuuucuaauucuaacaaguuagaaugugaggaaggaaug

SEQ ID NO: 9960 - RNA, 64 nt, Human
aaucauuguaaaccuuuuuuuuuuucuucuccacucuaacaaaaguaaaagaacaaaacuuuug

SEQ ID NO: 9961 - RNA, 64 nt, Human
cagcugaggcaguguauauacccuuagggccauuucuaacaaagccuuggccacucccagcaca

SEQ ID NO: 9962 - RNA, 64 nt, Human
ugacaccguugccauaaaucccugauacucaaagucuaacaagaaagacauggaaaauuagcag

SEQ ID NO: 9963 - RNA, 64 nt, Human
uuccauucaggaugccggcuuuauuaacaaaaacucuaacaagucaccuccacuaugugggucu

SEQ ID NO: 9964 - RNA, 64 nt, Human
agacuucaugccaaauucacuuuuuagcauuauaucuaacaaaucaagagaauccuuaauauug

SEQ ID NO: 9965 - RNA, 64 nt, Human
cuagauuucaagcuaauuuucuuuuucugaagccucuaacaaaugaucuaguucagaaggaagc

SEQ ID NO: 9966 - RNA, 64 nt, Human
cggccaggcugggaacgggcaccaagcagccgccucuaacaaacaccaugguccguggaaguuc

SEQ ID NO: 9967 - RNA, 64 nt, Human
gauggaauccuguggacuaaugugccaccaguuuucuaacaaggguguacauaaaauggauuug

SEQ ID NO: 9968 - RNA, 64 nt, Human
uguucacauuuaucuuuuucaagccacaucuuccucuaacaaaucucucaguaugcgauugguc

SEQ ID NO: 9969 - RNA, 64 nt, Human
aggaucuuggguaugucuuggaauuaacuuguccucuaacaaucuucaugggguauggcucucu

SEQ ID NO: 9970 - RNA, 64 nt, Human
uguuguaccuguauccagaucuucuuuucacuguucuaacaaucuaacacuuucauagaaucau

SEQ ID NO: 9971 - RNA, 64 nt, Human
uuaugccauaaucuccuuugauucuuauggaaguucuaacaauauauggugguuccaacaccug

SEQ ID NO: 9972 - RNA, 64 nt, Human
acuaaagcauuuuuugcauuuaacugaugaaauuucuaacaaucaucaguuaggaauauuaaca

SEQ ID NO: 9973 - RNA, 64 nt, Human
auauuuucgaaguaguagauucucagaucuuuauucuaacaauuacaugauuugaaaacaguac

SEQ ID NO: 9974 - RNA, 64 nt, Human
accagcucccaguaaaaaccccaggcacucagucucuaacaagcuuuucugguugacaguguuu

SEQ ID NO: 9975 - RNA, 64 nt, Human
uguuaaaaccuauuugaguguaagacuugcccuuucuaacaauaaaugcuccguguuuaaguuc

SEQ ID NO: 9976 - RNA, 64 nt, Human
ucuaguaaccagcaacuguaaacgaaccugugccucuaacaagcgauucuaaaccaccuaugag

SEQ ID NO: 9977 - RNA, 64 nt, Human
uugcuuguaaacagaugugauagagauaaaguuaucuaacaaauugguuauauucuaagaucug

SEQ ID NO: 9978 - RNA, 64 nt, Human
cuauggggcggggccgcagggccagccuuguuucucuaacaaacaaacaaacaaacagccuugu

SEQ ID NO: 9979 - RNA, 64 nt, Human
uguauuaguuuuugcuuuucugagcuuuuuaaagucuaacaaaucuuuuuagucaucuuuuaua

SEQ ID NO: 9980 - RNA, 64 nt, Human
cuucuaacucaauagaucugggagauccugcauuucuaacaagcucccagguaaggcggaggcu

SEQ ID NO: 9981 - RNA, 64 nt, Human
aagacuucaucuuauucuucauguaaucccaccuucuaacaaaaaauaaauaaauauuuaaauu

SEQ ID NO: 9982 - RNA, 64 nt, Human
guguacauugaaaaccauguaaaauauugaagugucuaacaaauggcauugaagugucuuuaau

SEQ ID NO: 9983 - RNA, 64 nt, Human
ggauuaggcaaaaauaauuuauuuugcucuuguuucuaacaaggacuuggagacuugguggucu

SEQ ID NO: 9984 - RNA, 64 nt, Human
aaaucuacaggguacaaugauuacaaauuaaucuucuaacaaaauaaaauaugaaauauuaguc

SEQ ID NO: 9985 - RNA, 64 nt, Human
aagggaaacuuuaauccaaagaaagauuaauuacucuaacaaacaagagaagcuucauguuuga

SEQ ID NO: 9986 - RNA, 64 nt, Human
uguaugauguuucccauucauacaccuauaaaucucuaacaagaggcccuuugaacugccuugu

SEQ ID NO: 9987 - RNA, 64 nt, Human
cuccucuuuuuuccccccuaguugaaucagcuugucuaacaagcccauuuucaugccccagcug

SEQ ID NO: 9988 - RNA, 64 nt, Human
ggacauaguagugguaguaaagaaaaaaaggagaucuaacaaaaacacuugaauauuuuuuauu

SEQ ID NO: 9989 - RNA, 64 nt, Human
auccacccuuuuccaaguugauugcccaaggacuucuaacaauaaacucucuuuugcaccacag

SEQ ID NO: 9990 - RNA, 64 nt, Human
ucagacagagcacugacuauguacuaucaaacuaucuaacaaucugcauaagucugauucuauu

SEQ ID NO: 9991 - RNA, 64 nt, Human
cacuguugcaaaaucacuuccaaaaugauagcuaucuaacaacuaauuacuaauuuuuaaagaa

SEQ ID NO: 9992 - RNA, 64 nt, Human
agcuacuuuuagauuuggaaauugcuguuuacagucuaacaacauuaaaaugagagguagauuc

SEQ ID NO: 9993 - RNA, 64 nt, Human
cuacuugccuuaaauguuaauaucaaaagaguuuucuaacaagguuaauaccuuaguucuuaac

SEQ ID NO: 9994 - RNA, 64 nt, Human
auuuuuccuugaucccacugaucuugacaucaagucuaacaaagaaaaaguuuugaguuuugua

SEQ ID NO: 9995 - RNA, 64 nt, Human
ccuuucacugcuguuuauaaaauguguaaugaauucuaacaacucaaauuuugcuuuuugaagc

SEQ ID NO: 9996 - RNA, 64 nt, Human
aaccuguagguacauguuaugaaauaaacacauuucuaacaauacaagggaguaggggcagacc

SEQ ID NO: 9997 - RNA, 64 nt, Human
aagggcuuucucaauaagccucagcuuucuaagaucuaacaagauagccaccgagauccuuauc

SEQ ID NO: 9998 - RNA, 64 nt, Human
gaccuaaaaugucacuguucaaauuagccaguguucuaacaaacuaaacucuucaaaugcuugg

SEQ ID NO: 9999 - RNA, 64 nt, Human
ucuaaaauguaucauucuuuucuaauguauaugaucuaacaaaaaugaaacaugaaaugcagua

SEQ ID NO: 10000 - RNA, 64 nt, Human
gagaaaccguccucuuuuuccaucauaauucuaaucuaacaauggaagauuugcccauuuacac

SEQ ID NO: 10001 - RNA, 64 nt, Human
gggcugauugggauuuccauguucuuauuaaaaaucuaacaaaucuguuuggaguggacuaaau

SEQ ID NO: 10002 - RNA, 64 nt, Human
guccuaacuuucugaauuauuuuuaaagaucuucucuaacaagcuaugggaauuuggcuucaua

SEQ ID NO: 10003 - RNA, 64 nt, Human
cuccccuuuuugguacacuuuuuuugaaugguuuucuaacaacuugaagcacaggaucaaggaa

SEQ ID NO: 10004 - RNA, 64 nt, Human
gugcacuccuaugagaaucuaaugccacuacugaucuaacaagagguggagcucaggcaguaau

SEQ ID NO: 10005 - RNA, 64 nt, Human
uucuauguauguuaauuuauuuaguuuuuaacaaucuaacaauaauauuucaagugccuagacu

SEQ ID NO: 10006 - RNA, 64 nt, Human
uacuaaaccguugaguuucuaaauauuuauuuauucuaacaaaaagcaauuacuacaaauggau

SEQ ID NO: 10007 - RNA, 64 nt, Human
cagcuucauauugucuugaaaaccuaugauugucucuaacaaacaggcuacuugcuaguuagaa

SEQ ID NO: 10008 - RNA, 64 nt, Human
gaauaaguuauaaccuaguguauaaaaaauuauuucuaacaaacuacaguauacugucuugggu

SEQ ID NO: 10009 - RNA, 64 nt, Human
aaguaaugcuuaucagccccuucagugguguuauucuaacaaaaugaauacauuacaaauuauu

SEQ ID NO: 10010 - RNA, 64 nt, Human
aaugguccaccuggaacuaaaagggauacuauuuucuaacaagguauaucuaguaggggagaaa

SEQ ID NO: 10011 - RNA, 64 nt, Human
uuaugaaagugcuugagcuuuuaaccagguacugucuaacaacagucaucuuuugguucuguuc

SEQ ID NO: 10012 - RNA, 64 nt, Human
aaaaagccugcaauuucauaugcuguauauccuuucuaacaaaaaaauauauuuaaugauaagu

SEQ ID NO: 10013 - RNA, 64 nt, Human
uggucaaaucuuugacaaaauuuucaugaucuucucuaacaaaaaaaguuguuuauuaacugua

SEQ ID NO: 10014 - RNA, 64 nt, Human
auguuauuucacucuucauguauuuuuuuucuauucuaacaaauuuuucguccaccaucuuaac

SEQ ID NO: 10015 - RNA, 64 nt, Human
uuaaaaucgguuugauagcaccaugggacauuuuucuaacaaaaauaaaugcaugaagagacau

SEQ ID NO: 10016 - RNA, 64 nt, Human
cuggggagaagccccagcaagugugaaaaaagcuucuaacaaaacucugacuuacccaucagag

SEQ ID NO: 10017 - RNA, 64 nt, Human
gaaauaacuacccugucucccaccugcaggaaugucuaacaaagcauccaucuuccuccuucuu

SEQ ID NO: 10018 - RNA, 64 nt, Human
gcuauuugcugucauuucugggcuagggcuccuuucuaacaaccuagacuggaauaaggcccug

SEQ ID NO: 10019 - RNA, 64 nt, Human
augcagccacuuuggguuuuguuauaggcaucagucuaacaagucauuaggucacucgggaagg

SEQ ID NO: 10020 - RNA, 64 nt, Human
auuaagguuaaauagaauuguuucuucugaauaaucuaacaaaggaaaauauaagugauugaau

SEQ ID NO: 10021 - RNA, 64 nt, Human
aacaauuugaagcuucuguaauuuugagcacugcucuaacaacaagcauaauauaaaauuaguu

SEQ ID NO: 10022 - RNA, 64 nt, Human
uuucuuugaggauagaaaugcucuuguauaucuuucuaacaaauaguaaaaucuuuaaaaaauu

SEQ ID NO: 10023 - RNA, 64 nt, Human
agauuucuuuuuuuuccugaaaaacaacuaaccuucuaacaacuaucuuucaaaaguaaaugua

SEQ ID NO: 10024 - RNA, 64 nt, Human
cuuaaaaggauuggcuuguguuguuauuauuaagucuaacaaguccaaaagcuggagugugagg

SEQ ID NO: 10025 - RNA, 64 nt, Human
uguuucuuuaaaacugucaaauuugaggaaacaaucuaacaaaagccaauugaugaacauucug

SEQ ID NO: 10026 - RNA, 64 nt, Human
cacagguugucgaaauaauaauuccacagccucuucuaacaaugccuacaaugugaauuccucc

SEQ ID NO: 10027 - RNA, 64 nt, Human
cuuaaaccuaggaaaaguuacuuuguaucaggauucuaacaauuaugcuucauauuugugaagu

SEQ ID NO: 10028 - RNA, 64 nt, Human
aaugauguguaugcagaguuuuaaaauaaauucgucuaacaauaacuuccuuugguaguuuugg

SEQ ID NO: 10029 - RNA, 64 nt, Human
ucuacuccuuccuguuaaugaauuaagaacacauucuaacaagggucuguggcagacauugccg

SEQ ID NO: 10030 - RNA, 64 nt, Human; identical to SEQ ID NO: 10029

SEQ ID NO: 10031 - RNA, 64 nt, Human
aauuauuaaugaaaauaagaauuauuuugauggcucuaacaaugacauuuauaucacauguuuu

SEQ ID NO: 10032 - RNA, 64 nt, Human
uucagcuuaaccagucagaaacuaccgacuaaccucuaacaagagauuuauggucaguuaaccu

SEQ ID NO: 10033 - RNA, 64 nt, Human
ugugugggaacugugguuacaggaaauggagcacucuaacaauguuuacuucuaaacuuuguug

SEQ ID NO: 10034 - RNA, 64 nt, Human
agguuccucuuggagucuagaacauccuuaaaugucuaacaacaagggcuaccucugaguaccu

SEQ ID NO: 10035 - RNA, 64 nt, Human
ucuuuuggaauaucuuaguaacugaggaucauuuucuaacaaugugguugacauaccuucaguu

SEQ ID NO: 10036 - RNA, 63 nt, Human
ugugaagacagagcagaucagucuuugucaaugcucuaacaaauucuggcccuagauacuuua

SEQ ID NO: 10037 - RNA, 64 nt, Human
guaaacuucaguugcuuaaucaaacuaaugauagucuaacaacugagcaagauccucaucugag

SEQ ID NO: 10038 - RNA, 64 nt, Human
acuaucacgagccuuuguuuuucuccacaaaguaucuaacaaaaccaaugugcagacugauugg

SEQ ID NO: 10039 - RNA, 64 nt, Human
ugaggcagacucgcuuauuugaauugcacaauguucuaacaaggauguaacacagaauuggcuu

SEQ ID NO: 10040 - RNA, 64 nt, Human
aacuacuagaaaauugugcuggaaauggacacagucuaacaaauuccaaauucucacagaagaa

SEQ ID NO: 10041 - RNA, 64 nt, Human
aguggucaguuuggcugggcaauauuuucucucaucuaacaaacacaauccauugucaugaaau

SEQ ID NO: 10042 - RNA, 64 nt, Human
cucagaccuuagguaacauaccugcagcugcuuuucuaacaaacuguugaucagcaaaaauaaa

SEQ ID NO: 10043 - RNA, 64 nt, Human
aauuauaauuuauccuuguggcucucuuuauuuuucuaacaacuucaacaaaauaauccuguuu

SEQ ID NO: 10044 - RNA, 64 nt, Human
auggaaaagcaaaauacuguaaauaaacuuuuuuucuaacaauuugccagcaagacuauaaggg

SEQ ID NO: 10045 - RNA, 64 nt, Human
gaugugauauauaaguguacauaugugcuggaauucuaacaagucauagguuaauauuuaagac

SEQ ID NO: 10046 - RNA, 64 nt, Human
gaacuggaagcauuuuaagaaaucuuguugcuuuucuaacaaauucccgcguauuuugccuuug

SEQ ID NO: 10047 - RNA, 64 nt, Human
ucuguaauauauuuauuuuguuuaaagaaggcuuucuaacaaugacugacuaaauaaagcuguc

SEQ ID NO: 10048 - RNA, 64 nt, Human
auuuuauuauuauuauuuuggcaacauguacauuucuaacaaaguuuaucguggcuauuaaagu

SEQ ID NO: 10049 - RNA, 64 nt, Human
uuauauuguuaugucauaagcucuauuauguuauucuaacaaguagcaauuucacaaaauuugu

SEQ ID NO: 10050 - RNA, 64 nt, Human
aaaggacuagcccaaggccaacauuaacaagcccucuaacaaaaacuuuacaauacauuuaugu

SEQ ID NO: 10051 - RNA, 64 nt, Human
cauuuaaauaauuucuaaaagggucuuuucaagcucuaacaaagucacuaacaaaugcauuauu

SEQ ID NO: 10052 - RNA, 64 nt, Human
agcuuugggacuagucuguaucuuguuuuuuaagucuaacaacacugauaauaggaaguaaaaa

SEQ ID NO: 10053 - RNA, 64 nt, Human
uaaagcaucugagaucuaagaacacaauuauuauucuaacaaugauuauuagcucauucacuua

SEQ ID NO: 10054 - RNA, 64 nt, Human; identical to SEQ ID NO: 10016

SEQ ID NO: 10055 - RNA, 64 nt, Human
accaccucccaauaaucaacagcaaaauuauaggucuaacaauguuuuauagacaccccuccau

SEQ ID NO: 10056 - RNA, 64 nt, Human
uuuggcuucaaaguccugguuuuacaaacgcucuucuaacaagggaagaacacgggguaauuuu

SEQ ID NO: 10057 - RNA, 64 nt, Human
acuuuauagaagguugcuuuucuuuuuaauuuuuucuaacaaagaaaagaauaaaguauuuauu

SEQ ID NO: 10058 - RNA, 64 nt, Human
ucucguggucaugccaagaacacaggagggugagucuaacaagcacaccucaagccucugcuug

SEQ ID NO: 10059 - RNA, 64 nt, Human
aacaugaaagcucuguccaaaugaaaaagguauuucuaacaacaaccacaauaacaauaacaac

SEQ ID NO: 10060 - RNA, 64 nt, Human
guuaacuugaaccuuuuauauguuaugcauugauucuaacaaacuguaaugcccucaacagaac

SEQ ID NO: 10061 - RNA, 64 nt, Human
agguaacccgauaugauuuaggaugcauaucaguucuaacaauucaaucagaagucaagcucau

SEQ ID NO: 10062 - RNA, 64 nt, Human
uaaaaaaugacaaaaaugaacugaacaaaaaaguucuaacaaaauaauaaggcugaauuuuuaa

SEQ ID NO: 10063 - RNA, 64 nt, Human
uaaaauuaaaccagcaagaaagcauuaguaaaaaucuaacaauaugaagggcucuuaugaguca

SEQ ID NO: 10064 - RNA, 64 nt, Human
gacuagccuggccagcauggugaaaccucaucucucuaacaauauaauaauuagccaggcgugg

SEQ ID NO: 10065 - RNA, 64 nt, Human
guacaagucauuuuuaauguuaaaaauuagugaaucuaacaaaaggaauaaauuagcaauauuu

SEQ ID NO: 10066 - RNA, 64 nt, Human
uuuugaguuugaugccauaauaguuuuuaagguaucuaacaauaauuuauagauguacauugug

SEQ ID NO: 10067 - RNA, 64 nt, Human
ccagugccaggaaaaggccaaaagaaugucuguuucuaacaaauccacaaauagccccgagauu

SEQ ID NO: 10068 - RNA, 64 nt, Human
ggccuuucaucccucgggugugcuauggauggcuucuaacaaaaacuacacauauguauuccug

SEQ ID NO: 10069 - RNA, 64 nt, Human
cguuuuggccaaaguugaccacuacucuucuuacucuaacaagccacaugaauagaagaauuuu

SEQ ID NO: 10070 - RNA, 64 nt, Human
guaauaauguuacaugaucauggguguggcauucucuaacaaaugaugugaaaggaaaguaguu

SEQ ID NO: 10071 - RNA, 64 nt, Human
gagucuuugauucaccaaacaugaauguacauuuucuaacaaacucaaaaucugggaccaaaac

SEQ ID NO: 10072 - RNA, 64 nt, Human
aucuguugguuuuaggggaguuuuguuuuuuguuucuaacaauuuucagaccuguugguauagg

SEQ ID NO: 10073 - RNA, 64 nt, Human
cauaccauguaggugaggauuuuuaacuuuugcaucuaacaaaucaucgacuuaagagaaaaaa

SEQ ID NO: 10074 - RNA, 64 nt, Human
ugaauuguugauuuuguucacaaccucuuuuaaaucuaacaaguccuguucuguuuagugaagg

SEQ ID NO: 10075 - RNA, 64 nt, Human
acauuuauuuauacuaaauaacugucaaccauuuucuaacaaaaaguaagacugaauugacuga

SEQ ID NO: 10076 - RNA, 64 nt, Human
cugcuuuaaaaagucccacugucagauuauauuaucuaacaauugaauauuguaaauauacuug

SEQ ID NO: 10077 - RNA, 64 nt, Human
uaagccgaagccacaggugccugacagguucccuucuaacaacuauuugaccaagagaggcaau

SEQ ID NO: 10078 - RNA, 64 nt, Human
gcaugacugacuguuaaguuauaagauauagucaucuaacaagcuguguggaaaccuaacuguc

SEQ ID NO: 10079 - RNA, 64 nt, Human
uauuuagcuguagcgccaucagauauggaugccuucuaacaauugcuguuuguaaaauaaauca

SEQ ID NO: 10080 - RNA, 64 nt, Human
uuuuggauuuucuaaauaaaaauauugaaugcuuucuaacaaaacagaauauuucaaagaaauu

SEQ ID NO: 10081 - RNA, 64 nt, Human
ugacauuuagcaguaauccauuaagggcaguaccucuaacaaggacgccuuccagcuucagcga

SEQ ID NO: 10082 - RNA, 64 nt, Human
uuauagaaaaaaauaacauuuuaauguauauuguucuaacaaucauauugugaaucauuuugaa

SEQ ID NO: 10083 - RNA, 64 nt, Human
uuuguucaaaaccugcagcaaagagaagcaucagucuaacaagccagaacucauuuugugccac

SEQ ID NO: 10084 - RNA, 64 nt, Human
ucaucgacacaacccaucuacaaaugugcccagaucuaacaaaguaggcuaagaccuuccacuu

SEQ ID NO: 10085 - RNA, 64 nt, Human
acaucugauuccaguguggccauaauaacagaaaucuaacaacucuuuccuugccuuuucaaua

SEQ ID NO: 10086 - RNA, 64 nt, Human
ucuagaaaucagcuuuuaaaaauauugucugaagucuaacaaaaguuuucaccucuaauguguu

SEQ ID NO: 10087 - RNA, 64 nt, Human
ggaaaucaugcaaaacauuugaaugcaaagcauuucuaacaaaaagugacuggagcacuugcca

SEQ ID NO: 10088 - RNA, 64 nt, Human
uuacaaaaaaguucaagaaugauguccacugcuuucuaacaagauaauaaacccccccccucuu

SEQ ID NO: 10089 - RNA, 64 nt, Human
ggagaaagcacacugggaacacaauccagaauguucuaacaauaaguuuucagugaauaaacca

SEQ ID NO: 10090 - RNA, 64 nt, Human
aauauuucucccaacuuauccaaggaucuccagcucuaacaaaaugguuuauuuuuauuuaaau

SEQ ID NO: 10091 - RNA, 64 nt, Human
guacguuuguucagucucuaggguuguuuauuauucuaacaagguguggagugucagcgaggug

SEQ ID NO: 10092 - RNA, 64 nt, Human
uuuuuaaagaacaacauugccagaguaugcuuguucuaacaauauagauauauaaaccuuaaaa

SEQ ID NO: 10093 - RNA, 64 nt, Human
auuucagccaaacuguagaugaagagggcucugaucuaacaaaauaagguuauaugaguagaua

SEQ ID NO: 10094 - RNA, 64 nt, Human
uggggaggacaaaggugauuuuccuguguccacaucuaacaaagucaagauucccggcuggacu

SEQ ID NO: 10095 - RNA, 64 nt, Human
ugaggcauagguacuguuguaccaaggucacuuaucuaacaaaauaacccuucauguauuuuaa

SEQ ID NO: 10096 - RNA, 64 nt, Human
aaagcccagaguucacugugugucagaacaacuuucuaacaaacauuuauuaauccagccucug

SEQ ID NO: 10097 - RNA, 64 nt, Human
guccuccccacauuuugcuauguuaauauuugcuucuaacaauuugcagcuguuucacuuuuuc

SEQ ID NO: 10098 - RNA, 64 nt, Human
uuauggcaaauaauuuugccuucuaggcuguugcucuaacaaaauaaaccuuagacauaucaca

SEQ ID NO: 10099 - RNA, 64 nt, Human
uauuucguuuuuguuuugauccagugcucucccaucuaacaacuaaacaggagccauuucaagg

SEQ ID NO: 10100 - RNA, 64 nt, Human
agaauuuuuggaucaagcggaaagaguuuaagugucuaacaaacuuaaagcuacuguaguaccu

SEQ ID NO: 10101 - RNA, 64 nt, Human
aguucccagcugcuguaacggagccaccuccaacucuaacaauaaaccaaguucauugcagaua

SEQ ID NO: 10102 - RNA, 64 nt, Human
auugaaaaucuauuuuauuacagaaagaucaguuucuaacaaaugaaaauguaucaccuguucc

SEQ ID NO: 10103 - RNA, 64 nt, Human
uguucuuugaaagauaaaauuaaauacaugaguuucuaacaauuagaaaagaaaaaauuaaaac

SEQ ID NO: 10104 - RNA, 64 nt, Human
agcuuuuaaaaauacucuuuucagauucacguucucuaacaaagagucucauguucaagaucaa

SEQ ID NO: 10105 - RNA, 64 nt, Human
cuacaaauugcaauaugcaguuuuugaaagauuuucuaacaaaaagccaauaaauguagccauc

SEQ ID NO: 10106 - RNA, 64 nt, Human
cugcuccuugaauccaagccccaucuggggcuucucuaacaaaucuguaguaaguauacggacu

SEQ ID NO: 10107 - RNA, 64 nt, Human
ccacuaaguauucuaaauacuuuucaauggcuuuucuaacaaccucaguaguaauuugcugagc

SEQ ID NO: 10108 - RNA, 64 nt, Human
guauauauuaccuaacuucuaguguaguacugguucuaacaaguaacaagcaaguuuuaaaauu

SEQ ID NO: 10109 - RNA, 64 nt, Human
guucuccugccuggguucaaacucugcauccuucucuaacaacgugacuaccucaugucugcuu

SEQ ID NO: 10110 - RNA, 64 nt, Human
uucacagcaagaaaccgaauaaaauacuaacauuucuaacaacugcucugacauuguaaagaga

SEQ ID NO: 10111 - RNA, 64 nt, Human
gcaccagccgccgcgccccgggccggcggguuucucuaacaaauaaacagaacccgcacugccc

SEQ ID NO: 10112 - RNA, 64 nt, Human
caggcuggggcccaaccuagaaggcaggggucaaucuaacaaaacccuaacguugacuuuuuuc

SEQ ID NO: 10113 - RNA, 64 nt, Human
cuggugucauuuuguuuuaugacagacacacguaucuaacaaacaaacaaacagugaccuucuc

SEQ ID NO: 10114 - RNA, 64 nt, Human
uuucaguuuuauuggagaaacugaaggguaacauucuaacaaguaaacuguaugugcagauaaa

SEQ ID NO: 10115 - RNA, 64 nt, Human
aacccugaagcgcaccgcacugucugccccaaugucuaacaaaggccggaggcgacucuuccug

SEQ ID NO: 10116 - RNA, 64 nt, Human
caaguggauuuugacuuuguaucaugucaugauuucuaacaauaaaugauguuuuuaugugccu

SEQ ID NO: 10117 - RNA, 64 nt, Human
cagguuauaucagacaccacuaguagauagaaguucuaacaacuugagcucuguaacaaaaauc

SEQ ID NO: 10118 - RNA, 64 nt, Human
uuuccccaccccacacauucucaaccauaguccuucuaacaauaccaauagcuaggacccggcu

SEQ ID NO: 10119 - RNA, 64 nt, Human
accaucucuggggcuuggugcaggacucugaauuucuaacaaugcccagugacugucgcacuug

SEQ ID NO: 10120 - RNA, 64 nt, Human; identical to SEQ ID NO: 10027

SEQ ID NO: 10121 - RNA, 64 nt, Human
gccaaaaaacuggagaaacaaauauccugccaccucuaacaaguacaugaguacuugauuuuua

SEQ ID NO: 10122 - RNA, 64 nt, Human
ccccuccaucacaaguguuugaagccugucagauucuaacaacaaaagcugaauuucuucaccc

SEQ ID NO: 10123 - RNA, 64 nt, Human
gccccuucguucugguucugguucuaguucugguucuaacaacucacaaucccuuuagcuuucu

SEQ ID NO: 10124 - RNA, 64 nt, Human
accaccauucuguagccacccauccuuugccuuaucuaacaaacauuuuuccaggaagguggaa

SEQ ID NO: 10125 - RNA, 64 nt, Human
uaaaucuguuuuacauccuugagauucuuacacaucuaacaacaaaaaaaauuaucuacaucag

SEQ ID NO: 10126 - RNA, 64 nt, Human
uagcauccuguuacguauugaauauagaaaucauucuaacaacccagguuauuuucaaucagac

SEQ ID NO: 10127 - RNA, 64 nt, Human
gaaaaaaauagaauuauauuuuguaugaauuguuucuaacaaaccuugaucuguauauacuugu

SEQ ID NO: 10128 - RNA, 64 nt, Human
gcccugccuggaguucccccuggcucuaggacacucuaacaagcucuguccacgggucucccca

SEQ ID NO: 10129 - RNA, 64 nt, Human
gaguggaaggggguuuguucacacuuggaaucuuucuaacaaauccaucaagaugauaacacag

SEQ ID NO: 10130 - RNA, 64 nt, Human
aaauuuuguggcuucaaacacgaaauguuuauucucuaacaauuucuacagaucaggaauucaa

SEQ ID NO: 10131 - RNA, 64 nt, Human
uuaaugaaaagcagcccccaaaaucauuuucuuuucuaacaaagaacagccuguaaaaucgagc

SEQ ID NO: 10132 - RNA, 64 nt, Human
caugcacaugggaaagggugguuaucauuuuccuucuaacaaguagguacagauauucgguuac

SEQ ID NO: 10133 - RNA, 64 nt, Human
ugcaaaucauuggagaaucuauaaugaauaaagaucuaacaaguguaauaaauguggcaaauuu

SEQ ID NO: 10134 - RNA, 64 nt, Human
gaaacucucacccucacuccaucucccacugcggucuaacaaaucuccuuucgucucucagaac

SEQ ID NO: 10135 - RNA, 64 nt, Human
ggauuuuguagcuuuuaaaacuagaaaccauuguucuaacaaagcaggcaacuuuauucuauaa

SEQ ID NO: 10136 - RNA, 64 nt, Human
gaauguagagagagguagagagagaaauaugaacucuaacaaaggacugaggagugcagucugc

SEQ ID NO: 10137 - RNA, 64 nt, Human
uuuuuggggaagugaggugugcccaguuuuuuaaucuaacaacuacuuuuggggacuugcccac

SEQ ID NO: 10138 - RNA, 64 nt, Human
uuacuguauuauacuuuuccuuuuuuauauaaugucuaacaaaaaauacagcugcaacauuuug

SEQ ID NO: 10139 - RNA, 64 nt, Human
agagagcgcuccucucccagauaggaaaagggccucuaacaaggagaaauuagugugcggcaaa

SEQ ID NO: 10140 - RNA, 64 nt, Human
cauugauuuuuuuauaucuuucauaauauaauuuucuaacaaugcaauaaaaccacuaaacuuu

SEQ ID NO: 10141 - RNA, 64 nt, Human
uuuggucauauugccaacuggaaagucaaaauuuucuaacaacuuuaaguaaguucuuugaaga

SEQ ID NO: 10142 - RNA, 64 nt, Human
uuuuuuuuaaguuucauucuuccuagaauauuuuucuaacaauuuuuauuucagcuuuaaagau

SEQ ID NO: 10143 - RNA, 64 nt, Human
agauugauccuguuugauuuuggagagauccuauucuaacaaauacucuaaaaugauaaaauug

SEQ ID NO: 10144 - RNA, 64 nt, Human
ugcuaccucaaucucgggagaaacagcccuauauucuaacaaguugagcacagccuucuucccc

SEQ ID NO: 10145 - RNA, 64 nt, Human
guuucuugaaagaauuuuuuucguuauuuuuacaucuaacaaaguaaaaaaauuaaaaagaggg

SEQ ID NO: 10146 - RNA, 64 nt, Human
aaaugagagcccggcgcauggauuuuaauguuuuucuaacaacuguggagauuugagggaaugu

SEQ ID NO: 10147 - RNA, 64 nt, Human
acaacaagaaagcacauugaaaauaauuugauacucuaacaauccauuaacauguguagggguu

SEQ ID NO: 10148 - RNA, 64 nt, Human
aaaacccugugacucuggauuuuauuuuaaguucucuaacaagacuccuaccuugagaucuuag

SEQ ID NO: 10149 - RNA, 64 nt, Human
cuccaccuccuccuuccauuuugaccaaccuucuucuaacaaggugcucauuccuacuaugaau

SEQ ID NO: 10150 - RNA, 64 nt, Human
ccccuuggacauuccaaccugguagguaagcuaaucuaacaacuaacugccaaauugauaauau

SEQ ID NO: 10151 - RNA, 64 nt, Human
acuccuuggguauuagaguuucaaccaugaagucucuaacaauguauuuucuucaccucugcua

SEQ ID NO: 10152 - RNA, 64 nt, Human
ccgggaacugaacaauauuuauggauaaauguuuucuaacaaauucuguacagcuuuugauuau

SEQ ID NO: 10153 - RNA, 64 nt, Human
cccgggagcccgcuccacagcguggagacgucccucuaacaagaacuugucucagcacaugcgc

SEQ ID NO: 10154 - RNA, 64 nt, Human
ucuaauggaucuauaagaacagcaacaagagaguucuaacaauucuagugugaagccaaauagu

SEQ ID NO: 10155 - RNA, 64 nt, Human
cccuugauuggaagggcuuuucaaaaucauuuagucuaacaacugcccaguuuccagucggggg

SEQ ID NO: 10156 - RNA, 64 nt, Human
cauucuguagcauugccagcguucucuucacgucucuaacaauccuucgcuuuuccucacucac

SEQ ID NO: 10157 - RNA, 64 nt, Human
cuguccuguagcccccucggugggcccagggccuagggcccaggaucaagucacucaucucaga

SEQ ID NO: 10158 - RNA, 64 nt, Human
cuuuuguaccauggugugaaagucagaugcccagagggcccaggcaggccaccauauucagugc

SEQ ID NO: 10159 - RNA, 62 nt, Human
ggccccgccggcaccucugauguacagccagcagggcccaggcagccaccaagcccacccca

SEQ ID NO: 10160 - RNA, 64 nt, Human
aacuuucagagccucuuguauuuggaaggcuggaagggcccagacuuuggaauagugucuuggu

SEQ ID NO: 10161 - RNA, 64 nt, Human
agaaggggaauguguccuccugcucugcuuccucagggcccagcaggcggggguuugagcccug

SEQ ID NO: 10162 - RNA, 64 nt, Human
ucuaaacuaaacuaaugugaacaguagggaagcaagggcccaaaugcauaaguuucuuugcacu

SEQ ID NO: 10163 - RNA, 64 nt, Human
aggagagaaggggcuucucagacuuauuugcagaagggcccagaacucaguaugaaggcauugg

SEQ ID NO: 10164 - RNA, 64 nt, Human
gguggccucucuguggugguguguugguaaguuaagggcccagguauuugucucaugugugcaa

SEQ ID NO: 10165 - RNA, 64 nt, Human
cccuaguuaguggaaauuuggauaagggaacuguagggcccagauucuggagguuuuaugucau

SEQ ID NO: 10166 - RNA, 64 nt, Human
ggguucacuugccaugcaggaagaggcccacuagagggcccaucaggcaguguuaccuguuagc

SEQ ID NO: 10167 - RNA, 64 nt, Human
guguacauucugccuagaguguagccuaaagggcagggcccacguguauaguaucuguauauaa

SEQ ID NO: 10168 - RNA, 64 nt, Human
aggaaggaagcagcaguaucugcguagcccacagagggcccaggccccugcccagcugcagucu

SEQ ID NO: 10169 - RNA, 64 nt, Human
uucucaccuuucuuuuuugcuaauuauggaaaauagggcccauuucaucauagccuccuucccc

SEQ ID NO: 10170 - RNA, 64 nt, Human
cuguccagaguagagggcaccuguccacguggccagggcccaugcugccacccucgaggagaug

SEQ ID NO: 10171 - RNA, 64 nt, Human
cagggggaaggcagcucucuccagacagagucucagggcccagcaaggucagguuaucugcuuu

SEQ ID NO: 10172 - RNA, 64 nt, Human
ucuccccuuugugcuucccugcagcaacccauggagggcccagggugccugguaugggcaucag

SEQ ID NO: 10173 - RNA, 64 nt, Human
gugugugcagagucccugccguuuuaggacaaucagggcccaucuucugccaagugucugaccc

SEQ ID NO: 10174 - RNA, 64 nt, Human
auugcuggcugcccccucuuuguagcuccuauaaagggcccacaccugguggauaccugguuga

SEQ ID NO: 10175 - RNA, 64 nt, Human
aaugaaaugacuguuccugacagggaggaauagcagggcccaaucuucugagauggcuucuggg

SEQ ID NO: 10176 - RNA, 64 nt, Human
uccaggauccugcaggaacgagcacuggccagagagggcccagcuguagccauggcucaggcaa

SEQ ID NO: 10177 - RNA, 64 nt, Human
ccucugguuccaauuuccuguucuaagcaggacuagggcccaggaggcuaaggcugggagagaa

SEQ ID NO: 10178 - RNA, 50 nt, Human
ccagcagcuucuccaagugaagggcccaugugugcucaccucugggaaaa

SEQ ID NO: 10179 - RNA, 64 nt, Human
ucauggagcuggagaaaccagggauccugaccgcagggcccaucaauugcuacauagagauaca

SEQ ID NO: 10180 - RNA, 64 nt, Human
aauccuugcugcgugcccaccaggauuuccugugagggcccaggaaugagcaaggcauggucug

SEQ ID NO: 10181 - RNA, 64 nt, Human
accagaagccaaggaucucucuagugauggucagagggcccaaauggcagggauacccagugau

SEQ ID NO: 10182 - RNA, 64 nt, Human
auugacacuuccacacacucccuguaguccagguagggcccagaaauaggaaaggcuaggauug

SEQ ID NO: 10183 - RNA, 64 nt, Human
ucugaagggccauggcuaugcuucccuggcuccaagggcccauuuccuccuagaugcccuuuug

SEQ ID NO: 10184 - RNA, 64 nt, Human
gagacaagcgauuuuggaggaaacaagaaucccaagggcccaggaaaaccccaucuugaugcau

SEQ ID NO: 10185 - RNA, 64 nt, Human
aggagggaggccuagcugcucagaggcugcagggagggcccaggagccggcugggagggugggg

SEQ ID NO: 10186 - RNA, 64 nt, Human
cccauggagagggaauguguggcucuggcugcccagggcccaacucgguucacacggaucgugc

SEQ ID NO: 10187 - RNA, 64 nt, Human
guuuuuuaauccaguggcaaggugcucccacuccagggcccagcacaucuccuggauuccuuag

SEQ ID NO: 10188 - RNA, 64 nt, Human
ucccaaccuuuuugagcucaagcugugauaaagaagggcccauccuauuuccccucaucuaguc

SEQ ID NO: 10189 - RNA, 64 nt, Human
ggggggagcaggcugaagggagagccagccagccagggcccaggcagcuuugacugcuuuccaa

SEQ ID NO: 10190 - RNA, 64 nt, Human
cauugccagagaagaugugacaggccaaucagacagggcccagagcaucucuuugcugcuacug

SEQ ID NO: 10191 - RNA, 64 nt, Human
gcccucucugaguucugugcugucucuuggaggcagggcccaggagaacaaaguguggaggccu

SEQ ID NO: 10192 - RNA, 64 nt, Human
ucugagcccacucagcagcaggcaugaucagggcagggcccagcgcuaagggcugcuggggcua

SEQ ID NO: 10193 - RNA, 64 nt, Human
cuuuuagcacaucacugagaagauggcacuguccagggcccauguagcuggcaagcugcaaaag

SEQ ID NO: 10194 - RNA, 64 nt, Human
gggggccacagagaccuggaaagagaacucucccagggcccaucuccugcaucccaugaauacu

SEQ ID NO: 10195 - RNA, 64 nt, Human
agcuucuacagaaacccuuccaucuguagccucaagggcccaccuccaagggaaggcuuaggca

SEQ ID NO: 10196 - RNA, 64 nt, Human
ugggaccugggcccagacagucccccuugaccccagggcccaucagggaaaugccucccuuugg

SEQ ID NO: 10197 - RNA, 64 nt, Human
aaacuuggucauucccauuuugaagagaugcaagagggcccagugaggacauccgccucccuga

SEQ ID NO: 10198 - RNA, 64 nt, Human
uuacuuauucugccugaaaacaauguauuaccccagggcccaacaguaaaagauuguggacuuu

SEQ ID NO: 10199 - RNA, 64 nt, Human
cucaacauugccaaggugcuagugggucccuaagagggcccauguugggggugaagucaugagg

SEQ ID NO: 10200 - RNA, 64 nt, Human
ccugcauuucucagucgguguguaaucacguuccagggcccaaagcccagcucuuuguucaguu

SEQ ID NO: 10201 - RNA, 64 nt, Human
ucuuggguccuuagagugggcuggagagaccuagagggcccagcauguggcugggaaacuguug

SEQ ID NO: 10202 - RNA, 64 nt, Human
aggaaugaaaggaaugccaucaucucuaguucccagggcccagccuuccccuucucccccgggg

SEQ ID NO: 10203 - RNA, 64 nt, Human
aaagcagagauuuuagcauugccuuggcauaacaagggcccaucgauucccuacuaaugagagg

SEQ ID NO: 10204 - RNA, 64 nt, Human
agaggccaggauuggagagggggcaccgcguuccagggcccagugcuggaggacugggaaagcg

SEQ ID NO: 10205 - RNA, 64 nt, Human
aaauagacauaacugagcugaaguaauuccauaaagggcccagacagccuccuccaccauuccc

SEQ ID NO: 10206 - RNA, 64 nt, Human
aacagccuggcugagcccuggcccuggcagguuuagggcccauuuggggcccccuccuucucug

SEQ ID NO: 10207 - RNA, 64 nt, Human
caccaggccugggucagguggggaggggacaccaagggcccauuuccuccccucucuaccugca

SEQ ID NO: 10208 - RNA, 64 nt, Human
ccaguuuccuucccuggaccccugcagagcucacagggcccaggacaccaacgccgcauaggac

SEQ ID NO: 10209 - RNA, 64 nt, Human
uguucgcuccucccagauggcuucggagggccgcagggcccaccuuggacccuggugaccuccu

SEQ ID NO: 10210 - RNA, 64 nt, Human
gcuucugggagauuuuuuugagucaaagacuuaaagggcccaaugaauuauuauauacauacug

SEQ ID NO: 10211 - RNA, 64 nt, Human
aagggaagggcucagagcaagggaaauugagaaaagggcccaaggaggagauggugucuuagau

SEQ ID NO: 10212 - RNA, 64 nt, Human
aaaugggagaaauuggccaaaauaaagggguuacagggcccaugcaaguccgaaauccagcagg

SEQ ID NO: 10213 - RNA, 64 nt, Human
cuucuuucuccuuccccaauccgccuguuucgucagggcccaguuuguuuccucauacaccuuc

SEQ ID NO: 10214 - RNA, 64 nt, Human
acguuacagaaggaagaaaggaagccaguaacugagggcccacugccugcccggcccugggcca

SEQ ID NO: 10215 - RNA, 64 nt, Human
gccugucucugccucccugucuaccggacuggccagggcccaagacccccgcugcuccacugcg

SEQ ID NO: 10216 - RNA, 64 nt, Human
ccccagcucacccaucuguagcucccucaaagucagggcccaccccaucugaggcagagaagac

SEQ ID NO: 10217 - RNA, 64 nt, Human
gguccauuccccauucauggcacagagcaguggcagggcccagcuagcaggcucuucuggccuc

SEQ ID NO: 10218 - RNA, 64 nt, Human
guuccaucuccgagaguggugugcagggcaggccagggcccaugcuggcugcagucucuguggc

SEQ ID NO: 10219 - RNA, 64 nt, Human
ggagcaguuacaucgggucuggugcuccagaccuagggcccagcacuuucaucagauccugccu

SEQ ID NO: 10220 - RNA, 64 nt, Human
cucccaggugccagguggucuuccagccucuccaagggcccaccccccugccucuuccucccac

SEQ ID NO: 10221 - RNA, 64 nt, Human
ggaggaauagcugugauggaaggacuagagcgaaagggcccagagauaucaaggaagcuuuuca

SEQ ID NO: 10222 - RNA, 64 nt, Human
uuuguuagaggauugagaaugaaauuucugcaaaagggcccaugguucauuugguaucccuauu

SEQ ID NO: 10223 - RNA, 64 nt, Human
caagggccaauggcaguucagcgcaaggagagggagggcccacaggucagaaaaagcuccagag

SEQ ID NO: 10224 - RNA, 64 nt, Human
uaucugagacuguggaguaauagccacaaaacagagggcccacugcacagcauauccaggcugc

SEQ ID NO: 10225 - RNA, 64 nt, Human
cuccugcucaugcucagcugcuucuggaccuuccagggcccaugcagggugagggaaaggguag

SEQ ID NO: 10226 - RNA, 64 nt, Human
agcugcacccgugcacccgcuggggccuggagucagggcccacuccaggagggacccacugccu

SEQ ID NO: 10227 - RNA, 64 nt, Human
agggccuuuagccauuugucucuccucacacuccagggcccauauggcccagguucugacaguu

SEQ ID NO: 10228 - RNA, 64 nt, Human
uccagagggcauuuccccuugcgccuucucccacagggcccagccccucuccccugccccaguc

SEQ ID NO: 10229 - RNA, 64 nt, Human
agcaagggcauugccuccucucucugcucacuucagggcccagugcacucacuucacagugaca

SEQ ID NO: 10230 - RNA, 64 nt, Human
uccccuacaauccuugggcagagcauguggucugagggcccacagugaaagaacagcaguggug

SEQ ID NO: 10231 - RNA, 64 nt, Human
uaacagacugaaaugugcucaggcccuggccaggagggcccagggucauucuuuuaacaaaagg

SEQ ID NO: 10232 - RNA, 64 nt, Human
aaauugcacagacagaaucacuuugccacacugcagggcccaggagugggagcccaggcccucc

SEQ ID NO: 10233 - RNA, 64 nt, Human
uaaauacacaauuauuugguuuaggaugguuauuagggcccauuagaaacaggagaaguauuuu

SEQ ID NO: 10234 - RNA, 64 nt, Human
ccaucuuccugacugucccagguccccacucuccagggcccaucaagucacccagacccaugaa

SEQ ID NO: 10235 - RNA, 64 nt, Human
uacccugccaggggcacucagcaaacagaaccacagggcccaggaggcauuccacacaggcacu

SEQ ID NO: 10236 - RNA, 64 nt, Human
cacguuaacauaaugagucacuaggcuucuggggagggcccaacuucacccaugcaugagagac

SEQ ID NO: 10237 - RNA, 64 nt, Human
ggagagggggugaugaccccuccccaagccccucagggcccagaccuuccugcucuccagcagg

SEQ ID NO: 10238 - RNA, 64 nt, Human
ggcagggucaggcugggguaagccgggguuccacagggcccagcccuggcaggggucuggcccc

SEQ ID NO: 10239 - RNA, 64 nt, Human
cacuaaagguauuaauaaguccaguggaccacagagggcccaaucccucuuggccgcuaaggcu

SEQ ID NO: 10240 - RNA, 64 nt, Human
cacacaaagccuuaugagaguauuccuucccucuagggcccaaagaggcugcuaaccagcagga

SEQ ID NO: 10241 - RNA, 64 nt, Human
cuuaauuauaggcauuguggaguaacuuugauaaagggcccagcccuuucuguuuuggaagcua

SEQ ID NO: 10242 - RNA, 64 nt, Human
acaucgagccugacaucgaagcccugcugucucaagggcccagcugugccuagggcgccccucc

SEQ ID NO: 10243 - RNA, 64 nt, Human
augaugagcagccccugcggcugcggcuccuggcagggcccagugacaaggcccugagcuuugu

SEQ ID NO: 10244 - RNA, 64 nt, Human
auggguggcuauccgccaggccuuccaccuuugcagggcccaguugauggccuuguuagcaugg

SEQ ID NO: 10245 - RNA, 64 nt, Human
caaucuuagugaguuaaguugcagcauaaauccaagggcccacugggaaaagauacugucgggu

SEQ ID NO: 10246 - RNA, 64 nt, Human
gggguuugugggcaaguugauuuugccacacuguagggcccagguggucccauugccaccguga

SEQ ID NO: 10247 - RNA, 64 nt, Human
uuacccuuagagacugugacucaguauccggggcagggcccaggcaucuucauuuugacaggcc

SEQ ID NO: 10248 - RNA, 64 nt, Human
ggcccacagcuagguggggacugucugcuggcucagggcccaguguuuugccacucagguugca

SEQ ID NO: 10249 - RNA, 64 nt, Human
gaaggcugaggcaggaggaucauuugagcucaugagggcccaggaggucaaggcuucagugagc

SEQ ID NO: 10250 - RNA, 64 nt, Human
gagccagugccaacaaaacauuuugaauggacuuagggcccaugagguuguggcuggcuuaggc

SEQ ID NO: 10251 - RNA, 64 nt, Human
agaaagggugccagaccauucucuggcggggaccagggcccaaggccccagggcuggaaggaga

SEQ ID NO: 10252 - RNA, 64 nt, Human
gcgcagucuaaagggcaggccagugucuggaagcagggcccacguggcgguccgcuggcaggcu

SEQ ID NO: 10253 - RNA, 64 nt, Human
cauuggccaccuaguagcaguggugaggagugggagggcccagcaagcauuuaucagaaauaga

SEQ ID NO: 10254 - RNA, 64 nt, Human
ccucauuuuucuaguucccacaggaggaacacaaagggcccaugaugaaagccugcacacagug

SEQ ID NO: 10255 - RNA, 64 nt, Human
guuucaggcaagcccaagacuuuguaauuuuuaaagggcccaagauuuuuuuuuuuuuuuuuuu

SEQ ID NO: 10256 - RNA, 64 nt, Human
ccaacaucucccucccacauugucaccauuucaaagggcccacagugacuuuugcugggcauuu

SEQ ID NO: 10257 - RNA, 64 nt, Human
ucccccucacaggguggccaccugcaccagcgucagggcccagggugcugugaccgaugagacc

SEQ ID NO: 10258 - RNA, 64 nt, Human
ccuuccagcugggcagaguccccugcaaggaggcagggcccagcuuccacauccggagcccugg

SEQ ID NO: 10259 - RNA, 64 nt, Human
gcccccaugcccccaccccaccacaagaggcaggagggcccagucaugacccucgucucugcag

SEQ ID NO: 10260 - RNA, 64 nt, Human
ucuuuauguuuucuuucauugggcaacagcuaagagggcccagcaagguaauuuaugguugagc

SEQ ID NO: 10261 - RNA, 64 nt, Human
gaagguagcuauacuagcacuuuugaucaucuucagggcccacaaaaauguugucaagauuuua

SEQ ID NO: 10262 - RNA, 64 nt, Human
caucacacuugcuuccacuugccgggcuugauuaagggcccacgugacaugagaagggagcucu

SEQ ID NO: 10263 - RNA, 64 nt, Human
aaaguauuuaacugaaaguagggccugcucugacagggcccaugucccacaaggcugcuuggcc

SEQ ID NO: 10264 - RNA, 64 nt, Human
cucagauucaauaaugagagcucagacugggaacagggcccaggaaucugugugguacaaaccu

SEQ ID NO: 10265 - RNA, 64 nt, Human
uggcuuucuuagcguguaacuuguguagcagcacagggcccacacuuagaaggaccccacacuu

SEQ ID NO: 10266 - RNA, 64 nt, Human
caccgugccccugggcuggacucccgugcuccucagggcccaccccugcucugucugguacagg

SEQ ID NO: 10267 - RNA, 64 nt, Human
accagguuucuacacccccgccaggcugcccaucagggcccagggagcccccagaggacuuuau

SEQ ID NO: 10268 - RNA, 64 nt, Human
cgcaaaagcuggggagguaggaagggucacugugagggcccagggccccucucuucccaucucc

SEQ ID NO: 10269 - RNA, 64 nt, Human
uugcucuggaguuucacuccccuucugggucccaagggcccaauggccugacuuuuagaauugc

SEQ ID NO: 10270 - RNA, 64 nt, Human
ucaaaaacccugggguccugggccagagacaggcagggcccaguccaggggccccaggccuccc

SEQ ID NO: 10271 - RNA, 64 nt, Human
caccaggugaggugagcgugugugcucucagggaagggcccaggaucccaugccugggaggagc

SEQ ID NO: 10272 - RNA, 64 nt, Human
agccaggcuggcacugccacucacacucggccccagggcccaggagggacagugccuggagccu

SEQ ID NO: 10273 - RNA, 64 nt, Human
ggacaaggcccuccuggcagaggagcaccuaggcagggcccagcccugcuuccuggaguggaug

SEQ ID NO: 10274 - RNA, 64 nt, Human
gauggccaugcccuccauguguaagaacaaugccagggcccaggaggaccgccugcccugccug

SEQ ID NO: 10275 - RNA, 64 nt, Human
ggaggcggcgguggcacugaagagauagcuuucaagggcccaacacuuugcacuucggcuggcu

SEQ ID NO: 10276 - RNA, 64 nt, Human
agaaaaccagccacuucuuuucauaagcacugacagggcccagcccacagccacaggugcgauc

SEQ ID NO: 10277 - RNA, 64 nt, Human
ggaggacaagcauugcuaccaaccgccucaucugagggcccaacugauaugauuugauuuaucc

SEQ ID NO: 10278 - RNA, 64 nt, Human
gggaaguaaacugcagcaggccacuggggacagaagggcccauguacuuguugggaggaggagg

SEQ ID NO: 10279 - RNA, 50 nt, Human
ugugggugggugagguaugaagggcccagagcagagcccugggccaagga

SEQ ID NO: 10280 - RNA, 64 nt, Human
gcuuaggaaacgcucccacucccacgggccaucgagggcccagcacggcugagcggcugaaaaa

SEQ ID NO: 10281 - RNA, 64 nt, Human
cccgacgcuuuucagggcauuucucccuccagccagggcccaacucccaccugccugggcgaau

SEQ ID NO: 10282 - RNA, 64 nt, Human
gagugaaaggaccuuugggggugggugggagcaaagggcccaccugcugguuggugaaagcagu

SEQ ID NO: 10283 - RNA, 64 nt, Human
gagggucuccuaccuggaagucccccugagcuccagggcccagcccuaccugccagugcuggug

SEQ ID NO: 10284 - RNA, 64 nt, Human
ggaagugccaucugcauggccacucuugcccccaagggcccaggcuguggcugacacauagaag

SEQ ID NO: 10285 - RNA, 64 nt, Human
guucucuccucuuuuaacaacagucauuggauuuagggcccacccuaauccugugugaucuuau

SEQ ID NO: 10286 - RNA, 64 nt, Human
gcaggggcgcugggcaugugcccucacuguggacagggcccacccaccuccgguuccccugugc

SEQ ID NO: 10287 - RNA, 64 nt, Human
aaaguauaggcuguggacaauaacugaugaauauagggcccagauggaccaaguggggccgggg

SEQ ID NO: 10288 - RNA, 64 nt, Human
ggaacuuugagcacaggaggaaaugcaaccagucagggcccagaaucaugcaaaucucaggggu

SEQ ID NO: 10289 - RNA, 64 nt, Human
gguggagccagacagagcaggugcggggaagggaagggcccaggccagacccaucccaaacgga

SEQ ID NO: 10290 - RNA, 64 nt, Human
ccuuauccgugcagugguggcaguucagaaauaaagggcccauuugugggaugccgcauucacu

SEQ ID NO: 10291 - RNA, 64 nt, Human
aacgccgauuccgggagcuugggagcccugcgucagggcccagagccucgcacuugcugugugc

SEQ ID NO: 10292 - RNA, 64 nt, Human
cuguggaaggugcgucgggccagggccacacccaagggcccagcugucuugccugcccgugggc

SEQ ID NO: 10293 - RNA, 64 nt, Human
cugacuucccaagcccuggugaccagaccaaggcagggcccagcauaauuccuccaguuggaug

SEQ ID NO: 10294 - RNA, 64 nt, Human
ugcacauuauaaaauuguuuuucuaauacuuuauagggcccaacuucagaaaauacuucgcuuu

SEQ ID NO: 10295 - RNA, 64 nt, Human
uagagaaacacacaugccuuaaaauuuaaaaagcagggcccaaagcuuauuaguuuaaauuagg

SEQ ID NO: 10296 - RNA, 64 nt, Human
aaauauuucauguccuauuuuaauagaaaaccucagggcccaaguaacagugauagaaguuaga

SEQ ID NO: 10297 - RNA, 64 nt, Human
agaaaacagucuuccauagauuuuuaaggaagaaagggcccaagccaggagaucgcuugguuuu

SEQ ID NO: 10298 - RNA, 64 nt, Human
agcccucccccaaaaguuauaaaaccauuuuaucagggcccaacauguggcaugcaaugaagag

SEQ ID NO: 10299 - RNA, 64 nt, Human
gcaggugcuggcccucggaccugagagcccagccagggcccauguggucugcaaaugggagcgg

SEQ ID NO: 10300 - RNA, 64 nt, Human
caccacgcccgcccgggcuuuuaccaugaggccgagggcccaggcccugugugcggugcccagg

SEQ ID NO: 10301 - RNA, 64 nt, Human
ugagacccaaucccugggcgccccugguauccaaagggcccagggacccuguugcgcugcccug

SEQ ID NO: 10302 - RNA, 64 nt, Human
accuuucugcuaggauuggcuucccgcagagggcagggcccauccuaagcagcuuccaaguccc

SEQ ID NO: 10303 - RNA, 64 nt, Human
ggcgggcuggcuugacucaggcccugugagauagagggcccagcccagccccacccacagaucc

SEQ ID NO: 10304 - RNA, 64 nt, Human
cucugagaucuaaggaugucacagggccaacuugagggcccagagcaggaagcauucagagagc

SEQ ID NO: 10305 - RNA, 64 nt, Human
ucugugaugccccugccuccagggcuagguagagagggcccaggcaggcggccuauccugaucc

SEQ ID NO: 10306 - RNA, 64 nt, Human
auagaguagccgagggagagucuuggggccaagaagggcccagggugggucaggcgugugcacu

SEQ ID NO: 10307 - RNA, 64 nt, Human
uccuccuccuucucuuuccuccuccuccucaccaagggcccaaccgugugcauacaucgucugc

SEQ ID NO: 10308 - RNA, 64 nt, Human
cugccccucccugacccggggcccccuuuccuccagggcccagucuggcucccgagcucagaca

SEQ ID NO: 10309 - RNA, 64 nt, Human
uucucguugccagcaguugauuuacaguggucacagggcccaauucuagacauaaaacaaagga

SEQ ID NO: 10310 - RNA, 64 nt, Human
acccaaauagcaucuagaaagccaugaguuugaaagggcccaucacaggcacuuuccuacccaa

SEQ ID NO: 10311 - RNA, 64 nt, Human
aggucugccauccacggccuuuucuggcaagagaagggcccaggaaggaugcucucauaaggcc

SEQ ID NO: 10312 - RNA, 64 nt, Human
ggaaaauccucgcaagaggucuacgagaaggaugagggcccaagucuagggucuaaacaaagcc

SEQ ID NO: 10313 - RNA, 64 nt, Human
gcuaauuugaaagaaaauugauaagaaaacuuugagggcccaaguccacaauuuggugagacca

SEQ ID NO: 10314 - RNA, 64 nt, Human
uaaauaaaacuuguuauuuuggcauauuucugguagggcccauugcacauguguaucaguauag

SEQ ID NO: 10315 - RNA, 64 nt, Human
gcuggaccggccuuaggggugaaggugggggcacagggcccaccccgcccgggaccccgggagc

SEQ ID NO: 10316 - RNA, 64 nt, Human
gggggggcugucccagggggcaagaaggggugucagggcccagugacaaaaucauugggguuug

SEQ ID NO: 10317 - RNA, 64 nt, Human
acugucaggucauuaucaggcauaggcagccuauagggcccaaagaaggcaaaaagauaagauu

SEQ ID NO: 10318 - RNA, 64 nt, Human
uacuauguaccaggcaccaggaagccagaagcucagggcccagcccuugccuuugguaccugcc

SEQ ID NO: 10319 - RNA, 64 nt, Human
caggggaggccgggccuugcccucccuucugcccagggcccaguguucuugauagaagacccuu

SEQ ID NO: 10320 - RNA, 64 nt, Human
uccgagauggcuucuggaggaaggcgccccuccgagggcccaacacuggccagggaugacaacc

SEQ ID NO: 10321 - RNA, 64 nt, Human
ucucacccacaguaucacacguggaaccgcagacagggcccagaagcuuuagagguaugaggcu

SEQ ID NO: 10322 - RNA, 64 nt, Human
ggcuuccuauucaaggagaugaugaccuggguccagggcccagaccuggacuccaaggccggcc

SEQ ID NO: 10323 - RNA, 64 nt, Human
uagaaggagagagaagaagaugaaguuugccaggagggcccauauuuuuucagcugaaggguaa

SEQ ID NO: 10324 - RNA, 64 nt, Human
guacacugguuagauaaaacuuaaggccacaaggagggcccagguaggcgaugucaguguguga

SEQ ID NO: 10325 - RNA, 64 nt, Human
uagcaaagccacgcuccccacaggacuuggacagagggcccacagggggaugggcuggcugugg

SEQ ID NO: 10326 - RNA, 64 nt, Human
guaccaggaacuggcaaccuucaucucacuccugagggcccaggucucugccuucauuguugcu

SEQ ID NO: 10327 - RNA, 64 nt, Human
auauauuccauaaaaauacaaaguaacccugacuagggcccaacuuuaauuuugaaugcauuuc

SEQ ID NO: 10328 - RNA, 64 nt, Human
aauauuuggaauugaacgacuguauauugcuaagagggcccaaagaauuggaauccuccuuaau

SEQ ID NO: 10329 - RNA, 64 nt, Human
gccaguacuuugccauccuugcacuucuguuaucagggcccaaauaacaguggcaagcuaccaa

SEQ ID NO: 10330 - RNA, 64 nt, Human
ccaaacuguucagauucaagauuauuccaagcgcagggcccaaauguuauagccaaagaaaguc

SEQ ID NO: 10331 - RNA, 64 nt, Human
gggccugagguauuaaggcuaagaggugggggacagggcccaucuaccagccuucaucaggaag

SEQ ID NO: 10332 - RNA, 64 nt, Human
guccugacccagcauauggaugcccuccccuuggagggcccagccugcaaaccccaucugauac

SEQ ID NO: 10333 - RNA, 64 nt, Human
aggacaauggugguagggccacuuagagagcaguagggcccaggcuggugcagccuacauggca

SEQ ID NO: 10334 - RNA, 64 nt, Human
auugcagcaaccuuccuucucagccagccuacguagggcccaggcauggucuugugucuuaaga

SEQ ID NO: 10335 - RNA, 64 nt, Human
cccaaaugaugugugugguguuucuaagagaaacagggcccauaaccagugggcagcuuuagga

SEQ ID NO: 10336 - RNA, 64 nt, Human
gugaugucagccacugggguguugugcucacuucagggcccagcacaaaaauccuuguuugaca

SEQ ID NO: 10337 - RNA, 58 nt, Human
uggcugagcuggcugccugaggaggggcagggcccacccaugucaccggucagugccu

SEQ ID NO: 10338 - RNA, 64 nt, Human
cagaaccucggucaguguuucccugucugggggcagggcccagagcgagcacgcgucuggcggc

SEQ ID NO: 10339 - RNA, 64 nt, Human
gaugggcuugagggggcucagagcauaaggcuucagggcccaaguugggagaagugaccaaagu

SEQ ID NO: 10340 - RNA, 64 nt, Human
aagcugcccuuuggguaggugcugggcuccugggagggcccagaugauggggugaggcaugucu

SEQ ID NO: 10341 - RNA, 64 nt, Human
aaauagccccagacugggcccaggcaggucugcaagggcccagagugaaccguccuuucacaca

SEQ ID NO: 10342 - RNA, 51 nt, Human
agauucuggacuacgugugacagggcccaaggcugggccucccugacccgg

SEQ ID NO: 10343 - RNA, 64 nt, Human
cccagccccccagcagcccccagccgaggggcccagggcccacagccagcgguggaggugucuu

SEQ ID NO: 10344 - RNA, 64 nt, Human
ccgacgaguuguagcucccuccuccuggaagccaagggcccacguccucaccacaaagggacuc

SEQ ID NO: 10345 - RNA, 64 nt, Human
cagaggcaccuugcugggucuguggcauuuuccaagggcccacguagcaccggcaaccgccaag

SEQ ID NO: 10346 - RNA, 64 nt, Human
ggggagacucaagucuuacuccccaggagcucccagggcccaaggaggagaaugcugccuccuu

SEQ ID NO: 10347 - RNA, 64 nt, Human
caagagacgggccaccuuugaccccaaggccuggagggcccaaugucgcugcaaacacagccac

SEQ ID NO: 10348 - RNA, 64 nt, Human
guccuucagggcugcaagaguuauugccuagcacagggcccagacagggcuggacuagacacga

SEQ ID NO: 10349 - RNA, 64 nt, Human
gcuuguauaguggccugugaggugacagauuggcagggcccaaggccccagguuuucauuuuuc

SEQ ID NO: 10350 - RNA, 64 nt, Human
uucagaugaugccuucuguugaauucuguuauuaagggcccaugaugagcuguaacuucucaag

SEQ ID NO: 10351 - RNA, 64 nt, Human
gaauaaacuguuuucuccaccaggcuuugacaaaagggcccacaggaaucuuaccaaugccaac

SEQ ID NO: 10352 - RNA, 64 nt, Human
uaaagaaagauugugcacuuuaaccucucucaucagggcccaagggcuggcugggauuuuuuuu

SEQ ID NO: 10353 - RNA, 64 nt, Human
ggcuccucccuuggcuuucccuuggcccacuuccagggcccaggugcugcaacuaaaugugaaa

SEQ ID NO: 10354 - RNA, 64 nt, Human
aagggcugggucugccucagaaggcaccagcaccagggcccagguauuaaggcugagagugaag

SEQ ID NO: 10355 - RNA, 64 nt, Human
ccugugcuaggcgcugacauuaacaggagcaaccagggcccaauuccuggccuuggagcucaaa

SEQ ID NO: 10356 - RNA, 64 nt, Human
caggccaacagcaccuccccgcugggaagagaagagggcccagcccagagccaccuggaucuau

SEQ ID NO: 10357 - RNA, 64 nt, Human
uugcaggagcgaccccgacguggaacgcugccucagggcccaccggaacgacauggagaccauc

SEQ ID NO: 10358 - RNA, 64 nt, Human
gcccucacugggagcccuugguguucugagcagcagggcccaggcagcacaugagcagugccca

SEQ ID NO: 10359 - RNA, 64 nt, Human
ugagggggacacaguggugcucugcugaguugugagggcccagaucacagaucccaugugagaa

SEQ ID NO: 10360 - RNA, 64 nt, Human
gcugcucugcaagcccacuggccagcucuggcucagggcccaccuccuccagcgaguaccccag

SEQ ID NO: 10361 - RNA, 64 nt, Human
ggcuacgggggagggagagccugaggcucugcucagggcccauuucaucucuggcagugccuug

SEQ ID NO: 10362 - RNA, 64 nt, Human
ccagccuuagaaaauccauguacucuguuguuagagggcccagaguuccuucuccacccccgcu

SEQ ID NO: 10363 - RNA, 64 nt, Human
agcuacugagcuaaagcaaguggguaaauggcauagggcccaggcuagcuuccagaaagcaccc

SEQ ID NO: 10364 - RNA, 64 nt, Human
ggcucccauucacucuuccagaaucccaagacccagggcccaggcaaaucaguuacuaagaaga

SEQ ID NO: 10365 - RNA, 64 nt, Human
ggacgucccugaggcuccaccuccaagcucagacagggcccaggcuuggggaacagagagagca

SEQ ID NO: 10366 - RNA, 64 nt, Human
gaagccuguugguuugcugcugucguuuuugaggagggcccauggggguaggagcaguugaacc

SEQ ID NO: 10367 - RNA, 64 nt, Human
ggaggguccuaagaauggcucccggagcuaacugagggcccagccuuuuuucugcaugauccag

SEQ ID NO: 10368 - RNA, 64 nt, Human
aucccugugcugucccggcucucauucaugccgaagggcccaacccauuggcuguguucuguuu

SEQ ID NO: 10369 - RNA, 64 nt, Human
aaaugggagaaauuggccaacacaaaaggguaacagggcccaugcaaguccaaaauucagcagg

SEQ ID NO: 10370 - RNA, 64 nt, Human
uggagcaggcaccuugggcugggccugcucccccagggcccagggccccccagcuuagaacagc

SEQ ID NO: 10371 - RNA, 64 nt, Human
gggaaggagauguggacggccugucuccuccugcagggcccacccuaagaauguauuuuuaaac

SEQ ID NO: 10372 - RNA, 64 nt, Human
ccacagccuggccagcuccagggaccccaguugcagggcccaagcaggugggaguggacaccag

SEQ ID NO: 10373 - RNA, 64 nt, Human
aggcccuuacuaucugugccugggucuagcacucagggcccacugccuaugagucuagaaggcu

SEQ ID NO: 10374 - RNA, 64 nt, Human
acuuuauauuuuguauuaugucaaauguuauggcagggcccaaauagcauagccacaaguuugg

SEQ ID NO: 10375 - RNA, 64 nt, Human
ggcaccaccugccugccugucgugccuuggacccagggcccagcuucccaggagagaccaaagg

SEQ ID NO: 10376 - RNA, 64 nt, Human
gcagagcaggguugaaaaaaauaucagcucccaaagggcccaugugucuacaucaucaguuacu

SEQ ID NO: 10377 - RNA, 64 nt, Human
aagugauguugaggugacgguggccucaggauucagggcccagccccugcaggggcccaggcug

SEQ ID NO: 10378 - RNA, 64 nt, Human
cuuccugagaacugaccuggaugcggcccucugcagggcccagucuucaguccuguggucccug

SEQ ID NO: 10379 - RNA, 64 nt, Human
ugaguugcccuugcucuucuggccuggccugcacagggcccagggagagauuuguucuugugug

SEQ ID NO: 10380 - RNA, 64 nt, Human
ugcccccugcuucccuaaggggcagguccagagcagggcccacaagggggauuagaguggccug

SEQ ID NO: 10381 - RNA, 64 nt, Human
guggcaggccuggucaggcucuccagguggucagagggcccaguggugccccagcacgguggug

SEQ ID NO: 10382 - RNA, 64 nt, Human
cucgccgcuccaaccaccagcuuccucagcgagcagggcccagggcucugggccugaagcaaga

SEQ ID NO: 10383 - RNA, 64 nt, Human
ucccuuuuuauuaagacaccagucauacuggcucagggcccaccgcuaaugccuuaaugaaauc

SEQ ID NO: 10384 - RNA, 56 nt, Human
caaggccacuguuuugcuagggccccagggcccacauuugggaaaguucuugaugu

SEQ ID NO: 10385 - RNA, 64 nt, Human
uucacugugacugggaccugaaugaccugcagucagggcccagaguugggacucuauacuaccc

SEQ ID NO: 10386 - RNA, 64 nt, Human
ccaauuuguaaaaacagcauugcuuucugaaauuagggcccaauuaauaaucagcaagaauuug

SEQ ID NO: 10387 - RNA, 64 nt, Human
aacgcaggugagcuggucauugucucguggccagagggcccagcagccacuguggaccuggggc

SEQ ID NO: 10388 - RNA, 64 nt, Human
ccggcgcuuugauugccugaguuucugacacuucagggcccagagguccugcgaggggcagaac

SEQ ID NO: 10389 - RNA, 64 nt, Human
cagaacuggacccccaugccagugcugcugcaggagggcccauauacuagggucugcugagcug

SEQ ID NO: 10390 - RNA, 64 nt, Human
gcccaaucauguguucaguagccguccucugagcagggcccaaggcagccaggggccuggaggg

SEQ ID NO: 10391 - RNA, 64 nt, Human
uuggccagggaggcgcagggacauggggcaagccagggcccagagcccuugacuguacagagac

SEQ ID NO: 10392 - RNA, 64 nt, Human
gccaagccaccccuagccuuggugggggaaaggcagggcccacccgggccagcccgugcccuga

SEQ ID NO: 10393 - RNA, 64 nt, Human
ccccagugauauggggggaggaggggcuagaacaagggcccaggggacuggaggcaggauggug

SEQ ID NO: 10394 - RNA, 64 nt, Human
ugaaggcugucccccaaccccacuccugagacauagggcccauccguccugggaaagagcaucc

SEQ ID NO: 10395 - RNA, 64 nt, Human
cucacaguuccugcaccucagcagccagggaagcagggcccagaggagacccaucaacucaucu

SEQ ID NO: 10396 - RNA, 64 nt, Human
gacuauuugcugugggcucuccuccagccugcccagggcccacccagaugccucugggguuacc

SEQ ID NO: 10397 - RNA, 64 nt, Human
gacugugcacauuucacuaggguccaaauacagaagggcccagggcccaggggcuugcagcuuc

SEQ ID NO: 10398 - RNA, 64 nt, Human
cacauuucacuaggguccaaauacagaagggcccagggcccaggggcuugcagcuucgugaggg

SEQ ID NO: 10399 - RNA, 64 nt, Human
ccaaguucaaggagcgcagauucaaugucuggugagggcccacuuccuaguucuuagacagcug

SEQ ID NO: 10400 - RNA, 64 nt, Human
aucccucuucccaucaauauccuaaaugugggggagggcccagagaauggcacccaagagccug

SEQ ID NO: 10401 - RNA, 64 nt, Human
agggccaggagcugccacacccccaaguccucucagggcccacccuccuuuuucagccucugca

SEQ ID NO: 10402 - RNA, 64 nt, Human
gguuugggagcuggguuuaggccccuggugucugagggcccaggccuugccagccucugcugcu

SEQ ID NO: 10403 - RNA, 64 nt, Human
aggaguuauuuaacaaugagcccagugacucaauagggcccaaaccuuuuuauuuuacaauaug

SEQ ID NO: 10404 - RNA, 64 nt, Human
ggaggcugccgaggccagggccuguggaggugccagggcccaccaugucgggguaugguuguag

SEQ ID NO: 10405 - RNA, 64 nt, Human
cugugcugcauacccaccgcccagcuucucccugagggcccaccagccugugcuguacaccccg

SEQ ID NO: 10406 - RNA, 64 nt, Human
cugugcugcauacccaccgcccagcuucucccugagggcccaccagccugugcugcauacccac

SEQ ID NO: 10407 - RNA, 64 nt, Human
gucuuggggccgaacagccccugcccugccucugagggcccaccagccugugcugcauacccac

SEQ ID NO: 10408 - RNA, 64 nt, Human
gccugaguggggccaagggaggcccagggggccgagggcccagguccccaucaugcccucacca

SEQ ID NO: 10409 - RNA, 64 nt, Human
ccgacgcgcaaccccgcucagcagucacagaagcagggcccagccaccuuggucuuuuuuuggg

SEQ ID NO: 10410 - RNA, 64 nt, Human
uugcucuuuggacuaggcugacagcaggaagagcagggcccaugaccggguggaaguucaguuu

SEQ ID NO: 10411 - RNA, 64 nt, Human
uguggcucauggccucugggcuggucccuugcacagggcccacgcuggagucuuaccacucugc

SEQ ID NO: 10412 - RNA, 64 nt, Human
cucagagcucuggaggcugggaaguccauaguggagggcccagagcccagugaggacccuucug

SEQ ID NO: 10413 - RNA, 64 nt, Human
gccagcucaaaucaggguccagugggaacugaagagggcccaagucggagcucggagggggcug

SEQ ID NO: 10414 - RNA, 64 nt, Human
ugaccucagguucccacaucaguggccacagggcagggcccaccugguagaaguguucuggaua

SEQ ID NO: 10415 - RNA, 64 nt, Human
uugaaaacacuacacagggcugcugucacuucccagggcccaggccucagcccaggccucggga

SEQ ID NO: 10416 - RNA, 64 nt, Human
aaaaggguggaugaaaaugcauuccgaaucugugagggcccaaaacagaauuuaggggugggug

SEQ ID NO: 10417 - RNA, 64 nt, Human
ccacaugcucugagaagaggagcccucaucuugaagggcccaggagggucuauggggagaggaa

SEQ ID NO: 10418 - RNA, 64 nt, Human
ccucuggggcucuaggguugcuggagccugagucagggcccagaggcugaguuuucucuuugug

SEQ ID NO: 10419 - RNA, 64 nt, Human
cgcucuuggugugcuucccgugaccuaggaccccagggcccaccuggggccuccugaacccccg

SEQ ID NO: 10420 - RNA, 64 nt, Human
uucuacaaaccaagcucagggccccaacccuagaagggcccaaaugagagaaugguacuuaggg

SEQ ID NO: 10421 - RNA, 64 nt, Human
cuccccagaagcucacacgcagcgucugaggugcagggcccaggugugcuggggugacaaagcc

SEQ ID NO: 10422 - RNA, 64 nt, Human
uucauuaccuuuuaaggacagugucuuugaauguagggcccacccugaucuagggugauugugu

SEQ ID NO: 10423 - RNA, 64 nt, Human
ggccccgacggacgcuugugaggcccgaggcagaagggcccaccccgucccuccucucccgcag

SEQ ID NO: 10424 - RNA, 58 nt, Human
aucauccagaacauaugugaguggggccagggcccaggccaggccgcuuuuuuacccc

SEQ ID NO: 10425 - RNA, 64 nt, Human
cuccugucugcccuagggagaaggcagguggacaagggcccaugaaaaaauacaggugucuaga

SEQ ID NO: 10426 - RNA, 64 nt, Human
cuuuuuccuuuuuuugguaacaagacuuagaaggagggcccaggcacuuucuguuugaaccccu

SEQ ID NO: 10427 - RNA, 64 nt, Human
ccaccaagaaggucauuuccaaacccauccuggaagggcccaggauccaaaggucaucaguccu

SEQ ID NO: 10428 - RNA, 64 nt, Human
ggggaccuuaggcacgccccaagcaccaggcaccagggcccaaggacgcgcagguguuggggca

SEQ ID NO: 10429 - RNA, 64 nt, Human
gagccuccccuggguuaacaaaugagccauccccagggcccacccccaggaaggccacagugcu

SEQ ID NO: 10430 - RNA, 64 nt, Human
agcuguccuacuccccaggacgaguuuucacuagagggcccacgaugccaggauucugauucau

SEQ ID NO: 10431 - RNA, 64 nt, Human
gucucgcugucucccucugugcagccacagccagagggcccagaauggccccacucuguuccca

SEQ ID NO: 10432 - RNA, 64 nt, Human
uuagcaacgcagaagaguacaaaguguggaagccagggcccagggaaggcagugcugcuggaaa

SEQ ID NO: 10433 - RNA, 64 nt, Human
cugucuuuguuagggucuaaucacccaccucuccagggcccauccccccucgggaaauggaagg

SEQ ID NO: 10434 - RNA, 51 nt, Human
augggggccccagcaguuaacagggcccagccacaaauucagcugaaggga

SEQ ID NO: 10435 - RNA, 64 nt, Human
gcuccgagacagcugcccauaaccugcuaaggucagggcccagggccccccacagcauggcuga

SEQ ID NO: 10436 - RNA, 64 nt, Human
aggaaacgcagggccugguuugggagagucaccgagggcccauguggcuggagguugggggcag

SEQ ID NO: 10437 - RNA, 64 nt, Human
uuauuauuaaagauugcuugguagugaaaagggaagggcccagaaucugacuggcugauucugu

SEQ ID NO: 10438 - RNA, 64 nt, Human
aggacagaugccacacaaggauagaugcuggcccagggcccagagcccagcuccaaggggaauc

SEQ ID NO: 10439 - RNA, 64 nt, Human
cucugucuuuacccuuuagaaacuggcauguguuagggcccagauuucaccagauacacaaucc

SEQ ID NO: 10440 - RNA, 62 nt, Human
uguugcuaaugcugaaguuuaaaucucaaggggaagggcccaccugcauuguugagugucug

SEQ ID NO: 10441 - RNA, 64 nt, Human
aaagggcuuuacagugggggcaccaagaccccaaagggcccaggccaggagacuguuaaaguga

SEQ ID NO: 10442 - RNA, 64 nt, Human
uauuacucucuauuuugagaagguagaagguaagagggcccauauucauucuuugccaugaaau

SEQ ID NO: 10443 - RNA, 64 nt, Human
augugccacugucacucagaagggcaagcuaggcagggcccauacaacagcaggggucugcagg

SEQ ID NO: 10444 - RNA, 64 nt, Human
caguggcuucccagcucugacccuucuacauuugagggcccagccaggagcagauggacagcga

SEQ ID NO: 10445 - RNA, 64 nt, Human
cagcacacugcagaagggcagcucagaagaaugcagggcccauucagcauggggaucccagcac

SEQ ID NO: 10446 - RNA, 64 nt, Human
uauuaaacaguauuugaaacagagaacgugucccagggcccaaaagucagaagggccccaccag

SEQ ID NO: 10447 - RNA, 64 nt, Human
agguacaggggcuucggggugcagacgucccuccagggcccauggucaguauugcaccuguguu

SEQ ID NO: 10448 - RNA, 64 nt, Human
gcacccagaacagugguggcaacauucauugccaagggcccaaagaaagagcuaccuggaccuu

SEQ ID NO: 10449 - RNA, 64 nt, Human
cuaauggcacucugacagcauccagggugacuacagggcccauuggaaauggaucaucauucuc

SEQ ID NO: 10450 - RNA, 64 nt, Human
aggguccgugcauuccugcucuccggacccccaaagggcccagcauuggugggugcaccaguau

SEQ ID NO: 10451 - RNA, 64 nt, Human
acaugagcuagggaaggcugaggaggacaggagaagggcccagacacucccuccagugaguguc

SEQ ID NO: 10452 - RNA, 64 nt, Human
uggaauccucuccgcacacuguggcccuugucucagggcccacaagcugaacuguggcauagcu

SEQ ID NO: 10453 - RNA, 64 nt, Human
uuggaaggggcaagaccucaaccuguugggguuuagggcccaugauggcagacauucuaccccu

SEQ ID NO: 10454 - RNA, 64 nt, Human
gguggucccccgagggcuuggugucuacuaccgaagggcccaagaccuccuggguccucucagg

SEQ ID NO: 10455 - RNA, 64 nt, Human
aggcaccagccgggccauaugcccagugccagcuagggcccaccgcccauccugcacacggggc

SEQ ID NO: 10456 - RNA, 64 nt, Human
agccuagccaaaaagggcuggcagcugucucuggagggcccagugccacuccucuggggugacc

SEQ ID NO: 10457 - RNA, 64 nt, Human
ugggugugccuaccuacuccucuuuucuuuuaaaagggcccacaaugcuccaauuuccugucuc

SEQ ID NO: 10458 - RNA, 64 nt, Human
ccacaucuugcuuuuuuuuuuaugaucagaacaaagggcccacucuaguucucuacaugucaau

SEQ ID NO: 10459 - RNA, 64 nt, Human
cuggcagagcuggaggaggaggagggcaaacccgagggcccagcgaacucuucgaaaaccugcu

SEQ ID NO: 10460 - RNA, 64 nt, Human
ucagugggguuagugagaagguugaaggguauguagggcccagggugggugucccugggagccc

SEQ ID NO: 10461 - RNA, 64 nt, Human
agccuggacagcuaccaggaucucacugggucucagggcccagagcuuuggccagagcagagaa

SEQ ID NO: 10462 - RNA, 64 nt, Human
cccuuccuccugagaguugaggccuguaaauacaagggcccaggacagagugugugcgugcgug

SEQ ID NO: 10463 - RNA, 64 nt, Human
cugaaggaagaggcugugagggcaguucagggccagggcccacagggcaucugcugaugggaag

SEQ ID NO: 10464 - RNA, 64 nt, Human
accgagagcaccuggugaugauggagaagauccuagggcccaucccaucacacaugauccaccg

SEQ ID NO: 10465 - RNA, 64 nt, Human
aggcacggagggaaggucagaggagaaggcaggcagggcccagugagaggggagcaugccuucc

SEQ ID NO: 10466 - RNA, 64 nt, Human
cuuggucacagggcgguucugggcacuugaacucagggcccaagcagaagcacaggcccagucc

SEQ ID NO: 10467 - RNA, 64 nt, Human
uuguaggaaggucuggccuggggucgggugaaggagggcccaggucaguucuggggucccagug

SEQ ID NO: 10468 - RNA, 64 nt, Human
ccagcagugcccccagcacuguccccaccuugcuagggcccagaaccaagcgucccccagcccc

SEQ ID NO: 10469 - RNA, 64 nt, Human
cagggccaugcacgcaaccugcacacgcacuuggagggcccaggugucucuccaccagccccca

SEQ ID NO: 10470 - RNA, 64 nt, Human
cacccuccccucucuugcacccgccucucccgucagggcccaagucccuguuuucugagcccgg

SEQ ID NO: 10471 - RNA, 64 nt, Human
aaucauguuuuugaaaaaucaagaccuccuguuaagggcccacuugacccuagaauaaggcagg

SEQ ID NO: 10472 - RNA, 64 nt, Human
gccaugcuggaaaccagcccaggccucccagggaagggcccagccacuuccagcuuuugaucuu

SEQ ID NO: 10473 - RNA, 64 nt, Human
agccugcacgucugucccucucugcuuucucuguagggcccagcucucaggaauacaaaguuga

SEQ ID NO: 10474 - RNA, 64 nt, Human
cugauaucacucauccuagacauccucgagaggcagggcccaauccuuccagacccaccagcug

SEQ ID NO: 10475 - RNA, 64 nt, Human
gaccccggcuggggcacaagagcaccagggggguagggcccaaagggaucaggggaagccucug

SEQ ID NO: 10476 - RNA, 64 nt, Human
uccuccagcucacuguggccagcuuugugcaaccagggcccacggcgccccuccugugcuguga

SEQ ID NO: 10477 - RNA, 64 nt, Human
ucugugucuccuucccauuugggacacccaggugagggcccagacaucuggauguggucagacc

SEQ ID NO: 10478 - RNA, 64 nt, Human
ugggcuagccugcacugccugggaaagucggccgagggcccaaagcugcugaggggucugaggc

SEQ ID NO: 10479 - RNA, 64 nt, Human
auucugcugugaggaggcccagaaaaggccaaccagggcccaaccgugcaugaugacaggguga

SEQ ID NO: 10480 - RNA, 64 nt, Human
agcuggucccacucaguccauagcagagaaugaaagggcccagagaggguggugaccucugccu

SEQ ID NO: 10481 - RNA, 64 nt, Human
cccuugguuacguccucauaaccuuagaccugaaagggcccauaaauauacuauguucacgauc

SEQ ID NO: 10482 - RNA, 64 nt, Human
cgggagcgagaagccaaggccagguucuggguguagggcccagagaagcagaacagcccagagc

SEQ ID NO: 10483 - RNA, 64 nt, Human
cgcggcgcagccccuggagcuccugcuggggggcagggcccaucugccgccuggggcuccggug

SEQ ID NO: 10484 - RNA, 64 nt, Human
cauccccuugucugaacuggagccaugggcacaaagggcccagauuaaagucuuuauccucagu

SEQ ID NO: 10485 - RNA, 64 nt, Human
cuccacagcugccuucaguggguagaauggggccagggcccagcuuuggccuuagcuugacggc

SEQ ID NO: 10486 - RNA, 64 nt, Human
cuauauuuaauuccaccagcaaagcuggcgaggcagggcccagcccugaaggagaucuccuugc

SEQ ID NO: 10487 - RNA, 64 nt, Human
gucauugucucccuaagcaauggggcaaggucugagggcccaccgaugagagagaugguggcag

SEQ ID NO: 10488 - RNA, 64 nt, Human
cccugggccuggggcagccuccuuccuguaggcgagggcccaagucugggggcagaaccugagu

SEQ ID NO: 10489 - RNA, 64 nt, Human
cuuugaguugugguggacgcuggccugggaugagagggcccagaagaccuucguauccccucuc

SEQ ID NO: 10490 - RNA, 64 nt, Human
ggcagccuggaccacuccucauagcaauacuuggagggcccagcccaagugaggcagccgaggu

SEQ ID NO: 10491 - RNA, 64 nt, Human
gcucugucuucccacugucccccccaucccgggcagggcccagugggauugagggggcuggguc

SEQ ID NO: 10492 - RNA, 64 nt, Human
gcgucacagaggcucucacacuccagccuccuccagggcccaggugggcgggcuucuggcccca

SEQ ID NO: 10493 - RNA, 64 nt, Human
uccucuggcccugcugcccccacacccaacuccgagggcccacgcuggggaaagcgggaagcgc

SEQ ID NO: 10494 - RNA, 64 nt, Human
gucucgccaucaggcagggacaggacgggcaagcagggcccaucuuacauccucucucuccaag

SEQ ID NO: 10495 - RNA, 64 nt, Human
gagaagguaaggugugaaccuaccugccuuggagagggcccaggucccaaaucucuucaaauuc

SEQ ID NO: 10496 - RNA, 64 nt, Human
cuucuuguggaggggaagguagagugaaagaaagagggcccacuuucuaacaggguggagcaaa

SEQ ID NO: 10497 - RNA, 64 nt, Human
ccuggacugcagugcaggagaugacagagugaggagggcccagagcagaauucuggccccagaa

SEQ ID NO: 10498 - RNA, 64 nt, Human
cgggugccugagcuuagguuguggaguggcugagagggcccaggagggcucgggacagcugugu

SEQ ID NO: 10499 - RNA, 64 nt, Human
ggaggguuguccucugacaggccuggcacggaggagggcccaccgaguggucccaugaaacacu

SEQ ID NO: 10500 - RNA, 64 nt, Human
ccagcgagcccacuguaucugggcccaaggccagagggcccagagagaagccugagcaccgugu

SEQ ID NO: 10501 - RNA, 64 nt, Human
uguggggcaggggaggcauccuuacuggagaggcagggcccagccauugggcaccucugggaag

SEQ ID NO: 10502 - RNA, 64 nt, Human
ggggaaggcaggagccuuccuuucuccugccccaagggcccagacccugggcaaacagagcuac

SEQ ID NO: 10503 - RNA, 64 nt, Human
gcccgcaccccagggagcggcgggggcggcgcgcagggcccacugugcccgggacaaccgcagc

SEQ ID NO: 10504 - RNA, 64 nt, Human
aaaagcagacacauagaucaauggaacagaauagagggcccagaaauaaagcuacacaccuaca

SEQ ID NO: 10505 - RNA, 64 nt, Human
agaacugagggcacguggggugcggcagcgggcuagggcccagggcagcuugcccgugcugcug

SEQ ID NO: 10506 - RNA, 64 nt, Human
uacagccguggggggaagcacauaaucccgccccagggcccacuagcauccacugauuggaccu

SEQ ID NO: 10507 - RNA, 64 nt, Human
gguuucucacaccucuguucccagggccccgcucagggcccagcagagaguccguaggcuugaa

SEQ ID NO: 10508 - RNA, 64 nt, Human
ugaagcugaaugccugaggggccuggaagcugcgagggcccagugaacuuggugggcccaggag

SEQ ID NO: 10509 - RNA, 64 nt, Human
cagaccuggcuccucggcagagcugccucccgucagggcccacaucaucuaggcuccccagccc

SEQ ID NO: 10510 - RNA, 64 nt, Human
ggccuuguuuuccgcuaauuccagggcagauuccagggcccagagcuggacagacaucacagga

SEQ ID NO: 10511 - RNA, 64 nt, Human
auucagaacagaagccauguaucucccccacaccagggcccaccauggagcuuguguucucaga

SEQ ID NO: 10512 - RNA, 64 nt, Human
uuuccccaaagacgaccagcauuuaaccaaccuaagggcccaaaggccuuggacaacugcaugg

SEQ ID NO: 10513 - RNA, 64 nt, Human
cuugaaggucgguggcggaggggguggcucucacagggcccaacucuaaaguggaagaaccuug

SEQ ID NO: 10514 - RNA, 64 nt, Human
gcauacccugccccuggaugggaaaggcagggucagggcccacugagacccaugcagaguuucc

SEQ ID NO: 10515 - RNA, 64 nt, Human
uggcuugcaaaggggguagguggggagagauaggagggcccagggacucaugggacaccuuucc

SEQ ID NO: 10516 - RNA, 64 nt, Human
ccgcauggcggcagcccaccuugguaagggccccagggcccaugcgagagcugccugauggccu

SEQ ID NO: 10517 - RNA, 64 nt, Human
cuggucuuccagcgaggugggagaggccucauccagggcccagcggucccugcagaagccagaa

SEQ ID NO: 10518 - RNA, 64 nt, Human
uccuaccucuugcccagucccaggcagaguaagcagggcccaccuagggaccaagaaagaguag

SEQ ID NO: 10519 - RNA, 64 nt, Human
cucgcccuucuccugugaggggagccaggcacacagggcccauugguguuugggauguggacag

SEQ ID NO: 10520 - RNA, 64 nt, Human
accaagauuuugaaggaaaugaguggccagcgccagggcccaggccauguggccugcccagccu

SEQ ID NO: 10521 - RNA, 64 nt, Human
ccucugugcagggucugcagggaucuggauugcaagggcccaagucugcaggucuggaagcauc

SEQ ID NO: 10522 - RNA, 64 nt, Human
auugaggcccgccacccccauaacuuugggagcgagggcccagccgaggguggauuuaucuucu

SEQ ID NO: 10523 - RNA, 64 nt, Human
ccuagugugcuaagcugagcagugcagugugaacagggcccaugguguauucuaggccacagcc

SEQ ID NO: 10524 - RNA, 64 nt, Human
gcugccccucuaggucugggcagccaugaccugcagggcccagagacacuguccuuccccucau

SEQ ID NO: 10525 - RNA, 64 nt, Human
uuccccucacuauccuaccccacccgcuccuugaagggcccagauucuaccacacagcagcagu

SEQ ID NO: 10526 - RNA, 64 nt, Human
gcacccucuacccuccguggccauggcaacguccagggcccagaacccugaggagugagcggcc

SEQ ID NO: 10527 - RNA, 64 nt, Human
uagaaccuagggaaugccagaggagcaaggaugcagggcccaggacuccagagcugugaccugg

SEQ ID NO: 10528 - RNA, 64 nt, Human
cacuggcuaccagacucagcccugagcagggaacagggcccagcuuccaccggcagggaguugu

SEQ ID NO: 10529 - RNA, 64 nt, Human
caccgaccaacugcccuaagcccccagggccuccagggcccagguucgagacccaaacccccaa

SEQ ID NO: 10530 - RNA, 59 nt, Human
ggucagacacguuccacugacccuggcccagggcccaggccugucuggggugggcgcug

SEQ ID NO: 10531 - RNA, 64 nt, Human
gguagagagagguugcuauaaaacgagcauuuggagggcccacggcuucacucaggaccugcug

SEQ ID NO: 10532 - RNA, 64 nt, Human
acuggugggaucugugcccagagaugggacugggagggcccacuucaggguucuccucuccccu

SEQ ID NO: 10533 - RNA, 64 nt, Human
cccuccaggcugcugugagagugucaaguguguaagggcccaaacucagguucagugcagaacc

SEQ ID NO: 10534 - RNA, 64 nt, Human
ggugguagaggagguaagacaguagggaaagacaagggcccaugcucuuaguggggaaaacucu

SEQ ID NO: 10535 - RNA, 64 nt, Human
guguauuucucugugaauccaugggucuggcuagagggcccaaagcuuguaaauauggggauag

SEQ ID NO: 10536 - RNA, 64 nt, Human
gggcagcuggaaagcaacacuggcccccagcugaagggcccagcugcagccagacagauggugc

SEQ ID NO: 10537 - RNA, 64 nt, Human
uuccuuguaaauuacaucugucaugguuucuuggagggcccacuuguauccucugguucuucau

SEQ ID NO: 10538 - RNA, 64 nt, Human
cgaugggagucucccuccgacuccagauaugaacagggcccaggccuggagcguuugcugugcc

SEQ ID NO: 10539 - RNA, 64 nt, Human
ugccaucagauucaagcccaggaggcugaaaacgagggcccaggaccagaaucgcugccuccuc

SEQ ID NO: 10540 - RNA, 64 nt, Human
ccugcuguccucccacggcugcagcagaguuugaagggcccagccgugcccagcuccaagcaga

SEQ ID NO: 10541 - RNA, 64 nt, Human
uaaagggaaaaaauggauucaaagcuaggauuucagggcccagcaguguuccuccaucagcaug

SEQ ID NO: 10542 - RNA, 64 nt, Human
agugggccaaguugggcaggacccccgccccugcagggcccaugcaccagagccacugagccca

SEQ ID NO: 10543 - RNA, 64 nt, Human
cucuggcucuggcuguggcucccgccuguccggcagggcccagggccagcgucgggcacagggc

SEQ ID NO: 10544 - RNA, 64 nt, Human
ugcggguugcccgccuccuccagagacuugcccaagggcccaucaccacuggccucugggcacu

SEQ ID NO: 10545 - RNA, 64 nt, Human
uuuuuaacgaugcaguauuugugcguuccagaaaagggcccagcucugagccccucacccuucc

SEQ ID NO: 10546 - RNA, 64 nt, Human
ggcacgggggcaugggcagagagggccacggggcagggcccacugagggaacaucaguggcccu

SEQ ID NO: 10547 - RNA, 64 nt, Human
ugagauccauccacgauccagcuccgguggagaaagggcccaugucaagccuuguucugcaccc

SEQ ID NO: 10548 - RNA, 64 nt, Human
cuggcacgacuccgucaccgccugccaggaagugagggcccagcucgucguaaucaaaacugcu

SEQ ID NO: 10549 - RNA, 64 nt, Human
agcgacuucccccgaccccuaccccacgcuacccagggcccagcggccaccccguaccacuguu

SEQ ID NO: 10550 - RNA, 64 nt, Human
agccuucagaggaccuaagacccaccuaugacucagggcccaccacaccccacccccccccaac

SEQ ID NO: 10551 - RNA, 64 nt, Human
cucucaguacuuguuacccagcuucucaacauccagggcccaauuugcccugccuggaguuccc

SEQ ID NO: 10552 - RNA, 64 nt, Human
caaacccgugacacuccaaacucgauuaugcuccagggcccacuuucuaaaccuguaagaucua

SEQ ID NO: 10553 - RNA, 64 nt, Human
gcccccuggcccacccccacuuuccagggcaaaaagggcccaggguuauaauaaguaaauaacu

SEQ ID NO: 10554 - RNA, 64 nt, Human
ucaggccggggcggugggaggcccgccucaggucagggcccagcgugugauguaggggccgggg

SEQ ID NO: 10555 - RNA, 64 nt, Human
cauggagggagacggggaugucacgccgucccgcagggcccagcacagccccagacccgaaaaa

SEQ ID NO: 10556 - RNA, 64 nt, Human
gggguggggguggugguggggguaguggccggugagggcccaggcuggucagcgucccgucuug

SEQ ID NO: 10557 - RNA, 64 nt, Human
aucacagcauacgugugacccaguuugggucaggagggcccagccuugguucugcuggacacuu

SEQ ID NO: 10558 - RNA, 64 nt, Human
caggacuagggacagggcugugccggccugggccagggcccacggacccgcagcucagggcgcc

SEQ ID NO: 10559 - RNA, 64 nt, Human
cagagcuggguccccccaaaacuugggcuggcccagggcccaccagcagcugauguugccuccu

SEQ ID NO: 10560 - RNA, 64 nt, Human
cagcccugaugacacccugcgagaccuggagcguagggcccagcuagcccgcaccuggauuucc

SEQ ID NO: 10561 - RNA, 64 nt, Human
ucuuccaacguaggccacucagcaacuggcauggagggcccaggcaacggagacguuuucucca

SEQ ID NO: 10562 - RNA, 64 nt, Human
ucaccugcuaggagccucacccgcugggaggcacagggcccaagggagcuggauguguugccca

SEQ ID NO: 10563 - RNA, 64 nt, Human
ggugcacacaggucacacagugccaagaggccccagggcccagggacuccccccacagcagggu

SEQ ID NO: 10564 - RNA, 64 nt, Human
gggaggggcaaccaggccucccagcgaguccugcagggcccaucuagaggacuuugggggccau

SEQ ID NO: 10565 - RNA, 64 nt, Human
ccuuucuaccaguuguggaccaugagagggugggagggcccagggagggcuuucguacugcuga

SEQ ID NO: 10566 - RNA, 64 nt, Human
ccagaugggacauguuccauagccuugcuggggaagggcccacugccaacucccucugccccag

SEQ ID NO: 10567 - RNA, 64 nt, Human
ugccuccugacagcuuccaaagagcugacuguggagggcccacaguguaucccaccccugcccg

SEQ ID NO: 10568 - RNA, 64 nt, Human
aaagguggugggggguggauggcggcugugacucagggcccagggaucacaugggggucacugc

SEQ ID NO: 10569 - RNA, 64 nt, Human
cagccccuccuuccaggucuugaugggagggaggagggcccagaagcuggacaacuuaagccac

SEQ ID NO: 10570 - RNA, 64 nt, Human
uuggaugccuggaucucuguaagggccagaagugagggcccagaggucugggucccccaggggg

SEQ ID NO: 10571 - RNA, 64 nt, Human
ucucuaccauguagaauugugcuuggcucauaauagggcccagcaauuacugaagaaagugaag

SEQ ID NO: 10572 - RNA, 64 nt, Human
ccugugcuuggcugggccugacccuuccugucccagggcccaggucugugugauaucuguauau

SEQ ID NO: 10573 - RNA, 64 nt, Human
ucaaucucccuggggcacuuucauccucaagcucagggcccaucccuucucugcagcucugacc

SEQ ID NO: 10574 - RNA, 64 nt, Human
ugacuccugguccuaggcuggaaggaggaagaauagggcccaugggagggagcugagaagacuc

SEQ ID NO: 10575 - RNA, 64 nt, Human
uaaguccaccccaggggcuggaaaccuggaguucagggcccagacuuugggguccgggagcuga

SEQ ID NO: 10576 - RNA, 64 nt, Human
gauuacagcauacaucugaccaguuuuggccagaagggcccagccuggguucugcuggaagcug

SEQ ID NO: 10577 - RNA, 64 nt, Human
augugugaacugcauugcaccuuuugcccugcccagggcccaugucagauuuaugucucugcug

SEQ ID NO: 10578 - RNA, 64 nt, Human
cucucacacuucacaacaauuuccucaacacuugagggcccagaaagucugaucucuccagaau

SEQ ID NO: 10579 - RNA, 64 nt, Human
accgucugccacaccgagaucugcugggucaccaagggcccacgcuggggcccuggggugaguc

SEQ ID NO: 10580 - RNA, 64 nt, Human
uuucuguagggcugaaugacucuuuuuccugcccagggcccauucuugcuucucaggcaccuuc

SEQ ID NO: 10581 - RNA, 64 nt, Human
ugguggcugcaagguggcuccagcaccauccgccagggcccacacccccuuccuacucccagac

SEQ ID NO: 10582 - RNA, 64 nt, Human
guuugccaaggcucugaccucacagaagaugcccagggcccagaagccaucagaauuaucagug

SEQ ID NO: 10583 - RNA, 64 nt, Human
gcaguuguaggcauguagcuacaggacauuuuuaagggcccaggaucguuuuuucccagggcaa

SEQ ID NO: 10584 - RNA, 64 nt, Human
agacaacauccugugacugccaggcagaaaggacagggcccaggucagccucagucugcugugc

SEQ ID NO: 10585 - RNA, 64 nt, Human
gcggcuuucugggucucagcccucucugcgguugagggcccagaggacagagagauggacaugc

SEQ ID NO: 10586 - RNA, 64 nt, Human
gucuccaccccccuccccccgccccgcacuccuaagggcccaucugcccagccucugaguuuuc

SEQ ID NO: 10587 - RNA, 64 nt, Human
caggagcagggcagcuggcuggaccagaaaguagagggcccaugggagugacugcacccuuggu

SEQ ID NO: 10588 - RNA, 64 nt, Human
gaucugaggugagucccaggauguuucguccaccagggcccagauucugggaggugcuggggac

SEQ ID NO: 10589 - RNA, 64 nt, Human
augccucugcagccacaauucugaccuaaguggcagggcccagaaauccugaaaaccucccgcu

SEQ ID NO: 10590 - RNA, 64 nt, Human
gaagagcugcagaugccgagaagccagcaaacacagggcccacuggaaaaaaauaguuuuuuca

SEQ ID NO: 10591 - RNA, 64 nt, Human
cuccaaccacaggacccuucggcucaccaagaacagggcccaggggagucaggccuauucgcug

SEQ ID NO: 10592 - RNA, 64 nt, Human
ugcugagaagccaccgggaaagcagccagcacaaagggcccaggaagccagcccccgagagcug

SEQ ID NO: 10593 - RNA, 64 nt, Human
ggaccggugcuggggccucuccuugcugugugugagggcccagguggaaggcgcggaccugaca

SEQ ID NO: 10594 - RNA, 64 nt, Human
agccucagacuccaagcuaggcugaggcucaggcagggcccacaggcagccgauucucuugugc

SEQ ID NO: 10595 - RNA, 64 nt, Human
uugcaagauuccugaaauuuaacaauugguuuucagggcccaguccaagccugcugcuggaaac

SEQ ID NO: 10596 - RNA, 64 nt, Human
caggcuuccuuuucaaccuaaccagccacagccaagggcccaagcagaaguacacccacaagca

SEQ ID NO: 10597 - RNA, 64 nt, Human
augcccugugaaauggcuugucuccucccccaucagggcccaccgaaagcucaggggagcacag

SEQ ID NO: 10598 - RNA, 64 nt, Human
uuucuacaaaagauuguaaaacccuuuuuaggcaagggcccaaggacagugccuuaguuuggau

SEQ ID NO: 10599 - RNA, 56 nt, Human
ucacccuggccgaugacugagccccgagggcccaacacagaucauggauuugcggc

SEQ ID NO: 10600 - RNA, 64 nt, Human
ggacccgcuuuagcccugcugcgggaaaugggggagggcccagggccagcgcauugugcacugg

SEQ ID NO: 10601 - RNA, 64 nt, Human
ugggcacaggcugccccaccccuccaugauuccaagggcccagaggggcggggccaggauggcg

SEQ ID NO: 10602 - RNA, 64 nt, Human
agaaccccagcccuguccagguggcuccgcgcccagggcccaggcuuagcagugcucccugccc

SEQ ID NO: 10603 - RNA, 64 nt, Human
ucggcucccuguggcuugugcccaugcaccugccagggcccagcaggccaacccaucaucuaga

SEQ ID NO: 10604 - RNA, 64 nt, Human
aggugcgcaguguggggaggggauggggugcgucagggcccagcaucgccgccuggcaucucuc

SEQ ID NO: 10605 - RNA, 64 nt, Human
caaugaauuuagggguuacgauuauagcaauuuaagggcccaccagaagcaggccucgaggagu

SEQ ID NO: 10606 - RNA, 64 nt, Human
gaggugcuugcccccauguggguguggcaguuacagggcccaggugagcugaagacaaaccacu

SEQ ID NO: 10607 - RNA, 64 nt, Human
gggggccacagcaccagcagcaucuuugcugggcagggcccagcccuccacugcagaagcaucu

SEQ ID NO: 10608 - RNA, 64 nt, Human
aggguggcucccuccuccccaucaagcacaagagagggcccaggaaaaaagguuucacauaagu

SEQ ID NO: 10609 - RNA, 64 nt, Human
ucagccgggaugccugcaucccacccccggccccagggcccaccacauaaaaucugggagccca

SEQ ID NO: 10610 - RNA, 64 nt, Human
ggcacuuuguucucacgguguccuccaugccugcagggcccaugcaugggaaguugcguuggcg

SEQ ID NO: 10611 - RNA, 64 nt, Human
cacuugugguucuaaaaggugugaaggugauuuaagggcccaggucagccacuguuuguuuaca

SEQ ID NO: 10612 - RNA, 64 nt, Human
gaaggcccgaggaggccgacugggcugcuggggcagggcccagggagguggcagggaagggugc

SEQ ID NO: 10613 - RNA, 64 nt, Human
cgcuccuggauuggagcagugugcucuggcgggaagggcccaucccguuggucgaggccugaca

SEQ ID NO: 10614 - RNA, 64 nt, Human
gcuuugcggcggugugagcuggcggucaggagugagggcccagccuucccggcaccucccagcc

SEQ ID NO: 10615 - RNA, 64 nt, Human
agaaaaaacccauccuaaaggcugggcccaugcaagggcccaccugaauaaacagaaugagcug

SEQ ID NO: 10616 - RNA, 64 nt, Human
aucuacaagagcccugaccacagggugagacagcagggcccaggggaguggaccagcccccagc

SEQ ID NO: 10617 - RNA, 64 nt, Human
aguggugaccugaggaacugccccccugcaaagcagggcccaccuccuggacucagagagccca

SEQ ID NO: 10618 - RNA, 64 nt, Human
guuccuggcgggcacacucaggaccgugccucacagggcccacucccugccuaugccucccucu

SEQ ID NO: 10619 - RNA, 64 nt, Human
ugcucaggcccuaacccuuggcuccaggagacacagggcccagcacccagguugcugucggcag

SEQ ID NO: 10620 - RNA, 64 nt, Human
augggaggcugccuuccuucccaaucucccugccagggcccacagcguggcccuagcccucccc

SEQ ID NO: 10621 - RNA, 64 nt, Human
agucugcuccuaguggcacuggcuucguccucccagggcccagaguguuccccaugcuccaccu

SEQ ID NO: 10622 - RNA, 64 nt, Human
agacacacaugggcagcccaaagcugcaggugccagggcccaccccagccucgccugucacccc

SEQ ID NO: 10623 - RNA, 64 nt, Human
uugacuuagggaacaagcccugggauuggacaaaagggcccaugcugcagccacugacuggggg

SEQ ID NO: 10624 - RNA, 64 nt, Human
caggaacccggccagguccccccacaugccccucagggcccaggccugagugagugcugcucag

SEQ ID NO: 10625 - RNA, 64 nt, Human
cagcagguccucgcugggcagaugcugcucccugagggcccaggugguggaggugggguuggag

SEQ ID NO: 10626 - RNA, 64 nt, Human
ugugagagagaagaaaaugguggccggagaugggagggcccaaggaaccuccugggagggggcc

SEQ ID NO: 10627 - RNA, 64 nt, Human
aagccuugaaaaccacggagguggaugccaggaaagggcccauguggcagaaggcaaaguacag

SEQ ID NO: 10628 - RNA, 64 nt, Human
cagcacaccuccucgaaccucauugucagcagagagggcccaucuguugucuguaacaugccuu

SEQ ID NO: 10629 - RNA, 64 nt, Human
aauauaauguguuaggaaauuacagucauuucuaagggcccagcccuugacaaaauugugaagu

SEQ ID NO: 10630 - RNA, 64 nt, Human
gagaagccuauuuuuauauuuuuaaaaaacugacagggcccaguuaaauaugauuugcauuuuu

SEQ ID NO: 10631 - RNA, 64 nt, Human
uccugauggggaggcagagccaggaagcuaagccagggcccagcugcguccaacccagcccccc

SEQ ID NO: 10632 - RNA, 64 nt, Human
gaggacucaggccgcagcccccgcgacggagggcagggcccacccugcggugucgcgcgccugc

SEQ ID NO: 10633 - RNA, 64 nt, Human
uucuccagaccccccugcuucaggaacacccgccagggcccaccccucccaccccgucccagca

SEQ ID NO: 10634 - RNA, 64 nt, Human
uggcauugcucaaaucugcuguguaugaggucacagggcccagcuguggcaggggugagugcau

SEQ ID NO: 10635 - RNA, 64 nt, Human
gguguccuccacguggcugcccuggggagcaaucccagcggaucgcuccgggccaccaagccgc

SEQ ID NO: 10636 - RNA, 54 nt, Human
uguggguugucucuucaugaagaaccagcggaacucaaaacugcuguucaagaa

SEQ ID NO: 10637 - RNA, 64 nt, Human
uccagggaggggaggggaugggaagcaccaccagccagcggaagagcagcccucuggugggcgg

SEQ ID NO: 10638 - RNA, 64 nt, Human
cacuccucagccucucccgggaguuccugcggucccagcggaacucagggagucuauuuaugaa

SEQ ID NO: 10639 - RNA, 63 nt, Human
accggcagcacgccuccuaggaacugugggagaccagcggagugggagggagacgcaguagac

SEQ ID NO: 10640 - RNA, 64 nt, Human
ccuccaccgccucuacccucacugggugggacugccagcggagaguccgcgggagguggcuugg

SEQ ID NO: 10641 - RNA, 64 nt, Human
ucccuucccccuucuuaugccccucucagaccacccagcggaugccuauucccgccccccaccc

SEQ ID NO: 10642 - RNA, 64 nt, Human
cugcuaacagaagcuggucugcauguuuguggauccagcggagaguggcagacuuucuucuccu

SEQ ID NO: 10643 - RNA, 64 nt, Human
uaucacaagaagauuaaaguggcagacaccccuuccagcggaaguuacuaauucggaccugacu

SEQ ID NO: 10644 - RNA, 64 nt, Human
cugacagccagcacuguguauuaucacucaggaaccagcggaucugcaaagaccuacaaucaaa

SEQ ID NO: 10645 - RNA, 62 nt, Human
auccaggggccauagacuaagcgggugaugccccagcggauguuggccacggaggagcugag

SEQ ID NO: 10646 - RNA, 64 nt, Human
gcaggaagacccaacacaugggaccuauaacugcccagcggacaguggcaggacaggaaaaacc

SEQ ID NO: 10647 - RNA, 64 nt, Human
gcuuacucacuagaacuucccugugugcugugagccagcggaaccacuuguacaaugccagauu

SEQ ID NO: 10648 - RNA, 64 nt, Human
cugccggccagagccucccggcguuucuuccgccccagcggagugcgcuggggcgcgccagggc

SEQ ID NO: 10649 - RNA, 64 nt, Human
ucccgagcacagcaccuucccagucuccugugccccagcggacagcacugagcaggccccggag

SEQ ID NO: 10650 - RNA, 64 nt, Human
gaagagacacaggccacacauuucaggcugguugccagcggacgucagcacucacggccugcag

SEQ ID NO: 10651 - RNA, 64 nt, Human
acagccugcgagucuaauccgggagcggcugcugccagcggaggcgacagcagcguugggagcu

SEQ ID NO: 10652 - RNA, 64 nt, Human
guguuuugccuguccccaggguagaaauguccuaccagcggauggagaauccuggcugccaugu

SEQ ID NO: 10653 - RNA, 64 nt, Human
ggccugggacccaagcugccgcagcugaguggccccagcggacaccuccucaggcuuaaaucuc

SEQ ID NO: 10654 - RNA, 64 nt, Human
gcagaugugaacugacaaggagugaagcgcccacccagcggauggacagcacccaccuggguuu

SEQ ID NO: 10655 - RNA, 64 nt, Human
aagagaacagaccauugaaaagacuauuaucugaccagcggaggcagaaaagagaggaacccag

SEQ ID NO: 10656 - RNA, 64 nt, Human
uaugcacagacugauaauaaaccucuaaaccugcccagcggaaguguguuuuuuuuuaaauuua

SEQ ID NO: 10657 - RNA, 64 nt, Human
aaguaacaggauauuuaauaagaguccuagauagccagcggagacuuuaagaaucauugccucu

SEQ ID NO: 10658 - RNA, 64 nt, Human
caggugauggcagggccaggguggccuggggcacccagcggaaugugcuuaguauuuggucacc

SEQ ID NO: 10659 - RNA, 64 nt, Human
cucccccacugcaccccaagagagagagccccagccagcggaacaguuucuauuacccccuccc

SEQ ID NO: 10660 - RNA, 64 nt, Human
cugcaucggccaaauuggggagggcauggaagauccagcggaaaguugaaaauaaacuggaaug

SEQ ID NO: 10661 - RNA, 64 nt, Human
cggagccgcacucuuuagccccggagcuccaggcccagcggaugcuggcacccaagcgcagcug

SEQ ID NO: 10662 - RNA, 64 nt, Human
gcuccugcagccggcccugcagcgcuacuuucugccagcggacgcggacccugacaccuacagc

SEQ ID NO: 10663 - RNA, 64 nt, Human
gugaccacaacuauacuguggaggauacaaugcaccagcggaaaaggauucaucagcuagaaca

SEQ ID NO: 10664 - RNA, 64 nt, Human
gcccggaagugaagcuggaagacaggaucaggugccagcggaccaucggcuggcagagcccagc

SEQ ID NO: 10665 - RNA, 64 nt, Human
gcaaucuuugcuucuuguaggcuaucgccccauuccagcggagacuuauguaggagggaccuuc

SEQ ID NO: 10666 - RNA, 64 nt, Human
ccggcuccuguccccuggcuucuccacagguuuuccagcggaggguggauggcucuguggacuu

SEQ ID NO: 10667 - RNA, 64 nt, Human
cuggagcaugagccagcucugucccaggauggucccagcggaugcugccaggggcagugaagug

SEQ ID NO: 10668 - RNA, 64 nt, Human
cucuguggcugaugggacuaauuauucccacuagccagcggacugaaggcaaagaagaccuuuc

SEQ ID NO: 10669 - RNA, 64 nt, Human
gcacugcuguggccacugcugaccacugaggcucccagcggaggguguucacagccaggucccg

SEQ ID NO: 10670 - RNA, 64 nt, Human
cgagcccagcugcugagcaggggugggacaugaaccagcggauggaguccagcaggggaguggg

SEQ ID NO: 10671 - RNA, 63 nt, Human
ccuggucccgcaguuucugaaacggaaucccagccagcggauuggggguggcccaggggaugc

SEQ ID NO: 10672 - RNA, 64 nt, Human
uggguguuuucuaccacagauugauuuggcucagccagcggaauuggccacauuuccaguguau

SEQ ID NO: 10673 - RNA, 64 nt, Human
ggacggggcugaggcccugcguggagaugcugcaccagcggaaggcugagacccgcuuaccuua

SEQ ID NO: 10674 - RNA, 64 nt, Human
acccugcacguugugcacugaccuuugccgaccuccagcggaaccccccagggggcaccagccc

SEQ ID NO: 10675 - RNA, 64 nt, Human
guuuauaggugagaauaggcuguauuauaugaaaccagcggagggaugcugagacagucauggu

SEQ ID NO: 10676 - RNA, 64 nt, Human
ucauugccauguagugucugccugaaaaugggucccagcggacaggggcugacccacguuacuc

SEQ ID NO: 10677 - RNA, 64 nt, Human
agguuuaugggcuauuacuuucauuuucguguugccagcggagcagugcccugguacuugcugu

SEQ ID NO: 10678 - RNA, 64 nt, Human
ccaugugaaaagauccgcuaagacagcaugucugccagcggaaacuucucgagcuccccccucu

SEQ ID NO: 10679 - RNA, 64 nt, Human
acgccuguaaucccagcacuuugggaggccaaggccagcggaucacuugaggucaggaguucga

SEQ ID NO: 10680 - RNA, 64 nt, Human
gguguaugcuuuuaacuuugaaauguauaaacacccagcggaaacguauaccuuucagugcaua

SEQ ID NO: 10681 - RNA, 64 nt, Human
aaaaaccugcaaaccagcgcuuccugagacggggccagcggaggcagagccgggaggcugcgug

SEQ ID NO: 10682 - RNA, 64 nt, Human
ugagcucauccgccguggagagcgaggccacgcaccagcggaagcuccggcagaagcagcugca

SEQ ID NO: 10683 - RNA, 64 nt, Human
aggaagccaagaaacuggaugccaagaccccaucccagcggaacaaguggcaacagcaggaguu

SEQ ID NO: 10684 - RNA, 64 nt, Human
aaaauuuaaguguggcucugugccuaugcucuccccagcggaaagugaccagaagaggugugca

SEQ ID NO: 10685 - RNA, 64 nt, Human
uucccuacuggcugcuccccuugggucccgcccaccagcggacucggcccccaaggcuccgccc

SEQ ID NO: 10686 - RNA, 64 nt, Human
cccagccccuacaccccgcuucucccggacucucccagcggacagccccccagccccacagccu

SEQ ID NO: 10687 - RNA, 64 nt, Human
aaagaccugcauccugcaucuguacuuggggaagccagcggagaggacggggagguuacuucuc

SEQ ID NO: 10688 - RNA, 64 nt, Human
gcacgaaaaggauuggggcgggcaagggggacagccagcggagaugaggggagcuggcgggcac

SEQ ID NO: 10689 - RNA, 64 nt, Human
cccagcugacacuugagcccagcauccuggggauccagcggauggacagcuuggcucucccaga

SEQ ID NO: 10690 - RNA, 64 nt, Human
ucuuuguaccugcccugcacuaugaaguggaugcccagcggaaggaggcaauuaaggcaaaggu

SEQ ID NO: 10691 - RNA, 64 nt, Human
uguugguccccuguucagaauggagugcagcccgccagcggaaaguguucauucugcauaggug

SEQ ID NO: 10692 - RNA, 64 nt, Human
ucacaacaggccagugggcaaacgugagccagggccagcggagaaacacuaaagaagacucggu

SEQ ID NO: 10693 - RNA, 64 nt, Human
ucugagaaaggagcucaguggggagguggucccuccagcggaccagggaaggggucaccgugcu

SEQ ID NO: 10694 - RNA, 64 nt, Human
auccauuguagggggaaucuaugauucugcuuccccagcggauucccacucuguccaccaagug

SEQ ID NO: 10695 - RNA, 64 nt, Human
caggcagggccacggcugggcuccagcugccggcccagcggaucgucgcccgaucaguguuuug

SEQ ID NO: 10696 - RNA, 64 nt, Human
agaaauuaccagaagccucgccuuuuccuaagcaccagcggaaggagcugugccccgggaugga

SEQ ID NO: 10697 - RNA, 64 nt, Human
gaacucuuggagcuuaggggagacccacgucgcuccagcggaggcuggacugcgagccucgucu

SEQ ID NO: 10698 - RNA, 64 nt, Human
agcugcuguuccggcugcccagccuuucucugagccagcggaugcacaguccguggccuucuuc

SEQ ID NO: 10699 - RNA, 64 nt, Human
gugagucacccaugaaauccagacauucucacccccagcggaugcacaggagccacucaggccu

SEQ ID NO: 10700 - RNA, 64 nt, Human
guuaccauaagucugauucucuuuaacugugugaccagcggaaacaggugugugugaacugggc

SEQ ID NO: 10701 - RNA, 64 nt, Human
ggcccugggaccuggagcccgcgcuggccucuccccagcggagccugcacguuacggagaccau

SEQ ID NO: 10702 - RNA, 64 nt, Human
uccucuggcaagccggaggacgcagcccccaagaccagcggacagcgccagaaggaaucgucga

SEQ ID NO: 10703 - RNA, 64 nt, Human
ucuuccaaggaaacuguuacuucaugucuaacucccagcggaacuggcacgacuccgucaccgc

SEQ ID NO: 10704 - RNA, 64 nt, Human
ucccgcagugggagcaaacugcaugcccagagacccagcggacacacgcgguuugguuugcagc

SEQ ID NO: 10705 - RNA, 64 nt, Human
cuucccucgcccaccugccugcccccauacucccccagcggagagcaugauccgugcccuugcu

SEQ ID NO: 10706 - RNA, 64 nt, Human
ugugcacauggcugggggacacucgguuugaccgccagcggaugggugucacaaaugcaucacu

SEQ ID NO: 10707 - RNA, 64 nt, Human
augcuuaaugcuucuggggaggagggggcuggucccagcggagccgcacucuucgcccgcuccg

SEQ ID NO: 10708 - RNA, 64 nt, Human
ggugguagcgugucugaaccaaacggaagaauagccagcggagcauggacuguuccagcacggg

SEQ ID NO: 10709 - RNA, 64 nt, Human
gagacaaggguccaacuuuuccuggauucgccucccagcggacgugagcuuccacugcggcugc

SEQ ID NO: 10710 - RNA, 53 nt, Human
cagugcuugggcccugcugacccccagcggacacaagagcgugcucagcagcc

SEQ ID NO: 10711 - RNA, 64 nt, Human
ggguucagaggggacucuuccaggagaggggugcccagcggagguaaagaugauagaggguugu

SEQ ID NO: 10712 - RNA, 64 nt, Human
ugucucgaggcagggcugacacauggugccauagccagcggagggcgcucagugagugccccgg

SEQ ID NO: 10713 - RNA, 64 nt, Human
gucccgcccaccucaaaccccgcaggugugccucccagcggauuauuuauuguagaaaguguau

SEQ ID NO: 10714 - RNA, 64 nt, Human
cugguuuauggcauccugagacaguugcacagugccagcggaggcugcacugagccuucaucgc

SEQ ID NO: 10715 - RNA, 64 nt, Human
gggaggcauucaucuacagacuccaacaaggccuccagcggagacaucuccccuuaugacaaca

SEQ ID NO: 10716 - RNA, 64 nt, Human
accucacuggggagaaaguguguucauguuuuguccagcggaucaggauguuaggaugacgagc

SEQ ID NO: 10717 - RNA, 63 nt, Human
cgugagcugucacauaguaggagcuucuagaugcauguggaagcaaugagaguugucccuuag

SEQ ID NO: 10718 - RNA, 63 nt, Human
guuguggccucuuaggcagccuguuucaagugccauguggaccuggugcagcugggaagcuug

SEQ ID NO: 10719 - RNA, 63 nt, Human
gcguucugugaucgccaaguucaaagcugugcacauguggacacucaauaaauguucauuggu

SEQ ID NO: 10720 - RNA, 63 nt, Human
auggagaagugguguuggcagcaagcuuuggcucauguggauuugguuuaaguggugcuucuu

SEQ ID NO: 10721 - RNA, 63 nt, Human
ucaaaagcauuugaccugucacuguacuaucuacauguggaagaauguucaaguugaauccua

SEQ ID NO: 10722 - RNA, 63 nt, Human
gaggaugugcaguaucccaguaucacugggauccauguggaacagagccagcugggggguugg

SEQ ID NO: 10723 - RNA, 51 nt, Human
ucaacaacaaugugcagugagcauguggaagaaaagaagcagcuuuaccua

SEQ ID NO: 10724 - RNA, 63 nt, Human
gugauaggaacuuuggaccuugaacuuauguaucauguggagaagagccaauuuaacaaacua

SEQ ID NO: 10725 - RNA, 63 nt, Human
ggggcacagucauucacaucacugauugggugccauguggaguggacauucaaaaaccugguu

SEQ ID NO: 10726 - RNA, 63 nt, Human
aaacuuuaccucauagccugugaagcagguuggcauguggauuacaaguccugcuuugacacu

SEQ ID NO: 10727 - RNA, 63 nt, Human
ggguuuauucuaagauaccuuuguauuuuauuucauguggagaucaugaaaguaggaaauaua

SEQ ID NO: 10728 - RNA, 63 nt, Human
caggcgauacggcagcucugugcccuuggccagcauguggaguggaggagaugcugccccugu

SEQ ID NO: 10729 - RNA, 59 nt, Human
uccucaagaucuggaacuaacgccaguagcauguggaugccauggagacuggaagacca

SEQ ID NO: 10730 - RNA, 63 nt, Human
gcuuugguugggccugugucacauccaggcagccauguggagggagucagggucugucuggaa

SEQ ID NO: 10731 - RNA, 63 nt, Human
uucacuuucuccacacuuucgaauuccuaaagacauguggaggaagucacuguuaaaugaauu

SEQ ID NO: 10732 - RNA, 63 nt, Human
auugcaaaauaaaauaguugaacucucugucuucauguggaagguuuagagcaguugugagau

SEQ ID NO: 10733 - RNA, 63 nt, Human
uguuuugucuuuuaacaggagugugaccagguacauguggaagauguggcuucugaugacaau

SEQ ID NO: 10734 - RNA, 63 nt, Human
acauauuuuguucacuguuguaucuauauuucacauguggaaacuuucagggugguugguuua

SEQ ID NO: 10735 - RNA, 63 nt, Human
aucugaagcacugauccacuggucacagguagacauguggagucaacucaagaaaaagcugag

SEQ ID NO: 10736 - RNA, 63 nt, Human
ggauggaguuaaacuugaugccagugggcagugcauguggaaaguaucagaguaaggcucucc

SEQ ID NO: 10737 - RNA, 51 nt, Human
aaaaagaugacuuaccuuagacauguggacuggaauuuuuuucauuaaugu

SEQ ID NO: 10738 - RNA, 63 nt, Human
cacuugugcuaauggucaguuguacacacaugacauguggaagugaccuguagcagcggucac

SEQ ID NO: 10739 - RNA, 63 nt, Human
cgugauuguuaaguuuccugaggccuucccagccauguggaacugugagucgaaaauuaaacc

SEQ ID NO: 10740 - RNA, 63 nt, Human
gaauaauauugugucauagaauuaauuuucagccauguggaccauauuuuguauccaaggauc

SEQ ID NO: 10741 - RNA, 63 nt, Human
auauauccaaaaacaucuauuugugaccuuaaacauguggacccauaggugcaguuagaaaaa

SEQ ID NO: 10742 - RNA, 63 nt, Human
agcccuccaguguacugaggguacuggccuagccauguggaauucccuacccugacuccuucc

SEQ ID NO: 10743 - RNA, 63 nt, Human
aggccuuugggaaaggacaggugccgagcccugcauguggagcccucccaccccacccccaga

SEQ ID NO: 10744 - RNA, 63 nt, Human
gagaaacaaauaagaccauaaagggaaaggauucauguggaauauaaagauggcugacuuugc

SEQ ID NO: 10745 - RNA, 63 nt, Human
ggagaaggaaguguucuagugugguuuaggaaacauguggauaaagggaaccaugaaaaugag

SEQ ID NO: 10746 - RNA, 63 nt, Human
guuggaguucucauauagaggugaccaguuugccauguggauauaauuuaguagauauuugac

SEQ ID NO: 10747 - RNA, 63 nt, Human
acauuuauauucaguguugugccauugaguucccauguggaucauucugaaggugaucuccac

SEQ ID NO: 10748 - RNA, 63 nt, Human
aaaaaaacaaacagaugaaaaccucagagaaggcauguggauuauaagauuugucuaguaaaa

SEQ ID NO: 10749 - RNA, 63 nt, Human
uacuguagguuuucaaccuuuuuuagauuuaugcauguggacauuuuuauaauguaauuacaa

SEQ ID NO: 10750 - RNA, 63 nt, Human
uuauuauucacugcacuauauucuaagcacuuacauguggagauacuguaaccugagggcaga

SEQ ID NO: 10751 - RNA, 63 nt, Human
cucccaccugccauucugacuuuauuaaaucaacauguggaccagaguguuaaugagauguua

SEQ ID NO: 10752 - RNA, 63 nt, Human
gaugcacuguaaauccggcauugauguuuccaccauguggaaaagcaaggauuucccuggccc

SEQ ID NO: 10753 - RNA, 63 nt, Human
uccugguggauacuguagaagaagcccauaucacauguggaugucgagacuucacgggcaauc

SEQ ID NO: 10754 - RNA, 63 nt, Human
cccguuagcauuggaugccuuugccaaaugguucauguggacacacaaaggcaaacagaucug

SEQ ID NO: 10755 - RNA, 63 nt, Human
aguuuuguuucugugugacaugcaauggcaacucauguggacacuauugaagggaugugacau

SEQ ID NO: 10756 - RNA, 63 nt, Human
uuuaauagaaucaaggcacaaaagucuuaaaaccauguggaaaaauuagguaauuauugcaga

SEQ ID NO: 10757 - RNA, 63 nt, Human
gauuuuucugaaagucauucacugaauuuuacacauguggaauaaacagugucuuuucuaagg

SEQ ID NO: 10758 - RNA, 63 nt, Human
cuggccacugucccaggcuauguauccuuucggcauguggaggaaggcagcugguauauucag

SEQ ID NO: 10759 - RNA, 63 nt, Human
ucacaagaacacuguucugauaucucugauugucauguggauuugaauguagcuugacagagg

SEQ ID NO: 10760 - RNA, 63 nt, Human
aggucuucacucuuucuucuuuguaaacuaugucauguggaaagauuuccucaguuagugagc

SEQ ID NO: 10761 - RNA, 63 nt, Human
acaguugcagcccuugugaugugauuagugucucauguggaaccauggcaugguuauugauga

SEQ ID NO: 10762 - RNA, 63 nt, Human
ccaugauuguaaguuucccgaggccuccccggccauguggaacugagucaauuaaacuucuug

SEQ ID NO: 10763 - RNA, 63 nt, Human
guugaaggccuguggugccaucuccccaugguucauguggagccacgaacauccuuucccugc

SEQ ID NO: 10764 - RNA, 63 nt, Human
cucagagcuccaauaaugugcuucagaucuguccauguggaaaugcuuucauccaaauuuuua

SEQ ID NO: 10765 - RNA, 63 nt, Human
gcuucagucuggagcuguuuguggggcgagugccauguggacagugguggaugaugugugugc

SEQ ID NO: 10766 - RNA, 63 nt, Human
aaaccaaaagcaacauuugucauguggucugaccauguggagauguuucuggacuugcuagag

SEQ ID NO: 10767 - RNA, 63 nt, Human
cagggccuaaauuaaaguauaaucauuuguauccauguggaauaaaauugugacaauuuccua

SEQ ID NO: 10768 - RNA, 63 nt, Human
gucagaaauugauugaguacgguuuacuaaagucauguggaauaaagccauuggaaacaaaug

SEQ ID NO: 10769 - RNA, 63 nt, Human
ggggauguguguugucucuuaagauuucuauaucauguggauuggaccaaaaacuucuaauca

SEQ ID NO: 10770 - RNA, 61 nt, Human
aagaugcgaguguguuauagcaguuaucaagcauguggacuuguaacaaauucuuagguca

SEQ ID NO: 10771 - RNA, 63 nt, Human
gaaauauuuccauuguuucccuuuuuugcagagcauguggaaguuaaaccugcuugauucuac

SEQ ID NO: 10772 - RNA, 63 nt, Human
caugugacuccauucaguuggggauuuugguuccauguggauccauacuaaguauucuucagu

SEQ ID NO: 10773 - RNA, 63 nt, Human
uucaaucugaagauacaugucuuucuccagggacauguggaaaaaaaaaagauguuauacaac

SEQ ID NO: 10774 - RNA, 63 nt, Human
cgcuucauuuuugauggcuggcucugaaagcaccauguggaguggagguggagggagcgagga

SEQ ID NO: 10775 - RNA, 63 nt, Human
aguagaugcuuucuuccuccugcaguucuggaccauguggagcuacauggagaaauugcacag

SEQ ID NO: 10776 - RNA, 63 nt, Human
cacccccaaaggguccugaagccccagaacuggcauguggaaggggcugaggccuaauugagg

SEQ ID NO: 10777 - RNA, 63 nt, Human
cuaccucagauuugcugcacucauuguggacuucauguggaucacaacuucuggauaagaaga

SEQ ID NO: 10778 - RNA, 63 nt, Human
auacacuaucucugugaaauagccucaccccuacauguggauagaaggaaaugaaaaaauaau

SEQ ID NO: 10779 - RNA, 63 nt, Human
uuuauuuucuucucaagcguuuucaagaucuagcauguggauuuuaaaagauuugcccucauu

SEQ ID NO: 10780 - RNA, 63 nt, Human
uuuugaagauuuaaguuacauaauggaauuaggcauguggaacaccaaacaggaaagaacuau

SEQ ID NO: 10781 - RNA, 63 nt, Human
gagagugucucgucuacacuucaguucuucucucauguggaaaacuaagcuuuuuauauugac

SEQ ID NO: 10782 - RNA, 63 nt, Human
uuaaagggucuugguuagcccacuuucccucuccauguggagauggaagguagagaaggauac

SEQ ID NO: 10783 - RNA, 63 nt, Human
ccuaagcauauuauuuuauagugucugccaugccauguggaaauacuuuauuuuuaaccucag

SEQ ID NO: 10784 - RNA, 63 nt, Human
ccagcaacaacucugggcgugccugugucugcacauguggauguacauaugucuguauauaug

SEQ ID NO: 10785 - RNA, 63 nt, Human
gauuuccagggugccaucuaauccugggcuguacauguggauauggacuugaggcccaccucu

SEQ ID NO: 10786 - RNA, 63 nt, Human
ggugaagcugaagcuguuggacaccugccuucucauguggacaucaucuggcaggaucccugc

SEQ ID NO: 10787 - RNA, 63 nt, Human
ugguaagugguuucaauuguccuucagauaauucauguggagauuuuuggagaaaccaugacg

SEQ ID NO: 10788 - RNA, 63 nt, Human
aagcgucacucaucuguacauaguuguaacucccauguggaguaucagucgcucacaggacuu

SEQ ID NO: 10789 - RNA, 63 nt, Human
gaucaacuaugagcccaucggcuacgccacagacauguggagcaucggggucaucugcuacau

SEQ ID NO: 10790 - RNA, 63 nt, Human
caugccuggccagaaaucuauguuuucuuagaacauguggaagaaggaaaaagacaaaaaagg

SEQ ID NO: 10791 - RNA, 63 nt, Human
uuugcuuaaaauuuuacuuuuguucuguauuuucauguggaauggauuauagaguauacuaaa

SEQ ID NO: 10792 - RNA, 63 nt, Human
uacauagaucuucaugaugugugaguguaauuccauguggauaucaguuaccaaacauuacaa

SEQ ID NO: 10793 - RNA, 63 nt, Human
gccgccgcgcuuaagaacauugccucugggugucauguggaccagacuucugaauagagaaua

SEQ ID NO: 10794 - RNA, 63 nt, Human
uuauguuaauauuucuauuaagaacauguugggcauguggacccaagcaccugggaaggaggu

SEQ ID NO: 10795 - RNA, 63 nt, Human
ggugaucucuuugcugaauuaaugaguucuuaacauguggacccaacugccugugugagaucu

SEQ ID NO: 10796 - RNA, 63 nt, Human
ccaccaucuuaccucacagugauguugugaggacauguggaagcacuuuaaguuuuuucauca

SEQ ID NO: 10797 - RNA, 63 nt, Human
ugagauauuugaaaauauuuuaccauuauacaucauguggacuuauuuuauauuaaagaagau

SEQ ID NO: 10798 - RNA, 63 nt, Human
gacacugcuggugggaauguaaacuagagcagccauguggagaacaacauggacuuucuucaa

SEQ ID NO: 10799 - RNA, 63 nt, Human
aagacauaagacuucagucaagugaaaaauuaacauguggacuggacacuccaauaaauuaua

SEQ ID NO: 10800 - RNA, 63 nt, Human
cugucgcauacauccuucuuuuguagcuuacaccauguggaugcucugucuguagacacugcu

SEQ ID NO: 10801 - RNA, 63 nt, Human
gcuaacaaagacaaaagucugucuuuccugaaccauguggauaacuuuacagaaauggacugg

SEQ ID NO: 10802 - RNA, 63 nt, Human
cuguaaaguguguauucuugauguuuauuggcucauguggacagaaauguacagggagaauua

SEQ ID NO: 10803 - RNA, 63 nt, Human
acucaacaugagucaagagcauccugcuucuaccauguggauuuggucacaagguuuaaggug

SEQ ID NO: 10804 - RNA, 63 nt, Human
agaguuuucuaaagugauaaaaccaaagaaaagcauguggaaaagcagaagcuuagaaaguug

SEQ ID NO: 10805 - RNA, 63 nt, Human
uuauuuccuaaucaaaaaggucucaccacauaccauguggaugcagcaccucucaggauugcu

SEQ ID NO: 10806 - RNA, 63 nt, Human
aaccuuagcuagaagaauuucaggucauaccaacauguggauaggcuauagcuguucagaggu

SEQ ID NO: 10807 - RNA, 63 nt, Human
aucaauccugauuccucucuaagugggcauugccauguggaaggcaagccaggcucacucaca

SEQ ID NO: 10808 - RNA, 63 nt, Human
aaauggacaucuaauccagugcagaugaccuggcauguggaguuacagagggaucccucaugc

SEQ ID NO: 10809 - RNA, 63 nt, Human
acuaguuauuacagcuguaaggauaaaacacgucauguggauucauuuugaauuggugcuauu

SEQ ID NO: 10810 - RNA, 63 nt, Human
guaaucugucccaucauaaacuuaccuggagcucauguggaggaacagaaggccaagauccuu

SEQ ID NO: 10811 - RNA, 63 nt, Human
gaaaaacaucugaguguuuuucagauguuuugccauguggagcauauaaugauaugugcaaga

SEQ ID NO: 10812 - RNA, 63 nt, Human
agucuuucaggaaggaagcccuuccuuauguuacauguggaaagccugccuuccaagacaugu

SEQ ID NO: 10813 - RNA, 63 nt, Human
uuauguuacauguggaaagccugccuuccaagacauguggaaguaauugauccaccugccaga

SEQ ID NO: 10814 - RNA, 63 nt, Human
uuuggaaaccuuuucacaaagggaauugccuaacauguggacuuuuacaauaaaaaugcugca

SEQ ID NO: 10815 - RNA, 63 nt, Human
aguggccauuggcacuguuugcuuuuuuacaaucauguggacacaagcauaaguaaagaaaau

SEQ ID NO: 10816 - RNA, 63 nt, Human
cucagugaagaaucggauguggggguaagggcacauguggaagcaaagaaaccuuugacgucu

SEQ ID NO: 10817 - RNA, 63 nt, Human
caaaaggcaguuucaagccaaugcuaugguuuccauguggacauacagugccuauguagcagg

SEQ ID NO: 10818 - RNA, 63 nt, Human
gaugcugcugugagaggcacagagcccuuuccgcauguggaagagugggaggaagcagaggga

SEQ ID NO: 10819 - RNA, 63 nt, Human
caccuccugccaugauucugaggccuccccagccauguggaacuguaaguccaauuaaaccuc

SEQ ID NO: 10820 - RNA, 63 nt, Human
ugugggaugucaucuuuuuauaauuaguguucccauguggagaaaauuauucacacuacuugc

SEQ ID NO: 10821 - RNA, 63 nt, Human
gauaacaagcaaggauaucagagcugggaaauucauguggaucuggggacugagugugggagu

SEQ ID NO: 10822 - RNA, 63 nt, Human
gcucucccuuccucccauccccaguuugacuuccauguggauguuauauaccuucaucaaauc

SEQ ID NO: 10823 - RNA, 63 nt, Human
cauccugggcuagccuaccggaggaucagagaccauguggaacauaaaugaaucaucccaguu

SEQ ID NO: 10824 - RNA, 63 nt, Human
ggucacuuuuuccaacaaaacccacuccauagccauguggauuuuuauccaaaggcucaacaa

SEQ ID NO: 10825 - RNA, 63 nt, Human
uggacuccugaggguguucccuuccugaggucacauguggauuuggccagagccuucaggagg

SEQ ID NO: 10826 - RNA, 63 nt, Human
cuaauuguacaguggcucuggccaucuuuuccucauguggaagaauuuucuaucuuuaauaaa

SEQ ID NO: 10827 - RNA, 63 nt, Human
accugggaugaagaugaaugaagaacauggacucauguggaugugguuuggcucagauguccc

SEQ ID NO: 10828 - RNA, 63 nt, Human
gagugcgcccccggcuggggagggaagcacugucauguggacguggaugaauguaggaccagc

SEQ ID NO: 10829 - RNA, 63 nt, Human
cugcuccuuugaccccuggacuugguauaccuccauguggaguuguugggcgagagguguucu

SEQ ID NO: 10830 - RNA, 63 nt, Human
gaagcagucauacuuccaggaaaugcuuggauucauguggacauucaggaagcuuauucucau

SEQ ID NO: 10831 - RNA, 63 nt, Human
uugcuucuaguaugugccuacugugauuuuuuucauguggaaaaugcaaaauuuguaacaaaa

SEQ ID NO: 10832 - RNA, 63 nt, Human
ugggacucuuggaaucaggagacaaagcuaccacauguggaaagguacuauguguccauguca

SEQ ID NO: 10833 - RNA, 63 nt, Human
ggcuuuacuagccgauuuaguucucacaauaaccauguggagaagcugugacauuuuuaauuu

SEQ ID NO: 10834 - RNA, 63 nt, Human
acuuuguucucauuaauaucacuauuuacaacucauguggacucagaaaaacacacaccaccu

SEQ ID NO: 10835 - RNA, 63 nt, Human
ucaggaccccagcuaaccucagaacaacuaacucauguggacucggaaggacgggcagcuaug

SEQ ID NO: 10836 - RNA, 63 nt, Human
aacugacaguuccuuccuucauggagccugcuucauguggaggaaacaggaaauaaagcaaaa

SEQ ID NO: 10837 - RNA, 63 nt, Human
gaagccuggggcugguaggcccuuggugguccucauguggaugggcaagaagagagcggccau

SEQ ID NO: 10838 - RNA, 63 nt, Human
acguuucaaagcacauaugugccaaugugacaacauguggaaagccucaggagagagucuaag

SEQ ID NO: 10839 - RNA, 63 nt, Human
ccauuguagaagacuuaacaagcugcagauaaccauguggacuucugucauaauucuugcuga

SEQ ID NO: 10840 - RNA, 63 nt, Human
ugcuugcccggggagucccgccugaccugccuucauguggacccuuagaacagcacugggaga

SEQ ID NO: 10841 - RNA, 63 nt, Human
uccgauagaugacugauggcaaaagauugugaacauguggaagaaaaucagugggauucuggu

SEQ ID NO: 10842 - RNA, 63 nt, Human
uuaaaauauaaacuuguuucacaagcuuuaauccauguggauuuuuuuuuucuuagagaacca

SEQ ID NO: 10843 - RNA, 63 nt, Human
acugcuuguugacaucaacauggcaauugcacucauguggacugggaccgugcgagcugccgu

SEQ ID NO: 10844 - RNA, 63 nt, Human
cugccuuugagcuguaguucccguuuauuuacacauguggauccucguuuuccaagcauggcu

SEQ ID NO: 10845 - RNA, 63 nt, Human
gaugcugagaccuuggugucucuaaacucugggcauguggacaggaggggcuugcggccgugu

SEQ ID NO: 10846 - RNA, 63 nt, Human
ggcacuauccagaaauaguggacagaggucuggcauguggaaaccuuggaucucggucacagg

SEQ ID NO: 10847 - RNA, 63 nt, Human
ucccggucagcaguaucaaggcugacuuguguucauguggagucauuauaaauucuauaaauc

SEQ ID NO: 10848 - RNA, 63 nt, Human
aacaaucuagaauuuucuuggugcaaaguguaucauguggaauauccucauauuuuuaccaua

SEQ ID NO: 10849 - RNA, 63 nt, Human
caggcgucuacacugucacucagacaccuguggcauguggaggagacugcccuguccugagcc

SEQ ID NO: 10850 - RNA, 63 nt, Human
uaaagagcagaacacccuugcguuuuguugggacauguggaccgugagucgcaaacacucugg

SEQ ID NO: 10851 - RNA, 63 nt, Human
cauaauucauugaaaagcaugauagcaauguggcauguggaagcgaacccccagggcauaaca

SEQ ID NO: 10852 - RNA, 63 nt, Human
ccauuuaaauuuuuuuccuuaccuuuuuauuugcauguggaucaaccaucgcuuuauuggcug

SEQ ID NO: 10853 - RNA, 63 nt, Human
acauauuuuccuuuaucugaucaacccaucaaucauguggauuucuugggauucuaauguuga

SEQ ID NO: 10854 - RNA, 63 nt, Human
gccuacuggggacugagcccccaggagggccagcauguggagagucgcugcggcugcuccugc

SEQ ID NO: 10855 - RNA, 63 nt, Human
gacucgggaagggccuccugucccuacaaggggcauguggacagcagggaccugcgcuaccgu

SEQ ID NO: 10856 - RNA, 63 nt, Human
agcuccuggucaggaagccaaucugaaaacaggcauguggaaacacaaaaaugauguguauga

SEQ ID NO: 10857 - RNA, 63 nt, Human
cagagagaaaggcggcgggucuuagaagaaaaucauguggagcaccagccucgguuuuucagg

SEQ ID NO: 10858 - RNA, 63 nt, Human
gguuccucugcucugaggguggguccaggcagacauguggacucuggggagguacugggggcc

SEQ ID NO: 10859 - RNA, 63 nt, Human
ugccaccccucccuucucccuugauaaugggagcauguggauggggugucugcgugugcaaac

SEQ ID NO: 10860 - RNA, 63 nt, Human
cccaggccaggugcccaggaaaggacggcugagcauguggagcgagagggaggcagguggacg

SEQ ID NO: 10861 - RNA, 63 nt, Human
ucagauuccugcguauucagcaucuucucuauucauguggagugaaagcugguuuuuauacag

SEQ ID NO: 10862 - RNA, 63 nt, Human
aaagcagcuuuaaauugucaguauuaagguuuucauguggaaaggugucauucaaaaaaaaag

SEQ ID NO: 10863 - RNA, 63 nt, Human
ugaaucagguggagaaaguaaucuccuugcaaucauguggacaccaaucacaaaaguaaagcc

SEQ ID NO: 10864 - RNA, 63 nt, Human
agauaauacguuauuauugucugccaaguucuacauguggagaaucugcuucugcuuuaaaau

SEQ ID NO: 10865 - RNA, 63 nt, Human
gggggacuucuagcuuugugucuuguuucagaccauguggaaugauaaauacucuuuuugugc

SEQ ID NO: 10866 - RNA, 63 nt, Human
cgccuguaaucccagcacuuugggaggccgaggcauguggaucaccugaggucaggaguuuga

SEQ ID NO: 10867 - RNA, 63 nt, Human
uuccucaaagauauggggauuuuuucaugaauccauguggaugaaugaggugucuccuuucca

SEQ ID NO: 10868 - RNA, 63 nt, Human
cuaugagcccggggcaugaucugauccccaagacauguggaggggcagccugugccugccuuu

SEQ ID NO: 10869 - RNA, 63 nt, Human
ggauuguauaauucauuaaagcuguggucuuuccauguggagacugauagaaaauaauuuugu

SEQ ID NO: 10870 - RNA, 63 nt, Human
gccuuggggagcagggcugaggggcgaagaggacauguggauauccagccagaaugcccucuc

SEQ ID NO: 10871 - RNA, 63 nt, Human
ggaaauagccauuuggaagcuuugguuaugaaacauguggaguguauuaagugcagcuugaca

SEQ ID NO: 10872 - RNA, 63 nt, Human
uguucuuauguaaauaagaauccauuauucgcucauguggaagcuucuuuugcaucauuuggg

SEQ ID NO: 10873 - RNA, 63 nt, Human
aagcuucauguugaaagaaccuauggguggcaccauguggacuuuucugucccuacugugaug

SEQ ID NO: 10874 - RNA, 63 nt, Human
acaaauaugaaaugagggaaggcaagaaagaaccauguggaaauggaauagaauugguauaaa

SEQ ID NO: 10875 - RNA, 63 nt, Human
cuacauguuauucuaguacuagaaacugaagaccauguggagacuucaucaaacauggguuua

SEQ ID NO: 10876 - RNA, 63 nt, Human
auguuaguaaaguuuugguuauuauauauuuaacauguggaagaaaacaagacaugaaaagag

SEQ ID NO: 10877 - RNA, 63 nt, Human
uacauuuucuguguucagcaaggcauugugugucauguggaucuuaguuaccaaacuaugaag

SEQ ID NO: 10878 - RNA, 63 nt, Human
ggcugacacaagaauccauucucacagaaacugcauguggaaccacaagcagccuucagccca

SEQ ID NO: 10879 - RNA, 63 nt, Human
gcugcuuccgaugugccaccugcaguaguggaucauguggagugaaaggcaaaucuuacugcu

SEQ ID NO: 10880 - RNA, 63 nt, Human
uccucaggcaguguggacucaggcccugggagucauguggaugccaguagccugggcccacag

SEQ ID NO: 10881 - RNA, 63 nt, Human
ccugaccuguggcugagggugucugggcuuaagcauguggaccccuucgguguguccggccuu

SEQ ID NO: 10882 - RNA, 63 nt, Human
acuuaauagacauuuuuuuguuccaaaagaguccauguggacugugccaucugugggaaaucc

SEQ ID NO: 10883 - RNA, 63 nt, Human
auguuugauuuuuauugcacaugguuuucccaacauguggaacaauaaauauccaugccaaug

SEQ ID NO: 10884 - RNA, 63 nt, Human
cuggccauggaguggccugaaagagagcaagaacauguggaucuuugauaggauuguuaccaa

SEQ ID NO: 10885 - RNA, 63 nt, Human
gugcaauugaagccucucagcagcggaggccgccauguggagagagcaggcaggcccacugcu

SEQ ID NO: 10886 - RNA, 63 nt, Human
ccacccuuguauuuuaucacgugcucuucagggcauguggaauucguugaguuugcuuuuaga

SEQ ID NO: 10887 - RNA, 63 nt, Human
cacgacaggcccgugugacagcugcugcccacgcauguggaagcuaggugggacucauuccua

SEQ ID NO: 10888 - RNA, 63 nt, Human
acaccuauguccagggcaccagggaugcaauuccauguggaugucaccaaaccccagugugga

SEQ ID NO: 10889 - RNA, 63 nt, Human
uaagcauuagugauggguagcugaugucagcuucauguggauuuuaagcacucuagaaacaau

SEQ ID NO: 10890 - RNA, 63 nt, Human
caaggcaggagaugcagcaguccuacuuauugccauguggacuugugggaaggacacguguga

SEQ ID NO: 10891 - RNA, 63 nt, Human
cauguaccaccaugugcuggagcaucuguucuacauguggauaucuaugaaugguaauguuuu

SEQ ID NO: 10892 - RNA, 63 nt, Human
cccagccuccccacugcucccuccucuguuccccauguggaggucggaggggcugggacuggg

SEQ ID NO: 10893 - RNA, 63 nt, Human
gcuugaaacguuauggauaugguuggagucacccauguggauaugauuuucagcuuggagcug

SEQ ID NO: 10894 - RNA, 63 nt, Human
gcucgccguggcagaugccaugcucaggacguucauguggaugguuucaugucaucgugcugg

SEQ ID NO: 10895 - RNA, 63 nt, Human
uaacauugguuauuuauuuguguaauggccuuacauguggauauuaacaguguaaacaauacc

SEQ ID NO: 10896 - RNA, 63 nt, Human
auaugaaauuuuggauacuguuaaaauauaacucauguggacuucaaugcagacuucacauuu

SEQ ID NO: 10897 - RNA, 63 nt, Human
gcuauaacauguaacuugcggauguucagcgugcauguggaauccauccauaaugguacauag

SEQ ID NO: 10898 - RNA, 63 nt, Human
ucucauccucaaucucaggggugguggguguggcauguggagaguugucaauauucaccauga

SEQ ID NO: 10899 - RNA, 63 nt, Human
uagauacccaacuuaaaccaaaggcaugucuaucauguggaugcaguaacauuuacauuuagu

SEQ ID NO: 10900 - RNA, 63 nt, Human
cuaggcaauccauugacauuucuccaaucagagcauguggaccuuggagccaggcaugcucag

SEQ ID NO: 10901 - RNA, 63 nt, Human
ccaugauuguaaguuuccugaggccuccccagccauguggaacagugagucaauuaaaccucu

SEQ ID NO: 10902 - RNA, 63 nt, Human
ugccucccaccaugauucugaggcuuucccagccauguggaacuguaaguccaauuaaaccuc

SEQ ID NO: 10903 - RNA, 63 nt, Human
uugaaguggucauccauuucuuuuuaagaagcucauguggacuuguucuauugccugaccuga

SEQ ID NO: 10904 - RNA, 63 nt, Human
guuaauuguuucugaauaucucaggguaggaaccauguggagccacacauucccugaccacag

SEQ ID NO: 10905 - RNA, 63 nt, Human
cagaguuaaccuguggcauuaggagaccuacuucauguggacccuuuuuuuccuucaguuuaa

SEQ ID NO: 10906 - RNA, 63 nt, Human
ccucuacagagccuuuuagggggaggggguacucauguggaugccuacuuggaaccugggccu

SEQ ID NO: 10907 - RNA, 63 nt, Human
augauaaucaaaggaagagaugugguguuuggucauguggaaaacucaauguauaauuuagac

SEQ ID NO: 10908 - RNA, 63 nt, Human
cagacaacaaggguuuuuagcuuuaagccugugcauguggacaauacucugagaacaugucug

SEQ ID NO: 10909 - RNA, 63 nt, Human
acccggccgugacaaauccuaguagauucugugcauguggagcggccgcgaagaggugacacc

SEQ ID NO: 10910 - RNA, 63 nt, Human
uguaugguguuuuuacacuacaaagaagucccccauguggauauuucuuauacuaauuguauc

SEQ ID NO: 10911 - RNA, 63 nt, Human
guguucaccggcugacucucaacugaccauucccauguggacaggccuuaauacugugagagg

SEQ ID NO: 10912 - RNA, 63 nt, Human
aauacuuuuguauaugcauaauauaaaucaucucauguggauaugaaacuucuuuuuuaaaac

SEQ ID NO: 10913 - RNA, 63 nt, Human
gcuuugagccagcuuuuuagucucauucccacacauguggaagccacguugccucucgaccgc

SEQ ID NO: 10914 - RNA, 62 nt, Human
agaagccugaugccaaguagcuccagggaacgcauguggauccuagacagcgccuuaucuau

SEQ ID NO: 10915 - RNA, 63 nt, Human
gaugacuuguucauccccccuucccuucgcccucauguggaaagaggagcugggaccgcggcg

SEQ ID NO: 10916 - RNA, 63 nt, Human
aggggaaaugguuuuuagaggugaggguugguccauguggaggaaagaagugucucuguuggg

SEQ ID NO: 10917 - RNA, 63 nt, Human
cccaccacccuggccugcuguccugcgucuauccauguggaaugcuggacaauaaagcgagug

SEQ ID NO: 10918 - RNA, 63 nt, Human
augccagcugaaauuagccugugcaaccacuaacauguggaagcauuacaaguucacuggacu

SEQ ID NO: 10919 - RNA, 63 nt, Human
augugaggucucagucugugauuuaagguguugcauguggacucuuaacuguacguguaguuu

SEQ ID NO: 10920 - RNA, 63 nt, Human
gaaaccggaccucacagcugacugggaacuggacauguggaagagcugcuggcugcaucaggg

SEQ ID NO: 10921 - RNA, 63 nt, Human
gcagauugauaucacacagacucaaagcaaaggcauguggaacuucuuuauuucaaaacagaa

SEQ ID NO: 10922 - RNA, 63 nt, Human
gauaugcgaacacacguuucaagguuguuugugcauguggaaauauuuuggggugcuaucugu

SEQ ID NO: 10923 - RNA, 63 nt, Human
aauggaagugggcgaaaaaucucaaggcugcuucauguggaccuugucaagcugcucccuccc

SEQ ID NO: 10924 - RNA, 63 nt, Human
ugagagcuaaauggagaggcugaacaaaggacgcauguggagcgcauggggagggaaggcugg

SEQ ID NO: 10925 - RNA, 63 nt, Human
aacuccuguguauugcaaugguaugaaucugcucauguggagacuggcuauaaacugaaaagu

SEQ ID NO: 10926 - RNA, 63 nt, Human
aggaacuaaaaccucagccccacucucucacaccauguggaaucucgugggggucggggaucc

SEQ ID NO: 10927 - RNA, 63 nt, Human
ccacugccuccccuguucugcucucucagucaacauguggaaauccaaggaggacaaagacuc

SEQ ID NO: 10928 - RNA, 63 nt, Human
ccaaagauuugcaccgugugggucugaccucaucauguggagugcagagggcccugaugacau

SEQ ID NO: 10929 - RNA, 63 nt, Human
ugcgugguagcugacaaugagcaccuucgguuccauguggagcgggguuuagcucaugcaaaa

SEQ ID NO: 10930 - RNA, 63 nt, Human
aaaauaguguaaaauauuuuaauaagccaaagccauguggaauuuuuguuuagaugccuuaac

SEQ ID NO: 10931 - RNA, 63 nt, Human
cauugagccucgagccaugggagagaugcugaccauguggacugcaaggcugcuugauucaca

SEQ ID NO: 10932 - RNA, 63 nt, Human
gagagagugauuuauaagcaccaauaucaacuucauguggauuuuugacaaggagggguaguu

SEQ ID NO: 10933 - RNA, 63 nt, Human
aagagaagagacagaaagaccccaugacccccccauguggauccccaucugugucucaguugc

SEQ ID NO: 10934 - RNA, 63 nt, Human
guuuuaauuuuugcuagauugauauuaaaaacucauguggaggaacucaaggaauguuuagaa

SEQ ID NO: 10935 - RNA, 63 nt, Human
agguuacuacuaguaucuaccucaaagcguugucauguggauugagaugauauguaugaauca

SEQ ID NO: 10936 - RNA, 63 nt, Human
gggaagauggcagcucacucaguacugccuggucauguggagcuuuccuuccuggaccaggcc

SEQ ID NO: 10937 - RNA, 63 nt, Human
gguacauggcuuccuggaaucaaaaugugaauucauguggaagggacauuaauccaauaaaua

SEQ ID NO: 10938 - RNA, 63 nt, Human
ugacacagucaccuucccuguuuccuuaggucccauguggacuaacgacuucucauuuuccuc

SEQ ID NO: 10939 - RNA, 63 nt, Human
ccuggaugugacucacagguaccuccaacccaucauguggagauacucauccuguucccccua

SEQ ID NO: 10940 - RNA, 63 nt, Human
agaaagccuacugaagcagcagcacugccacuacauguggacaaaagugaccauauaaaagaa

SEQ ID NO: 10941 - RNA, 63 nt, Human
aauaaugccugcuggauugucuccugaugaguacauguggacucaccugaggaagggaaggaa

SEQ ID NO: 10942 - RNA, 63 nt, Human
cuugaguacagugguggggacuaaaaaugugggcauguggagagggguauuugcccuggguga

SEQ ID NO: 10943 - RNA, 63 nt, Human
aggggcaguagcccccagcuccacgccuguugccauguggaaaagugggccuaggguggccac

SEQ ID NO: 10944 - RNA, 63 nt, Human
guugauauuuggaacuuuauuccaaaaguagugcauguggagaaagaaucuagacuuucuugu

SEQ ID NO: 10945 - RNA, 63 nt, Human
uuucuauagagcaugcaccaaauccagugaguccauguggagagagcacugugugcgcagcgg

SEQ ID NO: 10946 - RNA, 63 nt, Human
acacacacacacacaaacaauccaguguuuugucauguggaaaaucaaaacaaguuagaaagc

SEQ ID NO: 10947 - RNA, 63 nt, Human
gagaagagccguccagggacccaugguggcccacauguggaugccacaugcugcuguuuccug

SEQ ID NO: 10948 - RNA, 63 nt, Human
uguguccuauuuaguccaucaguauuuucaagucauguggaaagcccaaagucaucacaauga

SEQ ID NO: 10949 - RNA, 63 nt, Human
guuugcaccaaguaauugacauguuuuuuaauacauguggaccaugaacaguauucauucuac

SEQ ID NO: 10950 - RNA, 63 nt, Human
ugcuuuuucaacaaucuacugaguggccaugggcauguggauauggccaugaaugagcaagau

SEQ ID NO: 10951 - RNA, 63 nt, Human
ugaucuuguacagauauuaguguuaccagcauucauguggaaaucaagagcaaagacaaaaua

SEQ ID NO: 10952 - RNA, 63 nt, Human
cuacagcuaauucugcagggcacagcccagagccauguggauuugacuuacgggaguaaagcg

SEQ ID NO: 10953 - RNA, 63 nt, Human
uauuuuauuuuuuucuaccuugaggucuuuugacauguggaaagugaauuugaaugaaaaauu

SEQ ID NO: 10954 - RNA, 63 nt, Human
aaaaaaucucaaguguaggccugccuguguucucauguggauuuagaacaggaggauauucua

SEQ ID NO: 10955 - RNA, 63 nt, Human
gcuuccuggacuuguguuacuucaucuaauucucauguggauuggacgacuucugcucccuuu

SEQ ID NO: 10956 - RNA, 63 nt, Human
uugccuuuuuuuccaccauuaaggcuuuaagaacauguggaauaaguuuuuuagcugcuaaug

SEQ ID NO: 10957 - RNA, 63 nt, Human
ugacagguggcaccugucccacagcccucgucccauguggaacuuaccauugggauuguguuu

SEQ ID NO: 10958 - RNA, 63 nt, Human
caaagacuuugcguaaccacgccugguucuguacauguggaaaacucacagaugggcaaggcc

SEQ ID NO: 10959 - RNA, 63 nt, Human
cuggacuccuguccccgcgggccgcucaccugacauguggaccugcagcuuuguccccacugu

SEQ ID NO: 10960 - RNA, 63 nt, Human
ugagguaggaagaacaaacccuugucccuuugccauguggaggaaagugccugccucuggucc

SEQ ID NO: 10961 - RNA, 63 nt, Human
acauccaggaguacaacuccuucccaucauucccauguggaagggucucucccaucaaggaga

SEQ ID NO: 10962 - RNA, 63 nt, Human
uccucuuugguaaaauggggggaaauguuucuccauguggaauggaagacagcauggcccaca

SEQ ID NO: 10963 - RNA, 63 nt, Human
gggagggccguaccccacccucagcaccccuuccauguggagaaaggagugaaaccuuuaggg

SEQ ID NO: 10964 - RNA, 63 nt, Human; identical to SEQ ID NO: 10958

SEQ ID NO: 10965 - RNA, 63 nt, Human
uagauuauacaagggacaacuuuagugaugaggcauguggaugauuuggugggaguagguaua

SEQ ID NO: 10966 - RNA, 63 nt, Human
aagacagaggccugccccagugugccacagauccauguggauggagccuccuucagagggguc

SEQ ID NO: 10967 - RNA, 63 nt, Human
ggucacuuuuguucccagguaccucaugggaagcauguggaugacacaaucccuggggcugug

SEQ ID NO: 10968 - RNA, 63 nt, Human
uaugaggaugggaccaucaguuccaacgccacccauguggagcauccguuaugucccccgaag

SEQ ID NO: 10969 - RNA, 63 nt, Human
aaagaggagggaaaggccuuugguguggacaagcauguggacgcccuccguccugcagucuug

SEQ ID NO: 10970 - RNA, 63 nt, Human
cacccuagagaaaugccucuguaccacggcuaccauguggaaccuuaacuugcagaaggcuug

SEQ ID NO: 10971 - RNA, 63 nt, Human
uguaauuuugccaaguguuagauuugagucucucauguggaugcauuagucaggugguuacuc

SEQ ID NO: 10972 - RNA, 63 nt, Human
aagaaaaauaugaccacacuccagcugggaucacauguggacuuuuauuuccagugaaaucag

SEQ ID NO: 10973 - RNA, 51 nt, Human
auaugagcaacuuuaauugaacauguggaagacccuuuuaguuauggagag

SEQ ID NO: 10974 - RNA, 63 nt, Human
uggacacaugcuuaugucucauuuuccuuuuggcauguggaaagcugucaaugcaguguaagg

SEQ ID NO: 10975 - RNA, 63 nt, Human
ugccccugggguaggggugcugauuaccucagccauguggaggaaggcuggagcuuguuccug

SEQ ID NO: 10976 - RNA, 63 nt, Human
ccgaggucgcugcagccccaucuaccacaucuucauguggacauugagauucacaugcuggcu

SEQ ID NO: 10977 - RNA, 63 nt, Human
gggguguggcucuguccgggugcaguaugcagucauguggaaccuugcuuucuaguccuggga

SEQ ID NO: 10978 - RNA, 63 nt, Human
guugucaaaccaagggaaaaaaccacaguucaccauguggaguuuacuuuuuuuauaugaaug

SEQ ID NO: 10979 - RNA, 63 nt, Human
cuccgcaccaccucagcgggcaggaggucccaccauguggacagacauagcccaaggaggcac

SEQ ID NO: 10980 - RNA, 63 nt, Human
augggaggagcucaaaccagcacuaaugaacagcauguggaagaagauuuggccugagugugu

SEQ ID NO: 10981 - RNA, 63 nt, Human
ucauccccaauggaaugccaaacacuguugugccauguggaacugagaagaacuucacaaaug

SEQ ID NO: 10982 - RNA, 63 nt, Human
ggacgcauuucucugaguggaaacagguucuugcauguggauguguguuuccccaggcagacg

SEQ ID NO: 10983 - RNA, 63 nt, Human
cccagccguuucccugcagaaucagcucugucucauguggaaguggagaaucagccuugccug

SEQ ID NO: 10984 - RNA, 63 nt, Human
caaaguauaaauauuuuguuucuuuauggaggacauguggaaggaguuugaggguuugggaug

SEQ ID NO: 10985 - RNA, 63 nt, Human
uguugguuuauaagauuacagaccauuuguuuucauguggauaauuuuagugcauugcucacc

SEQ ID NO: 10986 - RNA, 63 nt, Human
caucaauaucaggagccugagcaugaguuaaagcauguggauggccuggagcuauguuuuuaa

SEQ ID NO: 10987 - RNA, 63 nt, Human
gggagguuuuauucugacuuccucugauuuuggcauguggagacacuccuauaaggagaguuc

SEQ ID NO: 10988 - RNA, 63 nt, Human
gcagaccagugguccuuccucucccaauguggccauguggaggacaggaugucuuccuggggg

SEQ ID NO: 10989 - RNA, 63 nt, Human
ucuacuaaaugcaaggaauugugcuuggugugucauguggauucucucuugcaucuucaugau

SEQ ID NO: 10990 - RNA, 63 nt, Human
uucccaacuuggucuccuccaacaugcugucuucauguggagcccucaccacaaucccugacu

SEQ ID NO: 10991 - RNA, 63 nt, Human
uccugacccucccuccccugggcagaagaaacgcauguggaccagaagacuuucccugcugcc

SEQ ID NO: 10992 - RNA, 63 nt, Human
aacagucaaaaucagggcccggugcaguguugucauguggaaccugcuuuauccauugcugag

SEQ ID NO: 10993 - RNA, 63 nt, Human
gagcacacugcccccgguugccugccugggccccauguggaaggcagaugccugcucgcucug

SEQ ID NO: 10994 - RNA, 63 nt, Human
agccaaacuggagcccccauugcaggcugucgccauguggaaagaguaacucacaauugccaa

SEQ ID NO: 10995 - RNA, 63 nt, Human
gccgcccucacaggacccaccaggcagcggagacauguggaauuagaguauuuugaggugucc

SEQ ID NO: 10996 - RNA, 63 nt, Human
ccuucggcugcugucuggacgucuggacccugccauguggauuauaaacccaaaguguacagc

SEQ ID NO: 10997 - RNA, 63 nt, Human
gaguccuguuuuccauuggcuucagggcgcauccauguggauauaggaaaagccucuuuccac

SEQ ID NO: 10998 - RNA, 63 nt, Human
cuggcccugccccagccuguguagcucuuccugcauguggaugcugcaugucuggucuggggc

SEQ ID NO: 10999 - RNA, 63 nt, Human
gaaaaguaucaggguaguucuguuucaaacuugcauguggagccauguggcacaaauacucau

SEQ ID NO: 11000 - RNA, 63 nt, Human
ucugcguuauuggcugugcucuccucaaugggacauguggaagaacuuggggucggggagugu

SEQ ID NO: 11001 - RNA, 53 nt, Human
ccagagaagcccuccccugacugcauguggaagggcacacagcagcaggcagg

SEQ ID NO: 11002 - RNA, 63 nt, Human
auguuuuuaauuauuuugauugcuggaauaaagcauguggaaaugacccaaacauaauccgca

SEQ ID NO: 11003 - RNA, 63 nt, Human
ugauuuuaacaacuuuuuaauauguaauucuuccauguggagguauucaauacuguaguguaa

SEQ ID NO: 11004 - RNA, 63 nt, Human
uucucuagcauggccugagguaugggguaugugcauguggaggccaggguaaggugaaugggg

SEQ ID NO: 11005 - RNA, 63 nt, Human
cuuaaaauacugcauuuuuauagcuucucagagcauguggaugggaugggauuuucguuauuu

SEQ ID NO: 11006 - RNA, 63 nt, Human
cgcugucggucccgucuaaccaugaugccuuaacauguggaguguaccguggggccucacuag

SEQ ID NO: 11007 - RNA, 63 nt, Human
auacuuagagaaccuauagcaucuucucauucccauguggaacaggaugcccacauacugucu

SEQ ID NO: 11008 - RNA, 63 nt, Human
cguggagaagggcuuaucugcaguacacucugccauguggagggugggccucuguggccucuu

SEQ ID NO: 11009 - RNA, 63 nt, Human
aagugaacgaggacaaccaccaccauguucuaacauguggacccuuuauugucuaacugauaa

SEQ ID NO: 11010 - RNA, 63 nt, Human
agauagaugggcucccucgguuagcuccaucaacauguggauggaacccucugcuauugauga

SEQ ID NO: 11011 - RNA, 63 nt, Human
gauccuucagagcucagucccuggaccucugcccauguggauuuguuguuaggucacuccaac

SEQ ID NO: 11012 - RNA, 63 nt, Human
cauuggagaugaugaaaccgagcagaccuggcccauguggagcuggcaugggggacacagccc

SEQ ID NO: 11013 - RNA, 63 nt, Human
uagcaccugagagcugggccuccucuccagaaucauguggaggggccagaggccugccagacc

SEQ ID NO: 11014 - RNA, 63 nt, Human
uguuauuauuuggacauugugagucaguauaaccauguggauaaaaugccagacaucuuuuua

SEQ ID NO: 11015 - RNA, 63 nt, Human
gugggggugcaggugauuguaaacacgggugugcauguggaugcacacgggugugcggugaag

SEQ ID NO: 11016 - RNA, 63 nt, Human
cccaguucucaacucuuacuaaacaugagaacacauguggaagauaaagccuacaaauaugaa

SEQ ID NO: 11017 - RNA, 63 nt, Human
uuuuuuugauguuggggguucucuugguuuugucauguggaaagugaugcgugggcguucccu

SEQ ID NO: 11018 - RNA, 63 nt, Human
uagacagaaagagacagaagcuggggcuacguccauguggacacagaccacagaugugggcac

SEQ ID NO: 11019 - RNA, 63 nt, Human
cucccccucucugugcccugguccccuugcugccauguggaugcuguugugauugcuguuugu

SEQ ID NO: 11020 - RNA, 63 nt, Human
uccuagaugcuggcuccaccuggaccagggauucauguggaguuuccuuggcccagucugugc

SEQ ID NO: 11021 - RNA, 63 nt, Human
cccugcggagaucuuggccacguuguaccuuuccauguggaauuauuccccaagcaguguagc

SEQ ID NO: 11022 - RNA, 63 nt, Human
aacaucaguggugaagaaauaaaauugauucuucauguggagaggacauaguuuccaggcugc

SEQ ID NO: 11023 - RNA, 63 nt, Human
acacccaagccggacagggucacacugggucggcauguggagcagcugguggagguaaggagg

SEQ ID NO: 11024 - RNA, 54 nt, Human
cccaagcuacucauguauaaaugccauguggagauagagccccagauguuucag

SEQ ID NO: 11025 - RNA, 63 nt, Human
ugccaugacuaaguuuucggaggccuccccagccauguggaacugugugugaguuaaaccucu

SEQ ID NO: 11026 - RNA, 63 nt, Human
ccaugauuguaaguuuccugaggccucccccgccauguggaacugugagucaauuacaccucu

SEQ ID NO: 11027 - RNA, 63 nt, Human
guaccacaagagcuaugagcugguuauccacuucauguggaaucauaaguguccccaagugac

SEQ ID NO: 11028 - RNA, 63 nt, Human
gauggcauccaggaauuagcugagccaacagaccauguggacagcuuuggccagagcucccgu

SEQ ID NO: 11029 - RNA, 63 nt, Human
caugaagaauucccaugcccaggcuccaugugucauguggaaaccuccacaggucugcuagug

SEQ ID NO: 11030 - RNA, 63 nt, Human
uggagaaaaauaauagugcccuucccauggggucauguggaaagcuuuuagcacaguaucugg

SEQ ID NO: 11031 - RNA, 63 nt, Human
guugagagugguucaguugucuuuaauguuugucauguggaaauggaaguagccucuuuuugu

SEQ ID NO: 11032 - RNA, 63 nt, Human
gcuuauuuuuguuuuuaaagaccuacuugacgucauguggacagugcacgugccuuacgcuac

SEQ ID NO: 11033 - RNA, 63 nt, Human
gagauuuggguaaaagaauggguaauguuuaaacauguggaggcauguggagcuuuauacaaa

SEQ ID NO: 11034 - RNA, 63 nt, Human
uaaaagaauggguaauguuuaaacauguggaggcauguggagcuuuauacaaacagggcagaa

SEQ ID NO: 11035 - RNA, 63 nt, Human
aguaaaaauucuaacuucguuuuguuuaaaagacauguggaugcuccaugccccuaggauuuu

SEQ ID NO: 11036 - RNA, 63 nt, Human
gcugugggcuccucugucucuggagagucuggucauguggaggugggguuuauugggaugcug

SEQ ID NO: 11037 - RNA, 63 nt, Human
cuugggaggccagcagccagacuacggaauccacauguggaccaugggaagucagucucuugc

SEQ ID NO: 11038 - RNA, 63 nt, Human
gagggcccccagcugaccccuacugcagauccgcauguggaccaugagccggcugccagcacu

SEQ ID NO: 11039 - RNA, 63 nt, Human
cauggccggucuccguggggcaggguugggccgcauguggaagggcucugagcuguguccucc

SEQ ID NO: 11040 - RNA, 63 nt, Human
gcccaggaacacgggagcuucugaagagcugaacauguggagggaggggaacgagaacuuguc

SEQ ID NO: 11041 - RNA, 63 nt, Human
cacacaagcugaugggcgucuuggcucugccgucauguggauguuauugucgcgcgcgucuau

SEQ ID NO: 11042 - RNA, 63 nt, Human
uguggagagcucauggccugucuaaauuguugccauguggaaauggggcagaguguugccaau

SEQ ID NO: 11043 - RNA, 63 nt, Human
auuuguuugagacaagaguggugggaucagagccauguggagagcucauggccugucuaaauu

SEQ ID NO: 11044 - RNA, 63 nt, Human
aaguauguuagaugcaguagacgauacagguugcauguggacacucagucacauuaacaacuu

SEQ ID NO: 11045 - RNA, 63 nt, Human
gggauugugagcuagucauucagccuguguaaccauguggaaauaaaaauugacgaccaaugu

SEQ ID NO: 11046 - RNA, 63 nt, Human
aguguacagggacagccauggccacacagcacacauguggagcagcggcucucccuggaaagc

SEQ ID NO: 11047 - RNA, 63 nt, Human
aggagggcugcccucuugcccuagugagggccccauguggauccacucuagugcugggagcca

SEQ ID NO: 11048 - RNA, 63 nt, Human
aggagccuccuuccuguagcagcgcccaguuuucauguggauggauuguaguucauuugaccc

SEQ ID NO: 11049 - RNA, 63 nt, Human
acagaugcaggaggggguacugaugguaacccccauguggauuugagggcagcagucccuggc

SEQ ID NO: 11050 - RNA, 63 nt, Human
uaauuuaauaacagaagccuccaccagcaacagcauguggaagauacagauuugucauuucuc

SEQ ID NO: 11051 - RNA, 63 nt, Human
caugccaaaagcucucugguuguaaccuggagacauguggaggggaauggcgaugggauuaua

SEQ ID NO: 11052 - RNA, 63 nt, Human
gcccagaagaggggcuguguggccugggaauaccauguggaagguugggcuucaaguuaacag

SEQ ID NO: 11053 - RNA, 63 nt, Human
cacacuguggcuggagacccauuuuuuccaucccauguggaaugagaaucuugaguugcccac

SEQ ID NO: 11054 - RNA, 63 nt, Human
uucuguuccuggcugccgagagugaaguuucaccauguggagguuuggcuccuaucaccuggu

SEQ ID NO: 11055 - RNA, 63 nt, Human
agcacaucugcccugaaagaaaacgccacuggccauguggaauccauggccuggaccacccca

SEQ ID NO: 11056 - RNA, 63 nt, Human
cccccguguuccugccgucagugccaacugccgcauguggaagcaucuacccguucacuccag

SEQ ID NO: 11057 - RNA, 63 nt, Human
uacagcgccguggaugugcugcagacccucgaacauguggaccuggacccucaggagcccccg

SEQ ID NO: 11058 - RNA, 63 nt, Human
cucccagguuuguuuuuccaaaguaacagaugacauguggaauaaaguaauagaguaacaagu

SEQ ID NO: 11059 - RNA, 63 nt, Human
cugaugauguguuaggauugcuacugaugcugucauguggaaacuauuuaaaggcacuauuau

SEQ ID NO: 11060 - RNA, 63 nt, Human
uuuaggccugaucuccguggaagaauuucgugccauguggaaacuuuuuaguucucacuacaa

SEQ ID NO: 11061 - RNA, 63 nt, Human
gccuuccacuggauuuugggguucccagcaccccauguggauuuuggggggucccuuuugugu

SEQ ID NO: 11062 - RNA, 63 nt, Human
auuugcucuaguguacuaguccaguaguguuugcauguggaugucuguggaugacaguuauug

SEQ ID NO: 11063 - RNA, 63 nt, Human
ugaguagaucuucuuaauauagcugucugaccacauguggaaggcagcuagacuuauuguauu

SEQ ID NO: 11064 - RNA, 63 nt, Human
uucaguauaccaguuugugggagggauaugagacauguggauggcagugagagaucgugccuc

SEQ ID NO: 11065 - RNA, 63 nt, Human
auuuuuuuaagaaaagguuacacugugcaccgacauguggagcuagaaggaaaagcuuuuaag

SEQ ID NO: 11066 - RNA, 63 nt, Human
gacucaaacagcugccuuacaauucacucauuccauguggaacaaacauuuaucagaugccua

SEQ ID NO: 11067 - RNA, 63 nt, Human
aaagguuaccgauuucaaaguccagauaccaagcauguggauauguuuagcuacguuuacuca

SEQ ID NO: 11068 - RNA, 63 nt, Human
ucagggccgcucccuagggucccuccugcccaacauguggagguggcugguucccaugaacgu

SEQ ID NO: 11069 - RNA, 63 nt, Human
ugagugggaugagugaugcccccacagcaccuccauguggacuuaggaagguggccuuccugc

SEQ ID NO: 11070 - RNA, 63 nt, Human
cugugcacuagaaaguugcagcccacagcccuucauguggacucugucaugacaugcuaacua

SEQ ID NO: 11071 - RNA, 63 nt, Human
ugacauaccugugcacucauguguauaccccugcauguggaaacaugaagauguuuucacuuu

SEQ ID NO: 11072 - RNA, 63 nt, Human
ggaaggauggucucaggguucugaucuugccuucauguggaccuucaucacuaccucuggccg

SEQ ID NO: 11073 - RNA, 63 nt, Human
ggaagcuuucuucuaagaugguuuucacagguacauguggaacagcguucaaccuuccaggga

SEQ ID NO: 11074 - RNA, 63 nt, Human
ggauaccagccguucuguguauuuuggacgaaggccgcgcagccgggucccagccuuguccug

SEQ ID NO: 11075 - RNA, 63 nt, Human
ugcuagccccaggguuagagugggcagggcagagccgcgcagcaccugggagcgguaccuuuc

SEQ ID NO: 11076 - RNA, 63 nt, Human
guuggccgggcccaggcgcgcggggacgcggaggccgcgcauccuuucccagcuccccacccu

SEQ ID NO: 11077 - RNA, 63 nt, Human
gaccaacuaacgccuaaaccucgguauuagccagccgcgcagaggaugccgagcacuuuccgg

SEQ ID NO: 11078 - RNA, 63 nt, Human
gcuccgggcgccccaacuccaacaccacguccugccgcgcagguucuuccccgcgcggaggag

SEQ ID NO: 11079 - RNA, 63 nt, Human
acucgcuggcaccacagugggccccuggacccggccgcgcagcugguggacuguaggggcucc

SEQ ID NO: 11080 - RNA, 63 nt, Human
cccuucccugcugagacuaagacguggacaggggccgcgcagauccgggggaggcucccaaau

SEQ ID NO: 11081 - RNA, 63 nt, Human
ccagacgucagccggcagggaugcagcaggcuggccgcgcaccggggcucgggcacccucugg

SEQ ID NO: 11082 - RNA, 63 nt, Human
uguaaauagugagauggacuuggggccucugacgccgcgcacucagccgugggcccgggcgcg

SEQ ID NO: 11083 - RNA, 63 nt, Human
ugacuccuuucuagugagacgugagcguagugugccgcgcaaggcucuguggaaguaaaucuu

SEQ ID NO: 11084 - RNA, 63 nt, Human
agugcccggcacagcacaggggcuuccagggaggccgcgcagggccguggggcugagccacgc

SEQ ID NO: 11085 - RNA, 63 nt, Human
caaggcccccgugcccuuccuguauccgcggcugccgcgcacucgccugccauccuccugccu

SEQ ID NO: 11086 - RNA, 63 nt, Human
guucaacccucggccugcagccagaguagccaggccgcgcaccccaaauguagucccccgauu

SEQ ID NO: 11087 - RNA, 63 nt, Human
ccugggaggagagacacugguggggauaggccagccgcgcaucagacugugaaccccacgaag

SEQ ID NO: 11088 - RNA, 63 nt, Human
acucguggcaugcgcaggugcuggagcuuggcagccgcgcaggagcauguaggcaggcucuca

SEQ ID NO: 11089 - RNA, 63 nt, Human
uuuaaguugacaaaaggaauggggaacuggcaggccgcgcagaagguucuugguuuuaaugga

SEQ ID NO: 11090 - RNA, 63 nt, Human
ccacuuucgccuccuccagcuccugccccgccggccgcgcaccgccaugcaugauggguaaag

SEQ ID NO: 11091 - RNA, 63 nt, Human
gccgcccacccgcgcccgccacucggggccccugccgcgcauccugcagcccgcuuaugcgua

SEQ ID NO: 11092 - RNA, 63 nt, Human
gcugggcgccgcuugggcucgcaacgccucauggccgcgcagccuccgccuggcgcuggcgcu

SEQ ID NO: 11093 - RNA, 63 nt, Human
cucugccuccugcacuuuagcaucguguccguggccgcgcacuuggcucuguugcugcucugc

SEQ ID NO: 11094 - RNA, 63 nt, Human
aagccgggacuggcugcggacccagccuccugugccgcgcacucacggagcugcguagucucc

SEQ ID NO: 11095 - RNA, 63 nt, Human
cuccugugcaucucggccagcacgggagccagugccgcgcaggaaugugggguccccuguguu

SEQ ID NO: 11096 - RNA, 63 nt, Human
cgccuguuggggcugauucggagagggcgccccgccgcgcagagaccagagcuccucagugcc

SEQ ID NO: 11097 - RNA, 63 nt, Human
ugacuucugcucuggauucacucuucccugucggccgcgcaugugcucaucccacucuccgcu

SEQ ID NO: 11098 - RNA, 63 nt, Human
acaggugcaggacugccagggaucggagugcgggccgcgcacggugccaggauuccgccgagg

SEQ ID NO: 11099 - RNA, 63 nt, Human
cgccccugcugugggggguucagaaaauaaaaugccgcgcagcccuugccaggggaagugucg

SEQ ID NO: 11100 - RNA, 63 nt, Human
ugggaggacggagccugggagcggggcggggccgccgcgcaagggggcgacgcauaaaggccu

SEQ ID NO: 11101 - RNA, 63 nt, Human
ggcaaaagcuuacaaauacuaaaaagaagugcugccgcgcaguguggaggccacuguuuggaa

SEQ ID NO: 11102 - RNA, 63 nt, Human
acaaggaaagaaaagacaaaggaaggccagagagccgcgcaguucucugcaggugcagaugca

SEQ ID NO: 11103 - RNA, 63 nt, Human
gaagcggggagggccgcuguggccuucgucacagccgcgcagugcccauggaggcgcugcugc

SEQ ID NO: 11104 - RNA, 53 nt, Human
cggaggcccuggggcucugacccgccgcgcagccccccgcgcgcccggacucc

SEQ ID NO: 11105 - RNA, 63 nt, Human
ccuggugacccggcgggaccugcgggcgcgcggcccgacgaccagagggcgagccugcuccuc

SEQ ID NO: 11106 - RNA, 63 nt, Human
ucagacuuuuugaaagucuaccuucuaaauugccccgacgaucuagauucuacauguuaccau

SEQ ID NO: 11107 - RNA, 63 nt, Human
cggcaacauugaagacguggacggaggaggggccccgacgacagguggcaacaaugccccgag

SEQ ID NO: 11108 - RNA, 63 nt, Human
cugagaagguagccaacaucaucuguacccaaccccgacgaaucucugcaaucucuguugcug

SEQ ID NO: 11109 - RNA, 63 nt, Human
uccagaaguggcuggauguacccugccugaggccccgacgaggagggguaugcaggcuggcag

SEQ ID NO: 11110 - RNA, 63 nt, Human
cucuucaugcuugacauaccuaccaguauuauucccgacgacacauauacauaugagaauaua

SEQ ID NO: 11111 - RNA, 63 nt, Human
gagcugcggcggcugcacccaggccacgugcugcccgacgaggagcugcaguggguguucgug

SEQ ID NO: 11112 - RNA, 63 nt, Human
gaaaagcagagaaccccaaagugggcaggcaaccccgacgagagcuuaucccuguggcggcau

SEQ ID NO: 11113 - RNA, 63 nt, Human
cucuucccucagcagccccggaagccugccucacccgacgaggacagcgagcggcccggcucc

SEQ ID NO: 11114 - RNA, 63 nt, Human
uguggugcccccccggcagcucccggcacugcccccgacgaacggaaacucuucugugaaaua

SEQ ID NO: 11115 - RNA, 63 nt, Human
cauggguuugggauuuguaacggcaaauuccugcccgacgacagggugucuuaugcaaaggcu

SEQ ID NO: 11116 - RNA, 63 nt, Human
auguagcuauuaugcgcccgucuacagggggugcccgacgaugacggugccuucgcagucaaa

SEQ ID NO: 11117 - RNA, 63 nt, Human
cccagcucucuuacccucccuuuacuccaccagcccgacgacccaugacugaggaggggauuu

SEQ ID NO: 11118 - RNA, 63 nt, Human
caccccaagcaggaaccccaggagaucaauuuucccgacgaucuuccuggcuccaacacugcu

SEQ ID NO: 11119 - RNA, 64 nt, Human
cccggcggcggggaggggaggcgggggcgccuccggcggcgagaugcagaggugacccucggac

SEQ ID NO: 11120 - RNA, 64 nt, Human
aaugaagaaaggaaccuugucuuucagggcauaaggcggcgacuuccaaggucaaugcuuuucc

SEQ ID NO: 11121 - RNA, 64 nt, Human
aucauuacuaaaaacacaaaaauuagccagguguggcggcgagcaccuguaaucccagcuacuc

SEQ ID NO: 11122 - RNA, 64 nt, Human
auguucugaucuggaauccugcggcggcggcggcggcggcgacagcgggcgagccagggcccgg

SEQ ID NO: 11123 - RNA, 64 nt, Human
caggaguuggaauguuguaguuaccuacugaguaggcggcgauuuuuguauguuaugaacaugc

SEQ ID NO: 11124 - RNA, 64 nt, Human
acgcgcguuuguucuugcgcacgggagaguuuguggcggcgauuaugcagcgugcaaugaguga

SEQ ID NO: 11125 - RNA, 64 nt, Human
cuuacgcugaaaggcugaaguggggcgcgcgaagggcggcgaagcggagacggcggcucuccgg

SEQ ID NO: 11126 - RNA, 64 nt, Human
agacugagacgcagucaggcgcacgcccgcaagaggcggcgaggugacaaguuuggagugcgcc

SEQ ID NO: 11127 - RNA, 64 nt, Human
ggguugcacgcaugugggggugcacaggcgcuguggcggcgagugagggucucuuuuucucugc

SEQ ID NO: 11128 - RNA, 64 nt, Human
agugcugggauuacaggcgugagccaccgcgcccggcggcgaaacacgauauuguacuaacauc

SEQ ID NO: 11129 - RNA, 64 nt, Human
ccaggaggcagugaggggagccccgcggggaggcggcggcgacugccacagcccuuccagccug

SEQ ID NO: 11130 - RNA, 64 nt, Human
gacagacgauggcagaggagagggcuccugugacggcggcgaggcuugggaggaaaccgccgca

SEQ ID NO: 11131 - RNA, 64 nt, Human
ccggcgcccagccaggcuccaguggcccgaacggggcggcgagggcggcgagggcgccgagguc

SEQ ID NO: 11132 - RNA, 64 nt, Human
agccaggcuccaguggcccgaacggggcggcgagggcggcgagggcgccgagguccggcccauc

SEQ ID NO: 11133 - RNA, 64 nt, Human
ggagcacagaggcugaccugugucagggagaggaggcggcgagagaggugagggggggaccugg

SEQ ID NO: 11134 - RNA, 64 nt, Human
ccugcggagacccugaguccgggaggcaccguccggcggcgagcucuggcuuugcaagggcccc

SEQ ID NO: 11135 - RNA, 64 nt, Human
ucgccuccccccacgccugcagcuucucgcgaggggcggcgacgguccccugguggcaggaggg

SEQ ID NO: 11136 - RNA, 64 nt, Human
auaaugcaauaacagguagaguagaacugcuuuuggcggcgaccgucacacacuguccucagcc

SEQ ID NO: 11137 - RNA, 64 nt, Human
gauaccaugagacacaaaaugagacaguuaaaagggcggcgaguagcggcaugucagccagcca

SEQ ID NO: 11138 - RNA, 64 nt, Human
cuccccaaaccgggccgccaggaucccuccccgcggcggcgauggcccgagccaugagagugag

SEQ ID NO: 11139 - RNA, 64 nt, Human
gcgcccggcugcgucugcagaggcggggagaggaggcggcgagggucccggggcgcgaggaagg

SEQ ID NO: 11140 - RNA, 64 nt, Human
ggaacuggagaggacccugagaggagacgggcugggcggcgacccccacagggcucucgagaac

SEQ ID NO: 11141 - RNA, 64 nt, Human
acaucuagcgccuucgggacgccggggacucugcggcggcgacccacgagcucgcggcccgcgc

SEQ ID NO: 11142 - RNA, 64 nt, Human
uucugacuuuguuuggagacacacacuucagcagggcggcgacuuggcaagacaaaugaugagc

SEQ ID NO: 11143 - RNA, 64 nt, Human
guaauuggcagcaacacuguaguagaggccagagggcggcgaguucggggucgacucuaccccu

SEQ ID NO: 11144 - RNA, 64 nt, Human
aggagccgaggccgagcgcccccugcuggcccgcggcggcgaggagcagagggagcggaggagg

SEQ ID NO: 11145 - RNA, 64 nt, Human
caacgacagccgagacauguacauggagucugagggcggcgacggcuaccuggcuccggagaau

SEQ ID NO: 11146 - RNA, 64 nt, Human
agacgcgguccucggccccacgugaaccaggcucggcggcgaagcccagccuuggagacaccca

SEQ ID NO: 11147 - RNA, 64 nt, Human
gcagcagcugucuaaagggcuugggggccuggggggcggcgaagguggguggggccccucugua

SEQ ID NO: 11148 - RNA, 64 nt, Human
cgacuacgacgaggccgauggcccgggcagcgggggcggcgaggaggccauggccggggccuac

SEQ ID NO: 11149 - RNA, 64 nt, Human
gaggauccugcauguuaauggguuuaauggagagggcggcgaagaggacccgcaggcugcaagg

SEQ ID NO: 11150 - RNA, 64 nt, Human
cggccccaggcccaggccccaccccggcggcgguggcggcgaggaggccucgguccuuauggug

SEQ ID NO: 11151 - RNA, 64 nt, Human
ggaggucccggaguaacuucucuccaggcugaagggcggcgaggcauagucccgagaagucacc

SEQ ID NO: 11152 - RNA, 52 nt, Human
ccagcaaagagauccacugaagggcggcgaugccugugguuguuuucuugug

SEQ ID NO: 11153 - RNA, 64 nt, Human
cucuggacgcucccuugcagaugcaccguggccuggcggcgagcccccggucaccuuccuccgc

SEQ ID NO: 11154 - RNA, 64 nt, Human
auaaaugaaugugcugaagcaaagugcccaugguggcggcgaagaagagaaagauguguuuugu

SEQ ID NO: 11155 - RNA, 64 nt, Human
aaggcugcuggggccuccacaccugccucaucacggcggcgaggcuacgacaauccggcuggga

SEQ ID NO: 11156 - RNA, 64 nt, Human
auuggccggggcgcggcgugcaaggcuucccgggggcggcgacugccgagcuccgcccuccagg

SEQ ID NO: 11157 - RNA, 64 nt, Human
gccaacucaaauucuaagaaagccacugcuuucucaucaucacucuauaccaauacuuauuucu

SEQ ID NO: 11158 - RNA, 64 nt, Human
caaaggaguuguaugcacaugaaaguuugagaagcaucaucauagagaaguaaacaucacaccc

SEQ ID NO: 11159 - RNA, 64 nt, Human
uucucaucuucguauaugacgaagucagaaaacucaucaucaggcgacgcccuggcgguaauua

SEQ ID NO: 11160 - RNA, 64 nt, Human
uccuguuucgcuccaccaacaccucugugagucucaucaucagcugagcgaugaugccuuacag

SEQ ID NO: 11161 - RNA, 64 nt, Human
uuucgucaaccuuacugaaacacacuggugcuuucaucaucagaggucaaauuauuaugauaac

SEQ ID NO: 11162 - RNA, 64 nt, Human
cacuuuagugagcucuuaacgcaaagaccaugcacaucaucagagacugagaugggagaggccu

SEQ ID NO: 11163 - RNA, 64 nt, Human
ccaaucaaggccuccguucuucuaaagauuaguccaucaucauuagcaacugagaucaaagcac

SEQ ID NO: 11164 - RNA, 64 nt, Human
agcaacugaggugugacuguuuggacccaggccucaucaucagggguccuggaggaagccucca

SEQ ID NO: 11165 - RNA, 64 nt, Human
cucagccccaaugagaaagcagauacaccuaagccaucaucaaccacuaacaucucaacuugcc

SEQ ID NO: 11166 - RNA, 64 nt, Human
gugacuguacaguuaucauuaucaucaucaucgucaucaucauagguaacaguuauaucaagcu

SEQ ID NO: 11167 - RNA, 64 nt, Human
uucagaaagacagugacuguacaguuaucauuaucaucaucaucgucaucaucauagguaacag

SEQ ID NO: 11168 - RNA, 64 nt, Human
cuguugggccaggugcugcuuguccuucuuagggcaucaucaauugcaaauauuuccuuuugcu

SEQ ID NO: 11169 - RNA, 52 nt, Human
cauaucagaauaucccaugagccaucaucaugucuccucucccauucgcaau

SEQ ID NO: 11170 - RNA, 64 nt, Human
acuggccaggugucugguuuggguccagagugcucaucaucaugucauagaacugcugggccca

SEQ ID NO: 11171 - RNA, 64 nt, Human
agagcucuguucuuagccuccugugcugcguguccaucaucagcugaccaagacaccugaggac

SEQ ID NO: 11172 - RNA, 64 nt, Human
guuacauugaccccagccugacuguccucauggucaucaucauuuugucaucugccuucccgcu

SEQ ID NO: 11173 - RNA, 64 nt, Human
uauaguccuauaguuuuacuccucaguuccucaccaucaucaucuugucuaagacccccauuau

SEQ ID NO: 11174 - RNA, 64 nt, Human
aaaaaaccacuuguggcacacgaugggcaucuaacaucaucaucuucuaauguguuggagauuu

SEQ ID NO: 11175 - RNA, 64 nt, Human
auaucuucucaggaguaauacaaaucagguauuucaucaucauuugguaauaugaaaacuccag

SEQ ID NO: 11176 - RNA, 64 nt, Human
ggcauauauaucugucuguuagcaaugauuauuacaucaucagaucagcaugugcuauacuccc

SEQ ID NO: 11177 - RNA, 64 nt, Human
gaccaugaccucuuugcauauccuggaaaaaugacaucaucaaaguauaguugauaauguuaua

SEQ ID NO: 11178 - RNA, 64 nt, Human
caauauuauuucuguuacuugaauaguagauauucaucaucaugcuuuugcacuugaauuugca

SEQ ID NO: 11179 - RNA, 64 nt, Human
uggugggucuuuuuauggaaguuuaaagaaaggacaucaucauagauaugaucuaacaguauuu

SEQ ID NO: 11180 - RNA, 64 nt, Human
ggacagguuauugaaacaaaguaugaacugguaacaucaucaagggaagaagcuuggaucacug

SEQ ID NO: 11181 - RNA, 64 nt, Human
uucuuaaucccauggcugguggccacgcccccaccaucaucagcugggaggaaaggcagaguug

SEQ ID NO: 11182 - RNA, 64 nt, Human
ggacaagggcuguaagacagggagccccauaggccaucaucauccuuaucccacacccauuaua

SEQ ID NO: 11183 - RNA, 64 nt, Human
gaggacccuuucacuuuuucuuuuuuacggaauucaucaucagagaagaaaauaacaaaaaugg

SEQ ID NO: 11184 - RNA, 64 nt, Human
ucaaguaccucaucugcacccgguacaaguggcucaucaucaagaucgugcuggcgcuguuggg

SEQ ID NO: 11185 - RNA, 64 nt, Human
gaaguaaaaaaccaucaccucccauucccaggggcaucaucauguucaacaaggcauggaggca

SEQ ID NO: 11186 - RNA, 64 nt, Human
uuucccauguaagcugcaguuucuaucuuuagcccaucaucauuuucugcccccccaaaaucug

SEQ ID NO: 11187 - RNA, 64 nt, Human
ggcauugauggaucacaugagaugguagaaggaacaucaucacauaccccucucacagagaaaa

SEQ ID NO: 11188 - RNA, 64 nt, Human
uuuuguaaaacagaaguuccagagcacagaaggucaucaucacaagcaaacuuuauuaaaaaaa

SEQ ID NO: 11189 - RNA, 64 nt, Human
aacauaauuuauuuccagaaaacaacagaaugaacaucaucaugaauacaugaaucggcuguga

SEQ ID NO: 11190 - RNA, 64 nt, Human
aaaaaacgaaaacaaaaacaaaaaaaacacaaaccaucaucacagaagaugcaacaucuuuucu

SEQ ID NO: 11191 - RNA, 64 nt, Human
ggagauuucuucacacaguauguucaucauauaucaucaucauuauuauggugguaaagauaga

SEQ ID NO: 11192 - RNA, 64 nt, Human
uaauuuaaaauauaaauccauucaggugacaacccaucaucaaaauuacaaauuuucugauuga

SEQ ID NO: 11193 - RNA, 64 nt, Human
ucauuagaguuaaacuucauagagucaacuguuucaucaucauagugagcccagagagccacug

SEQ ID NO: 11194 - RNA, 64 nt, Human
caaaagcuuacuuaaaauuaaggauuuacuaagucaucaucagcuguuuuucuuaauuucagcc

SEQ ID NO: 11195 - RNA, 64 nt, Human
uacacauugaggcugucuuuaaggggccugcccucaucaucaacgucucagcccuucaguuugg

SEQ ID NO: 11196 - RNA, 64 nt, Human
uccuuuggccagaugucacuucagccagggugugcaucaucauugguucuuuuucacaggcuga

SEQ ID NO: 11197 - RNA, 64 nt, Human
ucauuaccacaggccaggggcugggcagcguacucaucaucaacccuaaaaagcagagcuuugc

SEQ ID NO: 11198 - RNA, 64 nt, Human
cugaacagguuuugccuaccugguccuuacacuacaucaucaucaucucaugcccaccugccca

SEQ ID NO: 11199 - RNA, 64 nt, Human
aacagguuuugccuaccugguccuuacacuacaucaucaucaucucaugcccaccugcccacac

SEQ ID NO: 11200 - RNA, 64 nt, Human
cuuggccuucaaugacagggaucuagcaaugcugcaucaucagccuuccaauaccagguuuaag

SEQ ID NO: 11201 - RNA, 64 nt, Human
aaggacaacaagaaguggaugagaauauuuuguugaccuucauggguuuacagccucugucucu

SEQ ID NO: 11202 - RNA, 64 nt, Human
cccuccugugcccucaguggcugucguuuguuaacaucaucaggaagaugggaaaggucaggca

SEQ ID NO: 11203 - RNA, 64 nt, Human
gaugguuuuuucugccuuaaaccguguguguguccaucaucaucaguuugagcuguggcuguuu

SEQ ID NO: 11204 - RNA, 64 nt, Human
gguuuuuucugccuuaaaccguguguguguccaucaucaucaguuugagcuguggcuguuuguu

SEQ ID NO: 11205 - RNA, 64 nt, Human
agcaguagugugaaaaaagcacuauaagaaaaugcaucaucaguuugcuauuucccugauggcc

SEQ ID NO: 11206 - RNA, 64 nt, Human
agucacagaacaccuggacaccgccacaugcagucaucaucauguuacuuucaggagccucaac

SEQ ID NO: 11207 - RNA, 64 nt, Human
ugccuccuguggggaaagggguuggggugacagucaucaucagggccuggggccugagagaauu

SEQ ID NO: 11208 - RNA, 64 nt, Human
uuucuuuuuuuaugaccaacaaccaaauaaagcccaucaucaaucaucucucacuauauauuau

SEQ ID NO: 11209 - RNA, 64 nt, Human
accucuuaccuuucucaaagaaagcuucaaccaccaucaucagaaagaagguggccuaaaaacu

SEQ ID NO: 11210 - RNA, 64 nt, Human
uuuuuuaaaaugaauuuuuuuaaaacaaucuagccaucaucaaggugcuauaagaguuguauaa

SEQ ID NO: 11211 - RNA, 64 nt, Human
guuuaucagccauuguagguggcugugucuguugcaucaucauaagaaguuuaagcuuugugcu

SEQ ID NO: 11212 - RNA, 64 nt, Human
gcauacgauuguuuauuuuugcugcuguucucaacaucaucauugccugcugaugugccacgau

SEQ ID NO: 11213 - RNA, 64 nt, Human
cccaaaugcuggcuggccuugugguccaaauaggcaucaucaauaaaacaguuggcaugcaucc

SEQ ID NO: 11214 - RNA, 64 nt, Human
aguaauugaaaauguggugaaaagcugcagcugucaucaucaaaacaacucauaacauacuuua

SEQ ID NO: 11215 - RNA, 64 nt, Human
ugcacccacagguaccuccacacuugggaguuaccaucaucacagucagcccuggggguggggg

SEQ ID NO: 11216 - RNA, 64 nt, Human
ugggagagaauauuucaaaugaacacgugcaccccaucaucacuggaggcaaauuucagcauag

SEQ ID NO: 11217 - RNA, 64 nt, Human
auauugguuaguuuguucagauguugugcacagacaucaucaaaauuagcuaacauggguauuu

SEQ ID NO: 11218 - RNA, 64 nt, Human
aaacauuuauuucugaccuaccaaguuuucuucacaucaucaaauuuauucagcuucucagugc

SEQ ID NO: 11219 - RNA, 62 nt, Human
cuaaaauccugugaacaugacuuaaccagcuuaacaucaucaguaguacugccuagauggaa

SEQ ID NO: 11220 - RNA, 64 nt, Human
agaaugucaagacacucaagauaaagaccaacaagaccuucaauccagaguuacacaaaaagga

SEQ ID NO: 11221 - RNA, 64 nt, Human
cacuguaauggcugcuacagagauggaccaucuucaucaucaccagugguuucuucuaauuaua

SEQ ID NO: 11222 - RNA, 64 nt, Human
uauuuucugugaacauuugugacugcccauuccccaucaucauccguuuuaccuuaguuagcau

SEQ ID NO: 11223 - RNA, 64 nt, Human
acaacugcccauguacaugcccacuuuacucggacaucaucacgggaguuaagaaaaauugugu

SEQ ID NO: 11224 - RNA, 64 nt, Human
augugugucagaaaauuugaucaccauugaggaacaucaucaauugcagacugugaaguugugu

SEQ ID NO: 11225 - RNA, 64 nt, Human
accuccgccuuggggaaugaaagggucacuucugcaucaucacuagcuaguuuucuaguguuag

SEQ ID NO: 11226 - RNA, 64 nt, Human
aauagauuguuucuuuucauauaguccaauguuucaucaucaggaacuuucgguuuuaaaaaag

SEQ ID NO: 11227 - RNA, 64 nt, Human
gagugaaacaaucuuuguacaaugacuagucaugcaucaucaguaauuuuacaaguucuuguag

SEQ ID NO: 11228 - RNA, 64 nt, Human
aauucagcaucuucaguagcuucuaaaaaauaagcaucaucaaugccauuaucccagacagcau

SEQ ID NO: 11229 - RNA, 64 nt, Human
uccuuugcucuggauacaccgaaugaccagguaacaucaucaggccgggugcaguggcuccuau

SEQ ID NO: 11230 - RNA, 64 nt, Human
cacacccucccucccuagagcagcagcgaggauccaucaucagaaucacagugcucuccagacc

SEQ ID NO: 11231 - RNA, 64 nt, Human
uucuuucaaacaucauggccucccauccaaucaacaucaucaaauuacauguguaaucaaggcu

SEQ ID NO: 11232 - RNA, 64 nt, Human
gauucauggaggggcuuuagccaucagcuuuguacaucaucauuuuucugaaugaccaauccca

SEQ ID NO: 11233 - RNA, 64 nt, Human
cucugugagcaucacaaaguuuugguugcuuuaacaucaucaguauugaagcauuuuauaaauc

SEQ ID NO: 11234 - RNA, 64 nt, Human
gcaaaucacaaaaaaacuguuaucaauucacauucaucaucagcacgagacccauuuccuugug

SEQ ID NO: 11235 - RNA, 64 nt, Human
uuguaguguucaaaauauuuuuguauuguuaaugcaucaucauagaaaaacuuuuaaacaugag

SEQ ID NO: 11236 - RNA, 64 nt, Human
uucuucacaacacuuucuaacaucaaaugacucucaucaucaacaaauuguauuccuuauugug

SEQ ID NO: 11237 - RNA, 64 nt, Human
cuccauggacauagagagaaaggaaugauauucucaucaucaucuucaucaucccaggcucuga

SEQ ID NO: 11238 - RNA, 64 nt, Human
cuuggugaagaccugcaccccuggaaccucccaccaucaucacaacuguagucucauuugcagu

SEQ ID NO: 11239 - RNA, 63 nt, Human
gcugccaguguaagaucugaggcucuggacccagaccuucagguuucuccuguuuggugaaag

SEQ ID NO: 11240 - RNA, 64 nt, Human
gaguguugacaguuugaggagucgaauugagauucaucaucaaagagcaaugcagcgucguuaa

SEQ ID NO: 11241 - RNA, 64 nt, Human
ucccgccaucagcuaccucucaucaccccaccuucaucaucaugcuccagggucacccuggcca

SEQ ID NO: 11242 - RNA, 64 nt, Human
agaguggcuuugucaguauaaaaccauguaaagucaucaucaagucaucuggaugaaucuugaa

SEQ ID NO: 11243 - RNA, 64 nt, Human
aucucgauuaauaaccugccagucccagaucacacaucaucaucgaagucuuccccaguuauaa

SEQ ID NO: 11244 - RNA, 64 nt, Human
acaucuaccagaucauccaagugauuaaauuuaacaucaucaaugaugggaccaaggacauuau

SEQ ID NO: 11245 - RNA, 64 nt, Human
gaauggucgccaugauugaaaccacgcaccauuacaucaucauuacauuaauuacaucaacaua

SEQ ID NO: 11246 - RNA, 64 nt, Human
ggaugguucuccaauuguuccucggcuggauuuucaucaucagauauuucaacucaucucauca

SEQ ID NO: 11247 - RNA, 64 nt, Human
aggauuacaggcgugagccaccacucccggcugucaucaucaaauuuucaagugaagauagucu

SEQ ID NO: 11248 - RNA, 64 nt, Human
aaauuguuauaaggguuauuaauuuaauaaaauucaucaucagguuuccccuauaagcuuucuc

SEQ ID NO: 11249 - RNA, 64 nt, Human
uagaguuagauacuaaggaaacaaacuaauuggucaucaucauuuucuuuuuuucuuuuucuuu

SEQ ID NO: 11250 - RNA, 64 nt, Human
agacagaucuucaugaccuguucccaccccaguucaucaucaucucuuuuacaccaaaaggucu

SEQ ID NO: 11251 - RNA, 64 nt, Human
gugucagauaugcuucccucaaaccuuguuacagcaucaucacauuaccuguuugauguaaaaa

SEQ ID NO: 11252 - RNA, 58 nt, Human
acaaagaaugugaaguauaauaucuacccaucaucaaaaaucacaucagauaaguaac

SEQ ID NO: 11253 - RNA, 64 nt, Human
uacccuauugaauaggucagaaguagaaucuuuucaucaucacagaaaguucuauuggacagug

SEQ ID NO: 11254 - RNA, 64 nt, Human
cugaucaaugaagccagcaaugcuuuuuucuuggcaucaucaaagcugacauuuagaagagaug

SEQ ID NO: 11255 - RNA, 64 nt, Human
ucucaguccaucucgagccuccguucaaauugaucaucaucaaaacuuauguggcuuuuugacc

SEQ ID NO: 11256 - RNA, 64 nt, Human
gauggcacuuugaaggggccucaccgagugggggcaucaucaaaaacuuuggaguccccucacc

SEQ ID NO: 11257 - RNA, 64 nt, Human
aagcagugcaggggggucuuucacugauaagaagcaucaucaguaggguuugucccugaugccu

SEQ ID NO: 11258 - RNA, 63 nt, Human
gcugccaguguaagaucugaggcucuggacccagaccuucagguuucuccucuuuggugaaag

SEQ ID NO: 11259 - RNA, 64 nt, Human
guccugugccaccaaaacccaaagaucaaagguccaucaucaaaacaccaaagacucaagacac

SEQ ID NO: 11260 - RNA, 64 nt, Human
augggaaaacacacaugguuuggagcaauaggaacaucaucauaauuuuugugguucuauuuca

SEQ ID NO: 11261 - RNA, 64 nt, Human
ugcccacggacccaaccucuguccaggugccccucaucaucacaguuuaacacaagcuccccug

SEQ ID NO: 11262 - RNA, 64 nt, Human
ccagcaugugucuguaauuguaugauuuuuaaaucaucaucaaaagauuaaauuauguuugggu

SEQ ID NO: 11263 - RNA, 64 nt, Human
ucuuguucacaugcuccacguagcuguaacuucacaucaucagcuugcaguuuguaauugacua

SEQ ID NO: 11264 - RNA, 64 nt, Human
uccacaucuguuccucaaugugugacauugguggcaucaucacgccauuccuggucuaccggcu

SEQ ID NO: 11265 - RNA, 64 nt, Human
uuuccugguguuuggauggucagcugggaguguccaucaucaggggaagaucaaacacaggugc

SEQ ID NO: 11266 - RNA, 64 nt, Human
uuggcaaggucuccacuucaggggcaaacaucuccaucaucagcaacuccaaaccccagccacu

SEQ ID NO: 11267 - RNA, 64 nt, Human
ucacugaguacaucaagggcggcacgcuccggggcaucaucaagagcauggugaguccugggca

SEQ ID NO: 11268 - RNA, 64 nt, Human
uuuuaauuugcuuuggugaugauuacuguauugacaucaucaugccuuccaaauuguggguggc

SEQ ID NO: 11269 - RNA, 64 nt, Human
auguacugauugccaauacaccccacccucauuacaucaucaggacuugaagccaaggguuaac

SEQ ID NO: 11270 - RNA, 64 nt, Human
uuguauuucuauagcaccucucuauuggguuuaucaucaucaacaagacuacuguuuacuguag

SEQ ID NO: 11271 - RNA, 64 nt, Human
uccuccuccucuucuuccuuaucaucguguucuucaucaucaacuguuguacaagaaaucucuc

SEQ ID NO: 11272 - RNA, 64 nt, Human
acacaguuugcgcuggaauuaaaugaaauggauccaucaucaaagucuuuauugccaccuacug

SEQ ID NO: 11273 - RNA, 64 nt, Human
uccaaaggauuuuguaucuuuuugaaaauguuuacaucaucagaugauccacagaauucacuuu

SEQ ID NO: 11274 - RNA, 64 nt, Human
uccuccugcuccucaagaguguggucuauuuugccaucaucaccugcugucugcuuagaagaac

SEQ ID NO: 11275 - RNA, 64 nt, Human
agagacuucguaauuaaaggaacagagugagagacaucaucaaguggagagaaaucauaguuua

SEQ ID NO: 11276 - RNA, 64 nt, Human
uauggccuccuuugcccaaguugaaacaggggcccaucaucaugucuguuuccagaacagugcc

SEQ ID NO: 11277 - RNA, 64 nt, Human
ccagcccugccuccagggcuccugggcugccagggaccuucagcucccagaggcaguguggucc

SEQ ID NO: 11278 - RNA, 64 nt, Human
aaugcaaaagucuagaggggguaacagucugcaucaucaucacaaccuaaauggagaaagcugu

SEQ ID NO: 11279 - RNA, 64 nt, Human
aagaaugcaaaagucuagaggggguaacagucugcaucaucaucacaaccuaaauggagaaagc

SEQ ID NO: 11280 - RNA, 64 nt, Human
ugccuauaaauaguaggaccaauguugugauuaacaucaucaggcuuggaaugaauucucucua

SEQ ID NO: 11281 - RNA, 64 nt, Human
uuuuaucauguauauccuauacacacaucuccuucaucaucauauaugaaguuuauuuugagaa

SEQ ID NO: 11282 - RNA, 64 nt, Human
gugaaauuauggaaaauuacuuaaaacgugaauacaucaucacaguagaauuuauuaugagagc

SEQ ID NO: 11283 - RNA, 64 nt, Human
ugaauuuucugucauuuaauuucagauccuagcucaucaucagugaaguccagccuacuuacuu

SEQ ID NO: 11284 - RNA, 64 nt, Human
ggggcaugguuugugugcuggacuuucucauggccaucaucaguaugcuuauggauuugaugac

SEQ ID NO: 11285 - RNA, 64 nt, Human
aagggagagagccuggggucuacaagaggagacacaucaucaaauguuugaaugaucacaaauu

SEQ ID NO: 11286 - RNA, 64 nt, Human
agguuuucuucuauuugcccuuaguuuagaucuccaucaucaauuccacuuacuauuguaauac

SEQ ID NO: 11287 - RNA, 56 nt, Human
ucuaugaaaaaguagaauaaaaauuccaucaucacuuuggacaggaguuaauuaag

SEQ ID NO: 11288 - RNA, 64 nt, Human
agcuagaaaaugcuaaacugagguauggagccuccaucaucaugcucuuuugugaugauuuuca

SEQ ID NO: 11289 - RNA, 64 nt, Human
aggcgcaccccguggacuggcccaggaggacgugcaucaucacugcaaucagcaugaacaccag

SEQ ID NO: 11290 - RNA, 64 nt, Human
ugugucugaacgauggccgcaugacuuuggugggcaucaucagcuggggccugggcuguggaca

SEQ ID NO: 11291 - RNA, 64 nt, Human
auacaguaaaaacaaauguaaauaaaagaaaacacaucaucaauaaaacuguuauuaugcguga

SEQ ID NO: 11292 - RNA, 64 nt, Human
caaaggguuuccuuguguuuucauuguaaaauaccaucaucagugagagucuugaguucacuaa

SEQ ID NO: 11293 - RNA, 64 nt, Human
auuccauacuaaagccaugaagaacuacacguaacaucaucauuuguauuaauugcacaacucc

SEQ ID NO: 11294 - RNA, 64 nt, Human
uguucauuaggagaguaaguccacucuucccucucaucaucauggccccaccggguacccugag

SEQ ID NO: 11295 - RNA, 64 nt, Human
cacuugggcccaggaguuugaggcugcagugagccaucaucauggcaucauugcauuccagccu

SEQ ID NO: 11296 - RNA, 64 nt, Human
gauggauuuucaaggucaugcuggccaauuaaggcaucaucaguccuaccugagcaacaagaau

SEQ ID NO: 11297 - RNA, 64 nt, Human
uuaagauugucagcaaacuugucccaaaauggcacaucaucauaauccauuuucucuuugcuag

SEQ ID NO: 11298 - RNA, 64 nt, Human
aaaucaguccuuauccucuuucuaucuucacucccaucaucaucuauuuucacacuauccagcu

SEQ ID NO: 11299 - RNA, 64 nt, Human
uggagaaccagguuucaaaaucagguaagaaaaccaucaucauuaacugagcaccagcugugcu

SEQ ID NO: 11300 - RNA, 64 nt, Human
agccccuggagaaaccgccagggcgaggugcgaccaucaucaggaucaaagcagacggggcgug

SEQ ID NO: 11301 - RNA, 64 nt, Human
augauacagucaggacacaucguucgauuuaagccaucaucagcuuaauuuaaguuuguaguuu

SEQ ID NO: 11302 - RNA, 64 nt, Human
uucucuuccagcaacaacuaaaugacuccucugucaucaucagcgcccucaagaccuaccuggu

SEQ ID NO: 11303 - RNA, 64 nt, Human
cacucuagccuuucucaggcugcaccaaagauuccaucaucagggccaacugagagugagggag

SEQ ID NO: 11304 - RNA, 64 nt, Human
caguaccgcagagugauucccccacugaggaugucaucaucaaacucuucuuuggugugugaau

SEQ ID NO: 11305 - RNA, 64 nt, Human
caaaugucacagcaggauuuccccaacccagcuccaucaucacagacacagagagcugcagggg

SEQ ID NO: 11306 - RNA, 64 nt, Human
acaggugcagcagugaucaauggcucucagcauccaucaucaucgucgucugucaaugaugugu

SEQ ID NO: 11307 - RNA, 64 nt, Human
aguuguauuaaguagauucauauucuugugcaaccaucaucaccauccggcugcaaaacucuuu

SEQ ID NO: 11308 - RNA, 64 nt, Human
agaccucacagucccucagguucuacugggaucucaucaucauccuuagucaagcagcagggcc

SEQ ID NO: 11309 - RNA, 64 nt, Human
aaaaauaucagcucccaaagggcccaugugucuacaucaucaguuacugucaugcaccacauuu

SEQ ID NO: 11310 - RNA, 64 nt, Human
caauagauggauauuuuuauuucuagaacucugacaucaucauuuguuaauauuuaaugauuuc

SEQ ID NO: 11311 - RNA, 64 nt, Human
ccuccacguucugcucaucauucucugucucauccaucaucauguguguccacgacugucucca

SEQ ID NO: 11312 - RNA, 64 nt, Human
gaaaauuagucgauucucagauuaccuuuauucgcaucaucagaccuauggacgcaaucauuua

SEQ ID NO: 11313 - RNA, 64 nt, Human
caaagccaggucccucucauuuagccuguccugucaucaucauggccagcuggaggcaggggcu

SEQ ID NO: 11314 - RNA, 64 nt, Human
gaauauuuguuuuaauaccacagcuauuuagaagcaucaucacgacacauuugccuucagucuu

SEQ ID NO: 11315 - RNA, 64 nt, Human
cccuucuaaggaaaaagagagguucagagcguuggaccuucaugaacaguggccuggcuggcgu

SEQ ID NO: 11316 - RNA, 64 nt, Human
guggcacgcuccgugaagaaguaguacaccuugucaucaucacccacugcacuggccuugcucu

SEQ ID NO: 11317 - RNA, 64 nt, Human
gaucagguugucugcauuuguugguguaagugaacaucaucacaguuauccugaguugaguuua

SEQ ID NO: 11318 - RNA, 64 nt, Human
gaacaacauguucguggugcugaaugccucucagcaucaucaaggauaacugaaacugggucuc

SEQ ID NO: 11319 - RNA, 64 nt, Human
uuguugcugcacgugcugggcccgccaaugccgucaucaucaggauuuuacaaaucucuuugcg

SEQ ID NO: 11320 - RNA, 64 nt, Human
ccaguacaggaagugacaccaguacucuguaaagcaucaucauccuuggagagacugagcacuc

SEQ ID NO: 11321 - RNA, 64 nt, Human
aauaaauacaguacucaacuuccuuucauauuagcaucaucaacccucuaauucaccuuauggg

SEQ ID NO: 11322 - RNA, 64 nt, Human
agggcucuucugccaucccuugucucccugaggccaucaucaaacaggacagaguuggaagagg

SEQ ID NO: 11323 - RNA, 64 nt, Human
uggaggccuccuguccucggggaccccagcaccucaucaucagcauugcuggagccaaggguag

SEQ ID NO: 11324 - RNA, 64 nt, Human
cugauucacguuagcaguguguacacuacuguaucaucaucagcuucaucacccuguaaaccag

SEQ ID NO: 11325 - RNA, 64 nt, Human
uccuaaaauauugcugcuuccucuuccuuugaagcaucaucaguagucacacccucacagcugg

SEQ ID NO: 11326 - RNA, 64 nt, Human
auuuaauuuuuaaguugaaucccaugaaaggugucaucaucacuaggaauaacacccuuuguaa

SEQ ID NO: 11327 - RNA, 64 nt, Human
gcggggccccgaucccagaauuaucaacuccacccaucaucauuuggucaugaagcauccuuuc

SEQ ID NO: 11328 - RNA, 64 nt, Human
cauugugaaugguugcaguggagcuuagguauaacaucaucaaguguguucacacgcggggucg

SEQ ID NO: 11329 - RNA, 64 nt, Human
gcugcuccccaccaccaggucugcauuuguucaucaucaucaggagcagaggugaccagagggu

SEQ ID NO: 11330 - RNA, 64 nt, Human
acggcugcuccccaccaccaggucugcauuuguucaucaucaucaggagcagaggugaccagag

SEQ ID NO: 11331 - RNA, 64 nt, Human
guuucccggcccuuaccuuuccugaugccccugacaucaucauucuugugggagacagcagccu

SEQ ID NO: 11332 - RNA, 64 nt, Human
agagcuggcgacugcagcugcaccaucacacaugcaucaucagccuauuuguaauaugucugcc

SEQ ID NO: 11333 - RNA, 64 nt, Human
uguccucuucucuagaguggagguuuucaaagugcaucaucagcauuaccugugaacuugcugg

SEQ ID NO: 11334 - RNA, 64 nt, Human
caacucagaaugcacuugauucaggaggucaucugaccuucaccuuggaugguuaguuucacuu

SEQ ID NO: 11335 - RNA, 64 nt, Human
acucugacucuuuauuguuguaagaaaaauaguucaucaucagagaauggucaguuuccauuca

SEQ ID NO: 11336 - RNA, 64 nt, Human
gaaauagcaaauguucuuucuaugcuuuccucaccaucaucacaguguuuacaaacuuuugaaa

SEQ ID NO: 11337 - RNA, 64 nt, Human
aaguaugguuucuacugaauguguauugcuuucccaucaucauaaaauuuuuaaaaauccuaag

SEQ ID NO: 11338 - RNA, 64 nt, Human
accuugacccuucccuuuccucugcuucucuccucaucaucauucccaacaacauccucugcca

SEQ ID NO: 11339 - RNA, 64 nt, Human
ugggaacgcggagaacagugggguuacagggagucaucaucagcccuaccccuuggccaaccac

SEQ ID NO: 11340 - RNA, 64 nt, Human
caaaagucaaaucagaauggaaaagacucaaaaccaucaucaacaccaagaucaaaaggacaag

SEQ ID NO: 11341 - RNA, 64 nt, Human
ucuuucucagauuuuuaguaaaugcaaguaagaacaucaucaaaguucacuuuguauuguaccc

SEQ ID NO: 11342 - RNA, 64 nt, Human
gcuccaugaauccagcccgcuccuucggcccugccaucaucauugggaaguucacaguccacug

SEQ ID NO: 11343 - RNA, 64 nt, Human
caauguguuuucuugccuaaauucauuuaucuggcaucaucagaguacuaacauguuuauauuu

SEQ ID NO: 11344 - RNA, 64 nt, Human
ugagcacaaugacauuuuuauauuacagagcuuccaucaucaugaagaaaaaaaaauuugguuc

SEQ ID NO: 11345 - RNA, 64 nt, Human
cuagcaugcagaaaaugcccacguaaauagcugucaucaucauuaucuuuuaacauuuuggggg

SEQ ID NO: 11346 - RNA, 64 nt, Human
ugcaggccccaucuccaggcuaaggggaggagagcaucaucacuuuccauuagcuguauuggcu

SEQ ID NO: 11347 - RNA, 64 nt, Human
uaaguuacucugaguuuacacaugaaaaggugaacaucaucaaaaacccuggacacaguucccu

SEQ ID NO: 11348 - RNA, 64 nt, Human
agcauagcaguguacagcuugaagagauguuccacaucaucacuccagcuccuucucuuuucuc

SEQ ID NO: 11349 - RNA, 64 nt, Human
cauacuggaaugaaugauuucuuggugguauuagcaucaucacagaccuauacuugcuuucuga

SEQ ID NO: 11350 - RNA, 64 nt, Human
cuguuuaugaggggaaggaugguaccaucgaggacaucaucacagguggggcccuuuucacucc

SEQ ID NO: 11351 - RNA, 64 nt, Human
uuuuuggacagauagucccauggaaagagacugucaucaucacccuuucauucaucauagggau

SEQ ID NO: 11352 - RNA, 64 nt, Human
uaaaaugcggcacuauuucugaacaaagagagcucaucaucagucuuaauauucagagaaaacu

SEQ ID NO: 11353 - RNA, 64 nt, Human
ccccuuaaauaagccccucaccuugcugccucaggaccuucaagauuccaucugugggcuggcc

SEQ ID NO: 11354 - RNA, 64 nt, Human
aguauaacugauuucaggcuaacuuauuaccacucaucaucauauacuagcaggaauggcaaua

SEQ ID NO: 11355 - RNA, 64 nt, Human
gcagcuaaauaguaaguacuuuuuaaaauuuuugcaucaucaucuuccuauuuaaugaauugug

SEQ ID NO: 11356 - RNA, 64 nt, Human
uaauauuuuuaauguuuuuuaaagcauuaaugaacaucaucauuaauuucaccuauuauauugu

SEQ ID NO: 11357 - RNA, 64 nt, Human
guauuuccuguuguagucauuuuuagcucgaccacaucaucaggucuuugccaccgaggcauag

SEQ ID NO: 11358 - RNA, 64 nt, Human
ggcagcucuccuuggucaccuucaugggcuuccccaucaucaugaugguguccaacaucuacgg

SEQ ID NO: 11359 - RNA, 64 nt, Human
aaguauguaaauacuagaaagguaguacuagugacaucaucacguguauuguuaucuauggggc

SEQ ID NO: 11360 - RNA, 64 nt, Human
cguagcagaaaccauuuugcugccacaaaauuuucaucaucagaacuaauaaaucaaguguucc

SEQ ID NO: 11361 - RNA, 64 nt, Human
ucaggagucucugguagccugcagaaguaagccucaucaucagagccuuuccucaaaacuggag

SEQ ID NO: 11362 - RNA, 64 nt, Human
guugaaaagccaaaggucaaacaggcuguaauuccaucaucaucguuguuauuaaagaauccuu

SEQ ID NO: 11363 - RNA, 64 nt, Human
auaccaccaucuaagcuccuguaucagcaguccucaucaucacucaucugccaagcuccucaau

SEQ ID NO: 11364 - RNA, 64 nt, Human
auagaaucaucuaagcuccuguaucagcacuccucaucaucacucaucugccaagcuccucaau

SEQ ID NO: 11365 - RNA, 64 nt, Human
cuggcccccaggacuuccugcgcugugucagugccaucaucaucuuccugguggucuccuuugc

SEQ ID NO: 11366 - RNA, 64 nt, Human
acagacagaauucuucacauuaaggaacugucuucaucaucauacauguagaaaagaaucugaa

SEQ ID NO: 11367 - RNA, 64 nt, Human
cugcugagaaauguugcuuugaguuugcuuuacacaucaucaacucuaaauccuauaguaacau

SEQ ID NO: 11368 - RNA, 64 nt, Human
cagcagaggugauucuuacauaugauccaguuaacaucaucacuuuuuuugaggacauugaaag

SEQ ID NO: 11369 - RNA, 64 nt, Human
cuuuucgacacuuaccuaguaaaguauucuuaggcaucaucauaacuuuuccucaccuuuauuc

SEQ ID NO: 11370 - RNA, 64 nt, Human
agcccccugagucaucacucuagaagaaucuguacaucaucaggacugcauugcucaggcauuu

SEQ ID NO: 11371 - RNA, 64 nt, Human
gcuuuauuuucuuuguacaagcuuaaaauuucaacaucaucauccgccaaaguuguuccucccu

SEQ ID NO: 11372 - RNA, 64 nt, Human
uuccugugguagugcucccagucugaccucuguagaccuucaguacucacucuucuugcuuagg

SEQ ID NO: 11373 - RNA, 64 nt, Human
gcuaaguccuuccauaaagaugcuaaauaacuuucaucaucacauaaaugucuucauaaaccaa

SEQ ID NO: 11374 - RNA, 64 nt, Human
cagcuauuagucucaucuucuuaacucccucaggcaucaucaaauucuuugaucuucucuucca

SEQ ID NO: 11375 - RNA, 64 nt, Human
ucuucuaccaggcagccgagaacagggagauaaacaucaucaucuucuaagagcugaucaagaa

SEQ ID NO: 11376 - RNA, 64 nt, Human
ccaugcagggccucacacgguuugaagccuggaacaucaucaaggcacugccugauggaccugu

SEQ ID NO: 11377 - RNA, 64 nt, Human
acagaugaaacacaaacaauaguaauucucaggccaucaucaguggagccauguuaauguaauc

SEQ ID NO: 11378 - RNA, 64 nt, Human
cauucucugaacguauuucagaaaucacuguguucaucaucaaauuagaauguugguucuuuuc

SEQ ID NO: 11379 - RNA, 64 nt, Human
gaaccacuaaugggugucaucuuggccaucuaaacaucaucaauuucuaaaaacauuuuccuua

SEQ ID NO: 11380 - RNA, 57 nt, Human
ugccgagaagaaggagauaaacaccaccaucaucaaagagcugcucaagaaauuuuu

SEQ ID NO: 11381 - RNA, 64 nt, Human
auacuguaaauuagguuaauuuuguaagucuuagcaucaucauauugugcuguuuuggauaaca

SEQ ID NO: 11382 - RNA, 64 nt, Human
cucuauuuuuguuuaugugugauagugguucugucaucaucauucauguuuuuuaaggccuggu

SEQ ID NO: 11383 - RNA, 64 nt, Human
uggcaucccggccuugccauuagcaugccucaugcaucaucagaugacaaggacaacccucaug

SEQ ID NO: 11384 - RNA, 64 nt, Human
uguggacuuaggaaaacaauauaaaggacauccucaucaucacggggugaaggucagacuaagg

SEQ ID NO: 11385 - RNA, 64 nt, Human
uggccguguauguccacaugugugccuguagauacaucaucaagcccuuuggagcuuccuaagu

SEQ ID NO: 11386 - RNA, 64 nt, Human
uucaagaagaaaugaaagaagggacagacauguucaucaucaaggcugugcugccuguugcuga

SEQ ID NO: 11387 - RNA, 64 nt, Human
aguuaugaucaucguuuuccugccuugaccccaccaucaucaaacacucaguuaaauauaaauu

SEQ ID NO: 11388 - RNA, 64 nt, Human
gaccuggccacccugcagcagcuauacgacuucacaucaucagaggacgccccgugcgcuguca

SEQ ID NO: 11389 - RNA, 64 nt, Human
gagugccuacaaagcuaaugcuuggugcuagaaacaucaucauuauuaaacuucagaaaagcag

SEQ ID NO: 11390 - RNA, 64 nt, Human
uuuccguuguuuaccaaauuuucuuagauuuggucaucaucaggaagcauuuguaaaaauaaaa

SEQ ID NO: 11391 - RNA, 64 nt, Human
ucagggacccagccccuccucucugagaaacucugaccuucauguccuuaggcugugcuccugc

SEQ ID NO: 11392 - RNA, 64 nt, Human
aacguccggcuccaucggcacuaccaccccgcuccaucaucacuauguccagcuccgucggcac

SEQ ID NO: 11393 - RNA, 64 nt, Human
uauguccagcuccgucggcacuaccacccugcuccaucaucacuacguccagcuccaacggcac

SEQ ID NO: 11394 - RNA, 64 nt, Human
agucaccuuccucaucuugcaggugcugaaccaacaucaucaguuucuauucuaaucaggcccc

SEQ ID NO: 11395 - RNA, 64 nt, Human
uuugagguaucacugcagucaccucuucuacccucaucaucauagguaagguuuucaagguggc

SEQ ID NO: 11396 - RNA, 64 nt, Human
aaagcugucuccauaguuuaaaaucgaauagugccaucaucacaguauauuagucaaauagaag

SEQ ID NO: 11397 - RNA, 64 nt, Human
ucucacugucucguuuucacaccgcaucaguccccaucaucacuacuccuccccagagacauac

SEQ ID NO: 11398 - RNA, 64 nt, Human
uuuuagauuguugaacagauaaauacgaaacugccaucaucauuuguagaaaaacuguuuauac

SEQ ID NO: 11399 - RNA, 64 nt, Human
aucggcagugugggaaaugcgaagcauuucucaucaucaucaucucugcuacagucauguuucu

SEQ ID NO: 11400 - RNA, 64 nt, Human
gauaucggcagugugggaaaugcgaagcauuucucaucaucaucaucucugcuacagucauguu

SEQ ID NO: 11401 - RNA, 64 nt, Human; identical to SEQ ID NO: 11398

SEQ ID NO: 11402 - RNA, 64 nt, Human
cugugcuggccaggugacuccuaguucuuggccacaucaucagaaagucaaaggucucacucca

SEQ ID NO: 11403 - RNA, 64 nt, Human
cuggagcugucugccaaaagaaacugccuacagacaucaucacagcagccuccucacuugggua

SEQ ID NO: 11404 - RNA, 64 nt, Human
cucucccauccugcucaggucuuuucagcagucucaucaucagcaaccaugacugaugacuggg

SEQ ID NO: 11405 - RNA, 64 nt, Human
cccugccauccuccccaggucccagcggcaccaacaucaucauuggcuccauugcuggggcugu

SEQ ID NO: 11406 - RNA, 64 nt, Human
ucacucaggaacccuggagacagaagucaggugucaucaucagacuugcggccacagcacuaga

SEQ ID NO: 11407 - RNA, 57 nt, Human
ucagcggggagucccuguaggcucugccaucaucagcaccaggagagccgaccccuc

SEQ ID NO: 11408 - RNA, 64 nt, Human
gccuccaguauuggacagcacacagaaagguuuucaucaucaagagaguucugcuggucagccc

SEQ ID NO: 11409 - RNA, 64 nt, Human
gcugaaaagcuuuccugacccaagcaaagacacacaucaucaacuuccaaugucuggacaacuc

SEQ ID NO: 11410 - RNA, 64 nt, Human
ugaauuuucugagacggauguaacaaauacugaacaucaucaacccaguaauaaugauuugaac

SEQ ID NO: 11411 - RNA, 64 nt, Human
gucuuaaaggucuugaggguugaccauguugcgucaucaucaacauuuuggggguuguguugga

SEQ ID NO: 11412 - RNA, 64 nt, Human
uaaggacucccauuuccaguauuaaagagagaaucaucaucaaggcaccguagguaacucagug

SEQ ID NO: 11413 - RNA, 64 nt, Human
aaguauauugauagcuuuguagguacaggaaaaacaucaucauuauuuccucuguucacauuua

SEQ ID NO: 11414 - RNA, 64 nt, Human
ccccagauggcgagcagcaccaccuccaagccgucaucaucauccucaggacccaggacccucc

SEQ ID NO: 11415 - RNA, 64 nt, Human
auuugugaaaaacagagcagugaccuagcuguugcaucaucaugacugccauguaaccuguaau

SEQ ID NO: 11416 - RNA, 64 nt, Human
uucaaacaugaucaaagauuucccaaugugaucucaucaucauggauacucaauuuguuuuuuc

SEQ ID NO: 11417 - RNA, 64 nt, Human
aauaaguuuuaaguuguccaaaguuaauuguaaacaucaucaguacaguacucuuaguuacagu

SEQ ID NO: 11418 - RNA, 64 nt, Human
acaauaaaacaaaacaaugacacaaaaccacaaucaucaucauaaucguauccaagagaaaccu

SEQ ID NO: 11419 - RNA, 64 nt, Human
cuaacccaaggccuggguuaugucuuagucgagacaucaucaucugagaagcaccacauccuuu

SEQ ID NO: 11420 - RNA, 64 nt, Human
uuuuuguccucauaaucaaaacagcauaacaugacaucaucaccaguaauaguugcauugauac

SEQ ID NO: 11421 - RNA, 64 nt, Human
uacuuuauugaaaggggacaccuguacauucuuccaucaucacuguaaagacaaauaaaugauu

SEQ ID NO: 11422 - RNA, 64 nt, Human
cuuauguuucuaaauuuugugauucuauaaaacacaucaucaauaaaauaaugacauaaaauca

SEQ ID NO: 11423 - RNA, 64 nt, Human
uauuucuuuucuaucucaucuugaugaugauagucaucaucaagaauuuaaugauuaaaauagc

SEQ ID NO: 11424 - RNA, 64 nt, Human
cuuauguuucuaaauuuugugauucuauaaaacacaucaucaauaaaauagugacauaaaauca

SEQ ID NO: 11425 - RNA, 64 nt, Human
uauuucuuuucuuucucaucuugaugaugaucgucaucaucaagaauuuaaugauuaaaauagc

SEQ ID NO: 11426 - RNA, 64 nt, Human
caugagaguucugucacggucacuuuacuguccccaucaucacccagcacggggcuaagcauau

SEQ ID NO: 11427 - RNA, 64 nt, Human
uucaugagagucccuacaaacuguauggcaaaaccaucaucaugaguucuagcauuaaucaaca

SEQ ID NO: 11428 - RNA, 64 nt, Human
guggugaccuggguuggauggcagagaccgcugccaucaucacagacgccuccuuccuguccgg

SEQ ID NO: 11429 - RNA, 64 nt, Human
auggagguggagcuguggcccgcggagaagcagucaucaucauccauggaguggcugcuggugc

SEQ ID NO: 11430 - RNA, 64 nt, Human
ccugacucccgucuccaucugucacgugguucaccaucaucaggcaccaggcgcaaacugcuuc

SEQ ID NO: 11431 - RNA, 64 nt, Human
ugagaauuaauucuggagagaaugccccauugaacaucaucaauauuggagagcuuucuguuuu

SEQ ID NO: 11432 - RNA, 64 nt, Human
cagcugggcuugaggggcugacaacaggaaguaccaucaucacugccagagcucaagaucccac

SEQ ID NO: 11433 - RNA, 64 nt, Human
ccuggcacccuccuuuccugcuccgccugcccggcaucaucagcccuucuggggcguguaccuc

SEQ ID NO: 11434 - RNA, 64 nt, Human
guccagcugcccaggucauggccuaccucuucaccaucaucaacagccuccaaggcuucuucau

SEQ ID NO: 11435 - RNA, 64 nt, Human
uaccauuaaaagagugugacaauguauuguaguccaucaucacucaaaccugaaacuucagcau

SEQ ID NO: 11436 - RNA, 64 nt, Human
gacccuuugaagguaacaaguuaagaaaauuucccaucaucauguacuuacuauugaacaugaa

SEQ ID NO: 11437 - RNA, 64 nt, Human
cucacugaauguuagucaucguuauuauauucaucaucaucaguauuauuauuuguagaaaggc

SEQ ID NO: 11438 - RNA, 64 nt, Human
auacucacugaauguuagucaucguuauuauauucaucaucaucaguauuauuauuuguagaaa

SEQ ID NO: 11439 - RNA, 64 nt, Human
aguguaagaccguaaagaguacgagcgcgccauucaucaucagacagcccacacuggugagaaa

SEQ ID NO: 11440 - RNA, 64 nt, Human
agaucccguccaaagugccucccaugccuaccaccaucaucacaucccccagcaagccagccac

SEQ ID NO: 11441 - RNA, 64 nt, Human
gacccguuacccacuacccuucucucccccagcucaucaucagucgcugucucuuuucugugau

SEQ ID NO: 11442 - RNA, 64 nt, Human
uccuggcuugaauuuucuuauaaucccaugaaaccaucaucagagucacaauaaugaauuuauc

SEQ ID NO: 11443 - RNA, 64 nt, Human
uugacauacaggagagcugcaguugugaaagcaccaucaucauagaggaugauguaauuaaaaa

SEQ ID NO: 11444 - RNA, 64 nt, Human
agguuuuggaggaagaagacaacuucccucauuccaucaucaccaucucuuucucacuagguuc

SEQ ID NO: 11445 - RNA, 64 nt, Human
uccacaaugaugaugauuucagcagggaugacgucaucaucacauucagggcuauuuuuucccc

SEQ ID NO: 11446 - RNA, 64 nt, Human
aucggaagaugcuugugauuuuaauauuauuugucaucaucauugugcucauuguuguccucgu

SEQ ID NO: 11447 - RNA, 64 nt, Human
aaaauacuuugcauucuaaguugccaauaaaauagaccuucaaguuauuuuaaugcucuuuucu

SEQ ID NO: 11448 - RNA, 64 nt, Human
accucugcauccauggugacggagguggcaaugacaucaucaaggucagaggguaaauuccuaa

SEQ ID NO: 11449 - RNA, 64 nt, Human
cgucgucaucaucuugcugagucaucaucaucaucaucaucauugucgucgucaucaucuugcu

SEQ ID NO: 11450 - RNA, 64 nt, Human
ugucgucgucaucaucuugcugagucaucaucaucaucaucaucauugucgucgucaucaucuu

SEQ ID NO: 11451 - RNA, 64 nt, Human
cauugucgucgucaucaucuugcugagucaucaucaucaucaucaucauugucgucgucaucau

SEQ ID NO: 11452 - RNA, 64 nt, Human
caucauugucgucgucaucaucuugcugagucaucaucaucaucaucaucauugucgucgucau

SEQ ID NO: 11453 - RNA, 64 nt, Human
caucaucauugucgucgucaucaucuugcugagucaucaucaucaucaucaucauugucgucgu

SEQ ID NO: 11454 - RNA, 64 nt, Human
ggaaacacacacacacacacaucaucauuaucaucaucaucauugucgucgucaucaucuugcu

SEQ ID NO: 11455 - RNA, 64 nt, Human
cccggaaacacacacacacacacaucaucauuaucaucaucaucauugucgucgucaucaucuu

SEQ ID NO: 11456 - RNA, 64 nt, Human
aguauguggauacccggaaacacacacacacacacaucaucauuaucaucaucaucauugucgu

SEQ ID NO: 11457 - RNA, 64 nt, Human
aaccuuucauguagccccucaacagaaugcauugcaucaucaccaugguaacaguucccaucac

SEQ ID NO: 11458 - RNA, 64 nt, Human
uuuacaauuaaaucuaaaaugcuuaauccaauaucaucaucaaaauucagugaaaucccaaaac

SEQ ID NO: 11459 - RNA, 64 nt, Human
uuuuccuacagaaacaaaaguuaauuuugaagagcaucaucaugggcuggggugguggcugccc

SEQ ID NO: 11460 - RNA, 64 nt, Human
uuguaauauaaggcaagcccucucucagagcugccaucaucacuuuuugaauuucuuugggggu

SEQ ID NO: 11461 - RNA, 64 nt, Human
gcgugccugcgauggcguucauguccgucucgcucaucaucaccgacauguccuucuuaucugg

SEQ ID NO: 11462 - RNA, 64 nt, Human
cagguccccuggcccuuccuucacccaccacccccaucaucaccgauucuuccuugccacaauc

SEQ ID NO: 11463 - RNA, 64 nt, Human
gugacaggucccagagccaaagccggcccucaagcaucaucagggagugguguagucaguugaa

SEQ ID NO: 11464 - RNA, 64 nt, Human
uuuucuugagcuaaagacaggcuuuuuccaccggcaucaucacugcuaucaucauuaacagcgu

SEQ ID NO: 11465 - RNA, 64 nt, Human
uggccccaccccaccauucccucuaggcccagaccaucaucauggcccuggccauugaugugua

SEQ ID NO: 11466 - RNA, 64 nt, Human
cuacagugggguacaguagcuggcuauucacaggcaucaucauagcccacuagucucauauuau

SEQ ID NO: 11467 - RNA, 64 nt, Human
guuaucuaaugauguucucugacccagcagaaaucaucaucaugaugaugauaauuuauuaacu

SEQ ID NO: 11468 - RNA, 64 nt, Human
caucugugugacuaaugguuuauuuguauuauaucaucaucaucauccuaaaauuaacaaccca

SEQ ID NO: 11469 - RNA, 64 nt, Human
cugugugacuaaugguuuauuuguauuauaucaucaucaucauccuaaaauuaacaacccagaa

SEQ ID NO: 11470 - RNA, 64 nt, Human
acagcuucccuuuaugcugagccccugccacaugcaucaucauccuggccauguggcauuguca

SEQ ID NO: 11471 - RNA, 64 nt, Human
guaaaaauuguacaguacuuauguucccaaguagcaucaucaucuucuggguaguaauuacauu

SEQ ID NO: 11472 - RNA, 64 nt, Human
aagaaucacuggcuucuaugcgcuucuuuucucucaucaucauguucuuuuaccccaguuuccu

SEQ ID NO: 11473 - RNA, 64 nt, Human
aaccacgaccaccaccaccaccaccacucaccaccaucaucaccuccggaaaguguaguccugc

SEQ ID NO: 11474 - RNA, 64 nt, Human
acgauucuuggaaauaugucuuccaagugccauccaucaucaguaggacaagugucgggaguuu

SEQ ID NO: 11475 - RNA, 64 nt, Human
ucucugaggaugguucuacaguugggauuuuggccaucaucaaccaagaagagaaauucauuua

SEQ ID NO: 11476 - RNA, 64 nt, Human
aggcuguccccagcggugacgggagguguccuggcugcuccaggacaaaagacaaucgucucug

SEQ ID NO: 11477 - RNA, 64 nt, Human
ggggccugaccacagauuccucucccauccuuuucugcuccaaccugccccacugggucccggc

SEQ ID NO: 11478 - RNA, 64 nt, Human
ucucagauaaaaagcaguuuuauaaacccgcaaucugcuccagauucaagcaguaauauuucag

SEQ ID NO: 11479 - RNA, 64 nt, Human
caaauauucguguuuuauaaauagcucucauagucugcuccaucuugauaguuaagugauuucu

SEQ ID NO: 11480 - RNA, 64 nt, Human
ucugggucccuugcccugcaguuuccagggggcucugcuccaaguucccuagcgggccccucag

SEQ ID NO: 11481 - RNA, 64 nt, Human
gggcugggugggagaugggagggccaacugcgagcugcuccacuucucagcucuccccugcccu

SEQ ID NO: 11482 - RNA, 64 nt, Human
ucuccuccccucugcccccggcucuuagcuccagcugcuccagguaguugguucauccuucccc

SEQ ID NO: 11483 - RNA, 64 nt, Human
ccccaccuccccacugugguuagucagaggcauccugcuccaagcucugcuuuuccuuccucug

SEQ ID NO: 11484 - RNA, 64 nt, Human
gaaucccucugucuggaguaguccuugccucuuccugcuccaguagggccuuuucccuacccca

SEQ ID NO: 11485 - RNA, 64 nt, Human
cuaagcacccccaagccacuauccacuuugaauccugcuccauacauuggguguauauuuauuc

SEQ ID NO: 11486 - RNA, 64 nt, Human
caaugucacuugggccagaauggaccugcccuuucugcuccagacuuggggcuagauagggacc

SEQ ID NO: 11487 - RNA, 64 nt, Human
caaccagcacagccugccccaauucccccagccccugcuccagcagcugucaucucugggugcc

SEQ ID NO: 11488 - RNA, 64 nt, Human
cccagacgggguugcuccugguccaagaggcuaccugcuccaaggcggagggugggagcaggug

SEQ ID NO: 11489 - RNA, 64 nt, Human
aggggaggauggggacaaggaaaggaucagauaccugcuccaguaguugugaggccacuguguc

SEQ ID NO: 11490 - RNA, 64 nt, Human
cagcuucagagauuccuuaaaccuuccuaauuuccugcuccagggcaguaaacacaaauauuuc

SEQ ID NO: 11491 - RNA, 64 nt, Human
ugcccugaggaugggcuuccuuguccuguggccucugcuccaggggcaguguccuuucccugug

SEQ ID NO: 11492 - RNA, 64 nt, Human
guguguaagaugggcuauuuguucuuuggaaugacugcuccacuccacacucacaccucuauuc

SEQ ID NO: 11493 - RNA, 64 nt, Human
cuugcggaagguucuacgccaggggaaaaucagccugcuccagcuguucagcugguugagguuu

SEQ ID NO: 11494 - RNA, 64 nt, Human
cccacagccccuugcuucuaagggauccagagaccugcuccagauccucuuuccccacugaaga

SEQ ID NO: 11495 - RNA, 64 nt, Human
aauucaaggaggaaagaagaagaaauaaaagaagcugcuccauuuuucaucaucuacccaucua

SEQ ID NO: 11496 - RNA, 64 nt, Human
ggugugagagcccagggggaggacagcuugucugcugcuccaaaucacuuagaucugauuccug

SEQ ID NO: 11497 - RNA, 64 nt, Human
aacuauuuauuuugugauuguuuuccuuguuaaucugcuccaaccaccugaacaucuaaguaaa

SEQ ID NO: 11498 - RNA, 64 nt, Human
ggaagaagaacaggaagaaaaaaaguacucugaacugcuccaaguaacgcuaauuaaaaacuug

SEQ ID NO: 11499 - RNA, 64 nt, Human
guucccuuccaaaaugcacaaaucauacccuugucugcuccaauucagucuccaaaccuggugc

SEQ ID NO: 11500 - RNA, 64 nt, Human
gcuugccgaaaccagcaugaugcuucaaagagcccugcuccaccccucauggcauggauccuuu

SEQ ID NO: 11501 - RNA, 64 nt, Human
aaacagcaaacaguggggugaucugcagcccagagaccuucaaaugcgaacacuauaaacucca

SEQ ID NO: 11502 - RNA, 64 nt, Human
aacaagucccaugucugguucugugucuaaaggccugcuccaugacacaggaugcuacaugcac

SEQ ID NO: 11503 - RNA, 64 nt, Human
accacagguaaauccuuguuagcaaggaaucugucugcuccagucuacuccuaguuugauccuu

SEQ ID NO: 11504 - RNA, 64 nt, Human
ggcuggaccaccaccaucugcccuggcagccuggcugcuccagcuccugacagcaccugugucu

SEQ ID NO: 11505 - RNA, 64 nt, Human
agcugcugccccuggguccgguggacggccgcuccugcuccauggacucugccuacggcacccu

SEQ ID NO: 11506 - RNA, 64 nt, Human
cuccuagccugugcucugccagcagcacagacaucugcuccaucagaccucuuccauuuugcac

SEQ ID NO: 11507 - RNA, 64 nt, Human
cucucccugagugaggccagguguuggcagccaacugcuccaaucugccuccuuccccuaaaua

SEQ ID NO: 11508 - RNA, 64 nt, Human
cccucggaggcuguauaguccuccuuagagaggccugcuccagcuguucauaccacaucagugu

SEQ ID NO: 11509 - RNA, 64 nt, Human
caaugggaacccugcuucccaggggaggaaccaacugcuccaccuucuagggacccaguuuguu

SEQ ID NO: 11510 - RNA, 64 nt, Human
agaaggaaggauguccccagcccaggaggucuuucugcuccaucguccccaaggaauaaguuug

SEQ ID NO: 11511 - RNA, 64 nt, Human
aggagcgagcaugugacagucccuggacaaccuccugcuccauccacuacaagaaggaaggaug

SEQ ID NO: 11512 - RNA, 64 nt, Human
cuuccaccacugagucaucugcugucucuucagucugcuccauccaucacccauuuacccaucu

SEQ ID NO: 11513 - RNA, 64 nt, Human
gaacuggggucauucggucugugaucucguugcacugcuccaagucuggcuguguccaggcggu

SEQ ID NO: 11514 - RNA, 64 nt, Human
ccuguugcccugggaaagggcaaccucccuuucacugcuccaguggcagccauggggaaggcag

SEQ ID NO: 11515 - RNA, 64 nt, Human
uccugugccccacugcugcccucugcagagccaucugcuccaggcacccaccugccucugcuug

SEQ ID NO: 11516 - RNA, 64 nt, Human
ugggcagggagugauagccaaacuccuuggucaccugcuccaagaaggaagcaguagcugagca

SEQ ID NO: 11517 - RNA, 64 nt, Human
gcuccaguggccuugauuuuaggccaggaaucuucugcuccauguggcuuaagccuuccagcug

SEQ ID NO: 11518 - RNA, 64 nt, Human
auccugccauuaaggcuaugugcagucugcccuccugcuccaguggccuugauuuuaggccagg

SEQ ID NO: 11519 - RNA, 64 nt, Human
agacuuaauuacuaacuccaaggggaggguuccccugcuccaacaccccguuccugaguuaaaa

SEQ ID NO: 11520 - RNA, 64 nt, Human
uggacagacucagacccccagcaugguuagcgcugaccuucauugaggucccuuuggaaccaga

SEQ ID NO: 11521 - RNA, 64 nt, Human
auuccuauuauaagagcauauuuuagguaccuaucugcuccaauuauauuuuuaacauuuaaaa

SEQ ID NO: 11522 - RNA, 64 nt, Human
auucagucuguucauaaaacauggacugaugggucugcuccaggccacauuuguuuuuuaacag

SEQ ID NO: 11523 - RNA, 64 nt, Human
cccugcccaacccggacugcugcccguccucucccugcuccaggccacuaggccucccuugcag

SEQ ID NO: 11524 - RNA, 64 nt, Human
gcuuggcaguuauaccccaugcagucauaggagacugcuccaucauucucagcacauagggugc

SEQ ID NO: 11525 - RNA, 64 nt, Human
ccuuuggucaaagagaaagaacucuaauguccagcugcuccaucgauauacucauagaauggaa

SEQ ID NO: 11526 - RNA, 64 nt, Human
guggaccacagcguaccugccccuuucugcccuccugcuccagccccacuucugaaaguaucag

SEQ ID NO: 11527 - RNA, 64 nt, Human
aggucugaguuucugcugcagauagugguguuaacugcuccaacucuugucuugcuuaguuucu

SEQ ID NO: 11528 - RNA, 64 nt, Human
aaaaaaaaacucuugucuccuuaggauauguuaccugcuccacugcagacuagagaaauaaaug

SEQ ID NO: 11529 - RNA, 53 nt, Human
agccccccugcucccaguagccucugcuccagggggugcgcuggcugucgggg

SEQ ID NO: 11530 - RNA, 64 nt, Human
caugaccuugggcaagcuauguaaccccaauugccugcuccauuaaagacugugaagguagaau

SEQ ID NO: 11531 - RNA, 64 nt, Human
ugugccugguguguguuuacaaagggagaguuggcugcuccagcuccacagcccugggacccca

SEQ ID NO: 11532 - RNA, 64 nt, Human
gcugaucuccccuaacagucugacugaugagaugcugcuccaagccugugaggggcgaacagca

SEQ ID NO: 11533 - RNA, 64 nt, Human
uauaaccucccacccugcaaagggaaucucuugccugcuccaucucauaggcuaagucagcuga

SEQ ID NO: 11534 - RNA, 64 nt, Human
ucugggccuuuguuccccuauaugcauugcaggccugcuccacccuccucagcgccugagaaug

SEQ ID NO: 11535 - RNA, 64 nt, Human
ggcuuucugcccugagggacaucuucccacuccccugcuccacaugagccaugcaugcuuagca

SEQ ID NO: 11536 - RNA, 64 nt, Human
guggaccaacuucaaagcucuggacaggagacaccugcuccaggccccugugaucccaguucug

SEQ ID NO: 11537 - RNA, 64 nt, Human
gaccuuacccggcugaugguuagccccuugcugccugcuccaugugucuuaugagagcccguag

SEQ ID NO: 11538 - RNA, 64 nt, Human
uuacaguguggcccggagcgucuuggcugccgcccugcuccacgcagucugcuucagugcagug

SEQ ID NO: 11539 - RNA, 64 nt, Human
acccuagguaugcugcugagcccugccccccguccugcuccagccugcccguguguaaccugua

SEQ ID NO: 11540 - RNA, 64 nt, Human
ggcuuaaugccaguuacgacgcugccuuuccggccugcuccagcaaguagcuacugguucacgu

SEQ ID NO: 11541 - RNA, 64 nt, Human
uggcugacugcacagcuuccccgugccucccucccugcuccacucccacauuauaguccuuucc

SEQ ID NO: 11542 - RNA, 64 nt, Human
uagaauguucuuggaagcuccauugauuuaguagcugcuccaucaucuagcuugugaaaccauu

SEQ ID NO: 11543 - RNA, 64 nt, Human
cugcugggagcaacuaacuaguuauuaugcacaucugcuccagacccagcucuuuaacuucaug

SEQ ID NO: 11544 - RNA, 64 nt, Human
gaaaaacggacauuuggcuaggugucucucacggcugcuccauccuagcccccacaagcugggg

SEQ ID NO: 11545 - RNA, 64 nt, Human
guguggcccccaggagaguagcugccuguugcaccugcuccacaccuccccacagccucccugc

SEQ ID NO: 11546 - RNA, 64 nt, Human
gcacucccugcugccuuggaaaaagcacgggguccugcuccagggaauggugaaaugacuggau

SEQ ID NO: 11547 - RNA, 64 nt, Human
ugugaagccagcaccaccucagagacacuguucccugcuccaggguagaccugagaugaaccuc

SEQ ID NO: 11548 - RNA, 64 nt, Human
ccgguggugggaggauggagggauugggcugaagcugcuccaccucauccuugcugaguggggg

SEQ ID NO: 11549 - RNA, 64 nt, Human
aagaacacaucuccuuuucaaccccauuccuuaucugcuccaaccuggacucauuuagaucgug

SEQ ID NO: 11550 - RNA, 64 nt, Human
uugggguuucgcccuaucccacucccucucuuuccugcuccauugguuccuuaagaaaugcuau

SEQ ID NO: 11551 - RNA, 64 nt, Human
uccgcaggcaguuaccaaguacggcuggcuacaacugcuccauccgugccucuuuuuaaaguuc

SEQ ID NO: 11552 - RNA, 64 nt, Human
aucccauacaggcucuuaccucuucuccugagggcugcuccagacaacauuuauuacccagaag

SEQ ID NO: 11553 - RNA, 64 nt, Human
agcacagacagacucucaccucuucuccugaggucugcuccagacaacauuuauuacucacaag

SEQ ID NO: 11554 - RNA, 64 nt, Human
gugccuauguggcugugcuaugguuucuaugagucugcuccauccaugugucuguuuggggguc

SEQ ID NO: 11555 - RNA, 64 nt, Human
cgcucuggcccuggcccuggccguccugugugaucugcuccagcagugggaccaguuggccccu

SEQ ID NO: 11556 - RNA, 64 nt, Human
ugcuaaccuucugcucuggacuggacucacuuuucugcuccagggacuccuuuucuggguuugg

SEQ ID NO: 11557 - RNA, 64 nt, Human
cauuuugauaaaauggcaacaaaaugcagacacccugcuccagguauuauuucagguuuaguac

SEQ ID NO: 11558 - RNA, 64 nt, Human
aacccugucacuaagcagcacgugacacuggcaggaccuucaucuccagcaucccaccccuggg

SEQ ID NO: 11559 - RNA, 64 nt, Human
ucgucucccggccccucgcugggggagaaagcaucugcuccaaggagggagggagcgcagggaa

SEQ ID NO: 11560 - RNA, 64 nt, Human
ugucuaccggacuggccagggcccaagacccccgcugcuccacugcggggcugggcgggcugac

SEQ ID NO: 11561 - RNA, 64 nt, Human
cacccaagacugucaagggaugagcaucccaaaccugcuccacagagguagcugcguccugaaa

SEQ ID NO: 11562 - RNA, 64 nt, Human
agucacuuaaaaugucccagugucaguauuuacucugcuccaaaguagaacucuuaaauacuuu

SEQ ID NO: 11563 - RNA, 64 nt, Human
gcucaguugugguuuuuuagguggagagacacaccugcuccaauuuccccaccccccucucuuu

SEQ ID NO: 11564 - RNA, 62 nt, Human
aguggaucuggcugaagugaacgggccgccuucugcuccagcugcaucacagugauggccaa

SEQ ID NO: 11565 - RNA, 64 nt, Human
cgcuccuccaggccuggccgugcccgcucaggaccugcuccacuguuuaacacuaaaccaaggu

SEQ ID NO: 11566 - RNA, 64 nt, Human
caggggcugcuggcgagcucuuucucuuuagggacugcuccauaccccaugauggagcacacgg

SEQ ID NO: 11567 - RNA, 64 nt, Human
cggccccgacccccgcgccgcgccccugcucgcccugcuccacgcugccccgcgcccgcugcug

SEQ ID NO: 11568 - RNA, 64 nt, Human
gcccggcagcuacgugggggccugcuucgacaggcugcuccacccggacgccguacccgcccuu

SEQ ID NO: 11569 - RNA, 64 nt, Human
ucggacuuugcaggaguuccuuucccuccgaacgcugcuccaugcacaggaaaagggcauuuug

SEQ ID NO: 11570 - RNA, 64 nt, Human
guguuacaccgugcgcuccaaaguaccacaaagccugcuccacaccuggauggguaagaguuac

SEQ ID NO: 11571 - RNA, 64 nt, Human
cuucccggggagcacaguagugcgggccugggcccugcuccaccuccagaaguggcuggaugua

SEQ ID NO: 11572 - RNA, 64 nt, Human
gacucugagcugccccuggcuuccuuuaaggaggcugcuccagaaggaaccuggguggggaggg

SEQ ID NO: 11573 - RNA, 64 nt, Human
ggggaggagggguuccugagggaccugacuuccccugcuccaggccucuugcuaagccuucucc

SEQ ID NO: 11574 - RNA, 64 nt, Human
auccuccuugucgcuugaaaccuucccacacucccugcuccaggagggaaaaacagauguuguu

SEQ ID NO: 11575 - RNA, 64 nt, Human
cuucugagcccgucucccggacagguugaggaagcugcuccagaagcgccucggaaggggagcu

SEQ ID NO: 11576 - RNA, 64 nt, Human
uuaaaauucucauuuucuuucuuuuuuuuccccccugcuccacacuucaaaacucccguuagau

SEQ ID NO: 11577 - RNA, 64 nt, Human
agcaguugcuaguccauucuccauucuggagaaucugcuccaaaaagcuggccacaucucugag

SEQ ID NO: 11578 - RNA, 64 nt, Human
aagaaugcaugcccagucagaaaucuguucuauucugcuccaggaaaaucggaaaccugugagu

SEQ ID NO: 11579 - RNA, 64 nt, Human
gguuugucacuccaccucauugagccugacuguucugcuccauaaaauaggguaauaaagguca

SEQ ID NO: 11580 - RNA, 64 nt, Human
cagagcccucaacuauucuguuccacacccaaugcugcuccacccucccccagacacagcccag

SEQ ID NO: 11581 - RNA, 64 nt, Human
uggcaucugaauguuccagcagccuaacugugcucugcuccagaaacauguguguggcuucccu

SEQ ID NO: 11582 - RNA, 64 nt, Human
gcucuugucccucacugccccaguaagcuggaggcugcuccagaacucagcaguguuggagggg

SEQ ID NO: 11583 - RNA, 64 nt, Human
accugucacauaaagcauuuuuuuaaaaagucagcugcuccaaaaucaucaacucagccccugg

SEQ ID NO: 11584 - RNA, 64 nt, Human
aggcaugcugagcaugggcacagacagcccaucccugcuccaugcugucugugagcaggcccca

SEQ ID NO: 11585 - RNA, 64 nt, Human
ucagugcaguugggcugggcugaccuacuaaaaccugcuccauguauggaccuggaaggccauu

SEQ ID NO: 11586 - RNA, 64 nt, Human
cugggccuuagugggccagggcugcccugagaagcugcuccaggccugcagcaggaguggugca

SEQ ID NO: 11587 - RNA, 64 nt, Human
gcuccuagguuuuccuuccaagcacccagcccuccugcuccaagagggauaaccugcaccccuc

SEQ ID NO: 11588 - RNA, 64 nt, Human
uauuuuuuaaacaaugugaucucaaauuuaaagacugcuccagauagccugcauuugcaaugga

SEQ ID NO: 11589 - RNA, 64 nt, Human
uaaggaagaaagaaaacaugccaagcugagcaugcugcuccaaauaaauaucugcuuuccuacu

SEQ ID NO: 11590 - RNA, 64 nt, Human
caggccucaucugaccccacccugggccacugcccugcuccagagaguggaccuugacucuucc

SEQ ID NO: 11591 - RNA, 64 nt, Human
caacaucaucauugccugcugaugugccacgaugcugcuccaauagacagcaauaagauugucu

SEQ ID NO: 11592 - RNA, 64 nt, Human
acaaaucagcuuauauuuuuuaucuugaugacuccugcuccagaaucgcuagacuaagaauuag

SEQ ID NO: 11593 - RNA, 64 nt, Human
guuacauccccaaggugaggggguggagucuggucugcuccacuaaccagggucuccuccuccu

SEQ ID NO: 11594 - RNA, 64 nt, Human
ugccgugaggcucauaguugaugagggacuuucccugcuccaccgucacucccccaacucugcc

SEQ ID NO: 11595 - RNA, 64 nt, Human
cuggccacugggcuuggaugcuucgggcuucugacugcuccauagguuuugacuggugaaacag

SEQ ID NO: 11596 - RNA, 64 nt, Human
cucucgcuaucugcggguccuguccuuuucucaagaccuucaccauuacuggcauuuuccuguc

SEQ ID NO: 11597 - RNA, 64 nt, Human
ugccuaggagcuggcuggcagguguugggaccugcugcuccauggaugcaugcccuaagagugu

SEQ ID NO: 11598 - RNA, 64 nt, Human
ggcaccgccagccgccuucccuuuaacccucacacugcuccaguuucaccucuuugcucccuga

SEQ ID NO: 11599 - RNA, 64 nt, Human
ccccgaggccccccucugccuuugagcuucuccucugcuccaacagacacccuccacucugagg

SEQ ID NO: 11600 - RNA, 64 nt, Human
acuuccauuuggcccauuauuuguaacuguguaacugcuccaagugccagaaugcuuacacguu

SEQ ID NO: 11601 - RNA, 64 nt, Human
uuuugcuucucuugaaacuguugcccagucacuucugcuccaauucucuuccucucuaaauagu

SEQ ID NO: 11602 - RNA, 64 nt, Human
acaaacuggaaugaaagaauaguuugauucagaccugcuccacuauguguugcuaaaacacaug

SEQ ID NO: 11603 - RNA, 64 nt, Human
gcuucauuguuguauuguuaauaauuguuacuuacugcuccaggcauuuuauuaaauuaauuuu

SEQ ID NO: 11604 - RNA, 64 nt, Human
gcuacucuaaauuaugucuccuuauaaguuauugcugcuccaggagauuguccuucaucgucca

SEQ ID NO: 11605 - RNA, 64 nt, Human
auuugaaacgugaaggauuggguuuucaggcccucugcuccaccccuccugugugucagagcua

SEQ ID NO: 11606 - RNA, 64 nt, Human
ucugcuuuucauccuucaucuggauuccagagcacugcuccaguggggccaugauugguuucua

SEQ ID NO: 11607 - RNA, 64 nt, Human
uccacaaucguuaguaacuguauaaaaacucaugcugcuccaccagugggccuuggaaaaugca

SEQ ID NO: 11608 - RNA, 64 nt, Human
cuacaagcuaacucccugcaucugggcaucaggacugcuccauacauuugcugaaaacuucuug

SEQ ID NO: 11609 - RNA, 64 nt, Human
ggacuccagcacguuuucuggcuucugcuucauccugcuccaucggggaaugacacacugcggu

SEQ ID NO: 11610 - RNA, 64 nt, Human
gaucucagcucccguuccccaagcacacuccuagcugcuccagucucagccugggcagcuuccc

SEQ ID NO: 11611 - RNA, 64 nt, Human
ugcuagucccggcauccugauggcuccgacaggccugcuccagagcacggcugaccauuucugc

SEQ ID NO: 11612 - RNA, 64 nt, Human
ggagagaucuugaaagagguaaaauaaaccuucacugcuccacuccaggugaauccgcccacuc

SEQ ID NO: 11613 - RNA, 64 nt, Human
gcaaguaacuucugacuuacugucaguuguacuucugcuccauagacaucaguauucugccauc

SEQ ID NO: 11614 - RNA, 64 nt, Human
gccucugugucugagaaaguaucuuaguuguuggcugcuccagagguaucuuugucaaaagcuu

SEQ ID NO: 11615 - RNA, 64 nt, Human
auauguuucacccugucccucuaauaaagcuccucugcuccaccuugaaccugucaccuggccu

SEQ ID NO: 11616 - RNA, 64 nt, Human
gacuucugccugaaccuggggucaucgauucaaacugcuccaaguggugggaaucagaucuguc

SEQ ID NO: 11617 - RNA, 64 nt, Human
gaugaagccucaggaggggccucagacccagccccugcuccacacugugccaguagccuaggug

SEQ ID NO: 11618 - RNA, 64 nt, Human
uaagcacaaagcccauagcacugggcucugauggcugcuccacuggguuacagaaucacagccc

SEQ ID NO: 11619 - RNA, 64 nt, Human
uuuagucuggguccaugucccagaccccucuauucugcuccaggacagcaggacuucaggucuu

SEQ ID NO: 11620 - RNA, 64 nt, Human
ccagcuggcaggguugcccaccccugcuguccaccugcuccauccucuaggguuccacaggccc

SEQ ID NO: 11621 - RNA, 64 nt, Human
caggccugaggacaugccucccaccaaauguccccugcuccagucccacuccugucaccccacg

SEQ ID NO: 11622 - RNA, 64 nt, Human
ugugccugcuggguaggggcacgucugaggggcccugcuccaagccugcaggaccgagggccac

SEQ ID NO: 11623 - RNA, 64 nt, Human
aaaaucugugccaucauggugauuuuauccaagacugcuccacuuaccccagugcuggggacaa

SEQ ID NO: 11624 - RNA, 64 nt, Human
uuuucugugcugccagccccaggucuuccuccgccugcuccacaccacucgccgcugucccucu

SEQ ID NO: 11625 - RNA, 64 nt, Human
ggaagagaccguccgccagaucugcaggcuguuucugcuccaacacugcuugcuugugagcauc

SEQ ID NO: 11626 - RNA, 64 nt, Human
ucaugcuuuagaagccuacagcaacauucugagacugcuccaacaugcuugaagaucuaagcuu

SEQ ID NO: 11627 - RNA, 64 nt, Human
gccugauuagaugacucucaguccccauggcacccugcuccauguuaccuagagcaggcacuug

SEQ ID NO: 11628 - RNA, 64 nt, Human
ccaugggggaagaagguaugguuuugagaugaaacugcuccaccucagaccaucaggcauuagu

SEQ ID NO: 11629 - RNA, 64 nt, Human
ggaagaaucuuuuuaaagugacccaccuuucaugcugcuccagcauuguccugcuugugcugau

SEQ ID NO: 11630 - RNA, 64 nt, Human
cucuuuucuugaugccuuccggcugaaacccucucugcuccauaugcccuaaacuuaucuggga

SEQ ID NO: 11631 - RNA, 64 nt, Human
auuucacuaccugcuagagccuacugugaaaucacugcuccauauuugccaguggaggaaaugg

SEQ ID NO: 11632 - RNA, 64 nt, Human
ucagucgagcacucacugugucuuugucaagugucugcuccacgucaggcacugugcuuugcac

SEQ ID NO: 11633 - RNA, 64 nt, Human
gauuccucagcacacgaggcuuccacaacccagucugcuccauagcacucuggcccacccuguc

SEQ ID NO: 11634 - RNA, 64 nt, Human
uaucuccggcucccaagugacuggauuugccuaggaccuucagaccaacagacuucagacccuc

SEQ ID NO: 11635 - RNA, 64 nt, Human
uugguggguucaccccaacucacagcaguagaaacugcuccaucuuccaccacuuauuggguuu

SEQ ID NO: 11636 - RNA, 64 nt, Human
uccuucagccuuaaauacaaaaauaaaacugaaacugcuccagaaagcagcuuucuccaaaaau

SEQ ID NO: 11637 - RNA, 64 nt, Human
accucauccucuggcauggacgcagucagggagucugcuccaagcagacacugguggucccgcu

SEQ ID NO: 11638 - RNA, 64 nt, Human
ccgaugcugaggccacccacugacccaacugauccugcuccagcagcacaccucagccccacug

SEQ ID NO: 11639 - RNA, 64 nt, Human
cuuucucugucucaccuucauccacucugcaggccugcuccaccacagcccuaauccucuggac

SEQ ID NO: 11640 - RNA, 64 nt, Human
auuugaacuaaugguauaacuccuaaagcuuucucugcuccaguuauuuuuauuaaauauuuuu

SEQ ID NO: 11641 - RNA, 64 nt, Human
ggucuucccagaaggguaaaacucccagccuacccugcuccagcuucagcccagguaguuggug

SEQ ID NO: 11642 - RNA, 64 nt, Human
uaacgugggagcugaucccacgggcaggcucucccugcuccaggagaagacuaggaggaagaau

SEQ ID NO: 11643 - RNA, 64 nt, Human
guucaucccgccccugcuccauguccuuguguggcugcuccagcgagagcugguaacuagguag

SEQ ID NO: 11644 - RNA, 64 nt, Human
augggagauuaucagucuaguguucaucccgccccugcuccauguccuuguguggcugcuccag

SEQ ID NO: 11645 - RNA, 64 nt, Human
ugccccucaucaucacaguuuaacacaagcuccccugcuccagccaaauugaucucccagucuu

SEQ ID NO: 11646 - RNA, 64 nt, Human
ccuuccuuucccucugauggguacacugaagccccugcuccacagaguagauugcacauggagg

SEQ ID NO: 11647 - RNA, 64 nt, Human
cucgacaaaggccacaggcaguccaggccucucucugcuccaucccccugccucccauucugca

SEQ ID NO: 11648 - RNA, 64 nt, Human
gcuguaggccacuaggcgcaggggcaucucuccccugcuccagcgcaucucccgggcuggccac

SEQ ID NO: 11649 - RNA, 64 nt, Human
ugcuuccagcugagaugauuugagucugcccuaacugcuccauugaguucucgugcccucauca

SEQ ID NO: 11650 - RNA, 64 nt, Human
cagagaggaauaaaaagacauuuuauauuuuauucugcuccauucccuucacuguauaccuuaa

SEQ ID NO: 11651 - RNA, 64 nt, Human
gaaaacaagaaaggguaugaucaaucauuuucuucugcuccaaacagcuggaguaaaauucaug

SEQ ID NO: 11652 - RNA, 64 nt, Human
agaacguuuaauacuucauuacaucaaaucaacacugcuccauggugagagcacagcaacucau

SEQ ID NO: 11653 - RNA, 64 nt, Human
uccuccaagccccuguacauaaccuggagcgugugaccuucagagcuuuucacuuuaugcaaaa

SEQ ID NO: 11654 - RNA, 64 nt, Human
uucaguagaccaucugggcagcuuucccauggugcugcuccaaccaucagauaaaugacccucc

SEQ ID NO: 11655 - RNA, 64 nt, Human
ugggaccuaagagccagaggcuguguagaggcuccugcuccaccugccagucucguaagagaug

SEQ ID NO: 11656 - RNA, 64 nt, Human
uuccuucccuggaguguagaccugugugugggaccugcuccaggcugaucccuguccgcacagg

SEQ ID NO: 11657 - RNA, 64 nt, Human
agaguagguccccuccauggcccugaauccuccucugcuccagggcuggccucugcagagcuga

SEQ ID NO: 11658 - RNA, 64 nt, Human
augcagcccucccacuucacucucucugucucuccugcuccaacauggccagacgugccugcuu

SEQ ID NO: 11659 - RNA, 64 nt, Human
uucuuuccuuuuacuacuaccaguugcucccaugcugcuccaccaggcccuguuucggaugcca

SEQ ID NO: 11660 - RNA, 64 nt, Human
ucugcccugccagcugcagccugguuggcagcaucugcuccaucggggcaggggguaugcagag

SEQ ID NO: 11661 - RNA, 64 nt, Human
uguggagggcgccaucuaugguguggaugggaaacugcuccagcuccaagagguuuuucagcuc

SEQ ID NO: 11662 - RNA, 64 nt, Human
aaccaaaggaggugaugggaggcuuuucaagacgcugcuccaaacucaucaacuccugugagua

SEQ ID NO: 11663 - RNA, 64 nt, Human
ucugcccuuccaacgcaucacccgccucaaacugcugcuccagaacauucugaagagaacacag

SEQ ID NO: 11664 - RNA, 64 nt, Human
guugcucuguaggauaaucacacuuagaaaacaucugcuccaugacauucacaauaccagggac

SEQ ID NO: 11665 - RNA, 64 nt, Human
agcgcccaaaggauuccccuucacguuggugcaccugcuccauagcuccgggcgcugcgucccg

SEQ ID NO: 11666 - RNA, 64 nt, Human
gagcccugggcacagcagcggccgaggggauguccugcuccaauacccgcacugcucuggaguu

SEQ ID NO: 11667 - RNA, 64 nt, Human
caguuauccuggccccaugaccguggccacagcccugcuccagcagcacuugcccauuccuuac

SEQ ID NO: 11668 - RNA, 64 nt, Human
aagauggggcaaacagcccccaggcacuugcucccugcuccauacuuaagguuugugaugccaa

SEQ ID NO: 11669 - RNA, 64 nt, Human
guccugggagguggucgcccugcagugcaagcugcugcuccagagcguaccguggcccagacug

SEQ ID NO: 11670 - RNA, 64 nt, Human
uggcagggaggcagucgcccugcggugcaagcugcugcuccagagcauaccguggcccaggugg

SEQ ID NO: 11671 - RNA, 64 nt, Human
guagaaucgugguaauauuggcuguuaaauuggccugcuccagagacuggcucaaaaaagaaag

SEQ ID NO: 11672 - RNA, 64 nt, Human
ccuuuuaagcuacaguuccuucucuccauccuucgaccuucacaaaaucucugggacuguucuu

SEQ ID NO: 11673 - RNA, 64 nt, Human
gcggcccagccgggggauaacgcagggcggucuucugcuccaugcucuuccucgggucaaagcg

SEQ ID NO: 11674 - RNA, 64 nt, Human
acaagcauauuuuguggcauuugaacuauauuuacugcuccaauauccguuauuuuccaaagga

SEQ ID NO: 11675 - RNA, 64 nt, Human
uuggacaccccccaccauggugggcuugugguggcugcuccaugagggugggggugauacuacu

SEQ ID NO: 11676 - RNA, 64 nt, Human
ccaagauucaucugugaccuccaggcagcagucucugcuccagaaucucuggacggagcugcug

SEQ ID NO: 11677 - RNA, 64 nt, Human
aggcacaaaaccccaggcuucaagucucugcagccugcuccacauuugggcacagaaggacuca

SEQ ID NO: 11678 - RNA, 64 nt, Human
ucauuggugguagccaucaagcacuucccaggaucugcuccaacagaauauugcuagguuuugc

SEQ ID NO: 11679 - RNA, 64 nt, Human
uuguuauuaccaaaacaggaggggaaaaaauuaacugcuccaaauuuaaccauaaaucaauuca

SEQ ID NO: 11680 - RNA, 64 nt, Human
caccccuuucccuuccucucuauuuauaaggucccugcuccacccgaccccaccugcggugccu

SEQ ID NO: 11681 - RNA, 64 nt, Human
cuuuguagccuauguugcauguagcggacuuuaacugcuccaaggaguugugcaaacuuuucau

SEQ ID NO: 11682 - RNA, 64 nt, Human
agcaagugugcuuccgucaagauaccauauucuccugcuccaguauaacagcuugcaggcaaua

SEQ ID NO: 11683 - RNA, 64 nt, Human
cccugcgccugccucaggucuuucuugcugcagccugcuccagccuggcccccaccccaggggc

SEQ ID NO: 11684 - RNA, 64 nt, Human
uuuaaagauucaaaggauguucguauaaauggcacugcuccauccucccccuaugcauugguuu

SEQ ID NO: 11685 - RNA, 64 nt, Human
gaggguugcuaguagguucugcuucugcuucucucugcuccacugucugcagcccagauccugu

SEQ ID NO: 11686 - RNA, 64 nt, Human
agcaugaacgccaaggaauguacguugagaaucacugcuccaggccugcauuacuccuucagcu

SEQ ID NO: 11687 - RNA, 64 nt, Human
ggagagacacuccaucagguccccuuugccuuuccugcuccaccauucucaccaugcagggugg

SEQ ID NO: 11688 - RNA, 50 nt, Human
ugcggaagaagaggccauagcugcuccagccggggcuccggggcggcagc

SEQ ID NO: 11689 - RNA, 64 nt, Human
cugagaacaagcggagggccgggcccugggaccccugcuccagcccgaaugacggcaucuguuu

SEQ ID NO: 11690 - RNA, 64 nt, Human
ggaggaggacggcgccugugcccacggcugcugccugcuccagacauuuuguucuugaaucugu

SEQ ID NO: 11691 - RNA, 64 nt, Human
auugagaccagaccccaagucccccacccccauccugcuccagcguuuccucuaacagggacca

SEQ ID NO: 11692 - RNA, 64 nt, Human
uuguuuugcagggauagcugggaguauggccacccugcuccacgaugcgguaaugaauccagca

SEQ ID NO: 11693 - RNA, 64 nt, Human
agugcucugaaucguaccuggauucugugccuaccugcuccaucuaaagcagaaaacuccacaa

SEQ ID NO: 11694 - RNA, 64 nt, Human
agcuggaguagccuccugaccagccuggcccacccugcuccacccacugggcccccccaguuau

SEQ ID NO: 11695 - RNA, 64 nt, Human
agccaagaacguucccaggcagaacuccgcuccccugcuccaaacugcucuccuagggaauggg

SEQ ID NO: 11696 - RNA, 64 nt, Human
ccccaggccaucccaaacccaguggcagaggaagcugcuccaauggaugggggagaagccuggg

SEQ ID NO: 11697 - RNA, 64 nt, Human
agccagaagaaauugaggauguuuccuuucacagcugcuccaagccuguugcccaauucacggu

SEQ ID NO: 11698 - RNA, 64 nt, Human
aauuaguuuggguucucuacaugcauaacaaacccugcuccaaucugucacauaaaagucugug

SEQ ID NO: 11699 - RNA, 64 nt, Human
accuucccagagcuaaauaguuuagcugcuucaacugcuccagacuauugaaguaugcaaauca

SEQ ID NO: 11700 - RNA, 64 nt, Human
aaacaccgagacguuucugugacuucacuuucaccugcuccaggggucaaggacuugccuugcc

SEQ ID NO: 11701 - RNA, 64 nt, Human
gggaggggaggagagaugcauacccguuucucaacugcuccauggauugaaaaaauaacaguuu

SEQ ID NO: 11702 - RNA, 64 nt, Human
gaacucaacuccuggcuccugggacugcaccagacugcuccaaacucaccucacuggcuucugu

SEQ ID NO: 11703 - RNA, 64 nt, Human
ggagcuggcucuuagcugaggcuccugcuaccuccugcuccacccgccccuuccuagguuacaa

SEQ ID NO: 11704 - RNA, 64 nt, Human
agggucagcccuggacagaccucugcccagggaacugcuccauggggucugggagagcagccau

SEQ ID NO: 11705 - RNA, 64 nt, Human
gucagaaacuguuucugcagagccacucucuccccugcuccauuucgugacuuuuuuuuuuuuu

SEQ ID NO: 11706 - RNA, 64 nt, Human
gugggaaguuguugaagacuugaagacgugauuccugcuccaaucaucccuucuugcuccucuu

SEQ ID NO: 11707 - RNA, 64 nt, Human
uguggucucuggagaagcacugccauucagccuccugcuccagcuguucacaugcagaaaugcu

SEQ ID NO: 11708 - RNA, 64 nt, Human
cugauuggauucacugugcaugcuucagugggaucugcuccaccuuucagugacauuuaagaca

SEQ ID NO: 11709 - RNA, 64 nt, Human
ggaaugagagaguagggucaaacugucacaguaucugcuccauagguuucuguuuuuaauuuca

SEQ ID NO: 11710 - RNA, 64 nt, Human
gucgucucacaaaggcuuuccuuggccacagugggaccuucaccuggcaccucuauccuguaau

SEQ ID NO: 11711 - RNA, 64 nt, Human
gggccagaaaccgcuucugagcggggcacuucggcugcuccacagggaaggcgacacugaaagc

SEQ ID NO: 11712 - RNA, 64 nt, Human
ugugucccucgggcaugacaggcagaaacgagggcugcuccaggagaagggccuccugcuggcc

SEQ ID NO: 11713 - RNA, 64 nt, Human
uggcuauuacuuuguucuugguccuucacagggccugcuccaucccaccuuccuuucugcugcc

SEQ ID NO: 11714 - RNA, 64 nt, Human
gaugaugggcagcgcccgaguggcggagcugcugcugcuccacggcgcggagcccaacugcgcc

SEQ ID NO: 11715 - RNA, 64 nt, Human
gaugaugggcagcgcccgcguggcggagcugcugcugcuccacggcgcggagcccaacugcgca

SEQ ID NO: 11716 - RNA, 64 nt, Human
ugugagcgagagggugaguguggucagaguaaagcugcuccacccccagauugcaaugcuacca

SEQ ID NO: 11717 - RNA, 64 nt, Human
ugcccaggagagggaccaggggugcgcccacagccugcuccauucuccagucugaacaguucag

SEQ ID NO: 11718 - RNA, 64 nt, Human
cuuuucugugggccugaagguccgacugagaagacugcuccacccaugaugcaucucgcacucu

SEQ ID NO: 11719 - RNA, 64 nt, Human
ccaaccacagcaucgggagcacccagagcacccccugcuccaccagcagcauggcauagccccg

SEQ ID NO: 11720 - RNA, 64 nt, Human
cucgcucccccuccccccgcuccccccacgcccccugcuccaggcugccaaguguuuuccuuua

SEQ ID NO: 11721 - RNA, 64 nt, Human
uaauaccuaaucggcgagugcccaucugccccaccugcuccagugcgugcugucuguggagugu

SEQ ID NO: 11722 - RNA, 64 nt, Human
gugcucggggucaccaugaugccuuugaucgaugcugcuccaguaacuacaguggcauuaggac

SEQ ID NO: 11723 - RNA, 64 nt, Human
uuccagggggcgaacgcagcacagaggaagaggccugcuccacuugucugggaaccugggcagg

SEQ ID NO: 11724 - RNA, 64 nt, Human
ccgcacucggccaggagcuaguuuuaccagcacccugcuccacugccuuccucuagugcagccu

SEQ ID NO: 11725 - RNA, 64 nt, Human
gagccgaaaugguuauuuuacagcauacaagcuucugcuccaguaugauaauuuuuaauugccu

SEQ ID NO: 11726 - RNA, 64 nt, Human
gcaugguguccaccugccugcugaccacuggacgcugcuccaugcugaagaaaagugacagucu

SEQ ID NO: 11727 - RNA, 64 nt, Human
gaguguuucccugccacuucugugccuccacagccugcuccaguuccgcagcuagagcugggcc

SEQ ID NO: 11728 - RNA, 64 nt, Human
uagcacuuccuacauggacuguaacauuucuuuacugcuccaacuucucauuaaauugggggcu

SEQ ID NO: 11729 - RNA, 64 nt, Human
cguuguaaauaucgguggugauuguugccaaaaugaccuucaggaccggccuguuucccgucug

SEQ ID NO: 11730 - RNA, 64 nt, Human
uugggaccccacacacuccaggugggaucagaugcugcuccaaccaugcaguuccuggugaggg

SEQ ID NO: 11731 - RNA, 64 nt, Human
cgagaacggauccagaaaugcagucagaaggacccugcuccaccuggggggacugggaguguga

SEQ ID NO: 11732 - RNA, 64 nt, Human
cuuagaauucauugagacccauagcuucauauggcugcuccagccccacuucuuagcauucuua

SEQ ID NO: 11733 - RNA, 64 nt, Human
agccacuuccacauggcccuggcagggagcacugcugcuccaugcuccauucucacuguacuug

SEQ ID NO: 11734 - RNA, 64 nt, Human
cccaguaagaguaagaccuguuguuuuggaaggucugcuccaccaucuaagagcacuguuuuuu

SEQ ID NO: 11735 - RNA, 64 nt, Human
ggguaaaugaaagcaagaggcugcugccacugaccugcuccauucagaacaagacuggaugcuu

SEQ ID NO: 11736 - RNA, 64 nt, Human
uuucuccaaaagugagcccggauccuccugggagcugcuccaggcaugugggaagcugaagcgg

SEQ ID NO: 11737 - RNA, 64 nt, Human
cugccagagacauuuaugcccccagcaccaauuacugcuccaguuaugagccucaccccugagc

SEQ ID NO: 11738 - RNA, 64 nt, Human
agauuuuagaaauaaaugcagcuuuaccaugaaccugcuccacugagaaaagccaggcagaucg

SEQ ID NO: 11739 - RNA, 64 nt, Human
ucuugucauuggucaauaggggaggguagauuagcugcuccagaauucaauaaaguguaauauu

SEQ ID NO: 11740 - RNA, 64 nt, Human
ggguggggaggugaauguuuucuagagauucaaacugcuccagcaauuucuguaguuuucaccu

SEQ ID NO: 11741 - RNA, 64 nt, Human
ggguggaggugguguucuauaccuaaaggaugaccugcuccagaaacagcaccagcacagcaug

SEQ ID NO: 11742 - RNA, 64 nt, Human
aaaaugggcucccugguaucuccugucuucccuacugcuccaaacccuaaauuuugguuguaca

SEQ ID NO: 11743 - RNA, 64 nt, Human
acuauauguaacuucagacaaaguggaacuaagccugcuccaguguuuccucaucauugauuau

SEQ ID NO: 11744 - RNA, 64 nt, Human
aagcagaugaccucacaggagugauaagaaacaucugcuccacgccaacucccagagcugaugc

SEQ ID NO: 11745 - RNA, 64 nt, Human
uuuuauguuaaugcucuggacuugccuccagagacugcuccagaguuggugacacagcuguccc

SEQ ID NO: 11746 - RNA, 64 nt, Human
ccuucccaccgaacacuacuaaggggcuuguguucugcuccauaccuuuucucuuuucuuucug

SEQ ID NO: 11747 - RNA, 64 nt, Human
uuaaacuaucucagccguuucccugcuuucccuucugcuccauaugccucauuguccuuccagg

SEQ ID NO: 11748 - RNA, 64 nt, Human
caggauggauaugagaugggagaggugagugggggaccuucacugaugugggcaggaggggugg

SEQ ID NO: 11749 - RNA, 64 nt, Human
cugacugcccuccaugggggcauucuggcacccccugcuccaggacaggccaugggcaagcugc

SEQ ID NO: 11750 - RNA, 64 nt, Human
guguaauuagcauuuagaagcugaagauccccaacugcuccagccucugccgcugccaugcuuu

SEQ ID NO: 11751 - RNA, 64 nt, Human
ugccucuucugggcagaaggccccuccagggggacugcuccaacaggaaagagccccuccccca

SEQ ID NO: 11752 - RNA, 64 nt, Human
ccccuccuccuucccgcuuuuccccuucucccuccugcuccaggcccaaggcguguugguuuug

SEQ ID NO: 11753 - RNA, 64 nt, Human
guuggauuugggaaugaccuuggugagagucucacugcuccagggucucuuuuugguccaaagg

SEQ ID NO: 11754 - RNA, 64 nt, Human
auaauauaaaaucacuuggugauuaaaaaaauaacugcuccauaaauaaaacuccuaaagucac

SEQ ID NO: 11755 - RNA, 64 nt, Human
ccuccugcugcagaggggcaggcccugcacuguccugcuccacaguguuggcgagaggaggggc

SEQ ID NO: 11756 - RNA, 64 nt, Human
cuguucagccccacagcucccaacuauuugguuccugcuccauggucgggccucugacagccac

SEQ ID NO: 11757 - RNA, 64 nt, Human
uuagucaccuaacccucugucacccagucuguugcugcuccaugguggggccaagagucacuuc

SEQ ID NO: 11758 - RNA, 64 nt, Human
caugucugggcaccugcccugggcugaggccaggcugcuccaggggccuccugcgcccucaccu

SEQ ID NO: 11759 - RNA, 64 nt, Human
uaaaaguaaaggaugcuuacuccacuucgcuucucugcuccagguucacuuuggauaugaucuu

SEQ ID NO: 11760 - RNA, 64 nt, Human
gagcccucccucccaggcacccagcacuuuaagccugcuccauggaggcagagaggcccggcaa

SEQ ID NO: 11761 - RNA, 64 nt, Human
ggaagggacugguccaggcaugggucccuucccccugcuccaugggcaccucugcuguauugau

SEQ ID NO: 11762 - RNA, 51 nt, Human
ggcaggaagacaagcuaugaucugcuccaggcaucaagcucauuuuaugga

SEQ ID NO: 11763 - RNA, 64 nt, Human
ucccuccuggcucacagccaccaccuggauggaucugcuccaugcagaucuagccaggccuccc

SEQ ID NO: 11764 - RNA, 64 nt, Human
gaauccaagcucccugccccaaauaacuucaguccugcuccagaauuuggaaauccuaguuucc

SEQ ID NO: 11765 - RNA, 64 nt, Human
augcuuuuauccauucuucucuguccugucuucccugcuccaacucuuucucucaauauuccug

SEQ ID NO: 11766 - RNA, 64 nt, Human
ccugagugggaugacuucagcuagagucuccuuucugcuccaguucugguuuaaucuguuugaa

SEQ ID NO: 11767 - RNA, 64 nt, Human
ccacccucacucugccauuguuccaccuccugaccugcuccaucugagcucuccagcuggcccc

SEQ ID NO: 11768 - RNA, 64 nt, Human
guaacagaggcuagugagaaagaaaagcuccucucugcuccauuccaaaggccaucuugugguc

SEQ ID NO: 11769 - RNA, 64 nt, Human
ugcuguucuguaaaagagaauuggagaaugaaaccugcuccaacagagaucaugagacugaaau

SEQ ID NO: 11770 - RNA, 64 nt, Human
gccauggggucggcuccugauggugucauucugccugcuccaucgcgccagcgaccucucugcc

SEQ ID NO: 11771 - RNA, 64 nt, Human
acccugcacuugcuccccagauccacuucacuggcugcuccaugaauccagcccgcuccuucgg

SEQ ID NO: 11772 - RNA, 64 nt, Human
uuucuuccucccaaacucugcaccucuuccucagcugcuccagaccggccaggguaaccagcua

SEQ ID NO: 11773 - RNA, 64 nt, Human
ugcagagagccggcuccugggccugcuggggccucugcuccagggccucagggcccggccuggc

SEQ ID NO: 11774 - RNA, 64 nt, Human
caucagcaccauccaucaggacuggcucccccaucugcuccaagggagcguggucguggaagaa

SEQ ID NO: 11775 - RNA, 64 nt, Human
ggauccuuccucugcccuucuccugccuccccaccugcuccaugggcauaagacuguggggcuu

SEQ ID NO: 11776 - RNA, 64 nt, Human
gccauagggagaagcucccucuccccuucaucuucugcuccaaaggugguagcaagaggaguac

SEQ ID NO: 11777 - RNA, 64 nt, Human
ggagggucucuugauuccuaaccgcccccacauacugcuccaccgcugaacuucgggugccggg

SEQ ID NO: 11778 - RNA, 64 nt, Human
uuccccaaggagcuucagggcaguccuucuggcacugcuccagaauuccuccuucuuggugugu

SEQ ID NO: 11779 - RNA, 64 nt, Human
cucccguucccugcaugagggcggggaguucccccugcuccaucccccauugcaugggggaagg

SEQ ID NO: 11780 - RNA, 64 nt, Human
uggcucuucuuccuuuguacucuucagcuggcaccugcuccauucugcccuacaugauggguaa

SEQ ID NO: 11781 - RNA, 64 nt, Human
uuagaucagaacucaccaaauggaagccuagcagcugcuccauaaaccuagccccauucuucau

SEQ ID NO: 11782 - RNA, 64 nt, Human
augagagagcuauguuucugaaguucgugaccagcugcuccagacccccgcuccugggauucgc

SEQ ID NO: 11783 - RNA, 64 nt, Human
aaaacagacugcuguguucaguaacacacccucccugcuccaagugcaccaggaugcaaaugca

SEQ ID NO: 11784 - RNA, 64 nt, Human
aaacaaagaaaggaagccacugaacaucccuucucugcuccacaggagugccuuagacagccug

SEQ ID NO: 11785 - RNA, 64 nt, Human
gaugcugguucugacucuaccccacugcuuccuucugcuccaggccucaauuuucccuucuugu

SEQ ID NO: 11786 - RNA, 64 nt, Human
ccauggggggguggagaggggugcaaggcccugccugcuccacuuuuucuaccuuggaacugua

SEQ ID NO: 11787 - RNA, 64 nt, Human
agacaccccaccugugccccuaucaucaggggaacugcuccaccugagaggaccaacucuuuaa

SEQ ID NO: 11788 - RNA, 64 nt, Human
uuacgucagaaagagauuuucacccauccaugagcugcuccaucaccugguucuuguccuggag

SEQ ID NO: 11789 - RNA, 64 nt, Human
uuagcauuuguuuuagcauuaccuaauuuuuuuccugcuccaugcagacuguuagcuuuuaccu

SEQ ID NO: 11790 - RNA, 64 nt, Human
uucuccagcuucuacgcucacagcaacugcuuaccugcuccaagaagaugggaggaaggggagc

SEQ ID NO: 11791 - RNA, 64 nt, Human
ugaaccuuuguacauuucaaagaagacuccauggcugcuccagaugcccccuugcugggugcag

SEQ ID NO: 11792 - RNA, 64 nt, Human
ccuaauccaggcagauccaggacuauauuugggccugcuccagaccugauccuggaggcccagu

SEQ ID NO: 11793 - RNA, 64 nt, Human
cuuacacaggccggguucccacgcagaggggaggcugcuccaccccuacucuccucccuugcuc

SEQ ID NO: 11794 - RNA, 64 nt, Human
ucaucugcaucuucagauccaguacucuguguaccugcuccagccccacccccacagagagaac

SEQ ID NO: 11795 - RNA, 64 nt, Human
caaaggcaguuuguuuggaagacuucuaaagaaacugcuccagcuuuugcagccaaucagguag

SEQ ID NO: 11796 - RNA, 64 nt, Human
auuuacucucuauuauugggcauaaagguggcuucugcuccagaacucuauccacuguauuucc

SEQ ID NO: 11797 - RNA, 64 nt, Human
ucuugaagaccuuaaaggugcuuuccaaccugcacugcuccagugaaaugugguacuuuuuucu

SEQ ID NO: 11798 - RNA, 64 nt, Human
aaauuucgacuucagccuuugcacucaggagguucugcuccagcaugagcucuuguacuuacau

SEQ ID NO: 11799 - RNA, 64 nt, Human
ccacacugaccacgccccucggcggggccgcccucugcuccagcccucccgauuaaagcgugcc

SEQ ID NO: 11800 - RNA, 64 nt, Human
cauaagccacaccaaaaccagacucaauuuaaaucugcuccaaaugaguccauacccaucuuca

SEQ ID NO: 11801 - RNA, 64 nt, Human
uugucacuacuuaaguuagccucaucauuuugugcugcuccaacaccagcaggguaucucccaa

SEQ ID NO: 11802 - RNA, 64 nt, Human
auucuuuugaauuacaagagugacaguuaguaaacugcuccagggaaauaagugucaucuuuua

SEQ ID NO: 11803 - RNA, 64 nt, Human
uacaugugccugucaugacuguaauucauuaugacugcuccaggaagggcuaauggggccaaua

SEQ ID NO: 11804 - RNA, 64 nt, Human
agaaagucuuuuaggacaccacccgucccccgcccugcuccagagcguggaccgaggaggucuu

SEQ ID NO: 11805 - RNA, 64 nt, Human
cugggaaaggagauagccuugcuccggcccccuugaccuucagcaaaucacuucucucccugcg

SEQ ID NO: 11806 - RNA, 64 nt, Human
guuagagaaauccuuccuaaacccaaugacuucccugcuccaacccccgccaccucagggcacg

SEQ ID NO: 11807 - RNA, 64 nt, Human
ggcucauuuuguagauugagaaggugcgucuccccugcuccaagucucaucaugacagcgugcu

SEQ ID NO: 11808 - RNA, 64 nt, Human
ugaauugccuggggaucuugugaaacugcagacucugcuccaaguaaucugggcugggccugag

SEQ ID NO: 11809 - RNA, 64 nt, Human
aaaggaaggguggucagaaguacauuaaagauuucugcuccaaauuuucaauaaauuucugcuu

SEQ ID NO: 11810 - RNA, 64 nt, Human
aacugugaacauguggcucuggauagagugacugcugcuccauauuagcuuccagagggugagu

SEQ ID NO: 11811 - RNA, 64 nt, Human
gagccgaccuaaaaguaacaauagauaagguuuccugcuccaguguaucucaaaagaccgggcg

SEQ ID NO: 11812 - RNA, 64 nt, Human
ccacuccucagccccucaucuugccuccacccagcugcuccauuuuugccacaucguggcccgc

SEQ ID NO: 11813 - RNA, 64 nt, Human
gaaguagcaaacuguacauuccuucuuccucccccugcuccagaaggugccgguacugaagaug

SEQ ID NO: 11814 - RNA, 64 nt, Human
cccuccugcccgccacacagaccaccauccaccgcugcuccacgcgcuucgacuuuucuuaaca

SEQ ID NO: 11815 - RNA, 64 nt, Human
ccuaucccguggccauccgcugugacugcggagccugcuccacugccaccacggagugugagac

SEQ ID NO: 11816 - RNA, 64 nt, Human
cacaugagcagggugagaaaugcuugcuuuauagcugcuccacccucaucuccagagauuuugu

SEQ ID NO: 11817 - RNA, 64 nt, Human
gucauuccccucuucccucaagacucucugaaugcugcuccacugucuuuugucuuggagguca

SEQ ID NO: 11818 - RNA, 64 nt, Human
augaccaggucccugggaaugagcugccuaccugcugcuccacgaggaagcucaggccugcaca

SEQ ID NO: 11819 - RNA, 64 nt, Human
uuaaccacucacuuaguaaaugucauaacuacaccugcuccaggaccaaucagugaaaccugcu

SEQ ID NO: 11820 - RNA, 64 nt, Human
cugcaccgccuggagcagcaugggggucagaccccugcuccagggccacuugaguugugggccc

SEQ ID NO: 11821 - RNA, 64 nt, Human
ccuggaggcuccaggccacacccagcugguggggcugcuccagugccccaucaccggccuucuc

SEQ ID NO: 11822 - RNA, 64 nt, Human
guacagccccuccccgcccagaacugugaauggccugcuccaggccauggcugggggcagggag

SEQ ID NO: 11823 - RNA, 64 nt, Human
gcaaucauaccuuauaaaugacuuuugugccuuucugcuccagucucaaaauuuccuacaccug

SEQ ID NO: 11824 - RNA, 64 nt, Human
ccagcuccggggcaucagccugagugcgcuugagcugcuccaaaccuggcccuuccccacuccu

SEQ ID NO: 11825 - RNA, 64 nt, Human
ugaagaaagccaucgagagaggcucccucaugggcugcuccauugauguaagucuggggugugg

SEQ ID NO: 11826 - RNA, 64 nt, Human
gauugcacggaugguaaggaauauggauaacucacugcuccaggacucagaccucgaccccaga

SEQ ID NO: 11827 - RNA, 64 nt, Human
aacguuuuuguuaggcaucacaguuuugcaaccucugcuccaaagagaaaaauagaaugaguuu

SEQ ID NO: 11828 - RNA, 64 nt, Human
ccuauguaugcaaugcuccucagcccucuucucccugcuccaguagucucccuuccaaauaaau

SEQ ID NO: 11829 - RNA, 64 nt, Human
uuuaucaugaucaguaaaaauguuccaaaugcuucugcuccauuauagcaguaaagaacgaaua

SEQ ID NO: 11830 - RNA, 64 nt, Human
cagguaccauuuauuucaaaacaacuuuuuuagucugcuccaaaguuaaaauaauuaacuagcu

SEQ ID NO: 11831 - RNA, 64 nt, Human
guggguagucauucuuacaauugcacugcuguuccugcuccaugacuggcugucugccuguauu

SEQ ID NO: 11832 - RNA, 64 nt, Human
cuucuagagcaccugcuauccccaacuucuagaccugcuccaaacuagugacuaggauagaauu

SEQ ID NO: 11833 - RNA, 64 nt, Human
agggcugggggucaggaguccuaggcucccauuccugcuccauuaccaaccgaaggcucggucu

SEQ ID NO: 11834 - RNA, 64 nt, Human
ggaggggagucucugugccugggaauuaggaccccugcuccaaccaucgcucuugauccugggg

SEQ ID NO: 11835 - RNA, 64 nt, Human
agggaagagauagcauggcaugcagcacacacggcugcuccaguucauggccucccaggggugc

SEQ ID NO: 11836 - RNA, 64 nt, Human
cuguguccacagguguucuccagugccaaguacccugcuccagagcgccugcaggaauauggcu

SEQ ID NO: 11837 - RNA, 64 nt, Human
acggggugggaacugggggaccugggccucaggccugcuccaccacugacucaccgaaugaccu

SEQ ID NO: 11838 - RNA, 64 nt, Human
accuuguccccuggacaggucuccuuuccuggcccugcuccagcccagcccuucuucuaguggu

SEQ ID NO: 11839 - RNA, 64 nt, Human
uuccuggcagcugcccagaacccugcugaugagccugcuccaugggacccagccccccaggaga

SEQ ID NO: 11840 - RNA, 64 nt, Human
auugcagugucuauccugcugccaucagcccuuccugcuccagcuacaguugggccagcugugg

SEQ ID NO: 11841 - RNA, 64 nt, Human
gaggucugucugcacugggagccucaggagggcucugcuccacccacuuggcuaugggagagcc

SEQ ID NO: 11842 - RNA, 64 nt, Human
aaggggaaagaauuaaugcucuaacgugauaaaccugcuccaaggcaguggaaauaaaaagaag

SEQ ID NO: 11843 - RNA, 64 nt, Human
cugcccuccucaggguggucagcccaaccugucggaccuucacuucacaucaugguggggaccg

SEQ ID NO: 11844 - RNA, 64 nt, Human
cggcccugccacagcccccaaagacacuggccuccugcuccagcuucccuguccuggccccacc

SEQ ID NO: 11845 - RNA, 64 nt, Human
guccuucacgcacauauccguggccaccugagaccugcuccacgacccuuccaggcagagccga

SEQ ID NO: 11846 - RNA, 59 nt, Human
ccagcaucuccuucuacuaagagaagccacugcuccacccggagccagaccagaaacuc

SEQ ID NO: 11847 - RNA, 64 nt, Human
accuugcagccgcuuuccagggccaccaagggcucugcuccagccucucagagaaacagaggcc

SEQ ID NO: 11848 - RNA, 64 nt, Human
cgcccuuucgaccuuggccugaugaccagaugcccugcuccaucacaaccuccuuccccaggaa

SEQ ID NO: 11849 - RNA, 64 nt, Human
agcacuagcaccucacuccaucggccccggcacccugcuccaucggcacuggcgcccugcucca

SEQ ID NO: 11850 - RNA, 64 nt, Human
ggccccggcacccugcuccaucggcacuggcgcccugcuccaucggcacuaaugcuccacucgg

SEQ ID NO: 11851 - RNA, 64 nt, Human
gacauuggugccccacuccaucagcacuaacgcccugcuccaucggcacuggugucccacucca

SEQ ID NO: 11852 - RNA, 64 nt, Human
caucacuauguccagcuccgucggcacuaccacccugcuccaucaucacuacguccagcuccaa

SEQ ID NO: 11853 - RNA, 64 nt, Human
ggcaccaacgcccagcuccaccgguacuggcucccugcuccaucggcacuaacgcccugcuuca

SEQ ID NO: 11854 - RNA, 64 nt, Human
gugaggucugugccacaaggugagucugaacugacugcuccagcuaagugaucaggcacguuga

SEQ ID NO: 11855 - RNA, 64 nt, Human
acuuaucuggaucauuuggucaguuugguaauuccugcuccacaccccuauuuuccucuuaaua

SEQ ID NO: 11856 - RNA, 64 nt, Human
aaggcucggugaagcagagcucgugggauuccugcugcuccagguguccucagcucaccugucc

SEQ ID NO: 11857 - RNA, 64 nt, Human
cugcaggaccucccgggucaggcagggcggcccccugcuccacacacugcugcaucuugggucu

SEQ ID NO: 11858 - RNA, 64 nt, Human
ggggcaggguguuuagaauuuucuaaauguaguucugcuccagacagggaauuaggcccccauc

SEQ ID NO: 11859 - RNA, 64 nt, Human
cugaccaucaugcccucucucgggagcccuagcccugcuccaacuccauacuccacuccaagug

SEQ ID NO: 11860 - RNA, 64 nt, Human
gugcggccggagccuccccaaggagcgccgcccccugcuccacagcgcccagucccaucgacca

SEQ ID NO: 11861 - RNA, 64 nt, Human
ccaaacagagaaggaacccagcaucucagggccacugcuccauugcucugggggcugggaugcc

SEQ ID NO: 11862 - RNA, 64 nt, Human
uuaagugaaauuuauugaggaaaaauaugugaaggaccuucacucuaagauguuauauuuuucu

SEQ ID NO: 11863 - RNA, 64 nt, Human
gcuugcugacuccucucaaagggacagagcgccccugcuccagggaggaggcucaccggacccu

SEQ ID NO: 11864 - RNA, 64 nt, Human
gagacauuuuccgcccacuccugggacacuccgucugcuccaaugacugagcagcauccacccc

SEQ ID NO: 11865 - RNA, 64 nt, Human
accucccugagccucacaggcuuacaggagucaccugcuccauguggggacuggccuguuuccu

SEQ ID NO: 11866 - RNA, 64 nt, Human
aaucccuggcguacaggguuuccugcccgaggagcugcuccaggagccugcgcggcucgccugg

SEQ ID NO: 11867 - RNA, 64 nt, Human
agcaauacccccaccaccccuuucacuccauccccugcuccaggcucacucccaaaacagaccc

SEQ ID NO: 11868 - RNA, 62 nt, Human
aauuuccaacuucucccuaaucuucaacucugcugcuccaauggguccagaaauuacugagg

SEQ ID NO: 11869 - RNA, 64 nt, Human
ccugucauugucauacaucauccagcugagcggacugcuccaagugugugugcgaacgggaaca

SEQ ID NO: 11870 - RNA, 64 nt, Human
caggcugcucugcggccccuuccuccuccucuuccugcuccaacuucuguccaccuggggacag

SEQ ID NO: 11871 - RNA, 64 nt, Human
ucagucccugccugaaucugggcuuugcaagcuccugcuccauauugguggacaugggaauggu

SEQ ID NO: 11872 - RNA, 64 nt, Human
cugaggagguguccuggguuuggcuggcuggcuccugcuccagcggcccggcuucagguguccg

SEQ ID NO: 11873 - RNA, 64 nt, Human
uucuguggucagguaggcugggcugugaacagcacugcuccacauggugucggcucacagagcc

SEQ ID NO: 11874 - RNA, 64 nt, Human
ccuucccucucugccgcuuguccuugugucugggcugcuccaaguccuugugcugggcacccug

SEQ ID NO: 11875 - RNA, 64 nt, Human
gcuagcuagccagccaaggauaccggacacaccucugcuccaaaggaaauccaaaaaagcaaac

SEQ ID NO: 11876 - RNA, 64 nt, Human
aaguuccugaagcaucauccuggcagggaggcgccugcuccaccagcugguggguguuuguaau

SEQ ID NO: 11877 - RNA, 64 nt, Human
ugccuuugguuuacucagggucugauguuggaaucugcuccaacuccacacccuagcccuuaca

SEQ ID NO: 11878 - RNA, 64 nt, Human
acuaccugcauguccagagcaugcucacccagcucugcuccaaggccuuccucuacaccuucug

SEQ ID NO: 11879 - RNA, 64 nt, Human
gcagagaaacuuguucccaugacccuucccaaaucugcuccagcaggacuaagguggcuuuccc

SEQ ID NO: 11880 - RNA, 64 nt, Human
ccaacaucugacaucuuucccguggagcaacuuccugcuccacgggaaagaggucgauggauuu

SEQ ID NO: 11881 - RNA, 64 nt, Human
aaauaacuuuuaagaucagcucaucuauaaggcugaccuucaugcagagauuuuauuucaccuu

SEQ ID NO: 11882 - RNA, 64 nt, Human
cccagccuacuccccaucccagcuuuuagaggaucugcuccacugucuccuggggcaguugugg

SEQ ID NO: 11883 - RNA, 64 nt, Human
gcaggguagggggccugaguugaggggcuucccucugcuccacagaaacccuguuuuauugagu

SEQ ID NO: 11884 - RNA, 64 nt, Human
cggcgaaagccugccaccccacaaugaauccacccugcuccacugcgcgccucucccaggucuc

SEQ ID NO: 11885 - RNA, 64 nt, Human
uucugucaagacuuagccccgcugagaugcccuucugcuccagcuugcuggauguuaccugucc

SEQ ID NO: 11886 - RNA, 64 nt, Human
gggauaaaaaaccauacauuggguacaguguacacugcuccagugaagggugcaccaaaaucuc

SEQ ID NO: 11887 - RNA, 64 nt, Human
agagcaggaagccucagcugggccuggagugucccugcuccagcccugccagggacagguuucu

SEQ ID NO: 11888 - RNA, 64 nt, Human
ccccauggcccuggagagugggccugggugguaccugcuccaggcagggaaacugggggcucgc

SEQ ID NO: 11889 - RNA, 64 nt, Human
aggggcagagcuccugguacauccauguguggcucugcuccaccccugugccaccccagagccc

SEQ ID NO: 11890 - RNA, 64 nt, Human
ugacuccuuccugcugagcacugugcuaccuucacugcuccaaagccagacuaacagcucucca

SEQ ID NO: 11891 - RNA, 64 nt, Human
ccccagacucugugaucccccaggguccauggugcugcuccauccgcccccccuccccuguguu

SEQ ID NO: 11892 - RNA, 64 nt, Human
gcauucuguuaccugugauauuuuuuagacugaacugcuccauuccuagucuuaauuaccauau

SEQ ID NO: 11893 - RNA, 64 nt, Human
acagaacagagggccagagcuagggcugcugcuucugcuccagccccuuugccucuguccuccc

SEQ ID NO: 11894 - RNA, 64 nt, Human
ccccugaucucugaccucugcugagugcugggcacugcuccaagggacaggugggccuggcggc

SEQ ID NO: 11895 - RNA, 64 nt, Human
ccucugcgguaaaggacuuggucuguucuacccccugcuccagcuugcccugcucguccugauc

SEQ ID NO: 11896 - RNA, 64 nt, Human
cccaugcacucucucccacccccuuccagggccucugcuccaaaggaggccucuggaacccagg

SEQ ID NO: 11897 - RNA, 64 nt, Human
ucugcuagcaaagaauguacucaggugacaccaccugcuccagccacguccagugccacagucc

SEQ ID NO: 11898 - RNA, 64 nt, Human
gucccauccuggugugagaaucaaccaggcuuuccugcuccaccugagauaaccaacucccucc

SEQ ID NO: 11899 - RNA, 64 nt, Human
cugccggaggacccccaccugagagauggaugagcugcuccaaaggggaacuguugacacucgg

SEQ ID NO: 11900 - RNA, 64 nt, Human
aguugccauccugagggguuuaacaacaugcuccguagacgaagggagaggaggagagaaggcu

SEQ ID NO: 11901 - RNA, 64 nt, Human
guuuucaucaucaagagaguucugcuggucagcccugcuccaggggaugccucugccuucgcau

SEQ ID NO: 11902 - RNA, 64 nt, Human
gugcccaugaggacaaaguguagcagccuccugccugcuccaagaaaagggcuugcgaaaggaa

SEQ ID NO: 11903 - RNA, 64 nt, Human
ugcagcaaugaguugggaaaaacugaccgaguaccugcuccaucaugcuugauugagugcuccu

SEQ ID NO: 11904 - RNA, 64 nt, Human
gggaaaagcagcucuccccucagagugcaagccccugcuccagaagauagcuucaccccaaucc

SEQ ID NO: 11905 - RNA, 64 nt, Human
ggcaaucugaaucaaaaucucacacuuuuacccacugcuccaaaaaacagaaguagaaugccau

SEQ ID NO: 11906 - RNA, 64 nt, Human
ccaccacugaugcagucccaccgaaagccuccaucugcuccagggggacagccccucgugucca

SEQ ID NO: 11907 - RNA, 64 nt, Human
aggggagauggggaggagauauggagugagucaccugcuccagaagaugccagcuucucucucc

SEQ ID NO: 11908 - RNA, 64 nt, Human
ccccauuacaacauggucucacucagggccuggacugcuccaaaacucgcccaggucuccagcu

SEQ ID NO: 11909 - RNA, 64 nt, Human
ggggugcuggguauaagcagagagggauggguuccugcuccaagggacccuuugccuuucuucu

SEQ ID NO: 11910 - RNA, 64 nt, Human
guuaccucgggaaacaaacaggaucuucucugcccugcuccagucgaguuggccugacccgcuu

SEQ ID NO: 11911 - RNA, 64 nt, Human
cauuccaccccaguggggacagccauuccccuaccugcuccaggagccuggauuggcuuuaaau

SEQ ID NO: 11912 - RNA, 64 nt, Human
ucucuuggcagaugcaggcgggccuccucccaggcugcuccagacauggggguuggggaugggg

SEQ ID NO: 11913 - RNA, 64 nt, Human
ugauugggaaagaaaauccuggagagacacuucacugcuccaaggcuuuugagacacaagggaa

SEQ ID NO: 11914 - RNA, 64 nt, Human
gcagaguggccagcacaccucucauccgccccuccugcuccaucacugcugagccucuccccau

SEQ ID NO: 11915 - RNA, 64 nt, Human
uucaucucaggacuaaagagcuggguccuucccccugcuccaucugagccuugguaggguuaaa

SEQ ID NO: 11916 - RNA, 64 nt, Human
gugaugccgggcacgggcgcuccugcugccgucucugcuccaggaagcugccuccucugggccc

SEQ ID NO: 11917 - RNA, 64 nt, Human
aagagagaaggaagacagaggccugugcccacugcugcuccauguguaccaagagcagcagggc

SEQ ID NO: 11918 - RNA, 64 nt, Human
uaagagccuuucuaagaacaugauaggcuuacuucugcuccauaauaaagugggagaaaaaagc

SEQ ID NO: 11919 - RNA, 64 nt, Human
aaguuuuguaccugguuauuuuucacuuaaguuuguagacgaaaugugccauuauauuagcuuu

SEQ ID NO: 11920 - RNA, 64 nt, Human
cugaccggggccagggcugccauggucuccuugccugcuccaaggcacaggauacagugggaau

SEQ ID NO: 11921 - RNA, 64 nt, Human
uuaccauuugcuacuguacauaaacaaugaugcccugcuccagggagauuuugagguaaagaua

SEQ ID NO: 11922 - RNA, 64 nt, Human
ggccacuccagccagcccgccuccggggcggacccugcuccacuuccagaagccaggacuagga

SEQ ID NO: 11923 - RNA, 64 nt, Human
aaacaaagugcagacauucaaagaaauaagaaaucugcuccaaugcucuuguucuaaucucuaa

SEQ ID NO: 11924 - RNA, 64 nt, Human
uuugcagccauggucacgagucauuucugccugacugcuccagcuaacuuccagggucucagca

SEQ ID NO: 11925 - RNA, 64 nt, Human
gaagagauggcaccagggaaaggugugccauaagcugcuccagagcuuuugguaugcugagugu

SEQ ID NO: 11926 - RNA, 64 nt, Human
gucgccucauuuccugcuacacugaaggggucagcugcuccagugggccaaguugggcaggacc

SEQ ID NO: 11927 - RNA, 64 nt, Human
agcccaagguacacauugggcggccugcaggaaccugcuccagguggacacacgggccagcagc

SEQ ID NO: 11928 - RNA, 64 nt, Human
uagugacaccagcuguguuggauuggggcccacccugcuccagcauggccuaaucuuaacuaau

SEQ ID NO: 11929 - RNA, 64 nt, Human
cucagcaagggcucagcugggaucugcgcccggccugcuccagaacgcagcccacucgccaccg

SEQ ID NO: 11930 - RNA, 64 nt, Human
cccucccuguccacagguggcccgaggacgcucccugcuccacgucugcgccgccgccggaguc

SEQ ID NO: 11931 - RNA, 64 nt, Human
gggccuucccuucugcccccaggcgggcuccccgcugcuccagcugcggagcuggucgacauaa

SEQ ID NO: 11932 - RNA, 64 nt, Human
agcccuccucccuucugggcccgaccagcuuauacugcuccaucuuccccggccacaugccccg

SEQ ID NO: 11933 - RNA, 64 nt, Human
gccccagcccggagcccagcccccugccccggcccugcuccagaacccagcccagaucggagga

SEQ ID NO: 11934 - RNA, 64 nt, Human
gugcauccacagguggcccgagcuguucuuucagcugcuccaaggauugagacccaagucauca

SEQ ID NO: 11935 - RNA, 64 nt, Human
guuggggccacgcagaaauggccucaaggggacucugcuccacguggggccaggcgugugacug

SEQ ID NO: 11936 - RNA, 64 nt, Human
gugguuguaugcacugaugagaaaucaggcguuucugcuccaaacgaccauuuuaucuucgugc

SEQ ID NO: 11937 - RNA, 64 nt, Human
gucggagccacugguccugcugcuggcugccucucugcuccaccuugugacccaggguggggac

SEQ ID NO: 11938 - RNA, 64 nt, Human
aucugcgugugucugugaccgccugucucaguggcacggccacuuccuuucuguagcuggguua

SEQ ID NO: 11939 - RNA, 64 nt, Human
agauacacaaaauuccaccccaugaucaagaauccugcuccacuaagaauggugcuaaaguaaa

SEQ ID NO: 11940 - RNA, 64 nt, Human
accccauccuucuccaccaaagacaguugcgcgccugcuccacguucucuucugucuguugcag

SEQ ID NO: 11941 - RNA, 64 nt, Human
acggcuggggacccacccagccccucuccccucucugcuccagacucacuugccauugccagga

SEQ ID NO: 11942 - RNA, 64 nt, Human
aggggagaauccccuccuguucacucucccaacccugcuccagccccucagcuucccagacccu

SEQ ID NO: 11943 - RNA, 64 nt, Human
gcccaggccaaccuugccgggcuguuucccgaggcugcuccagggagccccgaggcccgcugga

SEQ ID NO: 11944 - RNA, 64 nt, Human
aggcagaccacugcccuuccgaccucaguccugucugcuccagucuugcccagcucgaaggaga

SEQ ID NO: 11945 - RNA, 64 nt, Human
ccaugaggaugaccagcaaaauucaagaacaaaacugcuccaacagacuuuuuuaaaggaaaaa

SEQ ID NO: 11946 - RNA, 64 nt, Human
aaggagccagcggccgacaaagcagaaacacccgcugcuccacguagccccugcucgcuguccu

SEQ ID NO: 11947 - RNA, 64 nt, Human
ccaggcaguggcugcagagggagccuccugcucccugcuccaggaugaaaccaagagggggaug

SEQ ID NO: 11948 - RNA, 64 nt, Human
cggccuucucacgucagugcaugucacaugcauccugcuccaggacugguuuccuagccucccg

SEQ ID NO: 11949 - RNA, 64 nt, Human
uuuggagucugacuggagucucgcauccuggggccugcuccauccaucccuccugggcgccaga

SEQ ID NO: 11950 - RNA, 64 nt, Human
agggucccucaaagcuucuguggcuucguggucacugcuccagccucagccagggcagggaggg

SEQ ID NO: 11951 - RNA, 64 nt, Human
augauggacaaaggccuggcgucggccagaggggcugcuccagugggcagggguagcuagcgug

SEQ ID NO: 11952 - RNA, 64 nt, Human
ccuuuccccagccucuccuccuugggcagggucucugcuccagcaagcaaacaggguggcccag

SEQ ID NO: 11953 - RNA, 64 nt, Human
ccgcgcccccgugcccccaggcccagccgccgcccugcuccaggcucuaggacugcgcgaugag

SEQ ID NO: 11954 - RNA, 64 nt, Human
cccgccucguccacgccugcgcccacuaucaucccugcuccagcugcccccgggaagccagccu

SEQ ID NO: 11955 - RNA, 64 nt, Human
agcugacaggguaccugcuccgggccagcgccaucugcuccaaguugggccuggccuuccugca

SEQ ID NO: 11956 - RNA, 64 nt, Human
aggccggaccacgugcaauaggguggaaaccaaacugcuccaugccggguuauuuaaaagaaag

SEQ ID NO: 11957 - RNA, 64 nt, Human
ccugagcgaccaggacuacauuucccaagaggcucugcuccaggaguccaggaaagacgaggca

SEQ ID NO: 11958 - RNA, 64 nt, Human
ugcucucugcccaucccagcugcacccuagcucccugcuccagggaugugagcacccacucccu

SEQ ID NO: 11959 - RNA, 64 nt, Human
ccucuaccaagccacuccaagagccagccccuuucugcuccacaaaaaccacaguuauuggaaa

SEQ ID NO: 11960 - RNA, 64 nt, Human
ccgccccaccacacuccccgccuguccugccucucugcuccagagagaggaugcagaggggugc

SEQ ID NO: 11961 - RNA, 64 nt, Human
uuuuucugacaugguuuucaggucuaaauaguggcugcuccaguccaugaacucaaagguuuga

SEQ ID NO: 11962 - RNA, 64 nt, Human
aucaaaguauuguccagacaagagucacuggccccugcuccagcuucuggguauccagagagca

SEQ ID NO: 11963 - RNA, 64 nt, Human
ugagcuaccuuggugaacucaugaccccaggccccugcuccaccaggaugucccccagguccug

SEQ ID NO: 11964 - RNA, 64 nt, Human
uaaaaaggaaggaaggagcaagugaaguuucauucugcuccagcgguggggaagccgcugaauc

SEQ ID NO: 11965 - RNA, 64 nt, Human
ugaacaugauccugaccuuuaccuaggauuccuccugcuccaaacuuugcccauccucuuugcc

SEQ ID NO: 11966 - RNA, 64 nt, Human
ucccugcuggcagacggcagaucccucaggaaaccugcuccacuugucagggucucuucggaga

SEQ ID NO: 11967 - RNA, 64 nt, Human
cagacagccaggccaggguaggcagugccugcuucugcuccaucaggugcaggggauuuggcug

SEQ ID NO: 11968 - RNA, 64 nt, Human
gcugccccacacaagggugcacugagugucguggcugcuccaaaugccccuucaugagcuuauu

SEQ ID NO: 11969 - RNA, 64 nt, Human
aauuuucccgacgaucuuccuggcuccaacacugcugcuccagugcaggagacuuuacauggau

SEQ ID NO: 11970 - RNA, 64 nt, Human
gcugugguaugagcuaugaccaagagcaggcuuccugcuccauggaguccugaguugcucuggg

SEQ ID NO: 11971 - RNA, 64 nt, Human
cuggccaggagcucuucaggccucccucucucuucugcuccacccuuggccugucucaucccca

SEQ ID NO: 11972 - RNA, 64 nt, Human
acugaccauccacucuacccucccacccccuucucugcuccaccacauccuccguccagccgcc

SEQ ID NO: 11973 - RNA, 64 nt, Human
gcccagccuuguaaauaaccacaagguccacucccugcuccacgaagccuuaagccauaggccc

SEQ ID NO: 11974 - RNA, 64 nt, Human
aagagcagagucugggccucugacucugaguccacugcuccauuuauaaccccagccugaccug

SEQ ID NO: 11975 - RNA, 64 nt, Human
ccuucugaggggucuccuguugccgugggagaugcugcuccaaaaggcccaggcuuccuuuuca

SEQ ID NO: 11976 - RNA, 64 nt, Human
acuguaucauaugcucaacucugaaaaccuugaacacggccaaaauccauaaagauuauaaaag

SEQ ID NO: 11977 - RNA, 64 nt, Human
uagcaaguguucaguaaauauuugcugcuugaaucugcuccagaauuaacaagaaagccaucuc

SEQ ID NO: 11978 - RNA, 64 nt, Human
gcugucaccugagacagugaauuaauguugacaucugcuccaaagccuuuuggaggggauuggg

SEQ ID NO: 11979 - RNA, 64 nt, Human
ccaguaugcacccagaggggacucagcuucaaagcugcuccaccaugcugggucccaggcagcu

SEQ ID NO: 11980 - RNA, 64 nt, Human
ccaggcccgccucccccuccacacucaggauguccugcuccaucuggccggcucacuccgugug

SEQ ID NO: 11981 - RNA, 64 nt, Human
gguaggcucugagcaagcuggcgaacagcccuggcugcuccaaaaccaaaaagcuggguccucu

SEQ ID NO: 11982 - RNA, 64 nt, Human
aguguaaaaguuguuaucuggacgaucugucucucugcuccaaagaaauuuuggagugaguggc

SEQ ID NO: 11983 - RNA, 64 nt, Human
gggacgagacaagcucccgaagcccgccagcuuccugcuccacucagcuccguccagucaaccu

SEQ ID NO: 11984 - RNA, 64 nt, Human
ugcguuggcggccuggguguuggcgguuccgugccugcuccaacucuccgugaggccccucucc

SEQ ID NO: 11985 - RNA, 64 nt, Human
gaguagccugcccaccgcucugucuccuggccgucugcuccaggcgcagcuggggcugaggaug

SEQ ID NO: 11986 - RNA, 64 nt, Human
gccacaggaagggcugagcuggaggugggcagggcugcuccaggcaggucagagcagugcaggg

SEQ ID NO: 11987 - RNA, 64 nt, Human
ccgucuguuuguagggcugccaggcugcagccugcugcuccagggagcaccagcugcagcugau

SEQ ID NO: 11988 - RNA, 64 nt, Human
gccugggacucagaccaggaagcugugggcccuccugcuccacccccaucccacucccacccau

SEQ ID NO: 11989 - RNA, 64 nt, Human
aagcagcucaucccuuccuggggaccacacugcucugcuccaccagaccacacuaugaaauagg

SEQ ID NO: 11990 - RNA, 64 nt, Human
ggcaggagguggcaucuugucucgucccugaugucugcuccagugauggcaggaggauggagaa

SEQ ID NO: 11991 - RNA, 64 nt, Human
ugcuguccacaugaccuccauuucccaaaguccucugcuccagcaacugcccuuccaggugggu

SEQ ID NO: 11992 - RNA, 64 nt, Human
acccugcauuuuccucuuguccuggcccuucagucugcuccaccaaggggcucuugaaccccuu

SEQ ID NO: 11993 - RNA, 64 nt, Human
uguacgugcacucugucaucuccuuggucacccucugcuccaggccuucuccaccacaggaccu

SEQ ID NO: 11994 - RNA, 64 nt, Human
gggcccucugccuaugggcacccaauccaagcagcugcuccaccuuuguuuggcauggugauuu

SEQ ID NO: 11995 - RNA, 64 nt, Human
cuuuggggcugacccccuccauugccauaacauccugcuccauucccucuaagauguaggaaga

SEQ ID NO: 11996 - RNA, 64 nt, Human
cccacaacgugcaacugacacucccacccagucucugcuccaccuuucagcccacgucacgugu

SEQ ID NO: 11997 - RNA, 64 nt, Human
ucuuccccucucagagcuacuugggccauagcuccugcuccacagccaucccagccuuggcauc

SEQ ID NO: 11998 - RNA, 64 nt, Human
acccauacuccucuucacccuguagcagggucuucugcuccagucaccccggccucuugcaaga

SEQ ID NO: 11999 - RNA, 64 nt, Human
guaagagaagccauuuuggaaauucacgaaaguacugcuccaccccaguugaguuauuuagaau

SEQ ID NO: 12000 - RNA, 64 nt, Human
ccacuauucucagcagccaaccaggauuuggcagcugcuccacuguuacgguugagggaacagg

SEQ ID NO: 12001 - RNA, 64 nt, Human
ggucagaucacaccugauggcuuccugucaaaaucugcuccaucagagcuuauaaauaugacag

SEQ ID NO: 12002 - RNA, 64 nt, Human
cguguagacacacgacaugcaagaguugcagcggcugcuccaacucacugcucacccucuucug

SEQ ID NO: 12003 - RNA, 64 nt, Human
cugauuggggaaaagguugaauuugugaaacaaucugcuccaaccuucuauuuuaauuauuauu

SEQ ID NO: 12004 - RNA, 64 nt, Human
gugaauuacaggucacaugaaaccaaaacgggcccugcuccauaagagcuuauauaucugaagc

SEQ ID NO: 12005 - RNA, 64 nt, Human
ccuugcaaguucauggccugucccucccagaccccugcuccacuggcccuucgaccaguccucc

SEQ ID NO: 12006 - RNA, 64 nt, Human
auucuaucagaacucugggccgucuaacuggcagcugcuccaggggcugccagggacugcucac

SEQ ID NO: 12007 - RNA, 64 nt, Human
gucccuggccuuguccaucugauucaggagaucacugcuccaucgugaggagcccucugaauag

SEQ ID NO: 12008 - RNA, 54 nt, Human
aaagcugcucauugaaauagauuccugcuccauggaguucaugcaaccuggugc

SEQ ID NO: 12009 - RNA, 64 nt, Human
ucccgggagcacggcuggggccuuucuugaucuccugcuccaccaaggcucuggggaaccugag

SEQ ID NO: 12010 - RNA, 64 nt, Human
guccccaccaucugcugucuuuucuuugccaucucugcuccaaccgggaugggagccgggcaaa

SEQ ID NO: 12011 - RNA, 64 nt, Human
gccucccaaacagggcugcugguuuccgcagccacugcuccaccucccccaaaucgucauggaa

SEQ ID NO: 12012 - RNA, 64 nt, Human
aggacgcuucacaggacaggaaaguggcaccugucugcuccagcucuggcauggcuaggagggg

SEQ ID NO: 12013 - RNA, 64 nt, Human
gaauuccacccgccuugcuuuaagacaaacagggcugcuccaacuaguuuugugucagcuucca

SEQ ID NO: 12014 - RNA, 64 nt, Human
gaagucugcaucaaaguaaaguucuucugaagugcugcuccauguuuccaccaaaugaauuuuu

SEQ ID NO: 12015 - RNA, 64 nt, Human
caggcacuguuuuguggcccaugcuaggcaguggcugcuccaugagcccuuuguggaccacaug

SEQ ID NO: 12016 - RNA, 64 nt, Human
cucugugucuggcuaguauugaaaacuagauaaacugcuccaaaccaacauggaguaaagagca

SEQ ID NO: 12017 - RNA, 64 nt, Human
cuggagccguagauuccgugccugccgccgcagcgccgccgacaacgcgggugcaggggggcgc

SEQ ID NO: 12018 - RNA, 64 nt, Human
cucuguccucucagccuguggccuccacauccccgccgccgaggccuagccuccgcccucucag

SEQ ID NO: 12019 - RNA, 64 nt, Human
gacuacagcgcucccggcugagcgcgccccccgagccgccgacuugccgucuccccguaaugcc

SEQ ID NO: 12020 - RNA, 64 nt, Human
uccugggaugagugccagccugagccugcauggugccgccgagcccgggguggaggagggagcc

SEQ ID NO: 12021 - RNA, 56 nt, Human
ugucccugucgcacguguaggaggcugccgccgagggacucggccggagagcugag

SEQ ID NO: 12022 - RNA, 64 nt, Human
uguaguuaucguuaguuccucuucccgagauggggccgccgagagaccccagcgccuuugaaaa

SEQ ID NO: 12023 - RNA, 64 nt, Human
augaugccccagagcucuaaccaaagguuuugcagccgccgaaaaacaggaaaguugggaagcg

SEQ ID NO: 12024 - RNA, 64 nt, Human
guuuaccgcccacccagcagcgcccgaggccagggccgccgaagggcagccccgcgaccacccc

SEQ ID NO: 12025 - RNA, 64 nt, Human
ucucccccacuuccuuacuuuagcgggcugcaaugccgccgauaugauggcugggagcucuggc

SEQ ID NO: 12026 - RNA, 64 nt, Human
gugucacuggucaggugcuucucaccacgggaaagccgccgaccugugacucgcuugagauggg

SEQ ID NO: 12027 - RNA, 64 nt, Human
cugaaaucauguuucuuagagaaaugccucggaugccgccgacgcggugcugcugccgccgcuu

SEQ ID NO: 12028 - RNA, 52 nt, Human
cggcuugcuucaugggcuaggagccgccgagcccgggcucccgagagcaacc

SEQ ID NO: 12029 - RNA, 64 nt, Human
guucuccuguccggcccagacucuucuguguggcgccgccgaagccaccguuagcgcgagcugc

SEQ ID NO: 12030 - RNA, 51 nt, Human
uuccccagcgccgccgcugacgccgccgacgccgcccucggcccagaccuc

SEQ ID NO: 12031 - RNA, 64 nt, Human
cuaagaggagcuagagcuugccucacccgcuguagccgccgagagcccaggauguacuggcgga

SEQ ID NO: 12032 - RNA, 64 nt, Human
cucgauguacauagcuuuucucagcugccugcgcgccgccgacagucagcgcugugcgcgcgga

SEQ ID NO: 12033 - RNA, 64 nt, Human
ccgacuccgugguuuccguaucgucaacccuucagccgccgacccgggaggggucuggccuaca

SEQ ID NO: 12034 - RNA, 64 nt, Human
gagaaugaggguggcuuggaccccugggaaucaggccgccgagggcugagcuccagagccgcac

SEQ ID NO: 12035 - RNA, 64 nt, Human
uccccagcaccccuggaggaggcaggggcuccccgccgccgaggcugccugcccugggcccacc

SEQ ID NO: 12036 - RNA, 64 nt, Human
cccugggacgcagccacgccaggaggaggacacggccgccgagagcaaggcacaaccucgaguu

SEQ ID NO: 12037 - RNA, 64 nt, Human
caggggaaacaggccaccgccaaagccauggcccgccgccgagagcccaggccccacccgcacc

SEQ ID NO: 12038 - RNA, 64 nt, Human
gaacccggccaugaccugggcgggggcgcggggcgccgccgagcccccucuucccgccuugcgc

SEQ ID NO: 12039 - RNA, 64 nt, Human
aacuccccuacaucaaaugcucaagcccugaguugccgccgagaagcccacaagaucugaguga

SEQ ID NO: 12040 - RNA, 64 nt, Human
ccggggccgagccuccgggccugaauacgggccagccgccgaggccgccagagcagggccgccu

SEQ ID NO: 12041 - RNA, 64 nt, Human
ggggcaggagccccaucccagccgugguucuguugccgccgagcugcgacggccucagacuggg

SEQ ID NO: 12042 - RNA, 64 nt, Human
gccggaggagccgccggagcccgccugcccgcccgccgccgaaggagaggagccgccugcgcag

SEQ ID NO: 12043 - RNA, 64 nt, Human
cacucccuggggcucaagcgauccucccaccucagccgccgaaguagcugggacuauaggugug

SEQ ID NO: 12044 - RNA, 64 nt, Human
ugagcuuccagggcuuggguggcgucggggcagggccgccgaggcugggaggaagcccuucugc

SEQ ID NO: 12045 - RNA, 64 nt, Human
ccucccggccucccucgcacacugggaggaggaagccgccgagacugcagggagccuggccccg

SEQ ID NO: 12046 - RNA, 64 nt, Human
ccgauaccacgagcugcugcgggaggccaccgaggccgccgaguaccaggaggcccuggagggc

SEQ ID NO: 12047 - RNA, 64 nt, Human
aacggugccucccacugcagccucugccugcucugccgccgaggcccggggaugggaugcggug

SEQ ID NO: 12048 - RNA, 64 nt, Human
gcugcgcgcgcucaugcacgcggccgccccgggagccgccgaccugcccugcugcgugcccgcg

SEQ ID NO: 12049 - RNA, 64 nt, Human
auguaucgccagccguugcuuuguuacugaacgugccgccgacgaccucagaaaacccagaugg

SEQ ID NO: 12050 - RNA, 64 nt, Human
guccaggagagggagcgccccuggcugccccucggccgccgacuggacgcgcgggccuugccag

SEQ ID NO: 12051 - RNA, 64 nt, Human
auuuaugcagagacagcuguuugaauuggaccccgccgccgacuugcggauuuccaccgcggag

SEQ ID NO: 12052 - RNA, 64 nt, Human
guacuguggaguuuugagggauggcaccguccaggccgccgagagccccucugccugugucgug

SEQ ID NO: 12053 - RNA, 64 nt, Human
acgcguggcaaacaagcacacgaaaagacguucagccgccgauggcuugguuauaauuuauaac

SEQ ID NO: 12054 - RNA, 64 nt, Human
auggguaccaggugggguuagguucccagaggacugagggaauccuguacaggaugucccaggg

SEQ ID NO: 12055 - RNA, 64 nt, Human
aaccggagucggguuuggggaaguugucaaggaaugagggaaaguaaauccucaugaggaaaag

SEQ ID NO: 12056 - RNA, 64 nt, Human
gaggacucgcagcucucccuuuccccagccaggaugagggaauuagacaauggaagucgagcac

SEQ ID NO: 12057 - RNA, 64 nt, Human
acaugccucagcgcuguuacuugaaugccuucccugagggaagaggcccuugagucacagaccc

SEQ ID NO: 12058 - RNA, 64 nt, Human
ugugugugcgcgcgcgccagugcaagaccgagauugagggaaagcaugucugcugggugugacc

SEQ ID NO: 12059 - RNA, 64 nt, Human
agccuccuugaaguuuacuaacaauugggauaacugagggaagagaagugacaauuccacucag

SEQ ID NO: 12060 - RNA, 64 nt, Human
uaguguagcucuagagggauauaccccagauggcugagggaagaaagggauugaggugguagga

SEQ ID NO: 12061 - RNA, 64 nt, Human
augugggaccuucucuugccauggccucaggucuugagggaaggcucgggccuagguuucugga

SEQ ID NO: 12062 - RNA, 64 nt, Human
auaucuguccccugcuacuagauugugagcuccuugagggaaaggaacaugauuuauuuguccu

SEQ ID NO: 12063 - RNA, 64 nt, Human
cucaccuucagcuccugcaccgacaucaggaacccacggccaccaccuccuccccucaaggcau

SEQ ID NO: 12064 - RNA, 64 nt, Human
ccugucuacaucuacagcuguucacuggaagcgcugagggaacaaaugguuggcaugcagcccc

SEQ ID NO: 12065 - RNA, 64 nt, Human
guggaagacgagggauugccaucgccuaugaggaugagggaagcggcugauaccauguggggcu

SEQ ID NO: 12066 - RNA, 64 nt, Human
aaggcacugccaaacaagaugcccuugggagcugugagggaaagaggaccugcgggcuuagauc

SEQ ID NO: 12067 - RNA, 64 nt, Human
uuagguagauugccuuaaagguuaugggagggcaugagggaacacuucuuaugagaaaacauuu

SEQ ID NO: 12068 - RNA, 64 nt, Human
cagaugauaucaggaugugguuuccagcuuugccugagggaauuccaacaugagauuaugggcu

SEQ ID NO: 12069 - RNA, 64 nt, Human
ggcagucuuucuaggcgaaccaagaauguuugugugagggaagguguuugcuguugcuuuacug

SEQ ID NO: 12070 - RNA, 64 nt, Human
ccagugaccagagcacccagggcuggccagucacugagggaacagcgucucggaacugcugguc

SEQ ID NO: 12071 - RNA, 64 nt, Human
uuggaugagaaagaugggcaauccugggcuggcuugagggaaucaugggcagaggaugaggugg

SEQ ID NO: 12072 - RNA, 64 nt, Human
ggaaggacuuuggguuaggaaggaaucaugaggaugagggaagaagaaagaguaauuacuguuu

SEQ ID NO: 12073 - RNA, 64 nt, Human
ccagagaccuggacuuuugucugcuuaagggaaaugagggaaguaaagacagugaaggggugga

SEQ ID NO: 12074 - RNA, 64 nt, Human
aggguuagaacagggugucccagacucucucuucugagggaagguugguugcaaaagugggauu

SEQ ID NO: 12075 - RNA, 64 nt, Human
gcauuuugauuauuucauuucuggaggaugaccuugagggaagcuuuuuaauauuaguuucaag

SEQ ID NO: 12076 - RNA, 64 nt, Human
gacccagagccaccaaagucacauccacaacuaaugagggaaaucuguaaagccaguuagauag

SEQ ID NO: 12077 - RNA, 64 nt, Human
ucuuucucuuggucaacucaggagccuuuuagucugagggaauggagaggcaaagaaagaaggg

SEQ ID NO: 12078 - RNA, 64 nt, Human
ccugcacguguccgccguagcuuuaccauuuuagugagggaagccagcccgggggugggagggg

SEQ ID NO: 12079 - RNA, 64 nt, Human
cugccccuuucugguuuaaaaaaauggugcuugaugagggaagguagacucuucccuaggacug

SEQ ID NO: 12080 - RNA, 64 nt, Human
cugcugucuagugcucaaaacuugcagcuagaauugagggaagagagagaccuucuuauauugu

SEQ ID NO: 12081 - RNA, 64 nt, Human
ugguaaaacuuuuaaauucaacaccugaaaaucaugagggaaaaugauuaccucuugagauaua

SEQ ID NO: 12082 - RNA, 64 nt, Human
agagggcugggagaaggggugauuagaagcagagugagggaacuaaauggagcccugacugcac

SEQ ID NO: 12083 - RNA, 64 nt, Human
aauuugcugacuccuacuuuauaggcugagucaaugagggaagaugacuggcguuuccucuguc

SEQ ID NO: 12084 - RNA, 64 nt, Human
cuucaguuaguuuuuaaaugggaauaaauauauaugagggaaugcuacacagcacuccucuugu

SEQ ID NO: 12085 - RNA, 64 nt, Human
cauuuucuuaugugagguggggaagggaaagguaugagggaaagagagucugagaauuaaaaua

SEQ ID NO: 12086 - RNA, 64 nt, Human
gguguauucugcccugcgcaucccacccgaggacugagggaaccuaggggggaccccugggccu

SEQ ID NO: 12087 - RNA, 64 nt, Human
aaagguugggguggccauaaugguuuguugggggugagggaaaaaacccacagggaccagaaug

SEQ ID NO: 12088 - RNA, 64 nt, Human
ggggcuaaccuuggggacuccaauuugccaaugaugagggaacauuugaaagaacugcaaauug

SEQ ID NO: 12089 - RNA, 64 nt, Human
cuaccuucucuuaagcaaucaguguguaaagauuugagggaagaaugaauaagagauacaaggu

SEQ ID NO: 12090 - RNA, 64 nt, Human
ugcucagggguggguauccagagagccauacuucugagggaagacuggcuggcaauaaagucaa

SEQ ID NO: 12091 - RNA, 64 nt, Human
ccuguggcucaggggagcaagcuuacacaagaagugagggaaggauguuuagcaguggcuggug

SEQ ID NO: 12092 - RNA, 64 nt, Human
cgggcauagcuggagcuggaaucugccuccggugugagggaaccugucuccuaccacuucggag

SEQ ID NO: 12093 - RNA, 64 nt, Human
ccacccucagcuccucacuguucucagagggaugugagggaacugaacucuggugccgugcuag

SEQ ID NO: 12094 - RNA, 64 nt, Human
cagacuuuccucuagucuccggguugggggugggugagggaauggggugggagucgggggaagu

SEQ ID NO: 12095 - RNA, 64 nt, Human
auuuaguagauauuugacaguuuguguagguauuugagggaaaaaacucaauguuuggcuuuuu

SEQ ID NO: 12096 - RNA, 64 nt, Human
ccagcagcugccacuuggggcugcagagcucuguugagggaacugcccagggcuggguagaggc

SEQ ID NO: 12097 - RNA, 64 nt, Human
guucuauaacaugaacauaagugcuuagcugccaugagggaaaaguaaugagagaaguuucuag

SEQ ID NO: 12098 - RNA, 64 nt, Human
gcuuaaauauauaauacauuuuuuuccauggaagugagggaauauuucaguuuccugaaguaug

SEQ ID NO: 12099 - RNA, 64 nt, Human
gaugcugcuguguggagaagguucugagaugcagugagggaagaaaggauccugcuggggauuc

SEQ ID NO: 12100 - RNA, 64 nt, Human
cuauguacauacugcuuauugaugugcugugauaugagggaaucugaaauguuucauaaaaaua

SEQ ID NO: 12101 - RNA, 64 nt, Human
cgcuguuguauauucuauagcguuccuuauucuuugagggaaacugugcuugcugugauccauu

SEQ ID NO: 12102 - RNA, 64 nt, Human
aaguaaagagacuccugcauuccuccuccccuccugagggaagcccauggacaagcucagucca

SEQ ID NO: 12103 - RNA, 64 nt, Human
aaacaaaauuauucucugagagggaaaggacauuugagggaaacaucaaauuuccccauaaaua

SEQ ID NO: 12104 - RNA, 64 nt, Human
cugugcaugccccaugaugaguuucuggccuaauugagggaaggaggaaauucauaccagcagu

SEQ ID NO: 12105 - RNA, 64 nt, Human
uguuggcguaggcuacagagaagccuucaagcucugagggaaagggcccuccuuccuaaauuuu

SEQ ID NO: 12106 - RNA, 64 nt, Human
gccauuuuuaugagguagucuaggcucaucuucaugagggaacugaggucuugggggguggggg

SEQ ID NO: 12107 - RNA, 64 nt, Human
gaguucugucuggucacuaucagaaggaacacuuugagggaaacccuggugcagccagcccuga

SEQ ID NO: 12108 - RNA, 64 nt, Human
cuuugaggaaaaaaagucaaagaaaaauuguauuugagggaaaaaaccaugaccaaguaaagga

SEQ ID NO: 12109 - RNA, 64 nt, Human
ucuauauguugcugaaacacacaggccauuucauugagggaaaacauaauaucuugaagaauau

SEQ ID NO: 12110 - RNA, 64 nt, Human
aauucuguaguuugccguaucauccaggaaaaccugagggaaaaaaauuauagcaauuaacugg

SEQ ID NO: 12111 - RNA, 64 nt, Human
uuacuaucuuauaguaauucaggcucuaauuagcugagggaaugaaacacacaaaaaucacuga

SEQ ID NO: 12112 - RNA, 64 nt, Human
augagccaaaaguuugucauuuaaaaguucauuuugagggaauaacauguaauauaauuugaaa

SEQ ID NO: 12113 - RNA, 64 nt, Human
ccacauuuuggaggacuuccucagcccuuuucauugagggaaaauauauuugaauuucuguuuu

SEQ ID NO: 12114 - RNA, 64 nt, Human
gcuucuaaguaaauacaauuuuuaaaaaaccguaugagggaacuguguagacaagguaccaggu

SEQ ID NO: 12115 - RNA, 64 nt, Human
gccuguuucuguccucacaccacagaaagaaaccugagggaaaacugagacgugagguuccuga

SEQ ID NO: 12116 - RNA, 64 nt, Human
gacccuuuuugcaaacauuuggugaccacacauuugagggaagacguggcguuaggugaagcag

SEQ ID NO: 12117 - RNA, 64 nt, Human
agguccacucagugacaaacacacacugaaggccugagggaagacugaggacaugggcucagug

SEQ ID NO: 12118 - RNA, 64 nt, Human
gauucugugucuacauguuauuuugaaguauaucugagggaaaaauaaaugaaaauuuucuuua

SEQ ID NO: 12119 - RNA, 64 nt, Human
ucugcacaucuaaacuuagauggaguuggucaaaugagggaacaucuggguuaugccuuuuuua

SEQ ID NO: 12120 - RNA, 64 nt, Human
gcugaucucagggaaauacaaauaacuugggagaugagggaaauaagaugaauucugugcuguc

SEQ ID NO: 12121 - RNA, 64 nt, Human
cagcuugggauguuaccuugccuuuuguuuguuuugagggaaguuuaaucuuuaaacucuuugg

SEQ ID NO: 12122 - RNA, 64 nt, Human
uagugauuucuaauauauaagaauaagguacuucugagggaauuuuauauuuucagaguuuaaa

SEQ ID NO: 12123 - RNA, 64 nt, Human
uucauguguuacaauaucaguuuccagaauaaagugagggaaaucaggucuuuauugauaaagu

SEQ ID NO: 12124 - RNA, 64 nt, Human
uguauacagaaaaugaaagaaacuaggguccauaugagggaaaacccaaugucaaguggcagcu

SEQ ID NO: 12125 - RNA, 64 nt, Human
ggaccuguggacagucggccuacuuacucugagcugagggaacacugaacaguaaaagcgucau

SEQ ID NO: 12126 - RNA, 64 nt, Human
aggaaaacuacugauacuuucagggguggcccaaugagggaauccauugaacuggaagaaacac

SEQ ID NO: 12127 - RNA, 64 nt, Human
uagugcaauuaaagaaacacggcuuguauuuuuaugagggaauucugcagcuagggauugugac

SEQ ID NO: 12128 - RNA, 64 nt, Human
cuggagcagggugaggcuggacuuuggggggcugugagggaaauauacugggguccccagauuc

SEQ ID NO: 12129 - RNA, 64 nt, Human
cugggagucagcaagcgagcacuuuauaucccuuugagggaaacccugaugacgccacugggcc

SEQ ID NO: 12130 - RNA, 64 nt, Human
ggcuaugugaacccacaguaaaccugaagguguuugagggaaaaacugcuauuuucugaaugaa

SEQ ID NO: 12131 - RNA, 64 nt, Human
ucaacaguuucaaaauaaaauaucauauaaauauugagggaaauguuuucauauuuuucaaaau

SEQ ID NO: 12132 - RNA, 64 nt, Human
gaagcaauauuauucaggucuuccuuguugcaagugagggaaauccaauuaaaacugguuuaaa

SEQ ID NO: 12133 - RNA, 64 nt, Human
gcuggcaggggcagugacccuuccaggguaccacugagggaagggccuggguucaagccucccg

SEQ ID NO: 12134 - RNA, 64 nt, Human
ugccaacauuucccuucuuccaguugcacuauucugagggaaaaucugacaccuaagaaauuua

SEQ ID NO: 12135 - RNA, 64 nt, Human
agcugcuucuggaccuuccagggcccaugcagggugagggaaaggguagaggucuuuucaccga

SEQ ID NO: 12136 - RNA, 64 nt, Human
uuuuuuaggcaguuauauuacuagauuaagcuugugagggaaugaaaauguuuuuuauuuguua

SEQ ID NO: 12137 - RNA, 64 nt, Human
cuagaacugaccuaagccacugauuaauauuuaaugagggaagguaggggagaaucuagccauu

SEQ ID NO: 12138 - RNA, 64 nt, Human
gagcaaagcauugagcaaaggggucccauagaggugagggaagccugaaaaacuaagaugcugc

SEQ ID NO: 12139 - RNA, 64 nt, Human
ggggauggcuaaaaccaucauaguacagguaaggugagggaauaguaaguggugagaacuacuc

SEQ ID NO: 12140 - RNA, 64 nt, Human
ggaccgggccuaccgcgaugcgcgcguggaacucugagggaagaguuagccccgguucccagcc

SEQ ID NO: 12141 - RNA, 64 nt, Human
gguaugggcugaaugcagccaucugagcaagggcugagggaagccaucaccuaacaccucuggc

SEQ ID NO: 12142 - RNA, 64 nt, Human
guauucuucuguaaugagaauagacuggaacaugugagggaaaaauauuuaaaaaaagauggca

SEQ ID NO: 12143 - RNA, 64 nt, Human
ggaaggaucccaggcacaugguucaucacgagcaugagggaacagcaaggggcacgguaucaca

SEQ ID NO: 12144 - RNA, 64 nt, Human
uauuaagacauaauuuucucccuucugaaaugagugagggaaguucauaagguaaauccuuccc

SEQ ID NO: 12145 - RNA, 64 nt, Human
uuuauuuuguauuaacaauaaaaauuccuaagacugagggaaauaugucuuaacuuuugaugau

SEQ ID NO: 12146 - RNA, 64 nt, Human
auauaauuuaacuguguuuuagguaacauguuaaugagggaaaauguuuaccaguguagcauug

SEQ ID NO: 12147 - RNA, 64 nt, Human
uuuucuuuaucuuauagcaggaaaaaaaaacuuuugagggaaauagaagggcugcguuacacaa

SEQ ID NO: 12148 - RNA, 64 nt, Human
ggagggagagagaggcaccccucugggaugcgggugagggaagguuggcugaaguuccuagucu

SEQ ID NO: 12149 - RNA, 64 nt, Human
uacauacagaauugcugacaggagcaggagacgcugagggaaacagcuggcaaugugacaaaag

SEQ ID NO: 12150 - RNA, 64 nt, Human
cgcuaagacaguaaaaauaaugaucaauaaauacugagggaacucagaggccagcgccggugcg

SEQ ID NO: 12151 - RNA, 64 nt, Human
ggcugcuaugccuguguguaaacuuggggauggcugagggaacauagacucacucuuccacauu

SEQ ID NO: 12152 - RNA, 64 nt, Human
gauaaaggaugaaauaaauucccagugcucaucaugagggaaacaugugacuauaccuuuccua

SEQ ID NO: 12153 - RNA, 64 nt, Human
accauccuuuugcuuauaugcuagauuuuucuggugagggaaggguuguguucuucaggggucu

SEQ ID NO: 12154 - RNA, 64 nt, Human
uuugguggauaggugggagggagcaaggggaguuugagggaaucagagcuugaugcuacuguac

SEQ ID NO: 12155 - RNA, 64 nt, Human
aaagugaugucuuugcacaggugagacuuugcacugagggaagggaaagggugaggauuuuggg

SEQ ID NO: 12156 - RNA, 64 nt, Human
ucacaugauggagguaugaggccuccgagauagcugagggaaguucuuugccugcugucagagg

SEQ ID NO: 12157 - RNA, 64 nt, Human
uggugacuggcucuuaucacuucuaguuuacaggugagggaaccaaguuucacagaggcuaagu

SEQ ID NO: 12158 - RNA, 64 nt, Human
ucccggcauggaagccaguauaagcauuuccaaaugagggaaaaguccuuggcucguuugaucc

SEQ ID NO: 12159 - RNA, 64 nt, Human
gguuuccauccuugagauucugaaguaugaagucugagggaaaccagagucuguauuuuucuaa

SEQ ID NO: 12160 - RNA, 64 nt, Human
ccuauauaaacauaucuugcuuuuaaaaaguucuugagggaauagcaacuuucccauggcugug

SEQ ID NO: 12161 - RNA, 64 nt, Human
caaauccagaauggugaaagaguccaacaauggcugagggaaguagagguuaagauauagcuca

SEQ ID NO: 12162 - RNA, 64 nt, Human
ccuuuacauacguaggaccaaacccucucuaccaugagggaagaagacacagcaaaugacagac

SEQ ID NO: 12163 - RNA, 64 nt, Human
auaauaaagaugaaaagagaagguacccuaaggcugagggaaagaauccuaacaaggaaaggca

SEQ ID NO: 12164 - RNA, 64 nt, Human
ccuuuuucccccuuugaaugaggucuuccauguuugagggaaagucuugcacuauugcauauau

SEQ ID NO: 12165 - RNA, 64 nt, Human
caugugaacagcuugcaccucauuuuaccaugcgugagggaauggcaaauaagaauguuugagc

SEQ ID NO: 12166 - RNA, 64 nt, Human
gggcuauugccaauacuagggucaaaaaugaauuugagggaacaguggguaagaaacuuuaugc

SEQ ID NO: 12167 - RNA, 64 nt, Human
uuuguuuuuuuuucuuuuuuuuaguugaaguuuaugagggaaauaccaguguucaguuuugaac

SEQ ID NO: 12168 - RNA, 64 nt, Human
aaugacaguagcauugaaguguuugcugcagaguugagggaaacccccagccacccucccggaa

SEQ ID NO: 12169 - RNA, 64 nt, Human
gaauccugguaaacaauaaagaagauucagacacugagggaaaaaaauaaagcuuuuuacuuaa

SEQ ID NO: 12170 - RNA, 64 nt, Human
auggaaagagccaaaaugucacaguuccuaucugugagggaauggagcacaggugcaguuagau

SEQ ID NO: 12171 - RNA, 64 nt, Human
gaaaguguuuuucuuuaaucaaaaguccuuagaaugagggaaacaaaauauuuauuuguuuugg

SEQ ID NO: 12172 - RNA, 64 nt, Human
uuuuuaaagagaacacuggacaacauuuuacuacugagggaaauagccaaaaaggcaaauaaug

SEQ ID NO: 12173 - RNA, 64 nt, Human
uaaaagggguucaucuuaacaaagucauccaugaugagggaaaaaguggcauuucauuuuuggg

SEQ ID NO: 12174 - RNA, 64 nt, Human
uuauaaugcaggggaaguacuacuccucaaauguugagggaagcuuccauaacauugaugacug

SEQ ID NO: 12175 - RNA, 64 nt, Human
aaucaauggcauuaaugaggagcacauucuuugcugagggaaauaacaguuuuuccaggcccua

SEQ ID NO: 12176 - RNA, 64 nt, Human
uucuuuuucucccccucccaucuuagucuuaccuugagggaacagucauaugagaaggaacuuu

SEQ ID NO: 12177 - RNA, 64 nt, Human
cuaggacgaaugacaggaagauuguugaaagccaugagggaaaaaauaaaccccaguucugaau

SEQ ID NO: 12178 - RNA, 64 nt, Human
aaagcuuucugcucagucaguuguguggggauggugagggaagaggggucacaugagggaggaa

SEQ ID NO: 12179 - RNA, 64 nt, Human
gucuggcugugugaguggcgucucucccuuccuuugagggaagcucagcuuucuuacgcgcuca

SEQ ID NO: 12180 - RNA, 64 nt, Human
augcacuaaccucccaaccugauuuccccgaaucugagggaaggugagggagugggaaggggga

SEQ ID NO: 12181 - RNA, 64 nt, Human
uccuuuucucccauuucuugcuagcuauugcaaaugagggaagaacauuauucaucucuccucc

SEQ ID NO: 12182 - RNA, 64 nt, Human
agguagucuucaaaaucuuggucaucuguuuggaugagggaaaguaccucaugaguugcacauu

SEQ ID NO: 12183 - RNA, 64 nt, Human
agacuuagcuccuguugucaugacggggacagagugagggaaugguaguuaaggcuucuuuuuu

SEQ ID NO: 12184 - RNA, 64 nt, Human
gauggguggcuuuaacaguuucacagcaggacacugagggaauauuucccuaucccuucaaaug

SEQ ID NO: 12185 - RNA, 64 nt, Human
gugugugcaaugccuuuuucugggggguggggggugagggaaaaccugguagugaauguguagu

SEQ ID NO: 12186 - RNA, 64 nt, Human
uaaaaauggaauuuugcaacauccuuuaauaaggugagggaagcaugaaccucagacuucuggc

SEQ ID NO: 12187 - RNA, 64 nt, Human
ccagccacugcuguggcccugcccagggcuugguugagggaacggcuucuggcuguauggcugc

SEQ ID NO: 12188 - RNA, 64 nt, Human
gagaaaauaaauaugugcuauuuccuuggcgaguugagggaauuugccaccuuacagaguuugu

SEQ ID NO: 12189 - RNA, 64 nt, Human
ucuggagggagagcggggggccucaguagccucuugagggaagugggacuccuggcuccccagg

SEQ ID NO: 12190 - RNA, 64 nt, Human
ccugauuucucugaacagaaaacaaaagagagaaugagggaaauugcuauuuuauuuguauuca

SEQ ID NO: 12191 - RNA, 64 nt, Human
caaugauggagggagccccugagagggaaucuggugagggaauccagacucccuucucucaagg

SEQ ID NO: 12192 - RNA, 64 nt, Human
auugaagugaucccuggucauccuaauaaugggaugagggaaguuuccagcagauuucaggcug

SEQ ID NO: 12193 - RNA, 64 nt, Human
gaauaccauacuacacaaugaucucugauuuugcugagggaaggaauuauauaugugccacuuu

SEQ ID NO: 12194 - RNA, 64 nt, Human
acauguuugcaaagucauguguuuucuuucucaaugagggaaaaacaauuuuauuaccugcuua

SEQ ID NO: 12195 - RNA, 64 nt, Human
uuaauagauggguuuuuaguaauugacaaauucaugagggaaagcauaugaucucuuuauuagu

SEQ ID NO: 12196 - RNA, 64 nt, Human
auaacuccuuucaguccucuggggcuccugucauugagggaagucguuacgccuuucacugcca

SEQ ID NO: 12197 - RNA, 64 nt, Human
aaaagguuaacuguauaaagaaucuaugacuuuuugagggaagugugauauauuaacaaauaua

SEQ ID NO: 12198 - RNA, 56 nt, Human
caguugagacugucgucuaagaacugugagggaaguuguggauaaaaaugguggaa

SEQ ID NO: 12199 - RNA, 64 nt, Human
auuuacaugguuuccuuugagacuaaaauagcguugagggaaaugaaauugcuggacuauuugu

SEQ ID NO: 12200 - RNA, 64 nt, Human
uaauauucacuuuggugcuacuacccccauuaccugagggaaacuggccagguccuugaucaug

SEQ ID NO: 12201 - RNA, 64 nt, Human
agggaagaccuucuuuggggccgugaugguggggugagggaauaugagugcguggugcgagugc

SEQ ID NO: 12202 - RNA, 64 nt, Human
cacuuguuccgggauggugugguggaagaggggaugagggaaagaaauggggggccugggucag

SEQ ID NO: 12203 - RNA, 64 nt, Human
ccacccaggccuggagcugggaugcaauguaggcugagggaaagacgucagguuccuuuaauca

SEQ ID NO: 12204 - RNA, 64 nt, Human
aucaugcuauguaaauauaagacuacuggcuuugugagggaauguuugugcaaaauuuuuuccu

SEQ ID NO: 12205 - RNA, 64 nt, Human
ccaggcuuguaauacccuucacauggaagauuaaugagggaaaucuuuauauucuguauaaaaa

SEQ ID NO: 12206 - RNA, 64 nt, Human
augcgccaccuccacgugagaacaagggugaaggugagggaagccccucaccuugggucuuuug

SEQ ID NO: 12207 - RNA, 64 nt, Human
agccucuguuuccagcucuuccgcccucucuggaugagggaacagaaguggaggaaacaaaaga

SEQ ID NO: 12208 - RNA, 64 nt, Human
uaacaaagcuaagcuugaacacuguugauguucuugagggaagcauauugggcuuuaggcugua

SEQ ID NO: 12209 - RNA, 64 nt, Human
auguauaaagugggguuucuuccauauugacaaaugagggaacagguggugucuaucuuguaua

SEQ ID NO: 12210 - RNA, 64 nt, Human
cguuugaaaaacacuauuagucuuucuaacacacugagggaaagauuaaaaucuguggaauaaa

SEQ ID NO: 12211 - RNA, 64 nt, Human
ccaaguggugcuaaacaauuuuucuuccaauguuugagggaagcagucuccugcgguucaguuc

SEQ ID NO: 12212 - RNA, 64 nt, Human
caacauaguuaauuuuuuucuaaccuugccacuuugagggaaggaaggguugggggaagggcaa

SEQ ID NO: 12213 - RNA, 56 nt, Human
gcagaauugguuucuucugagagucaugagggaaaaauguguuucaggccucuucc

SEQ ID NO: 12214 - RNA, 64 nt, Human
guaacgaucuuugcugggguuuuuugcuuuguuuugagggaaaugucuuggaguaaauuuuaag

SEQ ID NO: 12215 - RNA, 64 nt, Human
uugagcugcuggcuuuguucucucaagucaggucugagggaacccaucggcuucuguaauaauc

SEQ ID NO: 12216 - RNA, 64 nt, Human
cugaaucugucaagcuucaagaauaccagagaacugagggaaaauaccaaauguaguuuuauac

SEQ ID NO: 12217 - RNA, 64 nt, Human
uacaguuaggaaaguuuuuuucuuacaccgugacugagggaaacauugcuugucuuugagaaau

SEQ ID NO: 12218 - RNA, 64 nt, Human
acuuaacaauuaauuuucuaugaauugcuaauucugagggaauuuaaccagcaacauugaccca

SEQ ID NO: 12219 - RNA, 64 nt, Human
aaauaaguuucauaugcugcccucccucagauaaugagggaaccugggguacuuaaaaugccaa

SEQ ID NO: 12220 - RNA, 64 nt, Human
ggguggccugucuuuaagcaaugcuuuucucuugugagggaagacuguaacacagcugaacuau

SEQ ID NO: 12221 - RNA, 64 nt, Human
uccugggcuccuccccaucccccgugucucucacugagggaaagaaaauccccaagggcacugc

SEQ ID NO: 12222 - RNA, 64 nt, Human
ugaggccauccugaggaguuccuguuugggggugugagggaaaaucagcgcggauuuuaaaaag

SEQ ID NO: 12223 - RNA, 64 nt, Human
ucuaguuggcaaugucuuacauuuauguuaaguuugagggaauugguaguucaaguauaaguua

SEQ ID NO: 12224 - RNA, 64 nt, Human
aacuuuaaugccaucuuaggccuggaaguuagagugagggaaaugagcuuggcuucugggacug

SEQ ID NO: 12225 - RNA, 64 nt, Human
aggauuuggcagccuuccagaaugguauggaaucugagggaagauuuauguuucguuuuggagg

SEQ ID NO: 12226 - RNA, 63 nt, Human
aguuccaaguucgaaccugaagggagcauuugcugagggaauagucuugcacauuuuuucauu

SEQ ID NO: 12227 - RNA, 64 nt, Human
acauguagaugauaauaugauucaguagucaacuugagggaaauuuuuaaaaaacuauucucaa

SEQ ID NO: 12228 - RNA, 64 nt, Human
uccugggccucccagcccuccaguggccugugggugagggaagccagaaugacacaaagcaaug

SEQ ID NO: 12229 - RNA, 64 nt, Human
aguccuaaaaugaacaaacagauaugauuguguuugagggaaauaugucccuagcaggaaaaga

SEQ ID NO: 12230 - RNA, 64 nt, Human
agcuaauuuggucagcugaugggcauaauggaugugagggaaagaaaguuggaaaggaugaugu

SEQ ID NO: 12231 - RNA, 64 nt, Human
uguccucuggcuuaaggagugaagagguggcucuugagggaaauggucuggacuuauucccagc

SEQ ID NO: 12232 - RNA, 64 nt, Human
cuccuccagggcucucccuguccuuagccgauuuugagggaacccuguggcaccugucccugga

SEQ ID NO: 12233 - RNA, 64 nt, Human
uagccuggcugccucagaaagagcagucaggacuugagggaagcaucaaauucuauacccauaa

SEQ ID NO: 12234 - RNA, 64 nt, Human
uucacuauggaaaaacaaauauacaaauaugaaaugagggaaggcaagaaagaaccauguggaa

SEQ ID NO: 12235 - RNA, 64 nt, Human
uuuugcaaucccagucgguaugcuuucuaaaaacugagggaaacuuacuggggaaauagaauaa

SEQ ID NO: 12236 - RNA, 64 nt, Human
uucaccaccucaggguggagagacugaaugcuugugagggaauuaggaugguggaauauuggug

SEQ ID NO: 12237 - RNA, 64 nt, Human
ggaggaggaagcuggcgcugggggaggcugagggugagggaacagccuggaugugagagccggu

SEQ ID NO: 12238 - RNA, 64 nt, Human
uuuuaaugugacuaugcaacaugauagccaauggugagggaaaaggagguuucucuagaagagu

SEQ ID NO: 12239 - RNA, 64 nt, Human
uuuuccaguacauuaaauuugucaauuucaucuuugagggaaacugauuagauggguuguguuu

SEQ ID NO: 12240 - RNA, 64 nt, Human
uccucugcauuucuuuuaucuugauaacuccuagugagggaaucuaauuaagauuucaugcugu

SEQ ID NO: 12241 - RNA, 64 nt, Human
ucuuauuccuuugaagccauugcugugaauuacgugagggaaagauauugaagaggaguuggac

SEQ ID NO: 12242 - RNA, 64 nt, Human
auuccuccuuuugguaaacaacucaauuuuccuuugagggaacccucccccacccuuugaagag

SEQ ID NO: 12243 - RNA, 64 nt, Human
caauaguagucucaagaauggaaaccugaaugucugagggaaugggcugguagacuuuuucgaa

SEQ ID NO: 12244 - RNA, 64 nt, Human
aaagggguuaacuucagccaggauugauggcagcugagggaaauucuugcccaacuaaacccag

SEQ ID NO: 12245 - RNA, 64 nt, Human
cagagagagaggacagagggguaagaugagggguugagggaagguucuucaugauccacacuuu

SEQ ID NO: 12246 - RNA, 64 nt, Human
ccaacggcaucccaaggccaggugggcccucagcugagggaagguacgagcucccugcuggagc

SEQ ID NO: 12247 - RNA, 64 nt, Human
aggacacugauggguccugcugcucgggaaggccugagggaagcccacccgccccagagacugc

SEQ ID NO: 12248 - RNA, 64 nt, Human
uggagaaccuuuccuucaagcagaaacaagcaacugagggaaaaagaaacacaacaauaguuua

SEQ ID NO: 12249 - RNA, 64 nt, Human
cuauuuauuaucgcauacagauauucuaagucguugagggaaugacaccaucagacauuauaag

SEQ ID NO: 12250 - RNA, 64 nt, Human
acauuccaggggucguuugcuuuucaggguuuucugagggaaagugcauaugaaauccuugacu

SEQ ID NO: 12251 - RNA, 64 nt, Human
cgauguaauuuaaugcuaaagaguacuuacagcuugagggaaaagcauaaaguuuuaguuaaau

SEQ ID NO: 12252 - RNA, 64 nt, Human
uucuuuuucuuuuuuuuuuuuuaacuuuauuccuugagggaagcauuguuuuuggagagauuuu

SEQ ID NO: 12253 - RNA, 64 nt, Human
ggaggaugcuggguccuggguucaagugcacaugugagggaaccccaguccgugggaagguggg

SEQ ID NO: 12254 - RNA, 64 nt, Human
ggugcuccucacacccagaccugggcaucuucauugagggaaagaaaacagucauugugcaaaa

SEQ ID NO: 12255 - RNA, 64 nt, Human
ucaguauuuuuuacuuuucacacugucuucccgaugagggaaggagcccagccagaaagcacua

SEQ ID NO: 12256 - RNA, 64 nt, Human
ugcugaaucuuuaaaauuuuaauauauuuuuuuuugagggaaaucuuucuaaaauguauuacgc

SEQ ID NO: 12257 - RNA, 56 nt, Human
gcucaacuccagggcuuugaggccagugagggaaguggcugggcccuaggccaugg

SEQ ID NO: 12258 - RNA, 64 nt, Human
uuacagccccugaguccuacacccagaaggcggcugagggaacugaggccagcauuuuuccucc

SEQ ID NO: 12259 - RNA, 64 nt, Human
auaaugaugccccgaugccuuccuggaaguucagugagggaaagucaguugagggacacaaaag

SEQ ID NO: 12260 - RNA, 64 nt, Human
agcugcagcaguccuagaguuuuccaggggguucugagggaaucuuugguccccaguacucauu

SEQ ID NO: 12261 - RNA, 64 nt, Human
gacgaauaaaugaaucacggcaauuucuuauaaaugagggaagucuuaagaccuuccauuuuuu

SEQ ID NO: 12262 - RNA, 64 nt, Human
aaaaaaaaguuguuugcuuaaaaaaaauuucaugugagggaaaaaaaaaaaaccuauuccagaa

SEQ ID NO: 12263 - RNA, 64 nt, Human
cuucuucaguuuuaacgaguaauuggauaaacccugagggaaaacggagguagauucagcaccu

SEQ ID NO: 12264 - RNA, 64 nt, Human
ugaaaaaggcauauugcuuccagauucugaugugugagggaaaauacugucacaaugaaaaucu

SEQ ID NO: 12265 - RNA, 64 nt, Human
ccuccaccagugagaccacggggccacuguggggugagggaaggagcgcuuggagucagagcuc

SEQ ID NO: 12266 - RNA, 64 nt, Human
acagcuuuuucugagacacagcugccagcaaaccugagggaaagagagaagauuagugcucggg

SEQ ID NO: 12267 - RNA, 64 nt, Human
uagcuauaaacuagguccaauaacaugcuucaugugagggaacugauggacagcugucuaauuc

SEQ ID NO: 12268 - RNA, 64 nt, Human
aguauaauccaugagagguguuuccaaaaggagaugagggaacaggauagguuucagaagaguc

SEQ ID NO: 12269 - RNA, 64 nt, Human
cuuuuaagacaaacuguaugugauuaaguuguuuugagggaacugaagaaccugauguagcccc

SEQ ID NO: 12270 - RNA, 64 nt, Human
cgggggagagaguuagcauguaugaauguaaggaugagggaagcgaagcaagaggaaccucucg

SEQ ID NO: 12271 - RNA, 64 nt, Human
auugugcccagcugggacucuugggcucugugccugagggaaaauguuucacaacuaguggcug

SEQ ID NO: 12272 - RNA, 64 nt, Human
caacuucaagccuuaaccuggaauuuucuggauuugagggaauucccaagccuaugaucuuuuu

SEQ ID NO: 12273 - RNA, 64 nt, Human
gaagguguucaauaaaaauucaaauaauuuguacugagggaaacaguuauacuacaaaucaugu

SEQ ID NO: 12274 - RNA, 64 nt, Human
aauaaugcccccuuuccccuuuucugggcuacuuugagggaaaacaaucuuaagaaaaauagga

SEQ ID NO: 12275 - RNA, 64 nt, Human
uggaaguuuaaaaauguacaaguccuuucagugaugagggaauugauuuuuuuuaaaagucuuu

SEQ ID NO: 12276 - RNA, 64 nt, Human
uuuuuuuuuguuguuguuguuguuuuacggucucugagggaauauaguaaaaaugcauaugcac

SEQ ID NO: 12277 - RNA, 64 nt, Human
ucuacuugcguugcuuuagggcaggauucuauuuugagggaaaagacaguauccuuauuaccuu

SEQ ID NO: 12278 - RNA, 64 nt, Human
gggagggugccccgucugacaccccugggguugcugagggaacgguuggaguggggaucggccu

SEQ ID NO: 12279 - RNA, 64 nt, Human
cuugugucccugccgcugaagaauggggcugcucugagggaaacgcugucugcugccuucauac

SEQ ID NO: 12280 - RNA, 64 nt, Human
aauggaccaaaggacuuaagaauuuggggggaagugagggaaaaacguuaggugcuaaccaccu

SEQ ID NO: 12281 - RNA, 64 nt, Human
aggcucagcucucaggcacccccuacacuucaguugagggaaaagcucaagugccuuaggcccg

SEQ ID NO: 12282 - RNA, 64 nt, Human
cugggcgccuggagcaguuucacucugugaggagugagggaacccuggggcucacccucucaga

SEQ ID NO: 12283 - RNA, 64 nt, Human
cauuguggcacauucuuagaguuaccacaccccaugagggaagcucuaaauagccaacacccau

SEQ ID NO: 12284 - RNA, 64 nt, Human
ggucacgagacugagucuacaggagcuuugggccugagggaaggcacaagagugcaaagguucc

SEQ ID NO: 12285 - RNA, 64 nt, Human
uaugcuccaugcuuugagucaccaaugaagcgggugagggaagaugagagggggaggugagagc

SEQ ID NO: 12286 - RNA, 64 nt, Human
aggcccacaacuuggggacuagaccaccuuauguugagggaacucugccaccugcgugcaaccc

SEQ ID NO: 12287 - RNA, 64 nt, Human
ucuucacaguguggcagcugcacuaaucuguuugugagggaauauccauucccucacucuacuc

SEQ ID NO: 12288 - RNA, 63 nt, Human
aacccccaccauuaagcuaaaguaaaacccuuuugagggaagagggagacuggggagaaggga

SEQ ID NO: 12289 - RNA, 64 nt, Human
ccugagaguccucggggagggguccuggaugugaugagggaaagggggauugggggauccggga

SEQ ID NO: 12290 - RNA, 64 nt, Human
ccaggauguuggccuggggaggccacagcagggcugagggaacucugcuaugugauggggacuu

SEQ ID NO: 12291 - RNA, 64 nt, Human
agcagaggcccagucaaaugagcauugcaucccaugagggaagcacgacagggcugauggugag

SEQ ID NO: 12292 - RNA, 64 nt, Human
aacacggucccugcccacagugcuuagggccuacugagggaaagaaguaaccaggcaacuacaa

SEQ ID NO: 12293 - RNA, 64 nt, Human
uccugagugcaacuuaauuaccaccauggcagggugagggaacauuugcaucgucagcugccuc

SEQ ID NO: 12294 - RNA, 64 nt, Human
uguggugggaggagaggggauagucuacagcuaaugagggaaacaccaaagaucacaucauuaa

SEQ ID NO: 12295 - RNA, 64 nt, Human
caaaauuuuacaaauguuccugaaguguaucgauugagggaauuauuuuauucuagccugucau

SEQ ID NO: 12296 - RNA, 64 nt, Human
ggaguuguugugaaaaaaaaaaccccagugcuugugagggaacucaaaauaguuaccagaaaaa

SEQ ID NO: 12297 - RNA, 64 nt, Human
gcaucaguuaggugggucugggugagaguuauagugagggaauggucacuaaaguauccugaca

SEQ ID NO: 12298 - RNA, 64 nt, Human
ucaguauuuuaauaugguuacauuuagccaaaguugagggaaagagcuuauaaaauuuaacuuc

SEQ ID NO: 12299 - RNA, 64 nt, Human
uguagguuuuuuuguuguuguuaucuauaaaaauugagggaaaugguuaugcaaaaaaauauuu

SEQ ID NO: 12300 - RNA, 64 nt, Human
uggaggugaccgcugucaauaaaaagccggaggaugagggaaauaagauguguccauucauaug

SEQ ID NO: 12301 - RNA, 64 nt, Human
cugggcaccugguaccuggggaccuacaagguggugagggaaggguacgaguacauuccuuuuc

SEQ ID NO: 12302 - RNA, 64 nt, Human
auuaaaaaucacugcccuaacuacacuuccuccuugagggaauagaaauggaccuuucucugac

SEQ ID NO: 12303 - RNA, 64 nt, Human
uguuugccccugugugguuggucaaggagggaugugagggaaauagggaccccccgacuugccc

SEQ ID NO: 12304 - RNA, 64 nt, Human
cgugccucugugcuguguaugugaaccacccaugugagggaauaaaccuggcacuaggucuugu

SEQ ID NO: 12305 - RNA, 64 nt, Human
gaggaauaaaaaugaccuugagggcaccaaucugugagggaaguuaggaacccauuuccucccc

SEQ ID NO: 12306 - RNA, 64 nt, Human
aaaaaaagaaacauacauccuucaguauaggagaugagggaaugagagaaaauauuuuuugaag

SEQ ID NO: 12307 - RNA, 64 nt, Human
uuucagcauuuucauggaauuaauuuacacguaaugagggaaguccuaggauggauagaaaaaa

SEQ ID NO: 12308 - RNA, 64 nt, Human
uuaucuagguaggagggcuuuucuauacauuuucugagggaaagcagaacaccgggguuauagc

SEQ ID NO: 12309 - RNA, 64 nt, Human
guaccugcauugucuuggaauguaagcacugucuugagggaaggaagaggucuguucuguauug

SEQ ID NO: 12310 - RNA, 64 nt, Human
aguuuguggggaagaugcuggggaaggcuguguaugagggaauugugguggacgugccauuugc

SEQ ID NO: 12311 - RNA, 64 nt, Human
ugucuuuugagguugugcuguggggguuuggguuugagggaagggagcaggguggcgguugagg

SEQ ID NO: 12312 - RNA, 64 nt, Human
acaccaugagaauggaggcaggaauugagcugacugagggaagaugcaccuugaucucacccuc

SEQ ID NO: 12313 - RNA, 64 nt, Human
uuuucauccugugcuucuggaggacugauuuguuugagggaaucauucuaugcauuauauccua

SEQ ID NO: 12314 - RNA, 64 nt, Human
ucucuuaagcuauuagaaauauucccacuggggaugagggaaaaccccaugaaugcgggaaaug

SEQ ID NO: 12315 - RNA, 64 nt, Human
uacuggauggaaucuguaggaaacgguucuauuuugagggaagggggauuccuuuuuguuuuuu

SEQ ID NO: 12316 - RNA, 51 nt, Human
guauugagucugaugucugagugagggaacagagagguuaagguggguacg

SEQ ID NO: 12317 - RNA, 53 nt, Human
agcgccgagggaccaaaugagacugagggaagaaaaaaaaucucuuuuuuucu

SEQ ID NO: 12318 - RNA, 64 nt, Human
guugagaccuucuaauugguuuuuacugaaacauugagggaacacaaauuuaugggcuuccuga

SEQ ID NO: 12319 - RNA, 64 nt, Human
caugcugaacagaagggcaagagagguggaucugugagggaaaagacccaauaggauaacucaa

SEQ ID NO: 12320 - RNA, 64 nt, Human
cuccaccgcugccuaaguggcugcugacugauguugagggaacagacaggagaaaugcauccau

SEQ ID NO: 12321 - RNA, 64 nt, Human
ccugcuggaagcucugugggaaucagaugaaacuugagggaauugugacucuguucccuguuca

SEQ ID NO: 12322 - RNA, 64 nt, Human
guuaaauuuuugucauuuaucucugauggcacuuugagggaaaagaauguccacauacaguuuu

SEQ ID NO: 12323 - RNA, 55 nt, Human
ucacucuuuuucucuuucaggcccuugagggaaagcuacuugaucaaacauccga

SEQ ID NO: 12324 - RNA, 64 nt, Human
auuacuguuuauuacuuccaugaauuuuaaaaucugagggaaauguuuuguaaacauuuauuuu

SEQ ID NO: 12325 - RNA, 64 nt, Human
aauaaauaaauaaaaauaagccuguggccuguuuugagggaaaaguaacauaacucugauaauu

SEQ ID NO: 12326 - RNA, 64 nt, Human
uaauucacagaauggccucuugugggggugggucugagggaagucagcuauaaaacauuugcug

SEQ ID NO: 12327 - RNA, 64 nt, Human
gagacaagcacgucaagguguuuucacagcccccugagggaagggacgcagggucuccgacagg

SEQ ID NO: 12328 - RNA, 64 nt, Human
uccacuuguacaugcaauuuggacaguuauguguugagggaaauacaguuugguaccuuguuua

SEQ ID NO: 12329 - RNA, 64 nt, Human
cuaaguguggcugaugguagccucuaguuugaagugagggaagaaugaguagucaggaacuggu

SEQ ID NO: 12330 - RNA, 64 nt, Human
caaauuuaauauuuuuuuuucugaaugagaaacaugagggaaauuguggaguuagccuccugug

SEQ ID NO: 12331 - RNA, 64 nt, Human
cuggauuuguacauagccauucuagaaauagaguugagggaaauuauccauauacauaucacua

SEQ ID NO: 12332 - RNA, 64 nt, Human
ugggcacuagugcuaguagauauuacuacccuccugagggaaaucagaaaugauuuaaccccgg

SEQ ID NO: 12333 - RNA, 64 nt, Human
ucaguccauuuuaugaguuaacaauguauuuuguugagggaaguuuuuagggguuguuuugggu

SEQ ID NO: 12334 - RNA, 64 nt, Human
aauguuccuuaggaagaaaauaacauucuuggguugagggaaggaaugccauacacuacugucu

SEQ ID NO: 12335 - RNA, 64 nt, Human
uguuuuuaaauuaacaauggagagaaugauaagaugagggaaggaaaaggcauucauuauugac

SEQ ID NO: 12336 - RNA, 64 nt, Human
cauuaaaaaaaacaguuuagaugccuucuccuuuugagggaaaaagggugcuuuuuauuguaua

SEQ ID NO: 12337 - RNA, 64 nt, Human
augagguucuauuauaaagguucuacuuuuaaucugagggaaaacauguucagggcuucuagaa

SEQ ID NO: 12338 - RNA, 64 nt, Human
acugugaauaauuguauauaucucuaguuaagaaugagggaauggggagguuugcuuucuaaac

SEQ ID NO: 12339 - RNA, 64 nt, Human
aaaaccauguaguauuuucugauuuuuuuuuccaugagggaaaauaucuaauuuuuauaagacu

SEQ ID NO: 12340 - RNA, 64 nt, Human
acuagaaauuuauccuaaacagauggucuuucucugagggaaaaaaaaaaaugugucaugugag

SEQ ID NO: 12341 - RNA, 58 nt, Human
cuaucaaaaagcuaacaugacaaggaccugagggaaccaggauuccucccuccuacca

SEQ ID NO: 12342 - RNA, 64 nt, Human
ggcuuuggaauugggccucuggacagagucagaaugagggaauaaugaauaggucacaucuggu

SEQ ID NO: 12343 - RNA, 64 nt, Human
guucuugcugccccuucucuggcugugcuuugccugagggaagaguuggcaagaggccagaauu

SEQ ID NO: 12344 - RNA, 64 nt, Human
aaguagcuuuaagauaaagugguggucuuuuggaugagggaauaaugcauuuuuaaauaaaaua

SEQ ID NO: 12345 - RNA, 64 nt, Human
ucguggugcaggcaggcccuguggccugcugggcugagggaagucagagccccagggcgccacg

SEQ ID NO: 12346 - RNA, 64 nt, Human
cgaaaaguagucuucucugaggcugggccaagccugagggaaauggggcccuaggagggugggg

SEQ ID NO: 12347 - RNA, 64 nt, Human
auaaguuagaauguaaaagggcaguaauuaggggugagggaaaggagauaggggacccuaggag

SEQ ID NO: 12348 - RNA, 64 nt, Human
guuuuuuguuguuguuuauuuuugcuuuugugguugagggaaggacaagagauaagagguuguu

SEQ ID NO: 12349 - RNA, 64 nt, Human
uuuuucuggauauuauauguaagaauuuauuguuugagggaaauacgagguuucauuguuuaaa

SEQ ID NO: 12350 - RNA, 64 nt, Human
ucuaacuaguaucaagaucagugucagauauuguugagggaaguaauuuuauaaaguuacacaa

SEQ ID NO: 12351 - RNA, 64 nt, Human
gggucagacccgguguuugggugaagguaaggaaugagggaagaggagcucuuugggagaagac

SEQ ID NO: 12352 - RNA, 64 nt, Human
uccccauuuguuggauggcugcaaucucagugccugagggaagaugccuaguagaggaaagcuu

SEQ ID NO: 12353 - RNA, 64 nt, Human
ucagcagcggcuccugggaaaggccuggaaaggaugagggaacaggcaaggaacaaaggcaacc

SEQ ID NO: 12354 - RNA, 64 nt, Human
aguacaaagcccuaaguuuauuguaagugaaaacugagggaauuccugucuucuuuaggaguaa

SEQ ID NO: 12355 - RNA, 64 nt, Human
gcagggguuucuagaaguuggucaacagaucuggugagggaaguccccaggccagacgcuggac

SEQ ID NO: 12356 - RNA, 64 nt, Human
accaacuaaaugacagaugugugagaacaagaacugagggaaagcaccuucccccaccccagac

SEQ ID NO: 12357 - RNA, 64 nt, Human
aaacaguuauaacaguguuuaauuuagauaaguuugagggaaaauaaucaguaggcaagaggaa

SEQ ID NO: 12358 - RNA, 64 nt, Human
gcccgagcugaauacuugaaggagcaggucaagaugagggaaucucgcugggaagcugacaccc

SEQ ID NO: 12359 - RNA, 64 nt, Human
cuaagacuggagucuccuguggccuaacuuucaaugagggaaccggaugcuguucacacuuuga

SEQ ID NO: 12360 - RNA, 64 nt, Human
cauuggaaagcauggagagcuacauuucauaauuugagggaaaauuucuaacagaugccagaau

SEQ ID NO: 12361 - RNA, 64 nt, Human
gcuggaagccaguucuaggcuuccaggcgaaagcugagggaaggaagaaacuccccuccccguu

SEQ ID NO: 12362 - RNA, 64 nt, Human
agggauauggcuugaggagggaugggggcaggaaugagggaaggucuugggucaaggacaugga

SEQ ID NO: 12363 - RNA, 64 nt, Human
gccuacacaucccaauagaagccccuucuuaugcugagggaagcagcccucagaacaugauagc

SEQ ID NO: 12364 - RNA, 64 nt, Human
cacauguuuacacacucagugcccuaauuuccccugagggaaucgcuuuuuaagugauccuuac

SEQ ID NO: 12365 - RNA, 64 nt, Human
gaaaauggugugagccccaccgcugugcaucgaaugagggaaguggcagcagagaggccagagc

SEQ ID NO: 12366 - RNA, 64 nt, Human
cucuucaagcgggugaaaaaccucaugacaguauugagggaacaugggaauucauacugagaug

SEQ ID NO: 12367 - RNA, 64 nt, Human
aaguugggaagauauauugauuaugcuguucuguugagggaaaggucauguauuuagaaauuua

SEQ ID NO: 12368 - RNA, 64 nt, Human
uggauugauucagcucaccuuccaugauugcuuuugagggaaaagcuacaguggccacauuuca

SEQ ID NO: 12369 - RNA, 64 nt, Human
aaagcaguugagacaagaaaauaagagcucaggaugagggaaaagaaaaagauugagagaauuu

SEQ ID NO: 12370 - RNA, 64 nt, Human
gaaauguauucugcacccccggccccgcccaugcugagggaaggggagcaguugccaauauuug

SEQ ID NO: 12371 - RNA, 64 nt, Human
agaucccuuucugauuagccuacagaacuuaaagugagggaaccauuuccucucacagacaaag

SEQ ID NO: 12372 - RNA, 64 nt, Human
uucugguugaccucugcccgaucuucugucucucugagggaaucagaguccagcauccagcccc

SEQ ID NO: 12373 - RNA, 64 nt, Human
ggugauuauuuuggguggucagggaagugcucagugagggaagaacuugucaugagaaucucug

SEQ ID NO: 12374 - RNA, 64 nt, Human
ggagggaaucuguucccaggcccugccuggaaguugagggaaaguuuagacaucugcagagagg

SEQ ID NO: 12375 - RNA, 64 nt, Human
ccaaauuaagcuaccaugaaaagaagaggaaaagugagggaacaggaagguugggauucucugu

SEQ ID NO: 12376 - RNA, 64 nt, Human
ccauagaagagaggaagaaaacaaagggcaugugugagggaagcugcuuggguggguguuaggg

SEQ ID NO: 12377 - RNA, 64 nt, Human
uuuucuuccguuugauaauuaguugguuaaaagcugagggaaccggaaggaaagugcuaggugu

SEQ ID NO: 12378 - RNA, 64 nt, Human
gggcaucucugggcuggaugagcucccacaagccugagggaaaggccagcacucgcuagcagug

SEQ ID NO: 12379 - RNA, 64 nt, Human
uaagggcuggcauccacaucauuucacccugcagugagggaagaggccaccagguggcagcaca

SEQ ID NO: 12380 - RNA, 64 nt, Human
ggccuuaggagaccccguugccacggggggcugcugagggaacaccagugcucugucagcagcc

SEQ ID NO: 12381 - RNA, 64 nt, Human
aaauguauucugcaccccccggccccgcccaugcugagggaaggggagcaguugccaauauuug

SEQ ID NO: 12382 - RNA, 64 nt, Human
gcagaugcuuuuuauuaguacugauaaaacaaacugagggaaacaucccucuuagcugggaaac

SEQ ID NO: 12383 - RNA, 64 nt, Human
uuuugcccucugagaaaaggcaugguuucuuaauugagggaaggaagcagauucggaggggugg

SEQ ID NO: 12384 - RNA, 64 nt, Human
cuuccccacugagccccagcugcugagaaggccuugagggaaguagaggcugggagcaaaugcc

SEQ ID NO: 12385 - RNA, 64 nt, Human
ugaauguguccacaguugagagguuggagcaggaugagggaauccugucaccaucaauaaucac

SEQ ID NO: 12386 - RNA, 64 nt, Human
uguguguguguguuuguguguauuuuguaauaugugagggaaaucuaccuucguucauguauaa

SEQ ID NO: 12387 - RNA, 64 nt, Human
uaucacauaugauagagauauauaugcuguaaaaugagggaaaggaacuuucuaauaaaccaau

SEQ ID NO: 12388 - RNA, 64 nt, Human
aaccuugagcuauuuuaacacaguuuaaauauagugagggaaaacuccuaaguuuuacugcccu

SEQ ID NO: 12389 - RNA, 64 nt, Human
gauuugagggugaaaccaaagaaaacccccuaagugagggaaucuuuuaauauuuguggcuuua

SEQ ID NO: 12390 - RNA, 64 nt, Human
gaaauguauucugcacccccggccccacccaugcugagggaaggggagcaguugccaauauuug

SEQ ID NO: 12391 - RNA, 64 nt, Human
ccucaagagaacgugcuguggcccaugcugacguugagggaacaccuggagguguaugcugccg

SEQ ID NO: 12392 - RNA, 64 nt, Human
cuagcuuucacgagggucucgacccuggaccuccugagggaaacauggaaaaagcagugccaug

SEQ ID NO: 12393 - RNA, 64 nt, Human
auggggguuaguugcuuggcagccugccugccacugagggaagucccauuagagauguaucacc

SEQ ID NO: 12394 - RNA, 64 nt, Human
gcuuugucugccugcuuacuuguauauguaagcaugagggaaauacacuguugcuaauacugaa

SEQ ID NO: 12395 - RNA, 64 nt, Human
ucacaguggguggcaggugacuuuccggaggccuugagggaaaugcacacugucccauagccuc

SEQ ID NO: 12396 - RNA, 64 nt, Human
ugccaucccaagauuauguccucacuuauaacuaugagggaagaggaucuccagcugguucugu

SEQ ID NO: 12397 - RNA, 64 nt, Human
acuucaucuauuuguguacaaaaugaugucguuuugagggaauuuaaguauuuaaauugcuuca

SEQ ID NO: 12398 - RNA, 64 nt, Human
cccuuaagcuacagaauagaaauuuauuguguuuugagggaauauacuaaaugcagcuauguaa

SEQ ID NO: 12399 - RNA, 64 nt, Human
gcaugggcagagagggccacggggcagggcccacugagggaacaucaguggcccuccagucagg

SEQ ID NO: 12400 - RNA, 64 nt, Human
cucgucuggcugaacucugggagugugucccagcugagggaagcacaaguagcaaagcucauug

SEQ ID NO: 12401 - RNA, 64 nt, Human
cccacucacgaauauuaugcccaguuucugccucugagggaaagcccagaaaaggacagaaacg

SEQ ID NO: 12402 - RNA, 64 nt, Human
aaaccuuccaucuuauuggcauuuucugggguugugagggaaacggggauggcagucagacuca

SEQ ID NO: 12403 - RNA, 56 nt, Human
uccgcuuccugccccgcugaaggggcugagggaagggggucaaaggauuccagggu

SEQ ID NO: 12404 - RNA, 64 nt, Human
aucucuucucauccacccucuggcacccagccucugagggaaggagggauggggcauaguggga

SEQ ID NO: 12405 - RNA, 64 nt, Human
gggcugcugagucaaccuuuuauuguacaggggaugagggaaagggagaggaugaggaagcccc

SEQ ID NO: 12406 - RNA, 64 nt, Human
ccuucauuuuaaaaacccucaacaaauuacacauugagggaacauacuucaauaagaaccaucu

SEQ ID NO: 12407 - RNA, 64 nt, Human
ucacaccagagcaaugcucugugaguacccuuugugagggaaccaucagcuagcagaugagcac

SEQ ID NO: 12408 - RNA, 64 nt, Human
uuugcagcaugugucccauguuccccaacacuguugagggaaagcuguuccucaggaccugcug

SEQ ID NO: 12409 - RNA, 64 nt, Human
cacagcggggcucggagcauggcagcuaaguuagugagggaaggugagauggagguuuuggucu

SEQ ID NO: 12410 - RNA, 64 nt, Human
gaggacuucuggaacauuccaaauauucugggguugagggaaauugcugcugucuacaaaaugc

SEQ ID NO: 12411 - RNA, 64 nt, Human
guccugggaagaccaaaagaaaagcauuucaggaugagggaauggcaugcgcaaaggcccugag

SEQ ID NO: 12412 - RNA, 64 nt, Human
aagucaguguguuuuagaagggagguggcagcauugagggaaaccaggucaccauccacccucg

SEQ ID NO: 12413 - RNA, 64 nt, Human
uugcaugauuuggcauguuggggcacauuuggcgugagggaagcuggugcacauggguguccag

SEQ ID NO: 12414 - RNA, 64 nt, Human
auuugcuuuugauagaaaggacugcaguuugcuuugagggaaacuguggaaggcaccuucaggc

SEQ ID NO: 12415 - RNA, 64 nt, Human
guggugacauaccuuuccuuuugaguauaacuauugagggaaauauuuuggccagagagauguc

SEQ ID NO: 12416 - RNA, 64 nt, Human
agcaacaccaggccugucacacagaugaauguguugagggaaugaauaaguauuuccgucaaga

SEQ ID NO: 12417 - RNA, 64 nt, Human
uugaacaaaacauaaaaagccauuuuggagacagugagggaaguguggacauggacuaaauauu

SEQ ID NO: 12418 - RNA, 64 nt, Human
aaccuccccugugggugucacuggccagaugucaugagggaagcaggccuugugaguggacacu

SEQ ID NO: 12419 - RNA, 64 nt, Human
ccacucucugccuucacaguuguucaaagcugagugagggaaacaggaccuacgaaaacguguc

SEQ ID NO: 12420 - RNA, 64 nt, Human
gaacucccuccuccacugaacuccaacccugccuugagggaagaccacccuccugucacccgga

SEQ ID NO: 12421 - RNA, 64 nt, Human
gugcucagcugaaccgaugcugguugaggggccuugagggaaaucuaauuugagcucaggaaga

SEQ ID NO: 12422 - RNA, 64 nt, Human
aaugaacauguagcugcacuaugccagaaauuaaugagggaagacuuucuuccuaagugcuuau

SEQ ID NO: 12423 - RNA, 64 nt, Human
aggcugucucugccuucucugaugggacuggaguugagggaaggagcuguauuguggcacuucu

SEQ ID NO: 12424 - RNA, 64 nt, Human
uuaauauacucuaaaagccauacuaaaaaugcucugagggaacuggcuaagaauagugggccug

SEQ ID NO: 12425 - RNA, 64 nt, Human
aggauuuuuuuuuaaaccacagaacuugaauacaugagggaaccagaguucaaaguccuaugca

SEQ ID NO: 12426 - RNA, 64 nt, Human
agcuacuucucugagcucagaaagugccccuugaugagggaaaaugucccacugcacugcgaau

SEQ ID NO: 12427 - RNA, 64 nt, Human
agugucaggcaggacucacucaccgcugagcagaugagggaaguuuuagucuuggcggguggaa

SEQ ID NO: 12428 - RNA, 64 nt, Human
caugagccaaccuuagcuacaagguagggaguucugagggaagccgcgugcuccucaggagaga

SEQ ID NO: 12429 - RNA, 64 nt, Human
gaccaggcaccaggcagggucuagaaggcuguggugagggaagacgccuuucuccuccaaccca

SEQ ID NO: 12430 - RNA, 64 nt, Human
aaaagaauggauaaaugcaauauucuugaggucuugagggaauagugaaacacauuccugguuu

SEQ ID NO: 12431 - RNA, 64 nt, Human
ugggccuccaccgacugccugcucaccccugggcugagggaagggagaggagaggaacaagggc

SEQ ID NO: 12432 - RNA, 64 nt, Human
caccuucuauuuacucugugacuuuaugagagguugagggaaaaguggaagcuguacuugggaa

SEQ ID NO: 12433 - RNA, 64 nt, Human
cccuggcuagcccaaauggcacuaaggaggccacugagggaauccuccacguggcugucccagc

SEQ ID NO: 12434 - RNA, 64 nt, Human
agaguuaggaaacaccagcuccugccuggggcagugagggaaugggagcagcugugggcgccuc

SEQ ID NO: 12435 - RNA, 64 nt, Human
aggcggacugcggcgucagggggauagcggguggugagggaaggggcacgugcuagaccggcac

SEQ ID NO: 12436 - RNA, 64 nt, Human
agacggcagucgggccccagagcaagaaggcuggugagggaagggcucagcuucccaccccacg

SEQ ID NO: 12437 - RNA, 64 nt, Human
aaccuugugcuacuuaguaaaaauugauuacaauugagggaaguuugauagauccuuuaaaaaa

SEQ ID NO: 12438 - RNA, 64 nt, Human
ccuauguccacacuuaaccuuuaaagauguacauugagggaauaucaaaaaauagcguucaugg

SEQ ID NO: 12439 - RNA, 53 nt, Human
ucaaugguugcaccuuaugaccuugagggaaagccaguucauuuaagaggaaa

SEQ ID NO: 12440 - RNA, 64 nt, Human
aggaguccuguugaaauuaggaauaagugugcugugagggaagggcugccuuauuuuagagcac

SEQ ID NO: 12441 - RNA, 64 nt, Human
gccuguguccacuguggaaaguaguugauggaaaugagggaacacucaaagaguacauaugcca

SEQ ID NO: 12442 - RNA, 64 nt, Human
gugaccguccagccucacccgguggccugcacagugagggaagggcuucagggccaucugcucc

SEQ ID NO: 12443 - RNA, 64 nt, Human
cccaccccagcauccauacacguaggccuguugcugagggaaggcccucuagggucaucugguc

SEQ ID NO: 12444 - RNA, 64 nt, Human
gggucauaccaggaucugccucuguccacaaagaugagggaaaaugaugacugugcugugcucu

SEQ ID NO: 12445 - RNA, 64 nt, Human
ggauuuuaauguuuuucuaacaacuguggagauuugagggaauguguggugaauguaaaauacc

SEQ ID NO: 12446 - RNA, 64 nt, Human
gcaaaguuacaggccaguuuuuacuuguuugcccugagggaaaaauccuuuuaaaaaaaauuuc

SEQ ID NO: 12447 - RNA, 64 nt, Human
cccuacucucucgcagcucuugaaagcaucuguuugagggaaaggucucugggcaagcaagugg

SEQ ID NO: 12448 - RNA, 64 nt, Human
aggcccaaugcagaggagcccgcggagcaugugcugagggaagucugccuggugaggcuggcag

SEQ ID NO: 12449 - RNA, 64 nt, Human
uuaagaccccucucagggugccacugaugggggaugagggaaggcccucucucuacuccuugac

SEQ ID NO: 12450 - RNA, 64 nt, Human
cugacugaaccaugcccccaccuaagucacaaaaugagggaaguggggaguuagauuucagagu

SEQ ID NO: 12451 - RNA, 64 nt, Human
aacacagggcucccuguggugacaccaguggagaugagggaacggguagauggugugagugagg

SEQ ID NO: 12452 - RNA, 64 nt, Human
gggguaaggggcaggccagggcuguucacgcccaugagggaagaggaaagugccacugggcaag

SEQ ID NO: 12453 - RNA, 64 nt, Human
acccuccaaaggaacucuagagggcgagggaugaugagggaagcaauagguagcuggggagccc

SEQ ID NO: 12454 - RNA, 64 nt, Human
ggaaacgaaauucgagggaaauuccccggaaauaugagggaaaucucugcauugcaccaccaga

SEQ ID NO: 12455 - RNA, 64 nt, Human
aaccaggauuuggcagcugcuccacuguuacgguugagggaacagggaucaguccuguuagaag

SEQ ID NO: 12456 - RNA, 64 nt, Human
uguucccauccucuucuuuuagcaguaaaauagcugagggaaaagggagggaaaaggaaguuau

SEQ ID NO: 12457 - RNA, 64 nt, Human
ucacaguucucaguaguggggagcauguugggugugagggaacacaguguggaccaucucucag

SEQ ID NO: 12458 - RNA, 64 nt, Human
gugggccacacaagugcaguagugcaguucaccaugagggaagaauaaagagcugugggcaaaa

SEQ ID NO: 12459 - RNA, 64 nt, Human
accccugccccugugggacucauccuugcccaggugagggaaggagacaggaugaggucucgac

SEQ ID NO: 12460 - RNA, 64 nt, Human
uguagcgucuguauaauuauaauguugcccagugugagggaaagagcuuuccuacuugcacucu

SEQ ID NO: 12461 - RNA, 64 nt, Human
agugagagaaaaggggaugagugcagggcagaggugagggaacccaauagugauaccugguaag

SEQ ID NO: 12462 - RNA, 64 nt, Human
accuguuuauuguauuuuaaagugaaacugaauaugagggaauuuuuguucccauaauuggauu

SEQ ID NO: 12463 - RNA, 64 nt, Human
uugugucaucucauaaugguuggucuuuccaggcugagggaaauguuucuuguuuccagaguag

SEQ ID NO: 12464 - RNA, 64 nt, Human
ucauuaagaucaguuuuaagggguauagggagggugagggaagugggggguguuagguaagggu

SEQ ID NO: 12465 - RNA, 64 nt, Human
ugcuaaccaguucuuccauuaagccucggcugagugagggaaagcccagcacugcugcccucuc

SEQ ID NO: 12466 - RNA, 64 nt, Human
guuuuccuuauugauuacaacucagcuauaauccugagggaacaugggaaggaaucaaagguaa

SEQ ID NO: 12467 - RNA, 60 nt, Human
guacccaugcuccgugugucugugucugcauguccacacgucugaugcaccuguguacgu

SEQ ID NO: 12468 - RNA, 60 nt, Human
ucauuuaaacguauauuuagaacugcacuuuguccacaaccuucccuucucuuucuauuc

SEQ ID NO: 12469 - RNA, 60 nt, Human
aucccagccgacuacaccugcuucugguccuguccacauuuugauacgcagaucacuuga

SEQ ID NO: 12470 - RNA, 60 nt, Human
aaagggggcauggauuuacauugcaaaagguguccacaguguauuagugacauucuuuca

SEQ ID NO: 12471 - RNA, 60 nt, Human
ccccaagaggcucaugugacuaagaggaucuguccacauuuggggccuauccuuacuugu

SEQ ID NO: 12472 - RNA, 60 nt, Human
ugccuugucaaauucaaucucaauggccauuguccacauaacugaucacccauggcugcc

SEQ ID NO: 12473 - RNA, 60 nt, Human
gccaccccccaccuuacccuuauuccucucuguccacauuuucugccccaccuuacuucu

SEQ ID NO: 12474 - RNA, 60 nt, Human
ucauccucuccuugccaaaagauuuaaaccuguccacauugguggugaugaugggugagu

SEQ ID NO: 12475 - RNA, 60 nt, Human
ccugggguagccuguaguagacucggguccuguccacagcccuagcugccagcaaugcug

SEQ ID NO: 12476 - RNA, 60 nt, Human
agugguuguuucucuggucuugagugacuguguccacaguucauuuuuuuccgguaggaa

SEQ ID NO: 12477 - RNA, 60 nt, Human
ugaacugacuuuaguuuucaucuuauuuuuuguccacaugcuggugaugcugagaaacaa

SEQ ID NO: 12478 - RNA, 60 nt, Human
aauauaaaaauugguaaacuagaaguaacuuguccacaacccucaguuaugauacuuaug

SEQ ID NO: 12479 - RNA, 60 nt, Human
gaagccugacuguccuaugggcuucuccaguguccacaggggcuugggaugguugugggg

SEQ ID NO: 12480 - RNA, 60 nt, Human
ucgaauugugggugguuuuuugucuucuguuguccacagccagagcuuaguggaugggug

SEQ ID NO: 12481 - RNA, 60 nt, Human
caggguccccacccccacuggcuuuggugcuguccacacagugcccaccagaaggcagag

SEQ ID NO: 12482 - RNA, 60 nt, Human
cuuuugaaugucuuuugaggcugugaaagcuguccacauuuuugcuguguauuaaauagc

SEQ ID NO: 12483 - RNA, 60 nt, Human
acugcuuagaaauuauagacuauuaugaucuguccacagugcccauugucacuucuuugu

SEQ ID NO: 12484 - RNA, 60 nt, Human
gggcugcaggucauuagccagaauaaaggauguccacauucacaaucugugggccugcca

SEQ ID NO: 12485 - RNA, 60 nt, Human
aaucacaacauggggaauuuuauucauaaauguccacagaaacaguaaauguucucgcuu

SEQ ID NO: 12486 - RNA, 60 nt, Human
accccucaacuuccugcugcucagcuacuuuguccacauuggauuugguccaaacaugua

SEQ ID NO: 12487 - RNA, 60 nt, Human
ucuguccucccucaccccuuucaccugagcuguccacaguaggaaacauaaagaaacaau

SEQ ID NO: 12488 - RNA, 60 nt, Human
gaauauauuuuuuaaacgaagagacagaacuguccacaucugccuccucuccuccucagc

SEQ ID NO: 12489 - RNA, 60 nt, Human
cucucgucccgucccucccuuuccuccgccuguccacagccccuuaagggaaagguagga

SEQ ID NO: 12490 - RNA, 60 nt, Human
cguauguaauaaaggacgcccucccuccaguguccacauccaguucaccccagagggucg

SEQ ID NO: 12491 - RNA, 60 nt, Human
agagggucucuccguccucaugcuccucaguguccacacuucaaggccaaggauaguuuc

SEQ ID NO: 12492 - RNA, 60 nt, Human
uaaaggcauugucauguggccugccuuuccuguccacauccccaccucugaugcucaaga

SEQ ID NO: 12493 - RNA, 60 nt, Human
ccuugccuuugccaaccaccucugcuugccuguccacauuuaaaaauaaaaucauuuuag

SEQ ID NO: 12494 - RNA, 60 nt, Human
uaaaaccaacaaugaugccuagugaguauguguccacaggccauaacaggguagaagaga

SEQ ID NO: 12495 - RNA, 60 nt, Human
auagacacaagacacacacgcucaaaccccuguccacauauacaaccauacauacuugca

SEQ ID NO: 12496 - RNA, 60 nt, Human
ccaggcuggagucgguuccacccacucgccuguccacaggcuuccuuguaagcaagucag

SEQ ID NO: 12497 - RNA, 60 nt, Human
uuugagcagugcucucaagagcuccgugccuguccacaaugaccuagagugcauccugcu

SEQ ID NO: 12498 - RNA, 60 nt, Human
gggugggggagaggggagacagggcaaucuuguccacagucucccauucucauauguagc

SEQ ID NO: 12499 - RNA, 60 nt, Human
ucacaaggauuucucuaacccuauccuaauuguccacauacguggaaacaauccuguuac

SEQ ID NO: 12500 - RNA, 60 nt, Human
gugaaaggaaaggggccggggacaggaggguguccacauauguuaacaucaguuggaucu

SEQ ID NO: 12501 - RNA, 60 nt, Human
ucuccguggcuuugguuuaaaagacacacuuguccacauagguuuagagauaagaguugg

SEQ ID NO: 12502 - RNA, 60 nt, Human
uacuucaccaucucuuaaggacucggcauuuguccacagucagacugcaagagaggguag

SEQ ID NO: 12503 - RNA, 60 nt, Human
aggggucugggcagucccuccucuccccaguguccacagucacugagccagacggucggu

SEQ ID NO: 12504 - RNA, 60 nt, Human
cugugccacacuccuucuauguguguacaguguccacaggcaucacaccuucuucauuaa

SEQ ID NO: 12505 - RNA, 60 nt, Human
gcugcugccagaggaccguggauaccucaguguccacacacccaccaugcccagcccugg

SEQ ID NO: 12506 - RNA, 60 nt, Human
gaaucaccaaggccugggaucaaccugggcuguccacacagaaaacaaaaacccaaccaa

SEQ ID NO: 12507 - RNA, 60 nt, Human
gcgcuccccgcucgcugaaccccguuugccuguccacacccccucgcuccccaccauuuu

SEQ ID NO: 12508 - RNA, 60 nt, Human
ggguggugcuggcccaguuggugggaccccuguccacacccacccuauuuauuuccguug

SEQ ID NO: 12509 - RNA, 60 nt, Human
cagucuugagagguggccagccagacugccuguccacaugcgugucagcacauacagccg

SEQ ID NO: 12510 - RNA, 60 nt, Human
aacaaugguuugaaacaacuacuggaauauuguccacaauaagcuggaaguuuguuguag

SEQ ID NO: 12511 - RNA, 60 nt, Human
agcacaauauuuauuuuaaagugaauaaaauguccacaagcaguguugucauguagucaa

SEQ ID NO: 12512 - RNA, 60 nt, Human
cucccagauuuacuuagguaccccacgaguuguccacauaagcagcuucaucuuuaccuu

SEQ ID NO: 12513 - RNA, 60 nt, Human
gagcagcucucgagaacuaccuguugguauuguccacaagcucucccgagcgccccaucu

SEQ ID NO: 12514 - RNA, 56 nt, Human
cuuugcuccaaaaaaaauaguguuauuguccacaagauuguuuugguguuucucaa

SEQ ID NO: 12515 - RNA, 60 nt, Human
augguaggcagaauaaugucccccgaaauauguccacauccuaaucccaagaucugugca

SEQ ID NO: 12516 - RNA, 60 nt, Human
auuagaaugucaguugaucagcuagauuuguguccacacuaccaguuucacacccccuuu

SEQ ID NO: 12517 - RNA, 60 nt, Human
augucagcugcuuugcacaaagguccuucuuguccacaccccuuauccccaggcuggugc

SEQ ID NO: 12518 - RNA, 60 nt, Human
ccagcugcaucccugcagacagaggauguguguccacaugaguguuucugugugggaaau

SEQ ID NO: 12519 - RNA, 60 nt, Human
gaacacccugaacaguccugguugggaugguguccacauucauguucugcgguucuugaa

SEQ ID NO: 12520 - RNA, 60 nt, Human
ugagguuacaugcugcuugccuccaccagauguccacaacaauaugaaguacagcagaag

SEQ ID NO: 12521 - RNA, 60 nt, Human
aucacauuccuaauaccauucgaacucuguuguccacacuccccagcugcacugaccagu

SEQ ID NO: 12522 - RNA, 60 nt, Human
guuccuggaagacccagaguuaaaugcagauguccacacgaggggucggaguuaccugau

SEQ ID NO: 12523 - RNA, 60 nt, Human
uugugcccacacugagccagcaaguccugcuguccacacccacaagcuaccuggagggac

SEQ ID NO: 12524 - RNA, 60 nt, Human
guacagcagguuugcugcaguguuuuuuucuguccacaugcaaauuuuggauucuauccc

SEQ ID NO: 12525 - RNA, 60 nt, Human
gcccauaccccuggccaaggaagaucccuuuguccacaaguaaaaggaaaugcuccucca

SEQ ID NO: 12526 - RNA, 60 nt, Human
auauaaagaauucuuuugaggauggaauucuguccacaaaauaauuuugugagcccagau

SEQ ID NO: 12527 - RNA, 60 nt, Human
gagucaguguuauuacugguggaugcaccguguccacagcagcccccaaucccagcgaug

SEQ ID NO: 12528 - RNA, 60 nt, Human
gugacauugggugacugcugcuuggaaaacuguccacacuugcuacucuuugagaaugaa

SEQ ID NO: 12529 - RNA, 60 nt, Human
cuuccucauccagcaccaaaucuuugcuuauguccacaggccagggccugugcugcaguc

SEQ ID NO: 12530 - RNA, 60 nt, Human
uuuaaaugagauaaugcaguugcaacuguguguccacaaguauggacaucaaaucugugg

SEQ ID NO: 12531 - RNA, 60 nt, Human
uaauuuggaaugauaauuccagagauaaaguguccacaacaguuagggaaaugaugcuag

SEQ ID NO: 12532 - RNA, 60 nt, Human
gugggucuauucuucauuagcucagugacuuguccacacucgucuuagcacuuacguuuc

SEQ ID NO: 12533 - RNA, 60 nt, Human
guaggagaagaagcccugcacacagggcaguguccacagccagaaaacuccugcugggca

SEQ ID NO: 12534 - RNA, 60 nt, Human
ccagugcccagaagcagugagauuagucuguguccacaagcagaggcccccucgauggga

SEQ ID NO: 12535 - RNA, 60 nt, Human
gagaguggaugauagaugcaaaauaauaccuguccacaacaaacucuuaaugcuguguuu

SEQ ID NO: 12536 - RNA, 58 nt, Human
ugaccuggucgugauguggcauucagugcauguccacagcuaauggaaaaacacgagg

SEQ ID NO: 12537 - RNA, 60 nt, Human
ugggcuguauugauauugucgaucaugaaauguccacacuuauucuaaguggccaauuau

SEQ ID NO: 12538 - RNA, 60 nt, Human
ugggguccccccugagugggcugggcccucuguccacauguggggacagggcuggugugg

SEQ ID NO: 12539 - RNA, 60 nt, Human
gugguuugagaggaugaacccugcaggccauguccacaguucugagaggccaccugcuuu

SEQ ID NO: 12540 - RNA, 60 nt, Human
agugucuggacuuguaaucgggugcccugcuguccacagguggacucuggggaagccagg

SEQ ID NO: 12541 - RNA, 60 nt, Human
gggaggcggccucuccccuguugcugcccguguccacacaggaauguacacugguggcag

SEQ ID NO: 12542 - RNA, 60 nt, Human
gauagauugugggacccaggcaggaacagguguccacaagaacucaggauggcaucaguu

SEQ ID NO: 12543 - RNA, 60 nt, Human
ugcuguaacauuucccaccaacucucuugcuguccacaucaacagcuaaaucauuuauuc

SEQ ID NO: 12544 - RNA, 60 nt, Human
aauaaugucauguauaaaauaugaauaaaauguccacauaggaaauuaacacauauauac

SEQ ID NO: 12545 - RNA, 60 nt, Human
cccccugaggcccagagacaugcagcucucuguccacaaccaugccacuugcaugggagc

SEQ ID NO: 12546 - RNA, 60 nt, Human
uaccccaggccccuauacucuuccuuccuauguccacagcugaccccaagcagccguucc

SEQ ID NO: 12547 - RNA, 60 nt, Human
auauauaauacuuuaaauuuuaaaaauucuuguccacaaggaaauuugucuggguuauug

SEQ ID NO: 12548 - RNA, 60 nt, Human
gcuuguccaguauuucccuucguuccucaguguccacauugaggccuauacagaaaauca

SEQ ID NO: 12549 - RNA, 60 nt, Human
aaggaggcaaauagaagaaugagauacugauguccacaguucauuggcagaaucuaaccc

SEQ ID NO: 12550 - RNA, 60 nt, Human
guaaaccaaagcccuaaaauuccacugcguuguccacaagacagaagcugaagugcaucc

SEQ ID NO: 12551 - RNA, 60 nt, Human
guaaaaugaauuacuguauuuuuccuuuuauguccacagaaugagagucauauguuguua

SEQ ID NO: 12552 - RNA, 60 nt, Human
ccuguuuaaaaagucauuuuaaagguagaguguccacaucaggcaccauuugugauauga

SEQ ID NO: 12553 - RNA, 60 nt, Human
ugucacuggcuggcuggauccaaagucauguguccacacauucauaaauaaaaauuuuac

SEQ ID NO: 12554 - RNA, 60 nt, Human
cccccucagaccaggcccuugucugugcccuguccacacccaggagccauccucaguguc

SEQ ID NO: 12555 - RNA, 60 nt, Human
ugccagcuuucagacagagcccacuuagcuuguccacauggaucucaaugccaauccucc

SEQ ID NO: 12556 - RNA, 60 nt, Human
uuguauguguauauuuuuauagcugcagauuguccacacaguauacuuuuggaaguuugg

SEQ ID NO: 12557 - RNA, 60 nt, Human
cuuuaccaacaucuugaauauauauucuaguguccacaagauuuagcaaaaagauaaagc

SEQ ID NO: 12558 - RNA, 60 nt, Human
uguagcuacggaaccagauucuggugaauuuguccacaaucagccauuggccugucuggg

SEQ ID NO: 12559 - RNA, 60 nt, Human
uauuaaggaccuuugugaggcuagguacacuguccacaccucuuuggggaaguuacgauu

SEQ ID NO: 12560 - RNA, 60 nt, Human
ggucccucugaagagaccuuggcugcucacuguccacaugugaacuuuuucuagguggca

SEQ ID NO: 12561 - RNA, 60 nt, Human
ugaccaguaccaaucuugaguuucuuuuucuguccacaaguaaauuaauaucugcucuga

SEQ ID NO: 12562 - RNA, 60 nt, Human
gaaaugauuuuuuagauauuggggauccaguguccacacuuaaaaguuguauguguuuaa

SEQ ID NO: 12563 - RNA, 60 nt, Human
uuuuguuuacucuaucaugaacaaaggaacuguccacauacuguaaaccaugagcagugu

SEQ ID NO: 12564 - RNA, 60 nt, Human
gcacagaggugaacagaaacugaaacauuuuguccacaacuucacgggacguggccagac

SEQ ID NO: 12565 - RNA, 60 nt, Human
aucucuugccuucccccaugaacuucagccuguccacacaaaagccacauaaacucaagc

SEQ ID NO: 12566 - RNA, 60 nt, Human
cuaacuaacagucacgccgugggaugucucuguccacauuaaacuaacagcauuaaugca

SEQ ID NO: 12567 - RNA, 60 nt, Human
cugccaggcuggggcuuccucaggcauggguguccacagcacuggcccccucuccccagc

SEQ ID NO: 12568 - RNA, 60 nt, Human
cuggccaaaggagaugcagccagcuaagacuguccacacuuuggcagacaaccgguuuuc

SEQ ID NO: 12569 - RNA, 60 nt, Human
uuucccagcccaaauucuccucucuaaaaguguccacaagaagggguguuuauucuucca

SEQ ID NO: 12570 - RNA, 60 nt, Human
cauuacuuaauuuuaaacuuaaucaguguguguccacagagcaccaguggcuucgugagu

SEQ ID NO: 12571 - RNA, 60 nt, Human
accuguuuucuccucccccaucccuacccuuguccacaggcucaacauuucuacacguug

SEQ ID NO: 12572 - RNA, 60 nt, Human
accaucuagcccucagcaggccccgccggcuguccacagcggacccugcugaugccucca

SEQ ID NO: 12573 - RNA, 60 nt, Human
gugugcacuuggcgagccuccugcccacccuguccacaccuaauaagugcaaucauuuug

SEQ ID NO: 12574 - RNA, 60 nt, Human
ccuaucaggcugggugugcgaguguccaucuguccacauggaugucgagggugguuugug

SEQ ID NO: 12575 - RNA, 60 nt, Human
ucuguugggaaccugugauauaccuccauuuguccacaagaugguguuuaaaacaauuug

SEQ ID NO: 12576 - RNA, 60 nt, Human
auauaagcuuuuaagcaguuaucuaacuaguguccacaacccuguaaccauacuuccaca

SEQ ID NO: 12577 - RNA, 60 nt, Human
accucggggacuugagccuucugcaggggauguccacagagagggaagggccgaggggag

SEQ ID NO: 12578 - RNA, 60 nt, Human
ccccccaaccuugcccccggcacaccaaaguguccacauuguaccaaagacugacccccg

SEQ ID NO: 12579 - RNA, 52 nt, Human
gggacacggaaagggguugauuuguccacauuuuauuguuuuccuuuuauuu

SEQ ID NO: 12580 - RNA, 60 nt, Human
ggccaucacagccccauggacaacacuaauuguccacagcaaagggcaaggaauccucug

SEQ ID NO: 12581 - RNA, 60 nt, Human
aguauucucagccugaggguggguugcuacuguccacauaggcauuuccggaauucacuu

SEQ ID NO: 12582 - RNA, 60 nt, Human
gugcuuuaagauuuuaaaaaugugauguuuuguccacaguaguucaggcaauuaagaaua

SEQ ID NO: 12583 - RNA, 60 nt, Human
acagaagaagcuccugaaucccuuucaguuuguccacacaagacagcagagccaucugcg

SEQ ID NO: 12584 - RNA, 60 nt, Human
cuaucagguaaacugucacuuaaauggagguguccacaucuuaauuguuucuccuugaca

SEQ ID NO: 12585 - RNA, 60 nt, Human
gaggugccccugcccagcccuguccagccuuguccacacacacaucucacgccccugguc

SEQ ID NO: 12586 - RNA, 60 nt, Human
cucuuuacuguaaaggcaagccagcauguguguccacacauacauaggauggcuggcucu

SEQ ID NO: 12587 - RNA, 60 nt, Human
gggggaggccugagcauuucccagccccaguguccacaccucucagaaaagagaaaaaag

SEQ ID NO: 12588 - RNA, 60 nt, Human
aaauagagaugagacuuuuugugucaacucuguccacaagagugaguuaucuaguaugau

SEQ ID NO: 12589 - RNA, 60 nt, Human
agacuguggggacagauacaauuccacuccuguccacaggaacaugagauuuagcagacu

SEQ ID NO: 12590 - RNA, 60 nt, Human
uugacagaggcaccaaaaggcaaaugguacuguccacagugcacugcugcaaugaagaga

SEQ ID NO: 12591 - RNA, 59 nt, Human
auacaaccuggcuucgcugagcaguaccuuguccacagauuagaaaacguacacaagug

SEQ ID NO: 12592 - RNA, 60 nt, Human
ugagccagcaccagggcggugggagacuccuguccacaccucugccccagagcugccucc

SEQ ID NO: 12593 - RNA, 60 nt, Human
acugcacaccccacggccauguaacucuccuguccacauaugauaauaccauucugcaua

SEQ ID NO: 12594 - RNA, 60 nt, Human
gggacagucaugggacugcaucuuccgacuuguccacagcagaugaggacagugagaauu

SEQ ID NO: 12595 - RNA, 60 nt, Human
ggccugagaaggccuugcgggggugggguuuguccacagagcugcuggagcagcaccaag

SEQ ID NO: 12596 - RNA, 60 nt, Human
ccccgagucccugccgcgcgcccucgcgccuguccacaucccucugcccauccgagaccu

SEQ ID NO: 12597 - RNA, 60 nt, Human
cccggaaucccugccgcggccccucgggccuguccacaucccucugccccucccagaccu

SEQ ID NO: 12598 - RNA, 60 nt, Human
aguccuuuuguuugcgguuuagauucauuuuguccacacauguacccauuuuaaaaaaca

SEQ ID NO: 12599 - RNA, 60 nt, Human
ucugacuagcaaaacgcagaaccuuaagauuguccacauccuucaugcaagacugcugcc

SEQ ID NO: 12600 - RNA, 60 nt, Human
ugccugcagcugagauuccagaacgcccuguguccacagugauuagccucgucuuucagc

SEQ ID NO: 12601 - RNA, 60 nt, Human
ccguuuuuauauuacuuuuguaaauauucuuguccacauucuacuucagcuuuggaugug

SEQ ID NO: 12602 - RNA, 60 nt, Human
uuuggaagcaaaugauauuuccucuugcaguguccacaaaucugaauauuaggggcauga

SEQ ID NO: 12603 - RNA, 60 nt, Human
agccuccuggacuuccugaggacucgacauuguccacagauguacuggccauuacaugaa

SEQ ID NO: 12604 - RNA, 60 nt, Human
uggagugaaauugcaucgaggguaagacuguguccacagguuuaaaauucucucuucuga

SEQ ID NO: 12605 - RNA, 60 nt, Human
uuggcaggaaauaaggcgauuaacccuauguguccacaagccucaagccuuguuucaggu

SEQ ID NO: 12606 - RNA, 60 nt, Human
acaaugacauauaagccguauauagaucaauguccacauauauauacacacacacauaua

SEQ ID NO: 12607 - RNA, 60 nt, Human
acagccugucacugcccccuccccagccuguguccacagugcugugaucccgagggaagu

SEQ ID NO: 12608 - RNA, 60 nt, Human
gcguguuccuuguagccauagaugugauuauguccacaccgggcugccuuaaucuguccu

SEQ ID NO: 12609 - RNA, 60 nt, Human
gaucgaggcauggggcauguccuuuccaucuguccacauccccagagcccagcucuugcu

SEQ ID NO: 12610 - RNA, 60 nt, Human
caccccagcgccugggcccgccccacgcucuguccacacccacgcgccccgggagcgggg

SEQ ID NO: 12611 - RNA, 60 nt, Human
uuuauugccguccuggacucugugugagcguguccacagaguuuguaguaaauauuauga

SEQ ID NO: 12612 - RNA, 60 nt, Human
guggugcccagggugcccugccucaggacauguccacacccacgucacaagcaccugagg

SEQ ID NO: 12613 - RNA, 60 nt, Human
ucuuccgcuuccuccccaccgauuucagcguguccacaucacagcucccuccagaagcug

SEQ ID NO: 12614 - RNA, 60 nt, Human
agaccacaaaauacaaggccagaccuagaguguccacagcaggccugugcugcccgccuc

SEQ ID NO: 12615 - RNA, 60 nt, Human
gcaggcagaaccgugucuguggucgggugcuguccacagcucugucugccuuguucuugg

SEQ ID NO: 12616 - RNA, 60 nt, Human
caggugggcagacagugaccucucuagguguguccacagaguuuuucaggagagaaaacu

SEQ ID NO: 12617 - RNA, 60 nt, Human
gccagccuguguccccucccgcaggccuccuguccacaccagcgcccccuggggggccuc

SEQ ID NO: 12618 - RNA, 60 nt, Human
ccccguggagcgcggccugcacgggaguuguguccacaaaggcaaaguaaagggguggaa

SEQ ID NO: 12619 - RNA, 60 nt, Human
cuugcugggucagaucuguguggccagcccuguccacaccaugccucuccugcacuggag

SEQ ID NO: 12620 - RNA, 60 nt, Human
uucuacacagagcaggacugcacagcguccuguccacacccagcucagcauuuccacacc

SEQ ID NO: 12621 - RNA, 60 nt, Human
auuccugccucucaccaugcacgcauccauuguccacacacacacaaccagauaaucuuc

SEQ ID NO: 12622 - RNA, 60 nt, Human
cugggauucauucugguucuuaucaggguguguccacacucugcucacagguggauccac

SEQ ID NO: 12623 - RNA, 60 nt, Human
uagauuuuacagccucaguagucugcccaguguccacauuaaugaaggauccauguuugu

SEQ ID NO: 12624 - RNA, 60 nt, Human
uguguguguguccguguguguguguguguguguccacacuggccagccucccuacuuacc

SEQ ID NO: 12625 - RNA, 60 nt, Human
cugcugguccucaguaccagcgcccggggguguccacaaccacuugggacagaagaaggu

SEQ ID NO: 12626 - RNA, 60 nt, Human
agaaggaacuuuauguucccucuccugcuguguccacaaccuuagaaaucuguagcuaga

SEQ ID NO: 12627 - RNA, 60 nt, Human
gagaaaccuggccuggguugucucaaauccuguccacaaggcaacuccagaagaaagaag

SEQ ID NO: 12628 - RNA, 60 nt, Human
caccucucccagcugauggugagcugacaguguccacagguuccaggaccauuugagauu

SEQ ID NO: 12629 - RNA, 60 nt, Human
gaaauuucuauguuccgaaacacagaguaguguccacaugugagcuuuucacauuaccuu

SEQ ID NO: 12630 - RNA, 60 nt, Human
gaacacacagaggugcacaucacauucccuuguccacacugcccgccucucccacaugcc

SEQ ID NO: 12631 - RNA, 60 nt, Human
aggacacugauccagucacagccauacagcuguccacacugaagaacauguccuacaaca

SEQ ID NO: 12632 - RNA, 60 nt, Human
caaauguauucuacuuguucuaaaacaaucuguccacaaauauaaaacuauaaguaauaa

SEQ ID NO: 12633 - RNA, 60 nt, Human
auuaacaaaguaggaaguugagcacaaccuuguccacagccauuuuaaauauccacuuag

SEQ ID NO: 12634 - RNA, 60 nt, Human
gcugcuggcucuccuuggccucgccguccuuguccacaagcacuauggcccccggcucaa

SEQ ID NO: 12635 - RNA, 60 nt, Human
cagaugcauaggccugccuuccggagacccuguccacauugccgggaccacccugguggg

SEQ ID NO: 12636 - RNA, 60 nt, Human
aaaaauaaaucagaauuucaaauuuaaaauuguccacacacuaggaaauagaacuguguu

SEQ ID NO: 12637 - RNA, 60 nt, Human
ccccugguggcgcuuccuggcgcugcgcccuguccacagucaccuuaggucccuuuggaa

SEQ ID NO: 12638 - RNA, 60 nt, Human
uugaauuccuaccuuguuauucuaaacagauguccacauuguuaauuaaaucuaaauuau

SEQ ID NO: 12639 - RNA, 60 nt, Human
caccugggcccuaggcauacucuccaggauuguccacaaauguccucagagggucccuag

SEQ ID NO: 12640 - RNA, 60 nt, Human
gcgggcagcagggaagagggagcaaggcauuguccacagacugcuggggucacuucuuug

SEQ ID NO: 12641 - RNA, 60 nt, Human
gaggccaggaaggccgggccguggagguccuguccacagcuggacaggagagacaccgcc

SEQ ID NO: 12642 - RNA, 60 nt, Human
ucuccugguacccaaagaaauacugaguuguguccacaacauggcugggucuucagaccc

SEQ ID NO: 12643 - RNA, 60 nt, Human
aaaaaccuucaagucuacuuacccuucuccuguccacaauaaaguugagaaaacaccaag

SEQ ID NO: 12644 - RNA, 60 nt, Human
cauggagauuuugaaaaguguuauuucucuuguccacaggcacuuucaagaacuuuggga

SEQ ID NO: 12645 - RNA, 60 nt, Human
uuuuuuuuuuuuuuuugcugaggcaguuauuguccacaggccuuuggguacagaugaggc

SEQ ID NO: 12646 - RNA, 60 nt, Human
caaagacauuuaagcauaguaagaaucugauguccacaagaacaggaacuggguuaauaa

SEQ ID NO: 12647 - RNA, 60 nt, Human
ccuggagaguuaucuacagauguuaggauauguccacauaagaaagcaucuaaacugaac

SEQ ID NO: 12648 - RNA, 60 nt, Human
ugaccuggacuaagaaccccacggccccacuguccacacacugccuccccaccgcccacc

SEQ ID NO: 12649 - RNA, 60 nt, Human
cuugauaccacucauccacguguuccugauuguccacauuucaugauaaaaugagagcuc

SEQ ID NO: 12650 - RNA, 60 nt, Human
uaucagucacuugccacucccccacccuccuguccacaacuccuuuccacuuuaggccaa

SEQ ID NO: 12651 - RNA, 60 nt, Human
guaggcuucugggaggucccuuuucagggguguccacaaagucaaagcuauuuucauaau

SEQ ID NO: 12652 - RNA, 60 nt, Human
cuaccgucaguccacauggcaggucugcuguguccacaccacagaugaccacaucuaauc

SEQ ID NO: 12653 - RNA, 60 nt, Human
cuuuugggcaaccucuccguguacugcgucuguccacacucgauugggccccaggugugu

SEQ ID NO: 12654 - RNA, 60 nt, Human
aggcucuccugaccucaaguccaacaacaguguccacacuagucaagguucagcccagaa

SEQ ID NO: 12655 - RNA, 60 nt, Human
ugcagaaguaccuaccacaugggaaccguuuguccacacucauuccagagaaaaccgagu

SEQ ID NO: 12656 - RNA, 60 nt, Human
gaaacuucuguccucuuuggaugagaucaguguccacaaguggccgacauggaacaugcu

SEQ ID NO: 12657 - RNA, 60 nt, Human
ugggauugggcuaaggacuguggucuuaucuguccacauacagccaaaaugccuauccag

SEQ ID NO: 12658 - RNA, 60 nt, Human
aggcguguucagcacccugucccuccucccuguccacagcugggucccucuucaacacug

SEQ ID NO: 12659 - RNA, 60 nt, Human
ugucucugcuucuugccaggugggagggccuguccacacccuggauccccguaccacagu

SEQ ID NO: 12660 - RNA, 60 nt, Human
augcaaguguggccagggcccuggguaucauguccacaugcccagcaagagccuugccuc

SEQ ID NO: 12661 - RNA, 60 nt, Human
uaucucugauggcacuuugagggaaaagaauguccacauacaguuuuugaaagaucuucu

SEQ ID NO: 12662 - RNA, 60 nt, Human
accuguaucaagaacaaaaaugggaggagguguccacauuuaugguguguauagguaaca

SEQ ID NO: 12663 - RNA, 60 nt, Human
aggggaccauaggucccgucauguacucaguguccacagcagucagucguguaugacccu

SEQ ID NO: 12664 - RNA, 60 nt, Human
uuauccuacauuauuggaaaauaaaugagauguccacacaaauggauuauccacauaauc

SEQ ID NO: 12665 - RNA, 60 nt, Human
aguuuacaguauauggauucuaugaaaaaauguccacaacacaguaauuggucacuuguu

SEQ ID NO: 12666 - RNA, 60 nt, Human
aggcgcucccuccaggauucugccccugccuguccacagacuccuuugugcuggaaccug

SEQ ID NO: 12667 - RNA, 60 nt, Human
uuucagagccgcuguaggucucuucuugcauguccacaguaauguauuugugguuuuuau

SEQ ID NO: 12668 - RNA, 60 nt, Human
agcaggugaacaugaccguguuuucaacuguguccacaguucagaucccuuuccagauug

SEQ ID NO: 12669 - RNA, 60 nt, Human
gcaaaaggacuccacgccucuguggaaucauguccacagggggaccugccucccgugaug

SEQ ID NO: 12670 - RNA, 60 nt, Human
gcugaccacgguguucccuggcaucgucuguguccacacagaugcuaacugguagugcaa

SEQ ID NO: 12671 - RNA, 60 nt, Human
ggcuuuuggcuccacgcucacucauagccauguccacaugggggcuugcacacaggauca

SEQ ID NO: 12672 - RNA, 60 nt, Human
cucccaaccaaccagcaggguagcuauuacuguccacauuuuacaggcaaggaaacaggc

SEQ ID NO: 12673 - RNA, 60 nt, Human
auaauaaagacugugaacugccuggugcaguguccacaugacaaaggggcagguagcacc

SEQ ID NO: 12674 - RNA, 60 nt, Human
augcaccuccccccaccccccacccucccauguccacagugggucguguguuccuggaca

SEQ ID NO: 12675 - RNA, 60 nt, Human
auguccuuggugcuugggggauacggguucuguccacagagucccuuggagggaaaggug

SEQ ID NO: 12676 - RNA, 60 nt, Human
aaagucgcggugaaugcgugcaugucucaauguccacaaaggauucuggcuacccuuugg

SEQ ID NO: 12677 - RNA, 60 nt, Human
uggucaccagcaggagaaagcuuugaugcauguccacauaucauugacuguauccuguaa

SEQ ID NO: 12678 - RNA, 60 nt, Human
aaucuggggaggacaaaggugauuuuccuguguccacaucuaacaaagucaagauucccg

SEQ ID NO: 12679 - RNA, 60 nt, Human
uuucuagucaucuguggauguuaccuugcuuguccacagcagccagucacccuggccagu

SEQ ID NO: 12680 - RNA, 60 nt, Human
gaaacugucugucaugcaccacggugucuguguccacacaguaauaaacgguuuacuguc

SEQ ID NO: 12681 - RNA, 53 nt, Human
ugguugugcucggcaccugagcauguccacagguggccuccagcacaccccuc

SEQ ID NO: 12682 - RNA, 60 nt, Human
cccuaggugccaucuccucaagcuacaaaauguccacaucuuauauccccuuugcuucua

SEQ ID NO: 12683 - RNA, 60 nt, Human
uugugauuaacuguggcggcagacacagcuuguccacagcuugggccaggcuuccccugu

SEQ ID NO: 12684 - RNA, 60 nt, Human
auauuuuuauuuugguuuauuuguaaaacuuguccacagucagccuggcacagucgcuca

SEQ ID NO: 12685 - RNA, 60 nt, Human
uggcuggcuccagaguggacagguacgcucuguccacagcagcugcucaggcacaguaug

SEQ ID NO: 12686 - RNA, 60 nt, Human
acuguaugaccccaccccaaaucuuuguauuguccacauucuccaacaauaaagcacaga

SEQ ID NO: 12687 - RNA, 60 nt, Human
acuaagugaacccagauucuggauucuugguguccacagccuagcugauacgagauagcc

SEQ ID NO: 12688 - RNA, 60 nt, Human
auaaacauucagguuaauuaucuagauuuuuguccacaguauaugauccauccagacauu

SEQ ID NO: 12689 - RNA, 60 nt, Human
cugaagagguggaucccagaguggcucugauguccacauuagaaaaacuuacuuguaaug

SEQ ID NO: 12690 - RNA, 60 nt, Human
guuccuccagaauucauaugcugaagccucuguccacacaugcacaccagaugagggcca

SEQ ID NO: 12691 - RNA, 60 nt, Human
uuagaggccagaacuugauccagaaguugcuguccacagaagugcuuucuauuucaucau

SEQ ID NO: 12692 - RNA, 60 nt, Human
aagucaacccaaugauacacaucauguuccuguccacauacugguuuuccccaaaucagc

SEQ ID NO: 12693 - RNA, 60 nt, Human
acguguacagcggaguacgaaaaggaacguuguccacaggggauuuauggauacaacagc

SEQ ID NO: 12694 - RNA, 60 nt, Human
uauuuuacauuucauaugaaagcauaauuuuguccacaugugacucaaauugcauuggua

SEQ ID NO: 12695 - RNA, 60 nt, Human
uagggcuaguaagggagauuguauaccuguuguccacagucuucaggcagcuccccaggu

SEQ ID NO: 12696 - RNA, 60 nt, Human
agcccaggagguugaggcugcagugagccauguccacaccauugcacugcagccugagua

SEQ ID NO: 12697 - RNA, 60 nt, Human
auuucuaaaccuagugcacuguuuggccaguguccacagccucuuuucuggcuguguuuu

SEQ ID NO: 12698 - RNA, 60 nt, Human
cacauaggaugcgauaccuguggccguguauguccacaugugugccuguagauacaucau

SEQ ID NO: 12699 - RNA, 60 nt, Human
cccaacaccguggaauccucacuggugugcuguccacagauuugugaacuccugguagua

SEQ ID NO: 12700 - RNA, 60 nt, Human
acgccaggccagugccgccuacguggagacuguccacacagcugccucagaagcgccggg

SEQ ID NO: 12701 - RNA, 60 nt, Human
uguugccuaccugugccccuggcagccgcguguccacacaguuagcggagcgcgggacuu

SEQ ID NO: 12702 - RNA, 60 nt, Human
ggcacaugccugccagcguugugucaugccuguccacaggggauucguggggcucacuuc

SEQ ID NO: 12703 - RNA, 60 nt, Human
uucaagcgcuuggcagaaucuuguacuucguguccacaaugguacugaauuugcaucugc

SEQ ID NO: 12704 - RNA, 60 nt, Human
gaccugggugggaggaaacuguagccugaguguccacagggacacacgugagccacaggg

SEQ ID NO: 12705 - RNA, 60 nt, Human
gauguucuggcccucaccccugcccugggauguccacagaugccuccaccccccagaacc

SEQ ID NO: 12706 - RNA, 60 nt, Human
acugccaguaacuccaggcuuugacaucccuguccacagcucugagugugugggauaagu

SEQ ID NO: 12707 - RNA, 60 nt, Human
cuacucugguggggacuuggagaaccuuuguguccacacucuguaucuagcuaaucuagu

SEQ ID NO: 12708 - RNA, 60 nt, Human
gucuguggguaucacacugagugugaguuguguccacacgugcucaagcagaaggacuuu

SEQ ID NO: 12709 - RNA, 60 nt, Human
guaucaguggaauugauccauaaaccucccuguccacaucuugcccaauggggaauggau

SEQ ID NO: 12710 - RNA, 60 nt, Human
ccacgaagagcuggaccagcuucaaguacauguccacagcaacaugcaggaaggccucuu

SEQ ID NO: 12711 - RNA, 60 nt, Human
uuccucccucgccaaacgcguuccagaauuuguccacaggugcgccggcaccugcuuucc

SEQ ID NO: 12712 - RNA, 60 nt, Human
gccuucuggucugcaugacacuaagacgcuuguccacagcggcgacccaggccuccaagc

SEQ ID NO: 12713 - RNA, 60 nt, Human
gaacagaaguuguuuggaccuuagagccauuguccacaaucacggaugguucucaagagu

SEQ ID NO: 12714 - RNA, 60 nt, Human
cuauuuuaggggcugucugcuuuucuagucuguccacacagggauuaccugucaucuugc

SEQ ID NO: 12715 - RNA, 60 nt, Human
gcaaaugcauagucagguagauucagaccuuguccacaccuuccugggcaacccccacca

SEQ ID NO: 12716 - RNA, 60 nt, Human
uuggcuacaucauugccuuccugguacuccuguccacagugaagcuuuggcaucugcuca

SEQ ID NO: 12717 - RNA, 60 nt, Human
aagccaugagaggcagcgcccgccacccuguguccacagcccccaccuucccgcuucccu

SEQ ID NO: 12718 - RNA, 60 nt, Human
gagggaugacuuccaguuccgucuguccuuuguccacaaggaauuucccuggacgcuaau

SEQ ID NO: 12719 - RNA, 60 nt, Human
acgagaaggugcuuccgcugcuugaagguuuguccacauucgucacagauauaguuccgc

SEQ ID NO: 12720 - RNA, 60 nt, Human
gcauggaaugcgugaggcuggcuucuggguuguccacaccacucucugcuguguugacuu

SEQ ID NO: 12721 - RNA, 60 nt, Human
cagagucauugccgucgagucucugcuuuuuguccacauuuugggaucagcuuacugcau

SEQ ID NO: 12722 - RNA, 60 nt, Human
agaaaccuccagcaagggaagagagguguguguccacaggaaggggcuccguggggaucc

SEQ ID NO: 12723 - RNA, 60 nt, Human
aagguuuguacagaugcaugccacaguagauguccacauaauaaaauucauaguuaccaa

SEQ ID NO: 12724 - RNA, 60 nt, Human
uugauuucuggaucacgggauaccacuuccuguccacaccccgaccaggggcuagaaaau

SEQ ID NO: 12725 - RNA, 57 nt, Human
agaggcaaaaugagggcugacguggacuguccacaguguucaugugcuggagucagg

SEQ ID NO: 12726 - RNA, 60 nt, Human
uucacauagcugaugcgugcccugggaagguguccacagugagcccugugugcaggacug

SEQ ID NO: 12727 - RNA, 60 nt, Human
gguguccacagugagcccugugugcaggacuguccacacgguucacaccuugucaccauc

SEQ ID NO: 12728 - RNA, 60 nt, Human
gguccagcccugacuucauccucccuucucuguccacaccacgaguggcacaucccaccu

SEQ ID NO: 12729 - RNA, 60 nt, Human
gcaaggcuauaaaagggaauacuacaguuuuguccacacuuuaauuugagaccauuuuuc

SEQ ID NO: 12730 - RNA, 60 nt, Human
cccucuuucgggcugcauccacagaguuuguguccacacuuucucuccgagcaugugggu

SEQ ID NO: 12731 - RNA, 60 nt, Human
cccuuccuccuucccuagggcugcagggccuguccacagcuccuguggggguggaggaga

SEQ ID NO: 12732 - RNA, 60 nt, Human
ugcaaccgccuagacuuucuuucagauacauguccacauguccauuuuucagguucucua

SEQ ID NO: 12733 - RNA, 60 nt, Human
ccaucccugucccccgucccccugucccccuguccacauaccaaucccccuguccccgac

SEQ ID NO: 12734 - RNA, 60 nt, Human
agcagccuggacuuuacaguuaugugaaacuguccacaaaaagucauggcaauaauggug

SEQ ID NO: 12735 - RNA, 60 nt, Human
gaaaaacgucucccaaucacccaggaaagcuguccacaguaguccccccuuauccacggu

SEQ ID NO: 12736 - RNA, 60 nt, Human
cggcucugccccugccccccagcccucguguguccacaccgcagugccucugccccucgg

SEQ ID NO: 12737 - RNA, 60 nt, Human
ugggguucacaccccaaaaugacccaacgauguccacacaccaccaaaacccagccaaug

SEQ ID NO: 12738 - RNA, 60 nt, Human
cacacacaccugccuaaagacagggauggcuguccacaggauccuccagccccgugagag

SEQ ID NO: 12739 - RNA, 60 nt, Human
cgccuugcugcaacagagaggaaaugcccauguccacagcuuguacacacugcccccuca

SEQ ID NO: 12740 - RNA, 60 nt, Human
uguaauguauuaauacauccguucaugugcuguccacaugaauguguugacugugcucuc

SEQ ID NO: 12741 - RNA, 60 nt, Human
guacaugacacuccuccacgcgguuuccaguguccacacugcugcccgugcagugggacc

SEQ ID NO: 12742 - RNA, 60 nt, Human
gcaugugagaugagugacugccggugaauguguccacaguugagagguuggagcaggaug

SEQ ID NO: 12743 - RNA, 60 nt, Human
gugggcaccaucucucugaugacaguucuguguccacaacccagaccccuccacacaaac

SEQ ID NO: 12744 - RNA, 60 nt, Human
guuuuuuuggcaauucuuccacgugggacuuguccacaagaaugaaaguagugguuuuua

SEQ ID NO: 12745 - RNA, 60 nt, Human
cacaucuugccaagacagccuuuguccagcuguccacauugagucagacugcucccgggg

SEQ ID NO: 12746 - RNA, 60 nt, Human
gagauggggugaagggacacagucuugagcuguccacaugcaugugacuccucaaaccuc

SEQ ID NO: 12747 - RNA, 60 nt, Human
cuagucauagcucauccccaucucuaaauguguccacacaaccacaucugccuuuuccac

SEQ ID NO: 12748 - RNA, 60 nt, Human
acccaccgcgaccccacacuauuucugugcuguccacacucucuugccucccgacccccg

SEQ ID NO: 12749 - RNA, 60 nt, Human
cugucacgguaggagcucucccgguaccaguguccacagaccgcccaacacagaggcuuu

SEQ ID NO: 12750 - RNA, 60 nt, Human
uugcagggauuuuuaggguuuuuuccacauuguccacauuaaugguuggcaugauugugc

SEQ ID NO: 12751 - RNA, 60 nt, Human
guaacugugaguauaugaauguguugcacauguccacaguauuggcgagauaauuacaua

SEQ ID NO: 12752 - RNA, 60 nt, Human
cucucuugaauagcucuaacuccaaaccucuguccacaccuccagagcaccaaguccaga

SEQ ID NO: 12753 - RNA, 60 nt, Human
uagccacagaugcuccaugaggaaaaucccuguccacauuggaauaaaaaagacauuuuu

SEQ ID NO: 12754 - RNA, 60 nt, Human
guaaaccugacccaccaauaaggauucagcuguccacacgggcuggcgacacacuuaccg

SEQ ID NO: 12755 - RNA, 60 nt, Human
guaauaaaauugaggcuccacggaggcccguguccacaucagcugcagcucccacucaga

SEQ ID NO: 12756 - RNA, 60 nt, Human
aauguuaacauuuguugaucaauguggagcuguccacauucgguaucuuuucauuuuuau

SEQ ID NO: 12757 - RNA, 60 nt, Human
cccuccucucccucaucaaggacacgggccuguccacaggcuucugagcagcgagccugc

SEQ ID NO: 12758 - RNA, 60 nt, Human
ucuuaacuaauuacauuugcaaggaucuuauguccacaaaagucacagucugaggugcug

SEQ ID NO: 12759 - RNA, 60 nt, Human
acaaaagagaaagcucuugaauauaagcaauguccacacguuuuuagccagcccacaugc

SEQ ID NO: 12760 - RNA, 60 nt, Human
agaaggaaagaagccuggagcagccucuccuguccacagccagggguuaggucugcaggc

SEQ ID NO: 12761 - RNA, 60 nt, Human
cugcaguuccaggccagccagaaacuccuguguccacauagagcugacgugagaaauauc

SEQ ID NO: 12762 - RNA, 60 nt, Human
ugaaguaccuuuacuuguaucagaucuuauuguccacauuuuguacuacagaaaaacucu

SEQ ID NO: 12763 - RNA, 60 nt, Human
uaagauaguuuucuauuuccuucaguaauguguccacaguacccuguauuucgaguucca

SEQ ID NO: 12764 - RNA, 60 nt, Human
ugcccuuaaccaugacaccauuguaagagcuguccacauuuguauguugugcccuggaau

SEQ ID NO: 12765 - RNA, 60 nt, Human
uacaccacucucccagccugugaccaccgauguccacacacccccaaccacuuguccaca

SEQ ID NO: 12766 - RNA, 60 nt, Human
accaccgauguccacacacccccaaccacuuguccacacagcuacccacguacgacaucg

SEQ ID NO: 12767 - RNA, 60 nt, Human
uuccuucuuuuuuguuuuugcccccaguucuguccacaccccuucccuuuccuguccugu

SEQ ID NO: 12768 - RNA, 60 nt, Human
cuccuuguacucaccauugucucugucagauguccacauugcaaccaaauuuguauuuuu

SEQ ID NO: 12769 - RNA, 60 nt, Human
gugcuucugugaacgugaauuuuguucaguuguccacaggagauccacauaauuccuagc

SEQ ID NO: 12770 - RNA, 60 nt, Human
aggggaaggacaggcuggccucuccuucacuguccacagggccuuggguucccugagcug

SEQ ID NO: 12771 - RNA, 60 nt, Human
auguguugcuacucugacaucccgaguuucuguccacacauugcaugcacagcgccccac

SEQ ID NO: 12772 - RNA, 60 nt, Human
ccacggggcucccucucccgguggugaaaguguccacacgugugguagucuagugugccg

SEQ ID NO: 12773 - RNA, 60 nt, Human
cauuaggacaucaugucuuugucagugccauguccacaguaucugccauacucccuggca

SEQ ID NO: 12774 - RNA, 60 nt, Human
ccucaccccugccccuacccgaaggcccucuguccacacaacaugaaccuaggcugugac

SEQ ID NO: 12775 - RNA, 60 nt, Human
uuucggauuaguuaagauaaaagcauacauuguccacaggugagaagauuaaaucagaau

SEQ ID NO: 12776 - RNA, 60 nt, Human
gcaauggcggugacuuacaaugaaccauaauguccacauuucccaacuguauuuuggagc

SEQ ID NO: 12777 - RNA, 60 nt, Human
ucaguggaaugcagcugucaggccugaagguguccacagccgggcagguggucacugagg

SEQ ID NO: 12778 - RNA, 60 nt, Human
cccaugcucucacucucauccccguucucuuguccacacagcucuuccaauaaagguguu

SEQ ID NO: 12779 - RNA, 60 nt, Human
ggucccggauucuugggucuccaagaagucuguccacagacuucugcccuggcucuuccc

SEQ ID NO: 12780 - RNA, 60 nt, Human
ugcaucaguaucacaucuagcucccuuacuuguccacagauaauguaaacaaaggaggga

SEQ ID NO: 12781 - RNA, 60 nt, Human
aaauguguaauggagauugccucaaaauuguguccacauaauccacgcucaucuugcaaa

SEQ ID NO: 12782 - RNA, 60 nt, Human
uguugccacuuaaaaguucaugaccacaaauguccacagugucuuccucugaggaaacuc

SEQ ID NO: 12783 - RNA, 60 nt, Human
gcaccauccuugacguuuugcugccaccucuguccacauucuucuuggauuuguauaaaa

SEQ ID NO: 12784 - RNA, 60 nt, Human
aguuagaucugcugcucuuagguguggggcuguccacauuagggaacuugccucaaaaac

SEQ ID NO: 12785 - RNA, 60 nt, Human
gggccuccggcggcccggcugcuguucccauguccacaucucugaggccugcacccccuc

SEQ ID NO: 12786 - RNA, 60 nt, Human
gccugcauuuuuuugaguuccuacaucauuuguccacaaagauggcuucagagagguggu

SEQ ID NO: 12787 - RNA, 60 nt, Human
agcggcagggcaugguucuuggcagccugguguccacacggugcauuccugucccccucg

SEQ ID NO: 12788 - RNA, 60 nt, Human
aaggucagaggaguggcccucagugucaucuguccacagugauaccugccaagaugacca

SEQ ID NO: 12789 - RNA, 60 nt, Human
uuccaacugaguccaaacuuuucuaaugucuguccacaucaugcauuaggaaauguaauu

SEQ ID NO: 12790 - RNA, 60 nt, Human
gaggagcuguggacacagucgugguucaaguguccacaugcaccuguuagucccugagag

SEQ ID NO: 12791 - RNA, 60 nt, Human
cugugugugcacugcagacacgccccaguguguccacaugugugugcaugaguccaugug

SEQ ID NO: 12792 - RNA, 60 nt, Human
gcuagacagaaacaugucuugacuguuaguuguccacaaaucuucaguauuuucuccacu

SEQ ID NO: 12793 - RNA, 60 nt, Human
accguccagcauucacuggccggccagcuguguccacagcaguuuuugauaaagguguuc

SEQ ID NO: 12794 - RNA, 60 nt, Human
uuuuccagauacuugcuuuaaagcuacuuuuguccacaaaugaaauacugucacaguaga

SEQ ID NO: 12795 - RNA, 60 nt, Human
gagcagccagcugggaugggaacccaaggcuguccacaucuggcuuuugugggacucaga

SEQ ID NO: 12796 - RNA, 60 nt, Human
cuuaauagcaugcugcuccuuuuugcucaguguccacagcaagaugacgugauucuuauu

SEQ ID NO: 12797 - RNA, 60 nt, Human
aagaguuguauauguccaccuaaauuccuauguccacacuuaaccuuuaaagauguacau

SEQ ID NO: 12798 - RNA, 60 nt, Human
aaagucuaauuuaauaacuagggacaccuguguccacagcuguggcacagacucccacua

SEQ ID NO: 12799 - RNA, 60 nt, Human
gggcacaguaggacacagugacugcccagguguccacacaccuguaggccucugagccag

SEQ ID NO: 12800 - RNA, 60 nt, Human
cauggcauccucccuguacccaggucaggcuguccacaccacaugggagcccagaggagg

SEQ ID NO: 12801 - RNA, 60 nt, Human
cugccuucucacagcuuuccugaguccgcuuguccacagcuccuuggugguuucaucucc

SEQ ID NO: 12802 - RNA, 60 nt, Human
gaagcccagucucagucccucccccaacacuguccacacugccccuccccacuguuuauu

SEQ ID NO: 12803 - RNA, 60 nt, Human
acuucauuuuccaauccggagaaggggcucuguccacagucccccgccgccagguggccc

SEQ ID NO: 12804 - RNA, 60 nt, Human
ucaggagccugguggggacaagauggaggauguccacagaggcugaccugugggggaaaa

SEQ ID NO: 12805 - RNA, 60 nt, Human
ccaguuuguggaagucccaggcaaucacuguguccacaugagcgaaccccagcacguggc

SEQ ID NO: 12806 - RNA, 60 nt, Human
ucccacgcuccuccugccccagcccucugguguccacaccugcccacagagaauguaaac

SEQ ID NO: 12807 - RNA, 60 nt, Human
ugcucccugggucauaccaggaucugccucuguccacaaagaugagggaaaaugaugacu

SEQ ID NO: 12808 - RNA, 60 nt, Human
gccccgugaaagcauguguggcugcagacguguccacaugggccuugcgaaccuggguua

SEQ ID NO: 12809 - RNA, 60 nt, Human
acugugguaggggcagggaggcaacacugcuguccacaugaccuccauuucccaaagucc

SEQ ID NO: 12810 - RNA, 60 nt, Human
gcugcaaaggagguucauauuccccagauguguccacaaaccuguccaggaguugugucu

SEQ ID NO: 12811 - RNA, 60 nt, Human
uguccacacacucccuguccacacacucccuguccacaacugcagccgggcccucugccu

SEQ ID NO: 12812 - RNA, 60 nt, Human
uguccacacacucccuguccacacacucccuguccacacacucccuguccacaacugcag

SEQ ID NO: 12813 - RNA, 60 nt, Human
gccggccacgcucccuguccacacacucccuguccacacacucccuguccacacacuccc

SEQ ID NO: 12814 - RNA, 60 nt, Human
agcugccuaggaaaggccggccacgcucccuguccacacacucccuguccacacacuccc

SEQ ID NO: 12815 - RNA, 60 nt, Human
cacccagccagggcacucagugcauuggacuguccacauguucuugaggaaagccggugg

SEQ ID NO: 12816 - RNA, 60 nt, Human
auaggaugaaaaucaaguaaaaugcaaagauguccacacuguuuuaaacuugacccugau

SEQ ID NO: 12817 - RNA, 60 nt, Human
acucggcccugaugcccucguguccacuuguguccacacaggcccugggaggagcgggga

SEQ ID NO: 12818 - RNA, 60 nt, Human
augucuggcccauugucuccagucuguuccuguccacagcuucccuuuaugcugagcccc

SEQ ID NO: 12819 - RNA, 60 nt, Human
cauggagccaaaguacauccuuggaaucuuuguccacacagcagucaaggcaguuauggc

SEQ ID NO: 12820 - RNA, 60 nt, Human
uucucuucguaaugaauuuucuuuacauccuguccacacugcuggagauacuaaguccca

SEQ ID NO: 12821 - RNA, 60 nt, Human
agcugaaaacacauuuguugauauuugucuuguccacauugugauguucaguauuugagc

SEQ ID NO: 12822 - RNA, 60 nt, Human
augaaaauaaccauaguacaggaugauuucuguccacacaaagguuaaauuagauugcac

SEQ ID NO: 12823 - RNA, 60 nt, Human
auaaccccauugaguugauuguggccagaauguccacaggccuggccugggggcuguggg

SEQ ID NO: 12824 - RNA, 60 nt, Human
aagcugcagacacacacagucauucauuucuguccacaccccuguggguggcgggugugc

SEQ ID NO: 12825 - RNA, 60 nt, Human
ccacaacagcagcaggggccugaaaugugauguccacaagagcuaauacccuacagaugg

SEQ ID NO: 12826 - RNA, 60 nt, Human
aagagacucagagugccuucuccaucccaguguccacacucuccuccagcucugagcccu

SEQ ID NO: 12827 - RNA, 60 nt, Human
ccacagcucauagcucgucaucucggcccuuguccacacucuccaagcacauuacagggg

SEQ ID NO: 12828 - RNA, 60 nt, Human
aaugaaacacuucugaacacugauaggaaguguccacauccacaaaguuucucuugaguu

SEQ ID NO: 12829 - RNA, 64 nt, Human
uaccacugagcugcuggagguggguccuuauuucaagccauauucaacccacccaacaaaaccu

SEQ ID NO: 12830 - RNA, 64 nt, Human
caguuguuaacccacuaggcuccuuugaguagagaagccauaguccuucagccuccaauugaua

SEQ ID NO: 12831 - RNA, 64 nt, Human
augaaaagagcucuaaugccuuucaggcucuuagaagccauagauuuggacaagcccagcaaga

SEQ ID NO: 12832 - RNA, 64 nt, Human
ccuuuguaauaaaaagcuaguuuccugagugaacaagccauaaccuccccuaaacaccaccuag

SEQ ID NO: 12833 - RNA, 64 nt, Human
gacaguguacaaacuaagaaggccuaacugaacuaagccauauuuaucacccguggacagcaca

SEQ ID NO: 12834 - RNA, 64 nt, Human
ucucuuucgggggcagaggcuuucucugggugccaagccauauauauuagggaauaguagauug

SEQ ID NO: 12835 - RNA, 64 nt, Human
cucaggaaguuucucugugcaacuagaaaauucaaagccauauuuagggaacauuuuuucugag

SEQ ID NO: 12836 - RNA, 64 nt, Human
ucuguagaccuuguaaucagcacauugucaccccaagccauagucucucucuuauuuguauccu

SEQ ID NO: 12837 - RNA, 64 nt, Human
uucacacuucugcuuugagaccaggaugggguguaagccauagaguaagguuaacaaaaagaau

SEQ ID NO: 12838 - RNA, 64 nt, Human
aauucuucagauaugagauagugggcuuagaccuaagccauacauauuucuuuucccacauucu

SEQ ID NO: 12839 - RNA, 64 nt, Human
aggcaacagcagcaagggcuggucuggacaagaaaagccauagcccggcagccccuaccaugag

SEQ ID NO: 12840 - RNA, 64 nt, Human
uuccaagucugagcugugcugggguuugaacuaaaagccauauguggaauauugacauguguaa

SEQ ID NO: 12841 - RNA, 64 nt, Human
ugggcuggccaggcugugucaccuucuccaagcaaagccauauggagcaucuacccagacuccc

SEQ ID NO: 12842 - RNA, 64 nt, Human
aagcauaguuuuauccagggagaaaaauaaaaggaagccauagaauugcucuggucaaaaccaa

SEQ ID NO: 12843 - RNA, 64 nt, Human
aaguauuugggcaggugagucauguuuuaaccacaagccauaacucaucuguugucuuugcuug

SEQ ID NO: 12844 - RNA, 64 nt, Human
ggcagugacuucuuuugaguuagguuaauaaaucaagccauagagccccuccugguugauacuu

SEQ ID NO: 12845 - RNA, 64 nt, Human
aaauuauguaauacuuguggaacuuugauaaaugaagccauaucugagaauguagcuacucaaa

SEQ ID NO: 12846 - RNA, 64 nt, Human
guuuauuugugaaguuaaaaguaaauagcauuuuaagccauaaugucccaaaauagauguucug

SEQ ID NO: 12847 - RNA, 64 nt, Human
aucuucagaaucucuaguuuuuguucuauagauaaagccauaagaauccuuuccuaccaguuuu

SEQ ID NO: 12848 - RNA, 64 nt, Human
ggaauauuuugcagaauauagguuuaacugaaugaagccauauuaauaacugcauuuuccuaac

SEQ ID NO: 12849 - RNA, 64 nt, Human
aggggauuuuuuuuucuccuuuuuuuuucuuuuuaagccauaauuggugauacugaaaacuuug

SEQ ID NO: 12850 - RNA, 64 nt, Human
aggggagauuuaaaggaccagggacaugggaaccaagccauagggaucagagggccuuguccuu

SEQ ID NO: 12851 - RNA, 64 nt, Human
aggagucugcgagagccuccuugguuccaucgugaagccauaaacaggaaugccuuuggcaaua

SEQ ID NO: 12852 - RNA, 64 nt, Human
agguggggaaaaagacuaaccuguccuacccucaaagccauaugcaaauacugaaaagaaggcc

SEQ ID NO: 12853 - RNA, 64 nt, Human
aaucauggagcugagaauuucacagauacuuuauaagccauaguacaugagcuuaauaggcugu

SEQ ID NO: 12854 - RNA, 64 nt, Human
uacucuuucacuuaauucuuuacaagggauaucaaagccauaauggacuucauuaguuuuaggg

SEQ ID NO: 12855 - RNA, 64 nt, Human
cuugauuuucccauuucuaaagaugaauuucacaaagccauaaagcgugaaauuagagcuggac

SEQ ID NO: 12856 - RNA, 64 nt, Human
uuccuaagaacuuucuaucaaaagcauuggauccaagccauauauugaaauacaagcgugauua

SEQ ID NO: 12857 - RNA, 64 nt, Human
acacagaagauugccuuacgcucgugagcgugagaagccauaagagagagaccgaauucugugg

SEQ ID NO: 12858 - RNA, 64 nt, Human
auuguuuaauuucaccugaauaucauaaugcuuaaagccauauggaguuggaaauuauuuccaa

SEQ ID NO: 12859 - RNA, 64 nt, Human
uuuccagauggcuaguuuauuaaugauuucccaaaagccauaccuuaaagauaacuuuuuaaau

SEQ ID NO: 12860 - RNA, 64 nt, Human
aguauuuuggaauuuguauaauaaggauguuuagaagccauauaaguggcuuuuuuuaacagau

SEQ ID NO: 12861 - RNA, 64 nt, Human
agaccacuuagagggucucuaugccaaggucaacaagccauaccauccacugguuccagcugac

SEQ ID NO: 12862 - RNA, 64 nt, Human
aagacaagugaugcuaaaaccugaaauuccaaugaagccauaugaacagcuguucaguugcacu

SEQ ID NO: 12863 - RNA, 64 nt, Human
uuacuugcugcaguugcaacuaugcacuuguauaaagccauaauguuggaguuuauaucacuca

SEQ ID NO: 12864 - RNA, 64 nt, Human
ucgauaguguuuucuucaaugcugcugcugugugaagccauacuuuuucaggauucuuccccua

SEQ ID NO: 12865 - RNA, 64 nt, Human
gagagaaacaaaaaagugugacauuacagaugagaagccauauaauggcgguuugggggagccu

SEQ ID NO: 12866 - RNA, 64 nt, Human
aaaaaagacaacuuuauaaaauggcacuuuaagcaagccauaguuaguuuuauuuuuguaaugc

SEQ ID NO: 12867 - RNA, 64 nt, Human
cacauuuuauuuggagauauuuaaaugaaauagaaagccauauaacauagcuauaauuacuacc

SEQ ID NO: 12868 - RNA, 64 nt, Human
auaacuauuaccuuaaaaagcacugguuuagaaaaagccauaacuuaaauaguguuauaaaaua

SEQ ID NO: 12869 - RNA, 64 nt, Human
cagugacuaugcauuagugcugacucuuugguauaagccauaaaauauuuuccuuccuaucaau

SEQ ID NO: 12870 - RNA, 64 nt, Human
uccacauuuugaaaugcaaagaaagcucccuuguaagccauacuuccuuccccacucccauccu

SEQ ID NO: 12871 - RNA, 64 nt, Human
cacaauauuauauugcauauugcccaauaagcagaagccauaaggucucacacuuuucuuauaa

SEQ ID NO: 12872 - RNA, 64 nt, Human
uaauuugaaagcuaugagaauagaugugugggugaagccauagaacauauuugcuugaaauucu

SEQ ID NO: 12873 - RNA, 64 nt, Human
ccaggcucccuuugcacacagagcagcuacuucuaagccauaucgacuguuuugcagaggauuu

SEQ ID NO: 12874 - RNA, 64 nt, Human
uagacuuuuguauaagagaugucaugccucaagaaagccauaaaccugguaggaacagguccca

SEQ ID NO: 12875 - RNA, 64 nt, Human
ucagggcagacggcaauaaucucuuacaagaaugaagccauauucaaccccagaugagaaaacc

SEQ ID NO: 12876 - RNA, 64 nt, Human
guugcuaauauugaggaggcuugccccacccaacaagccauaguggagagaacugaauaaacag

SEQ ID NO: 12877 - RNA, 64 nt, Human
uaaaaagucuuuaagacauaagaauuccucaaagaagccauacauuuuuuaagguggggauuga

SEQ ID NO: 12878 - RNA, 64 nt, Human
aagcuaaaccucaaauauaaaaauuggcgaaaagaagccauacgccuuuuuaauuugccaaaaa

SEQ ID NO: 12879 - RNA, 64 nt, Human
uauuagccagugaaacacuugcuugccaacugccaagccauacuuauuaaguucgaacauguuu

SEQ ID NO: 12880 - RNA, 64 nt, Human
aaucugucucagccuacuuuauuccugcauugggaagccauaucgcagagcuaaaugcaauaga

SEQ ID NO: 12881 - RNA, 64 nt, Human
cgggcucagccuuccuggacacacuaggugugggaagccauaggagccuccagaugggggcugg

SEQ ID NO: 12882 - RNA, 64 nt, Human
uuuuggucucuuuugguggggugggggugggcuaaagccauaggaagaaaaaugugauguaugu

SEQ ID NO: 12883 - RNA, 64 nt, Human
agcuuuuaauucagcugcaugaccugugccuuuuaagccauaaagauaccucaagccuagcacc

SEQ ID NO: 12884 - RNA, 64 nt, Human
accauagaaauguaaaagaugugacaaaaccuuuaagccauacuccaggcuucuuaaacauaau

SEQ ID NO: 12885 - RNA, 64 nt, Human
cugugcauacucagcuuuguagaaccaugcugcaaagccauauaccgaugggguuauccaugca

SEQ ID NO: 12886 - RNA, 64 nt, Human
ugccucuguauagauguugucaguuaggaaacugaagccauaggucaggcagacaucagcucag

SEQ ID NO: 12887 - RNA, 64 nt, Human
cuuacuggugcauguuguaacauaucuaugauaaaagccauaguuuaccuaaaauggugauuuc

SEQ ID NO: 12888 - RNA, 64 nt, Human
gcgcaucauaugcagugauauaugccuauaauauaagccauagguucacaccauuuuguuuaga

SEQ ID NO: 12889 - RNA, 64 nt, Human
gcauugaccuucaugaccuuacauagcuuuagagaagccauaacguuagacugcaauacuaacg

SEQ ID NO: 12890 - RNA, 64 nt, Human
agggacgagcagagcgcagcccccacgccgauauaagccauagccccaggcccgcccugcccgc

SEQ ID NO: 12891 - RNA, 64 nt, Human
uacccugcuugaaauacaguuaguugauaacauaaagccauaguuuucuuggauuuucuuccaa

SEQ ID NO: 12892 - RNA, 64 nt, Human
uucuaguauuggaucugaaaauaaagugucauccaagccauaaaaaaaaaagaaaagaaaaaua

SEQ ID NO: 12893 - RNA, 64 nt, Human
ggaggaaaacauuagggaaaacaaaaaugauauaaagccauaugagguuauauugaaauguauu

SEQ ID NO: 12894 - RNA, 64 nt, Human
cucucccaucacuucccuacauggaguauaugucaagccauaauuguucuuaguuugcaguuac

SEQ ID NO: 12895 - RNA, 64 nt, Human
caacgaaagcugaauaguguuggaacugaggaggaagccauagcucagggucaucaagaaaaau

SEQ ID NO: 12896 - RNA, 64 nt, Human
gugucuccagguaacuuugcuugauuaaacagcaaagccauauucuaaauucacuguugaaugc

SEQ ID NO: 12897 - RNA, 64 nt, Human
cgcuuagaaacauguuccuguuccucgggaugaaaagccauaucuagucaauaacucugauuuu

SEQ ID NO: 12898 - RNA, 64 nt, Human
aaaaagaacucaaaaggagaacugugcucucccaaagccauaucaccagucuuaccaaacaaua

SEQ ID NO: 12899 - RNA, 64 nt, Human
augaaguauugaucauuuucuaucucaaaaguguaagccauaaggcuguuuuacagaauagcac

SEQ ID NO: 12900 - RNA, 64 nt, Human
aguuuuguguggcaucacagugauuugucaugaaaagccauauaugggggacaugcuaaaaugg

SEQ ID NO: 12901 - RNA, 64 nt, Human
ucauaccaaguauuggguacagguuacaauuuugaagccauaugaguuuauauugauuuuuuuu

SEQ ID NO: 12902 - RNA, 64 nt, Human
augguaagaaauugaaguauccuuaaaggccaugaagccauaugucccuaaagccuguguggag

SEQ ID NO: 12903 - RNA, 64 nt, Human
agguuugauucuuguuagaggguuuuuguucuggaagccauauuugauaguauacuuugucuuc

SEQ ID NO: 12904 - RNA, 64 nt, Human
cuccuguggcaccguuucucccuccacagggccaaagccauaguguccggucccaaggacaagg

SEQ ID NO: 12905 - RNA, 64 nt, Human
gacaugugucuucucuguccguuuccaauagguaaagccauaucaguuagacugcaauacuuua

SEQ ID NO: 12906 - RNA, 64 nt, Human
ugaugauuaucauaugauaccucagugauuuuaaaagccauagaagaaacuugacuaugccugg

SEQ ID NO: 12907 - RNA, 64 nt, Human
uuuuuuucaagagaguuauuuuaaagauucaaggaagccauaagucauacuaaauaauauuaua

SEQ ID NO: 12908 - RNA, 64 nt, Human
uguaaaaguaauaauuccccaauaucaucuaaucaagccauauuuaaauuucugaaguuaacuc

SEQ ID NO: 12909 - RNA, 64 nt, Human
uuuuuuuuuuuuuuuuaagcucaaggagaaauugaagccauagucgugccuguuugcuuagcau

SEQ ID NO: 12910 - RNA, 64 nt, Human
ucguuaauuaaaucugcaguuuuauuuuugaaggaagccauaacuauuuaauuuccaaauaauu

SEQ ID NO: 12911 - RNA, 64 nt, Human
aagcuauuuuaaagauaauggcauuauuauuuccaagccauagcuugggcugaaggacaaauug

SEQ ID NO: 12912 - RNA, 64 nt, Human
aaaccauuaguaggaggggugggccauguucauuaagccauaguggucccuaguucauuguuga

SEQ ID NO: 12913 - RNA, 64 nt, Human
aaauggcccuuuugaauguugaagauaggaaagaaagccauauauucaaauauguaauuuuccu

SEQ ID NO: 12914 - RNA, 64 nt, Human
uccugagguggauuuacugagagaaggugaaauaaagccauauuuaguauaccagagaagguag

SEQ ID NO: 12915 - RNA, 64 nt, Human
agcacauuggugacagaccuucggggccugucugaagccauagccuccacggagagcccugugg

SEQ ID NO: 12916 - RNA, 64 nt, Human
gacuugcuaaccaagcucgaaaaugaacaugaaaaagccauacauguauuauuucuccuaaaac

SEQ ID NO: 12917 - RNA, 64 nt, Human
uugguaccaaguccagguauaacauuccuauuggaagccauacuuauauuuucuuguaaagugc

SEQ ID NO: 12918 - RNA, 64 nt, Human
aaagacuuuagcugacucguuaagccugauacauaagccauauuuaaaauucuaagaaauaauu

SEQ ID NO: 12919 - RNA, 64 nt, Human
gaccaggauggacaacucauuggcccugccucaaaagccauaccucuucuccugcuaugcagaa

SEQ ID NO: 12920 - RNA, 64 nt, Human
gauuucccuaguaaccuugcagauauguuuaaccaagccauagcccaugccuuuugagggcuga

SEQ ID NO: 12921 - RNA, 64 nt, Human
ugaacaauuaagaggcucucccccucuugucuuuaagccauauucuccuacauguauuuuauaa

SEQ ID NO: 12922 - RNA, 64 nt, Human
agcuucuaacaaaacucugacuuacccaucagagaagccauacuggugaaaaauuguauauuug

SEQ ID NO: 12923 - RNA, 64 nt, Human
ugaccuuccacuagaccaugagcaccugggcggaaagccauauaucuuauuaagcuuuauaucu

SEQ ID NO: 12924 - RNA, 64 nt, Human
ugcuuuaagcuguaauguuuugccauguugcaaaaagccauaauaauaaguauaaaaaagcuuu

SEQ ID NO: 12925 - RNA, 64 nt, Human
ugguauuauggaccgaacugaaaauuuuauguugaagccauaucccccaugauuauauaguuau

SEQ ID NO: 12926 - RNA, 64 nt, Human
guggaaaauauauugucuuggaaauuuguuguaaaagccauauuucuaauggaaaaucaggugu

SEQ ID NO: 12927 - RNA, 64 nt, Human
uuuuacuaaacauaagguaauucauacuggagaaaagccauacaaaugagaagaauguggcaau

SEQ ID NO: 12928 - RNA, 64 nt, Human
uggagacuacuucguaguggaguaccgggaccagaagccauacugcaucagccccugugagccu

SEQ ID NO: 12929 - RNA, 64 nt, Human
cccaaggccccacuuucaagaaucagacagcaggaagccauagaugcuggcuggguuccagguu

SEQ ID NO: 12930 - RNA, 64 nt, Human
aaauaaaacccugccuuguaaaauaguaaaagagaagccauauauuggcuuuucuucuuaacuu

SEQ ID NO: 12931 - RNA, 64 nt, Human
uggugcugguuuauuuguuguuuucugggggaaaaagccauaucaugcuaaaauucuauagaga

SEQ ID NO: 12932 - RNA, 64 nt, Human
cuggggugggggcugagcaugcuugugcagaaagaagccauagccagaaaggacagaaucucuc

SEQ ID NO: 12933 - RNA, 64 nt, Human
ggcuaugcuucaguuuuucuuuguaagccaucacaagccauagugguagguuugcccuuuggua

SEQ ID NO: 12934 - RNA, 62 nt, Human
acuuguaugauuucuugugaaaacaagcuucaaagccauauggacacugugacaaugacuaa

SEQ ID NO: 12935 - RNA, 64 nt, Human
aacaaaucauuucuaaacaguuauuuuccauuaaaagccauauuaaguauuuugcuuguuaaau

SEQ ID NO: 12936 - RNA, 64 nt, Human
caccacagcucaagaaaaccuaaaguuucaauacaagccauaggcucacagaaaaagaaaaaga

SEQ ID NO: 12937 - RNA, 64 nt, Human
guuuugagaaauacgagucugucagagcggccauaagccauaaagagucaaucucuuaauuaua

SEQ ID NO: 12938 - RNA, 64 nt, Human
gcagagaaagugaaggucgacccagggcuguaggaagccauaggagagugaccacgggauuccc

SEQ ID NO: 12939 - RNA, 64 nt, Human
gagugacuaagauuugaguccauugcaaaagguuaagccauaugacaauuucaaaaugcaugug

SEQ ID NO: 12940 - RNA, 64 nt, Human
uuuagccuaaagugguuuucaaauccaguucuucaagccauaaaugaccaagauccaagcaauc

SEQ ID NO: 12941 - RNA, 64 nt, Human
uuucaaggggguucuaaagcauucaagugcuuaaaagccauaaaaaaugacuucuuaauuccug

SEQ ID NO: 12942 - RNA, 64 nt, Human
ucuggcuuuaaaauuuuaaaacaaacaaacaaaaaagccauagagagcagaacuugccgagggu

SEQ ID NO: 12943 - RNA, 64 nt, Human
aauaaucaaucaaucagcauauacauuucagccaaagccauagaagaaaaagcaauaguugcuu

SEQ ID NO: 12944 - RNA, 64 nt, Human
cagugaccuuugaccucggugaccacucuucuuuaagccauagacccugaggcccugggcuggg

SEQ ID NO: 12945 - RNA, 64 nt, Human
ccuggacacauuggaaugccuuggaaauagaaagaagccauauaugaccagaagccuuggaacc

SEQ ID NO: 12946 - RNA, 64 nt, Human
auuuaguaauggacuauacaggauguuaauaaugaagccauauguuuaugucuggauuuaaaaa

SEQ ID NO: 12947 - RNA, 64 nt, Human
uucauuuugugaauuauagaagcuacuuuuuauaaagccauauuuuuuuagggaaacuaaggag

SEQ ID NO: 12948 - RNA, 64 nt, Human
aucauuuugaaaggaccaugagcaacuauaagcaaagccauaagaagugguuugaucgauauau

SEQ ID NO: 12949 - RNA, 64 nt, Human
uuaaguuauuuaggaacacaaaggacagacaaaaaagccauaugcacaugccucauuuucucuu

SEQ ID NO: 12950 - RNA, 64 nt, Human
aauaaauaggggcuuauacaaaaaagaaaauaaaaagccauauauacugcaaaguuccuaacug

SEQ ID NO: 12951 - RNA, 64 nt, Human
aucaugcuggcaauguuaauuacccagguguaggaagccauacacugaggcggaagaucgcaag

SEQ ID NO: 12952 - RNA, 64 nt, Human
cuuacccaucuucaaaugaaaauuccauuuuuguaagccauaaugaacuguaguacauggacaa

SEQ ID NO: 12953 - RNA, 64 nt, Human
ugagauuucagcuaugcuagaggcuuuuauuagaaagccauauuuuuuucuguaaaaguuacua

SEQ ID NO: 12954 - RNA, 64 nt, Human
ucuucugguagcuucaugguaaaugcauccgaauaagccauacuggauugcaguguuuguuucu

SEQ ID NO: 12955 - RNA, 64 nt, Human
aauugggagauaccuuuggucugcuccugcaccaaagccauauggguggaagucaguuggccuc

SEQ ID NO: 12956 - RNA, 64 nt, Human
cccugccagccccacagauuuuauuuuugcacauaagccauaaccaauccucaaggcuggcaca

SEQ ID NO: 12957 - RNA, 64 nt, Human
ugccaccucuggccaaauaugcacuuucccuagaaagccauauuccagcagugaaacuugugcu

SEQ ID NO: 12958 - RNA, 64 nt, Human
cugggauuuaugcucaugaacuaaauuuaagcuuaagccauaaaauagauuagauuguuuuuua

SEQ ID NO: 12959 - RNA, 64 nt, Human
guuccuuguaagcugaaccaucaauuaucaguugaagccauacuuuuauuuaaauuaauauacg

SEQ ID NO: 12960 - RNA, 64 nt, Human
ugaggccacuuaucagggccuggagcccugauggaagccauaggaacuccagaguugccaagcc

SEQ ID NO: 12961 - RNA, 64 nt, Human
cccugauggaagccauaggaacuccagaguugccaagccauagcugagaagccuggugguuuuc

SEQ ID NO: 12962 - RNA, 64 nt, Human
auacaguuuuaacuuacuuagauuuauucuaguuaagccauaaguucaacguguaaacuuguuu

SEQ ID NO: 12963 - RNA, 56 nt, Human
caugccccgucuccaucuagcaggaaaagccauaucuugcaccagcagcaugaaug

SEQ ID NO: 12964 - RNA, 64 nt, Human
gaaaaauuauauaaauuuuagaaguuauuucauaaagccauacgguauugacauauuuuuaagg

SEQ ID NO: 12965 - RNA, 64 nt, Human; identical to SEQ ID NO: 12922

SEQ ID NO: 12966 - RNA, 64 nt, Human
cucucugacuuaucuggaaguauuucuuuuugugaagccauauguccuaacaggagcuucauca

SEQ ID NO: 12967 - RNA, 64 nt, Human
ccagggguccugaaaaccaaaggaggagcagcagaagccauaggcuccccagcuuucuccaggc

SEQ ID NO: 12968 - RNA, 64 nt, Human
uguagaaaauguaauaaacacuguuaagacuuaaaagccauauaauuccaccaaccaaaauuaa

SEQ ID NO: 12969 - RNA, 64 nt, Human
uuuuuaaaucacauuaauuuuaccaagugaaaccaagccauacuguuuuugagccaauuaagaa

SEQ ID NO: 12970 - RNA, 64 nt, Human
uugaggcuauacagccacugugcccuguggaauaaagccauauauauaaauguuuuauauguau

SEQ ID NO: 12971 - RNA, 64 nt, Human
ggggcaggggacuaucugaagcgcuuccauccuaaagccauaaugaaaauaucuuccucucuuc

SEQ ID NO: 12972 - RNA, 64 nt, Human
gggcccauuccccuaauaguuuuauuuuuaaagaaagccauacauagaaugcuucaagcuaucu

SEQ ID NO: 12973 - RNA, 64 nt, Human
gauuagauaggguuccaacugggccuacaagcucaagccauacauaaaaggaccuugggacaua

SEQ ID NO: 12974 - RNA, 64 nt, Human
uuccuccuauuuuuuuuuaaccuguuaaacucuaaagccauagcuuuuguuuuauauugagaca

SEQ ID NO: 12975 - RNA, 64 nt, Human
ccugcagugauagaaacaggucguucugcauuauaagccauagguggagcauucgguagcguau

SEQ ID NO: 12976 - RNA, 64 nt, Human
aauuuuauuuuguucucuacauacaaucaauguaaagccauaucacaaugauacaguaauauug

SEQ ID NO: 12977 - RNA, 64 nt, Human
acaucauguuucuucauuggauuuguaaaacuugaagccauaaaaauauuaguuugguguguau

SEQ ID NO: 12978 - RNA, 64 nt, Human
ggauacccuuuuaacuucuucccuucagccacauaagccauaugaugacacacagugucuuucu

SEQ ID NO: 12979 - RNA, 64 nt, Human
aucuguuugaaggaauuuuccugguuuucagaugaagccauaaggcuuuggaguuaaaccacag

SEQ ID NO: 12980 - RNA, 64 nt, Human
uuauggcaacauuauugaauuuuuuauguacauaaagccauauguuuagggugguuucuaucug

SEQ ID NO: 12981 - RNA, 64 nt, Human
ucagcgcucaggaaugugcuccggcagagugcugaagccauaauccccaaccauuucccuuggc

SEQ ID NO: 12982 - RNA, 64 nt, Human
caaucuguuuuccauuuccauugcaauacuacuaaagccauacaauaucaagcacccucccucu

SEQ ID NO: 12983 - RNA, 64 nt, Human
guguccaggcucugggcacagugcugccccuugcaagccauaacgugcccccagaguguagggg

SEQ ID NO: 12984 - RNA, 64 nt, Human
auaacgugcccccagaguguagggggccuugcggaagccauagggggcugcacgggaugcgugg

SEQ ID NO: 12985 - RNA, 64 nt, Human
gcuacaucauaguugauaaauugauguuaucguaaagccauauguucuguucaagucuuguuug

SEQ ID NO: 12986 - RNA, 64 nt, Human
ccacugcucaggguccauuccucacuauaagaugaagccauaucugccugccuuuuccuaagga

SEQ ID NO: 12987 - RNA, 64 nt, Human
aaaaccagucuguguuuacagacagaagagaaggaagccauagugucacuuccacacaauuauu

SEQ ID NO: 12988 - RNA, 64 nt, Human
caagaaucaugcacuuuuuaaaauuauuucuaagaagccauaacaaagcuguguacuaauaaag

SEQ ID NO: 12989 - RNA, 64 nt, Human
aagugguggggcugggagaggaggaacagaaggaaagccauagcgcucucuugccccuuggcau

SEQ ID NO: 12990 - RNA, 64 nt, Human
ucagccuacccacugaagucuuuggguagcucuuaagccauaacuaaggagcagcauuugagua

SEQ ID NO: 12991 - RNA, 64 nt, Human
agaguugggaaaaacaacagguuugaguccuauaaagccauaauuuaacuccaguagcugaugu

SEQ ID NO: 12992 - RNA, 64 nt, Human
cuuccuuagaaauucauauuuauuuguccacuugaagccauauuauuuucugauuuauuuucuu

SEQ ID NO: 12993 - RNA, 64 nt, Human
ccucugguguuccuggccucagccagcugcccacaagccauaaaccaauaaaacaagaauacug

SEQ ID NO: 12994 - RNA, 64 nt, Human
ccaggcacugugccgggcacuggggauauacacaaagccauaagcacuggggacugccagguug

SEQ ID NO: 12995 - RNA, 64 nt, Human
aggagagcucccuauccgccuuuggucagagcugaagccauauacgacuggguguuuguccccc

SEQ ID NO: 12996 - RNA, 64 nt, Human
gaaaauaaaaucacuuucuugcuugguaagcaagaagccauaucgauuuuuuuuaacuuacaga

SEQ ID NO: 12997 - RNA, 64 nt, Human
uuggucagcauaucuuagguauauaauaacuuugaagccauaacuuuuaacuggagugguuuga

SEQ ID NO: 12998 - RNA, 62 nt, Human
acuguaugcacacuaacuaaugaaaguccuagaagccauaaaagagacacuuuccugcuggu

SEQ ID NO: 12999 - RNA, 64 nt, Human
uugcuguuuuuauugaucuuaugguuuauuucuuaagccauagucaguguaaauacagcccugc

SEQ ID NO: 13000 - RNA, 64 nt, Human
gcggucuccaauuuaggacuuuuccauagugccaaagccauacauauucaguagaacaucaaua

SEQ ID NO: 13001 - RNA, 64 nt, Human
aguaaauguccaaguaauguuuuuauaauaaacuaagccauauuuagacaauaaacauugauaa

SEQ ID NO: 13002 - RNA, 64 nt, Human
ccuuuuaggaacguaaaguccuuuaagcacucagaagccauaccucaucucucuggcugaucug

SEQ ID NO: 13003 - RNA, 64 nt, Human
uuaagauuuacuuaauacucagaaaauucagauaaagccauagaguccuguuugaagcuucacu

SEQ ID NO: 13004 - RNA, 64 nt, Human
caaaccugcaccauccaucauuauguagaugaaaaagccauaggucauagccucuuugcuauuc

SEQ ID NO: 13005 - RNA, 64 nt, Human
gaacacuugccccucaguauaguacugucaagggaagccauacacuuuuuguagacauggguac

SEQ ID NO: 13006 - RNA, 64 nt, Human
ucauucugccauugacuuggcauuuaccuuggguaagccauaagcgaaucuuaauuucuggcuc

SEQ ID NO: 13007 - RNA, 64 nt, Human
acuuaccuuaccuuaccuagaaaaacauuaauguaagccauauaacaugggauuuuccucaaug

SEQ ID NO: 13008 - RNA, 64 nt, Human
cauucucccucucaaggcaggggucauagauccuaagccauaaaauaaauuuuauuccaaaaua

SEQ ID NO: 13009 - RNA, 64 nt, Human
uagaaguacaccuaauuguuauugguuaaaaaaaaagccauaugugaaugagguugguuuuugg

SEQ ID NO: 13010 - RNA, 64 nt, Human
uuguuugacauacagugaugauggcauuauugauaagccauacaugagacugcagauuauauug

SEQ ID NO: 13011 - RNA, 64 nt, Human
uuauaaugcuuuuuauagcccagcacagaauuuaaagccauaccaccaaaaguaccugugugug

SEQ ID NO: 13012 - RNA, 64 nt, Human
gccgucucugggcaaccaggccccaacugugcuuaagccauaaugccugcugcucucuagacaa

SEQ ID NO: 13013 - RNA, 64 nt, Human
ucuaaguaguugccaucuugaauccuuuguaauaaagccauacuuuugugugugugugugaugc

SEQ ID NO: 13014 - RNA, 64 nt, Human
gagaucaaugacuuuuuaggcagcuguguuuuuuaagccauauacaagaguaaguuaaaagggg

SEQ ID NO: 13015 - RNA, 64 nt, Human
cagacacaagaacaaucuuugcuauaauuguauaaagccauaaauguacauaaauuauguuuaa

SEQ ID NO: 13016 - RNA, 64 nt, Human
gugugagaaacagaguuauuaaguaaguugccagaagccauacaaguacaaagugucaagggga

SEQ ID NO: 13017 - RNA, 64 nt, Human
aauuugcuuuaaacuguuucagagcuucuucccuaagccauaaacugucucaccuaaacaagau

SEQ ID NO: 13018 - RNA, 64 nt, Human
uugauuuuguuuacugaaauuuguuauacuucaaaagccauaacuugaaaaauacugguggcgu

SEQ ID NO: 13019 - RNA, 64 nt, Human
ugaacaccgugucuccuucucuuguguguaccuaaagccauauuuccaagucugugguacucca

SEQ ID NO: 13020 - RNA, 64 nt, Human
gauauuuuucuucaauuuugaagagaaaauggugaagccauagaaaaguuacccgagggaaaau

SEQ ID NO: 13021 - RNA, 64 nt, Human
cuguaauuuuaguugaguauguuuaugauuuuugaagccauauggugaguaaauguaaauauga

SEQ ID NO: 13022 - RNA, 64 nt, Human
aggccagcauugucuuccaugggagaugacucuuaagccauaggggcugguuuuccguacucca

SEQ ID NO: 13023 - RNA, 64 nt, Human
guuugguuuauggggccuggauucuggcuugaagaagccauauuuggcaugggugaagugaaag

SEQ ID NO: 13024 - RNA, 64 nt, Human
uucuguucucuauuaaauuaagaaaauguuccaaaagccauaagccugaagauuggcccugugc

SEQ ID NO: 13025 - RNA, 64 nt, Human
ggacccuuaagaauuuuauuuuuaaaggagauugaagccauagaacucauauugacacucagcu

SEQ ID NO: 13026 - RNA, 64 nt, Human
auauauuaugauguggaaauaauugauaacuuuuaagccauacuauguuuuuaaagauaauuug

SEQ ID NO: 13027 - RNA, 64 nt, Human
uaugaauuuuacacuuggcaaauguuaaugacggaagccauagucugcuccuaauacaugucca

SEQ ID NO: 13028 - RNA, 64 nt, Human
cugcugcgacacaggcagcgcuuuguaaacugugaagccauauacgugaaacugaagagugcau

SEQ ID NO: 13029 - RNA, 64 nt, Human
ccucccaaccucccuuccagggggcuuaccagcaaagccauauucggcuaggaauuuggaauuc

SEQ ID NO: 13030 - RNA, 64 nt, Human
uuggaaucagaauuggaaucacauucuguuuaucaagccauaauguaaggacagaauaauacaa

SEQ ID NO: 13031 - RNA, 64 nt, Human
cgcgccccgcuccccuucucucucuuacucgguuaagccauagcgaggccuccgcucguuucag

SEQ ID NO: 13032 - RNA, 64 nt, Human
auucucuugcgugugaaucucuuacccugaaaaaaagccauaaugaauuaagccagacugacca

SEQ ID NO: 13033 - RNA, 64 nt, Human
cugcugaacuugaacccagagccuucaggugccaaagccauacucaggcccccaccgacauugu

SEQ ID NO: 13034 - RNA, 64 nt, Human
guauugccuuaaguuuucacucauugucuuuugaaagccauaugauaaaaugauuuuauuuaau

SEQ ID NO: 13035 - RNA, 64 nt, Human
uacaaccucuuauuguauaguuugccuugauuauaagccauaguaaaucgagcuguucgcauuu

SEQ ID NO: 13036 - RNA, 64 nt, Human
uaauauuagaauauauuaaccgcuuaaggcauugaagccauaugggauggggaaugcauuucuu

SEQ ID NO: 13037 - RNA, 64 nt, Human
cuuaguaccuccgcugcuucacuugcuuuagccaaagccauaaaaaaccugcaacguagagaaa

SEQ ID NO: 13038 - RNA, 64 nt, Human
gcccccucaccuuuuuggguagguaaaagacuaaaagccauauggauuuuaacugauaacaaug

SEQ ID NO: 13039 - RNA, 64 nt, Human
cuauguuuucaaaccuuuuugagccauaggauccaagccauaaaauucuuuaugcauguugaau

SEQ ID NO: 13040 - RNA, 64 nt, Human
uuugucaagagccaguagagcagacagaugcugaaagccauaguuucauggcaggcuuuggcca

SEQ ID NO: 13041 - RNA, 64 nt, Human
gagucccggcuucgaguagugauacgcaugaacaaagccauauccuuuugcaguggggucgaga

SEQ ID NO: 13042 - RNA, 64 nt, Human
aucugggcugagccaaagucccuuuuggaaauacaagccauaacauucgaaggacaucagcgac

SEQ ID NO: 13043 - RNA, 64 nt, Human
ucccagcuuccuggcagcaucgucuggucggugaaagccauagcauggacaccccauggggagc

SEQ ID NO: 13044 - RNA, 64 nt, Human
aaugccuuccuacagcucacuggggugcuuaccaaagccauagcuuuaaaccuucccagucccc

SEQ ID NO: 13045 - RNA, 64 nt, Human
gaugucagugagggcgaucauagggcauaagccuaagccauaccaugcagccuuugugccagca

SEQ ID NO: 13046 - RNA, 64 nt, Human
uagaaugacaguuaucuauggaggugguagaauuaagccauaccuuuuccuucaucacucuugg

SEQ ID NO: 13047 - RNA, 64 nt, Human
gggcuggaggggcugcccagggaccuuggucucgaagccauacgugguugucugcuuuccuaag

SEQ ID NO: 13048 - RNA, 64 nt, Human
aaagcacuagguuuuaaaucaguggguaucauaaaagccauauauaaaagauccuuucuuauag

SEQ ID NO: 13049 - RNA, 64 nt, Human
uugggcuagaauguacacgucuccuugccugaauaagccauauauaugcucuuaaacaaaaguu

SEQ ID NO: 13050 - RNA, 64 nt, Human
cuuuauuuauggauuguaauaacaaccacaagaaaagccauacaucuuaaugaacauacgccuu

SEQ ID NO: 13051 - RNA, 64 nt, Human
aauuggaacaaagggaaacagauacuugauaugaaagccauaaugacggugacuugugucgugg

SEQ ID NO: 13052 - RNA, 64 nt, Human
guucagguccaggguuacauaauugcagaagcacaagccauacaucgcagguaggaaaccacag

SEQ ID NO: 13053 - RNA, 64 nt, Human
aaucuguuaaugcacaugcacaauaauuuccugaaagccauaggacaugucuguagucagcacc

SEQ ID NO: 13054 - RNA, 64 nt, Human
gccauugcgcugccccggccgccaguccgcccagaagccauagacgagacguagguagccguag

SEQ ID NO: 13055 - RNA, 64 nt, Human
gaaauggcauuuacguuucucugaugcucccuugaagccauagaauuuaggggcuuuuuuaaaa

SEQ ID NO: 13056 - RNA, 64 nt, Human
cuggugugggaugcagccggccgaugagaaaauaaagccauauugaaugaucgccaccaguguu

SEQ ID NO: 13057 - RNA, 64 nt, Human
ggguguaauauaccauagugauaaauaugaccaaaagccauaaaugacugugagauguaugaga

SEQ ID NO: 13058 - RNA, 64 nt, Human
guguguaauauaccauagugauaaauaugaccaaaagccauaaaugacugugagauguaugaga

SEQ ID NO: 13059 - RNA, 64 nt, Human
ugccuuuuuuaauacaugaaagaauucuagagagaagccauauacauguaaguaacaugggaaa

SEQ ID NO: 13060 - RNA, 64 nt, Human
gcugcgcggccccagccugggcacccugauuuuuaagccauagaccuggggucagggcaggaag

SEQ ID NO: 13061 - RNA, 64 nt, Human
ccuuacuguacaucagagaauucauacuggagaaaagccauauaaauguagugagugugggaaa

SEQ ID NO: 13062 - RNA, 64 nt, Human
uccuggcuccgccucuuccaucaggaccacuauuaagccauaggaguccugggggugcaaaggg

SEQ ID NO: 13063 - RNA, 64 nt, Human
ccgccccccucagccccuuccuccccagggagcaaagccauaaggggcaggggccaccccacgg

SEQ ID NO: 13064 - RNA, 64 nt, Human
cacuccacaugugcuggggacauaggaagaccuuaagccauagcucaucccuuucuagauuuga

SEQ ID NO: 13065 - RNA, 64 nt, Human
aaguccacggccugaggccaggcccucugcacagaagccauaugccggccagccgcgccuccuc

SEQ ID NO: 13066 - RNA, 64 nt, Human
acacaaacuguauaagugucaggaauauggagagaagccauauaaauguaagaaaugugggaaa

SEQ ID NO: 13067 - RNA, 64 nt, Human
ccuucaaaaucaugagacaacucauaugggagagaagccauaugaauguaaauaaugugggaaa

SEQ ID NO: 13068 - RNA, 64 nt, Human
gacaguucuugcuguguaacagaugcuccauaguaagccauaaguauuccugcuaaaguuagcu

SEQ ID NO: 13069 - RNA, 64 nt, Human
cuuggcaaauggacaccaggggcuucuccccucaaagccauaccccgccucugggcgggcaugg

SEQ ID NO: 13070 - RNA, 64 nt, Human
ucgugacccugcccccucccuggggccccuccugaagccauacccucccccaucugggggcccu

SEQ ID NO: 13071 - RNA, 64 nt, Human
ccuuuccugcccggaccgugaauucaucuccuugaagccauaacguccgagcugcuggugcggg

SEQ ID NO: 13072 - RNA, 64 nt, Human
cagaaaucaagauacacaagugaggaauuguccaaagccauaaccuugauuggagagaacaugg

SEQ ID NO: 13073 - RNA, 64 nt, Human
gcuucaaauacauaggagaauucacacuggagaaaagccauagaaauguaagguuugugacaag

SEQ ID NO: 13074 - RNA, 64 nt, Human
cacgagugacagggcuccgggggaagucucagagaagccauagccccccugggaccuccggacu

SEQ ID NO: 13075 - RNA, 64 nt, Human
uuuccccuucagaugucagugucugcaugugggaaagccauagcacacaucuuaccuuuccaag

SEQ ID NO: 13076 - RNA, 64 nt, Human
ugcagggccaucucacccaugcagcauaaggcagaagccauagucacuuuccaucuugccugga

SEQ ID NO: 13077 - RNA, 64 nt, Human
aguggacgaaaauggggcuguuaauauacucuaaaagccauacuaaaaaugcucugagggaacu

SEQ ID NO: 13078 - RNA, 64 nt, Human
cuuguacgguacuggcagaaaagucauuuuucaaaagccauaggcuuuuccuugcccuuagcug

SEQ ID NO: 13079 - RNA, 64 nt, Human
ucuugcuguaacucagacauuccaaggguaugggaagccauauucacaccucacgcucuggaca

SEQ ID NO: 13080 - RNA, 64 nt, Human
auuauauauuaaacauucuugcugcugcgcugcaaagccauagcagauuugaggcgcuguugag

SEQ ID NO: 13081 - RNA, 64 nt, Human
acauugcuucugcgcugguggcaauagggcaacaaagccauaggccagagggcggggggauguc

SEQ ID NO: 13082 - RNA, 64 nt, Human
ucgggucuuaaaguguguggacauuuucaucccgaagccauagagacauuugcugucauauugc

SEQ ID NO: 13083 - RNA, 64 nt, Human
accacaagguccacucccugcuccacgaagccuuaagccauaggcccaggauauuucugagagu

SEQ ID NO: 13084 - RNA, 64 nt, Human
gagccaugacagguccaucagcaugaaguuggccaagccauagggcacagcaccuccuuguaac

SEQ ID NO: 13085 - RNA, 64 nt, Human
aacucaucuugauugaguggccuuccugccaaacaagccauauauaaagacugauggaaucguu

SEQ ID NO: 13086 - RNA, 64 nt, Human
auucuuugaaacuuguuggguagaaugaaaauuaaagccauaaugguagaagauggcauacuga

SEQ ID NO: 13087 - RNA, 64 nt, Human
ggggagugggguccaagugacagcuggaugggagaagccauaguuucucccagucagcuaggau

SEQ ID NO: 13088 - RNA, 64 nt, Human
aaauauggaagucacgucauaaucuaccuuugcaaagccauacaugaacuuuuauuuacuuugu

SEQ ID NO: 13089 - RNA, 64 nt, Human
uuauuuauuuuccaggauucagggaauauuccagaagccauagcuucuuaccgcacggcucuga

SEQ ID NO: 13090 - RNA, 64 nt, Human
guaggcuccaugccaaguaacagcagagggaguuaagccauaggaauuuggcuguggaguaaga

SEQ ID NO: 13091 - RNA, 64 nt, Human
uccauaggauaucugaggaacauucaucaaaaauaagccauagacaugaacaacaccucacuac

SEQ ID NO: 13092 - RNA, 64 nt, Human
uaccaaacacuaacaagaggaagcagaauaugagaagccauauuuuuacauaggagucagauac

SEQ ID NO: 13093 - RNA, 64 nt, Human
acaggcuggggccucgagaaggagucacucagacaagccauauuuuuagaaaguagucuacuga

SEQ ID NO: 13094 - RNA, 64 nt, Human
gaggguccucuucauuuuugggaacuccuuuccaaagccauauuuuugggaggcagagaggggc

SEQ ID NO: 13095 - RNA, 64 nt, Human
cuugcucauggcaugaaugcuauguggacagcccaagccauacccagaaucaccuuaauuccaa

SEQ ID NO: 13096 - RNA, 64 nt, Human
aaaaguuugcacauauuguucuguguaauuguguaagccauaauuacaguguuuaauucucuuu

SEQ ID NO: 13097 - RNA, 64 nt, Human
ggaacaacuguacuuuuuuugaucaguuggcaugaagccauagaauuaaauuuuggcuuuagaa

SEQ ID NO: 13098 - RNA, 64 nt, Human
uacuuuuuggauuguagccaguucagcuaggcaaaagccauacuuuucacaauuaaaaaaaaaa

SEQ ID NO: 13099 - RNA, 64 nt, Human
acacaucaguacuguggagaguuucuguuaggaaaagccauacauuuuuaaaaauguagcaaaa

SEQ ID NO: 13100 - RNA, 63 nt, Human
gggccgaucuggguguccugacccucagcuggcccugcccagccacccuggacgugaccguau

SEQ ID NO: 13101 - RNA, 63 nt, Human
cacagggggagggugaggcuuuguaccccagccccugcccaggccacugugagggugggugcu

SEQ ID NO: 13102 - RNA, 63 nt, Human
cacagggggagggugaggcuuugcaccccagccccugcccaggccacugugagggugggugcu

SEQ ID NO: 13103 - RNA, 63 nt, Human
gauugugguccccugcccccucugucccgucccccugcccaagugacugaaaccuacugagcu

SEQ ID NO: 13104 - RNA, 63 nt, Human
gcccgugucuucccucccuucucggccccgccaccugcccagcgugcccuggcucuccagaac

SEQ ID NO: 13105 - RNA, 63 nt, Human
ggugggaugcuuguagcuccucacagcaggauuccugcccacuguuuuuucucuguugggagg

SEQ ID NO: 13106 - RNA, 63 nt, Human
ucagggcggaaccaucuuucacccggccaagcuccugcccagauguugacccucacccagcgu

SEQ ID NO: 13107 - RNA, 63 nt, Human
acuucauaaagaugucucacagcccuggggacaccugcccagugggccccagcccuacaggga

SEQ ID NO: 13108 - RNA, 63 nt, Human
agacagagcugcugccuucccggccucacgcacccugcccaccagccccucggaagcauguga

SEQ ID NO: 13109 - RNA, 63 nt, Human
gcagcacaguggaagugggagccugguccuuccccugcccauggagagcucuuuaagggaucc

SEQ ID NO: 13110 - RNA, 63 nt, Human
ccaccagcccccaggugaggcuuccagcugggaccugcccagacaggcugagccugggcgugg

SEQ ID NO: 13111 - RNA, 63 nt, Human
cucccugcccccuguccugcuucccacccccugccugcccagccugggcccugcaguguggag

SEQ ID NO: 13112 - RNA, 63 nt, Human
aucaaggauggcuccaguacguacagcaagauuccugcccacaggaagggccacaggcccgcu

SEQ ID NO: 13113 - RNA, 63 nt, Human
gagauccuaagggaccacacccuuccuccuuccccugcccacagaggcagagggcacaggaaa

SEQ ID NO: 13114 - RNA, 63 nt, Human
cccugguguuccuggucacgucccccaggggacccugcccacuuccuggacuucgugccuuac

SEQ ID NO: 13115 - RNA, 63 nt, Human
gcccucaagcuuauacuagagaagagcaacugaccugcccaacuugugugaagucaggagggu

SEQ ID NO: 13116 - RNA, 63 nt, Human
cacaaccgaguaggggccacccuugacgggauuccugcccaggggagagaggcgcugggaaga

SEQ ID NO: 13117 - RNA, 63 nt, Human
auggagucuuggacccuuucuuucucugggaucccugcccagcaccuuccuauagagaugacu

SEQ ID NO: 13118 - RNA, 63 nt, Human
aggcaggagguggcacuggcucccacucccaccccugcccaggcuggcaucuagaaggcguca

SEQ ID NO: 13119 - RNA, 63 nt, Human
caccacccaccgcuggagccccagcugugagaaccugcccacuucccaccagcggcgcuccug

SEQ ID NO: 13120 - RNA, 51 nt, Human
aguccaaagaagcauauugacccugcccaauggaagaaccaggaagaugug

SEQ ID NO: 13121 - RNA, 63 nt, Human
aggcuuucauuucugucugcugagaucucagagccugcccaacagcagggaagccaagcaccc

SEQ ID NO: 13122 - RNA, 63 nt, Human
uccugcagucaaaagcccauuaacgagaaagugccugcccacugcaacggagccgccagcacc

SEQ ID NO: 13123 - RNA, 63 nt, Human
cugaucagucaguagguaucacagcucacauuaccugcccagcgcugcccaaggcucccugga

SEQ ID NO: 13124 - RNA, 63 nt, Human
ccaagcccugcccgccucuccccccacgcucaaccugcccacuuguccaggccuggccucuuu

SEQ ID NO: 13125 - RNA, 63 nt, Human
uuggcucacucugccaugagaacaggacaccauccugcccagcccagacgggguugcuccugg

SEQ ID NO: 13126 - RNA, 63 nt, Human
ggucaaguagaagguacuggggauggggacauuccugcccauaaaggauuuggggaaagaaga

SEQ ID NO: 13127 - RNA, 63 nt, Human
gggcucccugagaucuugguagaggaggccccuccugcccagaccuucguuuguuuccccggu

SEQ ID NO: 13128 - RNA, 63 nt, Human
cccuaagucuuucucuuucccaucauacccuucccugcccaccuuguuuucuguucuccuuuu

SEQ ID NO: 13129 - RNA, 63 nt, Human
ggcucaguggguggccaucgaucuggaccguccccugcccacuugcuccccgugagcacugcg

SEQ ID NO: 13130 - RNA, 63 nt, Human
gacuucggaaaugccuuaaguuccccucuuuauccugcccauguucacuccauuguaggguug

SEQ ID NO: 13131 - RNA, 63 nt, Human
auauuucccuuccgucuuccuucuccuucugggccugcccauguuguugagaggucuugguga

SEQ ID NO: 13132 - RNA, 63 nt, Human
agcucuugagccuacccuccucucacaucuccuccugcccaagauguaaggaagcauuguaag

SEQ ID NO: 13133 - RNA, 63 nt, Human
ggccaggcuagucuugaauuccugaccuccugaccugcccaccucaaccucccaaagugcuga

SEQ ID NO: 13134 - RNA, 55 nt, Human
agaaggaauauuucaucuagaggcgccugcccacuuccugcgccccccaggggcc

SEQ ID NO: 13135 - RNA, 63 nt, Human
cuauuuuuucugaggaauuaaggguuaccccacccugcccacucccaucccuucaaccccacu

SEQ ID NO: 13136 - RNA, 63 nt, Human
ucucuguaaggcaaaauaaucuaaaaagacuaaccugcccacccacuccuuauauugcuguga

SEQ ID NO: 13137 - RNA, 63 nt, Human
ucucccagccccauguacaaagcucaccaagccccugcccauguacagcccccagacccucug

SEQ ID NO: 13138 - RNA, 63 nt, Human
accacucccuuccccagcccgacuucuuggccuccugcccaaccagacaccucaaacucuguc

SEQ ID NO: 13139 - RNA, 63 nt, Human
caguaucugcguagcccacagagggcccaggccccugcccagcugcagucucccagccuccac

SEQ ID NO: 13140 - RNA, 63 nt, Human
ucucuauagcccacugagccccgagacagagaaccugcccacagcucuccccgcuacaggcug

SEQ ID NO: 13141 - RNA, 63 nt, Human
gcagacacagaaagacacaaaacggucgucuuuccugcccaaguaaagcuuacagacuaacug

SEQ ID NO: 13142 - RNA, 63 nt, Human
acgcuguccccgauaacucccuaggggcuccugccugcccaagcggcugagaaccagcgcccc

SEQ ID NO: 13143 - RNA, 63 nt, Human
cccuuggacuucuuuguguguccaguuuggccuccugcccaaacuguccauuccagcagcucc

SEQ ID NO: 13144 - RNA, 63 nt, Human
ggccagccucgccuuucuacccaggcccccugcccugcccaccucaggcccccacccuccacu

SEQ ID NO: 13145 - RNA, 63 nt, Human
uuucucaggacaucucuggcaggugcauuugugccugcccagcaguuccagcuguggcaaaag

SEQ ID NO: 13146 - RNA, 63 nt, Human
cugcggcucuggcccacugagccaccgcgcccuccugcccacgggaggacaagcaauaacucu

SEQ ID NO: 13147 - RNA, 63 nt, Human
gggcuuaggaaccuucucccuucuugggucugcccugcccauacugagccugccaaagugccu

SEQ ID NO: 13148 - RNA, 63 nt, Human
cucuuggccagauugggcucauuaaugucguugccugcccaucugcaugaaugacaggcagcu

SEQ ID NO: 13149 - RNA, 63 nt, Human
aacugucaaauccuugcauacuucugugacaccccugcccauuuucugucuuuaauuaaccaa

SEQ ID NO: 13150 - RNA, 63 nt, Human
ccccuuuucugaggaaugaguuugccuccguccccugcccaugcugggagcccacgcucaccc

SEQ ID NO: 13151 - RNA, 63 nt, Human
augaacaucugaggcugccuuguagagaugcagccugcccagcugaaucuuggcuucuggacc

SEQ ID NO: 13152 - RNA, 63 nt, Human
ccaucccuggggacagaggccuugugucaccugccugcccaggcagcuguuugcagcugaaga

SEQ ID NO: 13153 - RNA, 63 nt, Human
gacgggaccggaagacgagagagggcuggacauccugcccaccgugucccagccagggcaggg

SEQ ID NO: 13154 - RNA, 63 nt, Human
cccccaccccugcggccuuugcucacggguggcccugcccaccccuggcacaaccaaaauccc

SEQ ID NO: 13155 - RNA, 63 nt, Human
gauucuccuccugccucucccgugagucuccagccugcccagcaccggcagcuguggagcacg

SEQ ID NO: 13156 - RNA, 63 nt, Human
ccgucacagcucuguagagacaaucaacuguguccugcccacccuccaaggugcauugucuuc

SEQ ID NO: 13157 - RNA, 63 nt, Human
gcccugggaucagcuggaagcugccugucaucuccugcccaauccccagaaacccugauucag

SEQ ID NO: 13158 - RNA, 63 nt, Human
cccuggcccugcccugugcccugggaugccuacccugcccaccuccggagguggaaccgggcu

SEQ ID NO: 13159 - RNA, 63 nt, Human
aguggaggaggcccaggccacaguaccaccccaccugcccaggcagccccucgucaccuacuc

SEQ ID NO: 13160 - RNA, 63 nt, Human
accagcaggugugguggcucauggcguaaugggccugcccaaugcuuugggaggccaaggcag

SEQ ID NO: 13161 - RNA, 63 nt, Human
uacuugugacugaaggggcacaccacugcccugccugcccacuuagccguccauggcaccagc

SEQ ID NO: 13162 - RNA, 63 nt, Human
cagccuccaagccccacgccagcgagcaggcugccugcccaccccgugcccccagccagcugg

SEQ ID NO: 13163 - RNA, 63 nt, Human
cuggggacucagggaccggugcugcaggaguguccugcccaugccccagucggccccaucucu

SEQ ID NO: 13164 - RNA, 63 nt, Human
gcagaucaccuggggucaggaguucaagaccagccugcccaacauggcaaaaccucgucucua

SEQ ID NO: 13165 - RNA, 63 nt, Human
aagccggacggcagggaugggccccaacuucgcccugcccacuugacuucaccaaaucccuuc

SEQ ID NO: 13166 - RNA, 63 nt, Human
aagggcaggaggagcugcuuggcagaaggaccuccugcccagaccugaggagugagaggcuuu

SEQ ID NO: 13167 - RNA, 63 nt, Human
cccagugucacauccuuggcugucaaucccaugccugcccacgccacacacucugcgaucugg

SEQ ID NO: 13168 - RNA, 60 nt, Human
cugagccucugacccucugagagaugauguccugcccaggcccgauggccacuaggaccc

SEQ ID NO: 13169 - RNA, 63 nt, Human
acaucuaggguuguccugccccuuggcucuaucccugcccagaggugggaacuggaggagugg

SEQ ID NO: 13170 - RNA, 63 nt, Human
aguccacacauuauagucaugugccaccaccuuccugcccacaggccgagggacagggugagg

SEQ ID NO: 13171 - RNA, 63 nt, Human
aaggaugugacauggcuucuccucagggcaaccccugcccaacccucauccccaucuucucag

SEQ ID NO: 13172 - RNA, 63 nt, Human
caaccuccugggaccacugccaccugcaagagcccugcccaggagauagaagaccuggacucc

SEQ ID NO: 13173 - RNA, 63 nt, Human
ggguuccuucagguuccuugccaacccuccuccccugcccacaacuucuccaaacaaagcagg

SEQ ID NO: 13174 - RNA, 63 nt, Human
gugcguaggcuuccagugaugguuggggacaauccugcccaaaggcagggcaguggauggaau

SEQ ID NO: 13175 - RNA, 63 nt, Human
uguguauaugcauaugcaaacucgacccccguuccugcccagauaauggcucaauaacucuga

SEQ ID NO: 13176 - RNA, 63 nt, Human
cagugggacaugggcaccucgggaggcccgggcccugcccagcuacaguuccaccccucagcu

SEQ ID NO: 13177 - RNA, 63 nt, Human
aaagauaggggaagaagccagaaccccaccuggccugcccacaggacaagaaguggguaaggg

SEQ ID NO: 13178 - RNA, 63 nt, Human
cuacacagacaccugaaggagcccccacaugcgccugcccauccagcacugcagaugccaccu

SEQ ID NO: 13179 - RNA, 63 nt, Human
cuagauucccaguucuaaggccuuaucaccuccccugcccauaggccaacaaccauaguuccu

SEQ ID NO: 13180 - RNA, 63 nt, Human
uguaaguuauuucuuguuuguuuguuuggguauccugcccaguguuguuuguaaauaagagau

SEQ ID NO: 13181 - RNA, 63 nt, Human
gcagcgaaggcacugcaaucccuuccccauaucccugcccaacccggacugcugcccguccuc

SEQ ID NO: 13182 - RNA, 63 nt, Human
aaugaaaacgucagccucugccccacccucccuccugcccaaagugaauuugguacucagaaa

SEQ ID NO: 13183 - RNA, 63 nt, Human
uccacaaggcccaggcgcccagggucccaccgaccugcccaggaaugcaucacauuguucucu

SEQ ID NO: 13184 - RNA, 63 nt, Human
cuccaugcugaaggcucccauuuucaguucccuccugcccaggacugcauuguuuucuagccc

SEQ ID NO: 13185 - RNA, 63 nt, Human
gguuguuagagcugagaugacuguacacauaccccugcccaauuuauauagcucuuuguggag

SEQ ID NO: 13186 - RNA, 63 nt, Human
aggacucccccugugucagugcucugcucucacccugcccaagacucaccucccuuccccucu

SEQ ID NO: 13187 - RNA, 63 nt, Human
ugacuaagaauguaauggggaagaacugcccugccugcccaucucagagccauaaggucaucu

SEQ ID NO: 13188 - RNA, 63 nt, Human
ccuggugcucuccccaggcucccuccucagccuccugcccacccagggcccuuuacucucuuc

SEQ ID NO: 13189 - RNA, 63 nt, Human
guuugugauuuuuuuccuuaugcaaaucauacuccugcccaagaaaauacaguaguuccccuu

SEQ ID NO: 13190 - RNA, 63 nt, Human
guaacuucucuccugcucaugugucagugucuaccugcccaaguaaguggcuuucauacacca

SEQ ID NO: 13191 - RNA, 63 nt, Human
ugggugaacccagccccugaccuuccucuauccccugcccauccucccuuuuaccuccucucu

SEQ ID NO: 13192 - RNA, 63 nt, Human
gacuagaggccucuugugacuggagguaacaacccugcccaguaacugugggagaaggggauc

SEQ ID NO: 13193 - RNA, 63 nt, Human
ucucuuuuauaccuuccucacuggcccccuccaccugcccauagucaccaaauucuguuuuaa

SEQ ID NO: 13194 - RNA, 63 nt, Human
guuguuccugcaucccgauaccucagcccuggcccugcccagcccauuugggcucugguuuuc

SEQ ID NO: 13195 - RNA, 63 nt, Human
gaaaaaggaguuugagucacuggcaccuagaagccugcccacgauuccuaggaaggcuggcag

SEQ ID NO: 13196 - RNA, 63 nt, Human
ugagugaaaggagggugaggcugccgaugccuuccugcccagaaguggaugaugugggaguug

SEQ ID NO: 13197 - RNA, 63 nt, Human
cacaacuguccaagcucucagccccacagggaaccugcccagagagcuuuaccuuucccaagc

SEQ ID NO: 13198 - RNA, 63 nt, Human
gauuaggcccucaagacccuuuuggguuucugcccugcccacccucuggagaaggugggcacu

SEQ ID NO: 13199 - RNA, 63 nt, Human
cacaagugcacaucagcacuauggggccuauguccugcccagagaccucugcuccuuccugcu

SEQ ID NO: 13200 - RNA, 63 nt, Human
cacucugagugaggccaccaucacccaccacacccugcccacuccugcgcuuuucaucgccau

SEQ ID NO: 13201 - RNA, 63 nt, Human
ugcucaggccucaccucccagggcuacacagacccugcccaccccaucccuggcugaccugcu

SEQ ID NO: 13202 - RNA, 63 nt, Human
agggugauuccaagaucauccuucacccgagguccugcccaagcacaggccagaugcaagaau

SEQ ID NO: 13203 - RNA, 63 nt, Human
aauaucauauuucugugugugucucucucagccccugcccaggcuagagggaaacagcuacug

SEQ ID NO: 13204 - RNA, 63 nt, Human
auuuguuuggaugucugaucuuuuccuacaguuccugcccaggccuguuuuucucucccuuau

SEQ ID NO: 13205 - RNA, 63 nt, Human
uccuuaugucccauggaucucuuccugaucuucccugcccauuggguacccaggaaacugcaa

SEQ ID NO: 13206 - RNA, 63 nt, Human
gccuucuaaggacagcuccuucccuacucauucccugcccaaguggggccagaccucuuuaca

SEQ ID NO: 13207 - RNA, 63 nt, Human
uuugaaauaaaaauuggcauguagccaauguuuccugcccacacucacuuuuuucuauagacc

SEQ ID NO: 13208 - RNA, 63 nt, Human
auugcccuggggaucagacagccccuaccuaccccugcccacuccucuggagacugagccuug

SEQ ID NO: 13209 - RNA, 63 nt, Human
agaaccccugcccuggcagccuggaagaccgugccugcccagcccucgucaccacagggacuc

SEQ ID NO: 13210 - RNA, 63 nt, Human
cccaccaccccggggucucuggggaacugucaaccugcccacgggacauguacauuuccccuu

SEQ ID NO: 13211 - RNA, 63 nt, Human
ucuaagccuuagggagugagaccaacacccaucccugcccagccaacaguggccggggcuugu

SEQ ID NO: 13212 - RNA, 63 nt, Human
cucccgggccccgggccuggggcaugcguugcaccugcccagcccgguggcugcgccucccuc

SEQ ID NO: 13213 - RNA, 63 nt, Human
gaugaagcuccgccuccgccgcuuagucccaacccugcccaggaagaagggcccguggggcuu

SEQ ID NO: 13214 - RNA, 63 nt, Human
ggccaguggggggcaggggugcgccuccucugcccugcccaccagccugugauuugauggggu

SEQ ID NO: 13215 - RNA, 63 nt, Human
cccauguuucugggugggugaaaggggcccaacccugcccacuucagcccagcccgcccaagg

SEQ ID NO: 13216 - RNA, 63 nt, Human
ugcugccaucacugggaggcucagaggacccuuccugcccaccuucggagacggcuucuggag

SEQ ID NO: 13217 - RNA, 63 nt, Human
uugugacuggccucaggaauucucccuuccacaccugcccaccucaccucacugcaccgcacc

SEQ ID NO: 13218 - RNA, 63 nt, Human
cugccauuccuuucuaaguguguuuuauggcauccugcccacaaagaacucacagucugauua

SEQ ID NO: 13219 - RNA, 63 nt, Human
cuucacagguugacuaguaucuguggguaccucccugcccagguuauucacucacaagccacc

SEQ ID NO: 13220 - RNA, 63 nt, Human
ucccuguugguucugauuagguaacguauuggaccugcccacaacucccuugcacguaaacuu

SEQ ID NO: 13221 - RNA, 56 nt, Human
augagaugacugaugugugauguugcccugcccagaaagggcccugcccuagaccc

SEQ ID NO: 13222 - RNA, 63 nt, Human
cuucacaacggucagcacuccucucccagccccccugcccacuguucucaauaaaaugugagu

SEQ ID NO: 13223 - RNA, 63 nt, Human
gccugggcggggcugggagugggaccugagaucccugcccacucucuccccuucauuggcugc

SEQ ID NO: 13224 - RNA, 63 nt, Human
gagaaugccaucugacaggagggcccggggcccccugcccacccugcgggggccuccccagug

SEQ ID NO: 13225 - RNA, 63 nt, Human
auaaagagacuuacgugguaaaaaaugaagucuccugcccacagccacauuagugaaccuaga

SEQ ID NO: 13226 - RNA, 63 nt, Human
gucgccucugcauucaggaucaaaccccgaccaccugcccaaccugcucuccucuugccacug

SEQ ID NO: 13227 - RNA, 63 nt, Human
cuccugugacccagggagcagggucgcuaagguccugcccacugaggggacagccuucugggc

SEQ ID NO: 13228 - RNA, 63 nt, Human
uuucauuugccaguuucuauuuaguauuccaugccugcccaauucaucuguuacuguuuaauu

SEQ ID NO: 13229 - RNA, 63 nt, Human
aagaggcuugugcugugguggguucgauuuaucccugcccaccccacccccacaacuucccuu

SEQ ID NO: 13230 - RNA, 63 nt, Human
ccccagccaucagggcuggccguggacguggccccugcccacucaccugcccgccugcccgcc

SEQ ID NO: 13231 - RNA, 63 nt, Human
cuucccgagauagccaccuggaaacacuaggugccugcccagggaggaacggaggaggacucg

SEQ ID NO: 13232 - RNA, 63 nt, Human
gcccugcuaccugacgcgccagaagcacccagcccugcccagcaaccggccccagcagcaggu

SEQ ID NO: 13233 - RNA, 63 nt, Human
cagcagcugcaccccagaaucuguaugccugcaccugcccaaggauuuauucauagcuuaccu

SEQ ID NO: 13234 - RNA, 63 nt, Human
cguggcugacuuacaucauguguuggggaagggccugcccaguugcacucaggugacauccuc

SEQ ID NO: 13235 - RNA, 63 nt, Human
uucugucagcacucugaugugcucagaagagcaccugcccaaaguuuuucugguuuuaauuua

SEQ ID NO: 13236 - RNA, 63 nt, Human
cucaaacgaaucauuggcuauaaccuccagccuccugcccagcacaggaaucgguggucucca

SEQ ID NO: 13237 - RNA, 63 nt, Human
gcaccucucggaccucgcuguguuucacugccuccugcccacagacccaggccugccggcccg

SEQ ID NO: 13238 - RNA, 63 nt, Human
uagaggugacaugucucuccauuccucuccaacccugcccaccucccuguaccagagcuguga

SEQ ID NO: 13239 - RNA, 63 nt, Human
ccccuccaggaggguccuggggugggccagaugccugcccaccucugucuccugccucugcuc

SEQ ID NO: 13240 - RNA, 63 nt, Human
uggacccucucccgggaccuccugcuggcuccuccugcccagcuuccuaugcaaggcuuugug

SEQ ID NO: 13241 - RNA, 50 nt, Human
gccccaagaagaagcugugaccugcccacuggcacacagcuggcacuggc

SEQ ID NO: 13242 - RNA, 57 nt, Human
ucagggggaaggaggaaugacgcucaaccugcccagguuuggacacaacuacaaaga

SEQ ID NO: 13243 - RNA, 63 nt, Human
guuacuuugcaauauccacuuuauaaaauagcuccugcccaguggcucuugguuccugucaaa

SEQ ID NO: 13244 - RNA, 63 nt, Human
uacauggaaaccgggcucagugagaacugauuuccugcccaauauuugucuuugggcugucuc

SEQ ID NO: 13245 - RNA, 63 nt, Human
gcggaucaccugaggugaggaguucaagaccagccugcccaacauagugaaacuccgucucua

SEQ ID NO: 13246 - RNA, 63 nt, Human
caccuccccagcauuccagccccucuggucgcuccugcccacggagucguggggugugcuggg

SEQ ID NO: 13247 - RNA, 63 nt, Human
gcaccggucuuugauccgcagcaggggccagacccugcccacaagucccagcgcggcugcuuc

SEQ ID NO: 13248 - RNA, 63 nt, Human
acgggguuggggaccgaaaggacagggaugccgccugcccaguguuucugggccucacggugc

SEQ ID NO: 13249 - RNA, 63 nt, Human
uucauccccccggccaccucucuacccguccagccugcccagacccucucagaggaacggggu

SEQ ID NO: 13250 - RNA, 63 nt, Human
gaaggccaagcgagacuagcagucauccagaccccugcccaccuagacuguuuucugagcccu

SEQ ID NO: 13251 - RNA, 63 nt, Human
agucuugccagguggucuacccccggccccgcuccugcccauuccucugucccugcagacuca

SEQ ID NO: 13252 - RNA, 63 nt, Human
cucuaguugguucugggcuuugaucucuuccaaccugcccagucacagaaggaggaaugacuc

SEQ ID NO: 13253 - RNA, 63 nt, Human
cgcuggcguuuguguucugggcaccaccgugacccugcccagauggcuauaauauuauuuuau

SEQ ID NO: 13254 - RNA, 63 nt, Human
uaaucgugcuuuguuuuaugcuacuccucccacccugcccaugauuaaacaucauguauguag

SEQ ID NO: 13255 - RNA, 63 nt, Human
cgccauugagaaugugcuuuguaagauccacccccugcccacaaaaaauugcuccuaacucca

SEQ ID NO: 13256 - RNA, 63 nt, Human
cacuuccuugcuuaagguaugguacaagcaaugccugcccauuggagagaaaaaacuuaagua

SEQ ID NO: 13257 - RNA, 63 nt, Human
uguguguggcugccuccccugggcuuucugcucccugcccagauccuguaggccucaucuuag

SEQ ID NO: 13258 - RNA, 63 nt, Human
caacuuaguuuggauguaagaugcucugaggacccugcccacaccccugcgugcauuaggaug

SEQ ID NO: 13259 - RNA, 63 nt, Human
gaguucccugggaggcugacagggucaagccacccugcccaccacccucccacuuccccuccc

SEQ ID NO: 13260 - RNA, 63 nt, Human
gagcagcgaagaauaaagcaugacucaucucguccugcccaccccucacacuggacuauaaau

SEQ ID NO: 13261 - RNA, 63 nt, Human
ggccucaccaggcaagcugaggccaggagggacccugcccagucugugaaagcuacagagcac

SEQ ID NO: 13262 - RNA, 63 nt, Human
ccgcccucugcccccgcggcaaccgcucccacgccugcccacuuugcuagcccggcugugccc

SEQ ID NO: 13263 - RNA, 63 nt, Human
aagagucaggaagggaaagccagaaggggcacgccugcccagccucgcaugccagagccuggg

SEQ ID NO: 13264 - RNA, 63 nt, Human
gcaggaucuggcuuggggugcccggcccucaucccugcccacgcagugagugcucaugugucu

SEQ ID NO: 13265 - RNA, 63 nt, Human
gccaguccugcgcauuccagcuacgcuaagcgcccugcccaggcacguaacaaaacauagacc

SEQ ID NO: 13266 - RNA, 63 nt, Human
agcauuuuaauuaaaaaccucaauaaagauggcccugcccacacugugccuuguguuuggggc

SEQ ID NO: 13267 - RNA, 63 nt, Human
uuaggggcaaacaucacaaaauguaauuuaaugccugcccauuagagaaguauuuaucaggag

SEQ ID NO: 13268 - RNA, 63 nt, Human
ccugagcuucagaccguuuguccugucaucuguccugcccaacacuguaugguuuuucucuag

SEQ ID NO: 13269 - RNA, 63 nt, Human
uuaugcaggccauaaguuccaaaagauaauuucccugcccacaaaggcauaaacuugaaaaca

SEQ ID NO: 13270 - RNA, 63 nt, Human
ugugcaagcacauucaccaagugcaucgguagcccugcccaccccuccagaccucgguucuua

SEQ ID NO: 13271 - RNA, 63 nt, Human
cugaagccacagcugggcccaccgaggugcuauccugcccaggccagcacuuggcugaguugg

SEQ ID NO: 13272 - RNA, 63 nt, Human
cuccggagugaacaggcaucccuguugccccugccugcccagauuuacugaccccauuugucg

SEQ ID NO: 13273 - RNA, 63 nt, Human
augccuccuauuuguaacaauggguguagcuccccugcccaucuuggaggugcauggcccauc

SEQ ID NO: 13274 - RNA, 63 nt, Human
auaaguuauuauauucauuucguugguuucucuccugcccaauucuuggcacaggcauuaugu

SEQ ID NO: 13275 - RNA, 63 nt, Human
gaggugagggaagccugaaaaacuaagaugcugccugcccagugcacacaaguguagguauca

SEQ ID NO: 13276 - RNA, 63 nt, Human
uccuuacacuacaucaucaucaucucaugcccaccugcccacacccagcagagcuucucagug

SEQ ID NO: 13277 - RNA, 63 nt, Human
gaagcaaggggcaaggcugggccccuagcuuguccugcccauuccuccagguguugaucuuga

SEQ ID NO: 13278 - RNA, 63 nt, Human
uggucccuggcaacaggaaccugggcagcuuauccugcccacagguaagccccugggagcauc

SEQ ID NO: 13279 - RNA, 63 nt, Human
ccucauccuguucugucuacucacccuagcagcccugcccagacucuucagccccugcuccca

SEQ ID NO: 13280 - RNA, 63 nt, Human
cccagcccaaguccaaauguuuacagggagccuccugcccagucccccaaccccagccgcucg

SEQ ID NO: 13281 - RNA, 63 nt, Human
ggaaaaagggccacaagccguuuugcacaaaugccugcccaccugccccucuuccauccagga

SEQ ID NO: 13282 - RNA, 63 nt, Human
guccugcaaggcuggacugugaucuucaaucauccugcccaucucugguaccccuauaucacu

SEQ ID NO: 13283 - RNA, 63 nt, Human
cccacccuugagaauguacuuugugagauccacccugcccacaaaacauugcucuuaacuuca

SEQ ID NO: 13284 - RNA, 63 nt, Human
agcugagagucugaaagacagaaugucaccaguccugcccaaugccuugacaacagacugaau

SEQ ID NO: 13285 - RNA, 63 nt, Human
cagcccuugcccgugauggcuccuuggggucugccugcccacccacaugagcccgcgaguaug

SEQ ID NO: 13286 - RNA, 63 nt, Human
aucuucccuguguggucccucccuucgugugccccugcccagccucuuggcaccuccuguuua

SEQ ID NO: 13287 - RNA, 63 nt, Human
ggaggguuucaaacaagacaaaaggcauuccucccugcccaaucccagugcagucaaggccaa

SEQ ID NO: 13288 - RNA, 63 nt, Human
ugccuccacccugugcccgaggggguguccgguccugcccauccgauacucugguggaaaugu

SEQ ID NO: 13289 - RNA, 63 nt, Human
cuaugcaaguucauuuaagccucagggcuggucccugcccaaagggcuggacccuccuaaucc

SEQ ID NO: 13290 - RNA, 63 nt, Human
aggguuucccucccgauaucaaaaagacuguggccugcccagcucucguauccccaagccaca

SEQ ID NO: 13291 - RNA, 63 nt, Human
gcaaagaauucccacccugagguggguuacauaccugcccaauggccaaaggaaccgccuugu

SEQ ID NO: 13292 - RNA, 63 nt, Human
cuuaagagaguaaggccuugggcugugcugugaccugcccaagauuugacacuggcuaggagc

SEQ ID NO: 13293 - RNA, 63 nt, Human
gaaccucaagcuccuggccugauccagcuccuuccugcccaaggcagcuuagcccauccagac

SEQ ID NO: 13294 - RNA, 63 nt, Human
uaagccaugggacccgaggacugccccccggcgccugcccaggcggaggcccuuucagaaagg

SEQ ID NO: 13295 - RNA, 63 nt, Human
ggccaaugauggagggcggccgccagcccagggccugcccauccagaagggacuccccagggc

SEQ ID NO: 13296 - RNA, 63 nt, Human
aaaaaaaaaaaaaaaaguaaauauccagggaacccugcccagacuaauacuguugguggcaua

SEQ ID NO: 13297 - RNA, 63 nt, Human
gcagcuuguccuugcuccuggaaccuggcaggcccugcccagccagccaucggaagagagggc

SEQ ID NO: 13298 - RNA, 63 nt, Human
ggcuuucugggcacugcacuucagcguggcccaccugcccaugcccugaggccaguuggcgag

SEQ ID NO: 13299 - RNA, 63 nt, Human
gaauauccccucccagucaccuuguggcaagccccugcccaucugggaaaauaccccaucauu

SEQ ID NO: 13300 - RNA, 63 nt, Human
uccaaugaaaccaucaguagagacauugcuguuccugcccaucccagugccagcuacuccuuc

SEQ ID NO: 13301 - RNA, 63 nt, Human
ccuauggcaccuuucccuucugaaagucugguuccugcccagugacccuuggccuugugagcc

SEQ ID NO: 13302 - RNA, 63 nt, Human
cauccagccccacacccucauuuauaccaauuaccugcccaguaacuguggacuuuugcuucc

SEQ ID NO: 13303 - RNA, 63 nt, Human
aucaccuccaguuuggcuucugagcagagacucccugcccaucaagucugaaacccccaugga

SEQ ID NO: 13304 - RNA, 63 nt, Human
ggaucccagcaacccuaaugcuggaaaggugcuccugcccacacccagcauggacccagugug

SEQ ID NO: 13305 - RNA, 61 nt, Human
cucaggucaccagacucugaacaugcuacauccugcccaagacugcaccucuggaggugca

SEQ ID NO: 13306 - RNA, 63 nt, Human
ccugcugcucugacccuuggccucaggcuuggcccugcccaagcuacuuccuguacuuaaaag

SEQ ID NO: 13307 - RNA, 52 nt, Human
ucuacaacaccugccagugaccccugcccaaggccuaccccaguuccuagca

SEQ ID NO: 13308 - RNA, 63 nt, Human
gagcaaaggcucaccuuuguggagaggauaaaaccugcccaaccuaccucaccaugguuuuuc

SEQ ID NO: 13309 - RNA, 63 nt, Human
gggcacaagugucaggcgccgcacuuccuuuuaccugcccaaggaugcugucaagcaccugca

SEQ ID NO: 13310 - RNA, 63 nt, Human
gcaaaugcaggagccgaccuggggcugcacaucccugcccauccccagaaagacuguuccugu

SEQ ID NO: 13311 - RNA, 63 nt, Human
agggccgccacugcaguucugcuaggucugcuuccugcccaggaaggugccugcacaugagag

SEQ ID NO: 13312 - RNA, 63 nt, Human
aauggcccauggaagacacuugguuugagaaacccugcccacuuccaaagaccaaagagauua

SEQ ID NO: 13313 - RNA, 63 nt, Human
ucuuguguucucauacuuuucugucacuguaagccugcccaguaggcaguguuuugcagacuu

SEQ ID NO: 13314 - RNA, 63 nt, Human
cuaugaaucaggguaugaaauucaaaaccuccaccugcccaugcugcuugcaucccuggagaa

SEQ ID NO: 13315 - RNA, 63 nt, Human
uccuggcagcuuccaugucaccacuuguucauaccugcccagagcuaguuuuagacauggcaa

SEQ ID NO: 13316 - RNA, 63 nt, Human
ugguugcagcugcugauagccuucaggggaggaccugcccagguaugccuuccagugaugccc

SEQ ID NO: 13317 - RNA, 63 nt, Human
cucuucuuuuguucugugucugaccuacuaauuccugcccaugcuucaaacucaguucagaaa

SEQ ID NO: 13318 - RNA, 63 nt, Human
gccccugccucccuuccucccuggcgauccucaccugcccagccauggcacacacccuuccug

SEQ ID NO: 13319 - RNA, 63 nt, Human
gggccuuuccuaugggcaaggcccagugcucuuccugcccaccagggaccauggagcaguggc

SEQ ID NO: 13320 - RNA, 63 nt, Human
acaccagacugcaauaacuggaggcgccuccuuccugcccacccuucgcucacgccccagcgc

SEQ ID NO: 13321 - RNA, 63 nt, Human
acuggccccuaggcgccgauggccgaggccgcgccugcccaccgggcggggucgcugguuggc

SEQ ID NO: 13322 - RNA, 63 nt, Human
cugggcucgucucuuuccggagccccagcgucuccugcccaaauucaccgcggaaagggcccg

SEQ ID NO: 13323 - RNA, 63 nt, Human
cauucccgggagaggcggugugggggcccgggcccugcccagcuacgcagaaagcagccggag

SEQ ID NO: 13324 - RNA, 63 nt, Human
gggcuacugugaccauggaggccagugccagcaccugcccagugggccccgcugcaggugcau

SEQ ID NO: 13325 - RNA, 63 nt, Human
aaggccaaggcugcgggaggcugggagcccugcccugcccaucccuccugcaccagcgcuguc

SEQ ID NO: 13326 - RNA, 63 nt, Human
gcccuccagggucagcguuuggcuguuugugugccugcccacccgccucccugugccugggcc

SEQ ID NO: 13327 - RNA, 63 nt, Human
guugcugcucaacaggacugcacucgucucugcccugcccacccagagccccucuuugugccc

SEQ ID NO: 13328 - RNA, 63 nt, Human
gucccccagacccaaagcucucuccccacccuaccugcccaccuggggcuccugugcccccuc

SEQ ID NO: 13329 - RNA, 63 nt, Human
uaucuuccuguguucucuggcuucagaguuucaccugcccacacaggguccguugcuggcaac

SEQ ID NO: 13330 - RNA, 63 nt, Human
gcccgaggcaccggacgcuggagacccugcgccccugcccagcaccuccuccgugggcagcuc

SEQ ID NO: 13331 - RNA, 60 nt, Human
ccaccgaugcccaucuguagcagggccaggccugcccagcagccucugcucccuccuggg

SEQ ID NO: 13332 - RNA, 63 nt, Human
ugggcaggugguguccuguggcaccuccauccuccugcccagccggcugugucacacucaucu

SEQ ID NO: 13333 - RNA, 63 nt, Human
cagcaugucccucguggcucagggugccccaggccugcccagcuagugcuguccucccaucuc

SEQ ID NO: 13334 - RNA, 63 nt, Human
cacccagaccuccagagcauccagagccucuguccugcccacgcuagccucccugcagggacc

SEQ ID NO: 13335 - RNA, 63 nt, Human
ggcaccaggcagagugggagccuaggucaggccccugcccacugccugacccccaccccccgc

SEQ ID NO: 13336 - RNA, 63 nt, Human
caugguagaugcuccuguucuggugauaccaaaccugcccaccccucugagucgucuuugcuc

SEQ ID NO: 13337 - RNA, 63 nt, Human
ggauuuccugggcuuuuauucacuaaaugggcuccugcccaguuuggguacugugcugauuuu

SEQ ID NO: 13338 - RNA, 63 nt, Human
ccagcuuaaccacgugcauuuggccuauguaauccugcccaugguggccgcagcuaaucagaa

SEQ ID NO: 13339 - RNA, 63 nt, Human
aguuccuggaggccuuccgccuuguggagaaauccugcccagagggcgaugccucagaaugcc

SEQ ID NO: 13340 - RNA, 63 nt, Human
gaagcuuguugaaaacccagacugucuccacggccugcccagucgaccccaaaggaacacuga

SEQ ID NO: 13341 - RNA, 63 nt, Human
uggagcauuuguaagcacauggugaaaucagccccugcccaccaaaauaaucuuuauguuacc

SEQ ID NO: 13342 - RNA, 63 nt, Human
gcugcccuccucuuuccgcucccccaucucggcccugcccauacuccaagggucagcucccau

SEQ ID NO: 13343 - RNA, 63 nt, Human
uguguuggguucuauaccuaaaaauuuucccucccugcccaaggugauuggaaaguacugcaa

SEQ ID NO: 13344 - RNA, 63 nt, Human
guuuugcaguucugugaaauguuuuauaaugucccugcccagggaccuguuagaaagcacuuu

SEQ ID NO: 13345 - RNA, 63 nt, Human
uaacgagcccuaaaggcaagaagugugucuucuccugcccauuucucucucccacaguacauc

SEQ ID NO: 13346 - RNA, 63 nt, Human
aggacccugccaggucccgcgcaccaucccugcccugcccacgugguauugcugggcuccugg

SEQ ID NO: 13347 - RNA, 63 nt, Human
uguuccugaucagcccguaucaucugaggccugccugcccacccugccacccuccccucccuu

SEQ ID NO: 13348 - RNA, 63 nt, Human
gccccugggccccgcagauggccauuuccggugccugcccaguggccacucuucuggaagggg

SEQ ID NO: 13349 - RNA, 63 nt, Human
gguccccagggggcccccugcggccugggccccccugcccacggccagcuuccugcugaugaa

SEQ ID NO: 13350 - RNA, 63 nt, Human
uucugccucaguguaucacuggagucacaggacccugcccaccugaguucccaauaaagaaaa

SEQ ID NO: 13351 - RNA, 63 nt, Human
agcaauguuggaaaaugcagggugacugaguucccugcccagcuuucgggaucucuggccccc

SEQ ID NO: 13352 - RNA, 63 nt, Human
agguagaugccaacuggagggccagaccuguguccugcccauguccuccuugguggacguuuc

SEQ ID NO: 13353 - RNA, 63 nt, Human
cguuucuguuuacucagagcugcuagagaccauccugcccauccgaguucugagauugggacu

SEQ ID NO: 13354 - RNA, 63 nt, Human
ucucugcuaugauggugguauccgaggccuuucccugcccagucuggugccugccccacauug

SEQ ID NO: 13355 - RNA, 63 nt, Human
cauggggauccaagaccugagauaaagcaacagccugcccagaucccucuguucauccuaucc

SEQ ID NO: 13356 - RNA, 63 nt, Human
ccccagccagccaaaguaaugacacauuccagcccugcccagcaugcugaccuuuggccucua

SEQ ID NO: 13357 - RNA, 63 nt, Human
uucugagagucugcugggauugagcaaucaucuccugcccaaguuuccuccuugcccugagga

SEQ ID NO: 13358 - RNA, 63 nt, Human
cucagccccccuuucccuggagcaccugccccaccugcccacagagaacacaguggucucccc

SEQ ID NO: 13359 - RNA, 63 nt, Human
ccguccuucgguucuuacugagucacagacucgccugcccacuacguguccuggguucucucu

SEQ ID NO: 13360 - RNA, 63 nt, Human
cuuccuucuggugaaguccaccuccaacauuaaccugcccaccccacccccgucaucccugga

SEQ ID NO: 13361 - RNA, 63 nt, Human
acaccugccauugccuccucuccauugcagacgccugcccaucaaguauuaccugcggcgacu

SEQ ID NO: 13362 - RNA, 63 nt, Human
gcuggcucaacuucaccaagaugcauucucauaccugcccacagcuccauuuuggaggcaggc

SEQ ID NO: 13363 - RNA, 63 nt, Human
ggaauguugagauuuaggcuuauuugagcacugccugcccaacugucagugccagugcauagc

SEQ ID NO: 13364 - RNA, 63 nt, Human
uuaaggaagggucaagccagccacugcuguggcccugcccagggcuugguugagggaacggcu

SEQ ID NO: 13365 - RNA, 63 nt, Human
cauagccauacaucugacugccugacauggacuccugcccacuugggggaaaccuuauaccca

SEQ ID NO: 13366 - RNA, 63 nt, Human
uauugggcuggcagcaggacgacuggcuguccuccugcccacccacacugacggcaucuuccc

SEQ ID NO: 13367 - RNA, 63 nt, Human
ucccaaagugcugagauuacaggugugagccacccugcccagccgucaaaagagucuuaauau

SEQ ID NO: 13368 - RNA, 63 nt, Human
gccucaggcugaaguaacuuuucucugcuucucccugcccagcucagagcugagggccucccc

SEQ ID NO: 13369 - RNA, 63 nt, Human
uuuggcugcucaguauuugagcuaugucugcuuccugcccaccuccagccagagaagaaucag

SEQ ID NO: 13370 - RNA, 63 nt, Human
uauuuaacuuauuucaagggugcugugcucagcccugcccauggcugugcagcucccuccgug

SEQ ID NO: 13371 - RNA, 63 nt, Human
cccagccacaggcuucuuguccaccucuucuccccugcccaccagcugcucagcgcauaagac

SEQ ID NO: 13372 - RNA, 63 nt, Human
agcaaaaggaaugugugugcacuuggcgagccuccugcccacccuguccacaccuaauaagug

SEQ ID NO: 13373 - RNA, 63 nt, Human
uaguuaugcacagacugauaauaaaccucuaaaccugcccagcggaaguguguuuuuuuuuaa

SEQ ID NO: 13374 - RNA, 63 nt, Human
gaccuguccgacugagccacugccagccgcucuccugcccaccucuccccacccugaacccag

SEQ ID NO: 13375 - RNA, 63 nt, Human
caacauggauccuggaugaaucccaguucuuccccugcccagcuauugggagcuggccuaagu

SEQ ID NO: 13376 - RNA, 63 nt, Human
uggaggcagggcccugccccccucccuuccgcuccugcccagccugggggaaggagaaaggag

SEQ ID NO: 13377 - RNA, 63 nt, Human
uccccuccugagccugcugucaucuucacugccccugcccaucugucacccaccugcuccuuu

SEQ ID NO: 13378 - RNA, 63 nt, Human
acuuuuuuuuauggcguuuuucucgucccccucccugcccaaacuccccuucccuggggagcc

SEQ ID NO: 13379 - RNA, 63 nt, Human
cuguauguuaccuuuuuacucaaaggaguccccccugcccaguaacaguccuauuaguguuua

SEQ ID NO: 13380 - RNA, 63 nt, Human
auuauaguuuuguuaugaaaguauguauuuugcccugcccacauugcagguguuuuguauaua

SEQ ID NO: 13381 - RNA, 63 nt, Human
auccagaagcacaugaaguuugcaacuuuccacccugcccauuuuuguaaaacugcagucauc

SEQ ID NO: 13382 - RNA, 63 nt, Human
cuucuuccucaccucucagccuccagaucccuuccugcccaucccuucccuacaaugcccacu

SEQ ID NO: 13383 - RNA, 63 nt, Human
gaaugugaguggcaaguggcuuaucuggagccaccugcccaagucuuacuaaaaugcagcugu

SEQ ID NO: 13384 - RNA, 63 nt, Human
ucaguauuuuugccggcuggugaauucaaacaaccugcccaaagauugauuuguguguuugug

SEQ ID NO: 13385 - RNA, 63 nt, Human
uggugaaagaaagcacauccaaagcauaguuuaccugcccacgaguucuggaaagguggccuu

SEQ ID NO: 13386 - RNA, 63 nt, Human
cgaacuuuaggaacacaguuggaggucaccucuccugcccagcucccgcacccugcguuuagg

SEQ ID NO: 13387 - RNA, 63 nt, Human
ccacccaccgacacccccagaacccucugggggccugcccaggggacccccugagccccccga

SEQ ID NO: 13388 - RNA, 63 nt, Human
cuuguaugcucuggaaucuguggagacgccagcccugcccaaucagagaugccaaaaaugggg

SEQ ID NO: 13389 - RNA, 63 nt, Human
gagggguuuacgggcugugaauggaccuucagcccugcccacccucccuccccacugcugcug

SEQ ID NO: 13390 - RNA, 63 nt, Human
uuggucaucacucuucuguaaugcccaccugccccugcccagaauuccuagcugccuguguca

SEQ ID NO: 13391 - RNA, 63 nt, Human
cauccaaacagaggaugcucagauuucucacauccugcccaggaucuccucuuaggguagaag

SEQ ID NO: 13392 - RNA, 63 nt, Human
uggggagaagguggacagauuugggaggccccuccugcccaagugaggcccugggaauuuaca

SEQ ID NO: 13393 - RNA, 53 nt, Human
acccuuggcuuaacuccuaagccccugcccagcaccacagcagagaucacaca

SEQ ID NO: 13394 - RNA, 63 nt, Human
auggugcugugcugaggaaaggggaugcagagcccugcccagcaccaccaccuccuaugcucc

SEQ ID NO: 13395 - RNA, 63 nt, Human
ccugaaggacggggccaaccagccacuggcuuuccugcccaggcuuggccucccaggacaucu

SEQ ID NO: 13396 - RNA, 63 nt, Human
guuaggaaaaugcuguugugugacaauggagagccugcccaaggacugugcaaccuaucuguu

SEQ ID NO: 13397 - RNA, 63 nt, Human
ccagcaguaccguccgcaccgccaggcucagccccugcccaccccacuuccacauggcccucg

SEQ ID NO: 13398 - RNA, 63 nt, Human
aggcgaaucacgaggucaggaguucgagaccagccugcccaacauggugaaacccugucucua

SEQ ID NO: 13399 - RNA, 63 nt, Human
cccgaggaggucgugcagcacagcgcagaagccccugcccacgggauccggccccccagacac

SEQ ID NO: 13400 - RNA, 63 nt, Human
uguagugacacguucucugacagcaccuugccgccugcccacgaccuugaccgugaggagcug

SEQ ID NO: 13401 - RNA, 63 nt, Human
cugagccccccucggaggccccgccacagccaaccugcccagucuuuccucugggcuugaccc

SEQ ID NO: 13402 - RNA, 63 nt, Human
gggaguacuagggccggcccguccuuccccgccccugcccacauggcggcuccugccaacccu

SEQ ID NO: 13403 - RNA, 63 nt, Human
cuaagcccagggccccuugaggcccagacucagccugcccacuggugccggagacggagugga

SEQ ID NO: 13404 - RNA, 63 nt, Human
cugcugcugcagaacgguuuuugcugaggugccccugcccagcccuguccagccuuguccaca

SEQ ID NO: 13405 - RNA, 63 nt, Human
aucucuuuuuccccacacugucccuggccaagcccugcccagagcugaacccuguagcugccc

SEQ ID NO: 13406 - RNA, 63 nt, Human
ugggagaccuaccggcgcggcgagagcggacugccugcccacccugagguccccgacugagcc

SEQ ID NO: 13407 - RNA, 63 nt, Human
aaacaguaguacaagcuccccucagccagccugccugcccagcgaggcccccagguucaaggu

SEQ ID NO: 13408 - RNA, 63 nt, Human
ugccaccugguacagguagguggcgcucacguuccugcccaaaugcagcccaucggggaguca

SEQ ID NO: 13409 - RNA, 63 nt, Human
cauugugaaucuucccgucugaagaacgcccagccugcccagacaaagccccgccuuccccaa

SEQ ID NO: 13410 - RNA, 63 nt, Human
uagaugaccccuucagaucaucugugccuaccuccugcccaucaggcgucuacacugucacuc

SEQ ID NO: 13411 - RNA, 63 nt, Human
ccccacccccacugggcccaggccaggaggggcccugcccaugcccacacuacaggccagggc

SEQ ID NO: 13412 - RNA, 63 nt, Human
gaucacgauauaaaaaaauuuuuccaaguuauuccugcccauugaccuaacauauggauuaca

SEQ ID NO: 13413 - RNA, 63 nt, Human
cgaaauggccccugucuucggccgagcugguuuccugcccagccuggggcaaaccuagccgga

SEQ ID NO: 13414 - RNA, 63 nt, Human
gaauuauccuguaguacaagauuaucuuauuccccugcccaggugugagcacgugcucucgcu

SEQ ID NO: 13415 - RNA, 63 nt, Human
gcacugcaguuaacuguggcuccugcagggcacccugcccagaaugcccagaagagaaccaug

SEQ ID NO: 13416 - RNA, 63 nt, Human
ucccgucuccaaacagccuccuucgacucggcuccugcccagcucccggcggccuucguaggc

SEQ ID NO: 13417 - RNA, 63 nt, Human
acugcggaauguggccucugcuuccuccguccuccugcccaaggacgacgaggauugcuccag

SEQ ID NO: 13418 - RNA, 63 nt, Human
uguccgugugccccacccucccucggcuuuacuccugcccagugacugugaccacuguccgug

SEQ ID NO: 13419 - RNA, 63 nt, Human
agggccugcgacaggugugcucucuuuccaagaccugcccaggauuuaguaagggaaagucaa

SEQ ID NO: 13420 - RNA, 63 nt, Human
uagccaucacugccucuccagggacccuccucuccugcccaggacagacccagccagaaccac

SEQ ID NO: 13421 - RNA, 63 nt, Human
aucuaauaccauccugcccauuguccuuaccguccugcccauacagacuguggcuccuuccuc

SEQ ID NO: 13422 - RNA, 63 nt, Human
gaaggagauggcauagagaagaucuaauaccauccugcccauuguccuuaccguccugcccau

SEQ ID NO: 13423 - RNA, 63 nt, Human
uaucuauauuuuugcccaggucuggguauugcuccugcccagacccugacaucccuuuccacu

SEQ ID NO: 13424 - RNA, 63 nt, Human
ccucaacaucacacaguauacucagcuaacaaaccugcccauguguuuccugaaucuaaaaua

SEQ ID NO: 13425 - RNA, 63 nt, Human
ggugaaagagucacaccuuagugcuauaacucuccugcccaugauaguguauucuguuucagg

SEQ ID NO: 13426 - RNA, 63 nt, Human
auguaggucaggaccuuggcuggaccuggaggcccugcccagcccugcucugcccagcccagc

SEQ ID NO: 13427 - RNA, 63 nt, Human
gugcucaggcaccucuucccccaggaagccuucccugcccaccccaucuaugacuugagccag

SEQ ID NO: 13428 - RNA, 63 nt, Human
cgagcucugcagcgagcccugggaccacucaucccugcccagccagcuucagugcccggggcc

SEQ ID NO: 13429 - RNA, 63 nt, Human
gugagcgggggagggugcccggggcacacaaggccugcccagccagccagacucaccugcccu

SEQ ID NO: 13430 - RNA, 63 nt, Human
gucagcagggggccuggugggaggagcgacugcccugcccaaaugaacugccacagcagggac

SEQ ID NO: 13431 - RNA, 63 nt, Human
ccaagagccuccagaugugccugcagccuagucccugcccaagcuucucccccagccacccuc

SEQ ID NO: 13432 - RNA, 63 nt, Human
cgggggcucuggagugguggggaagugaugcugccugcccacgagcccugguuuggguggcaa

SEQ ID NO: 13433 - RNA, 63 nt, Human
uuccugcaugggagagcugucccuccuucuccaccugcccaccgggacacucccccugcucuc

SEQ ID NO: 13434 - RNA, 63 nt, Human
cuuugccucguccaggucucuaucucccaaagaccugcccaccuccugggcucucccagggaa

SEQ ID NO: 13435 - RNA, 63 nt, Human
gcacgcacacaagacgggagucacccugugcuuccugcccaagauacugacccauugaacccc

SEQ ID NO: 13436 - RNA, 63 nt, Human
cagccucucuggccauugcagagcugcuggccuccugcccagguggaggguccuggggacggc

SEQ ID NO: 13437 - RNA, 63 nt, Human
aucugcaugucuguccuuugaacacuuucucucccugcccaaaaggaaacccaaauuauuugu

SEQ ID NO: 13438 - RNA, 63 nt, Human
cuuccaaaaccgccaucagucccgagagcucacccugcccaccucgccgcaaagcgaaagaaa

SEQ ID NO: 13439 - RNA, 63 nt, Human
aauaaguucuuaaaaaauuuauacuuaaaaaauccugcccaaaaugugaagcuugguugacug

SEQ ID NO: 13440 - RNA, 54 nt, Human
ccauggaggucuccugcuaggcggccugcccagcugccgcccccggacucugau

SEQ ID NO: 13441 - RNA, 63 nt, Human
ccuacccgcagaauggugcucuccuuugcccucccugcccagcagccugauaggacucuccua

SEQ ID NO: 13442 - RNA, 63 nt, Human
augagccccaaggcuggggccacagcuccuaccccugcccagcagcccugagcucagcugcag

SEQ ID NO: 13443 - RNA, 63 nt, Human
cagcccgaguagagggcaucccggagcccccagccugcccacuacauccagccuguggcuuug

SEQ ID NO: 13444 - RNA, 63 nt, Human
gcuaagcaggggagcagagcaccaggccgggcgccugcccagcaggagcugaugccggaggca

SEQ ID NO: 13445 - RNA, 63 nt, Human
gacucgggagagcuaccuuacuuugaccaacagccugcccaguguggaugucucuuacagagg

SEQ ID NO: 13446 - RNA, 63 nt, Human
gagcucagcguucacaccaggcgggcuggguccccugcccaccugccucccugcccccuguga

SEQ ID NO: 13447 - RNA, 63 nt, Human
gggugccuucacugggccagucaacggggggcuccugcccaggccacagagaaccugaguucc

SEQ ID NO: 13448 - RNA, 63 nt, Human
cucccaaagugcgggauuacaagcgugaaccacccugcccagccagaaacuagauuuucuuua

SEQ ID NO: 13449 - RNA, 63 nt, Human
aauauaauaacaguggaagucacaaaaauguccccugcccagcccccucgccgcccuugaccu

SEQ ID NO: 13450 - RNA, 63 nt, Human
ggcccaccguuuacaugugcacgcccugacccaccugcccacgccgacuugggaggauggugg

SEQ ID NO: 13451 - RNA, 63 nt, Human
gggagccucuggggagcgaggcugaaaccugaaccugcccauggagacaguuguggugagggu

SEQ ID NO: 13452 - RNA, 63 nt, Human
cuuccucccaggccucccuccuacugccugugcccugcccagggcuccuguccugcagccauu

SEQ ID NO: 13453 - RNA, 63 nt, Human
gagccccucacgccgcccugcagcccccaugccccugcccaacaugcuggggguccagaaacc

SEQ ID NO: 13454 - RNA, 63 nt, Human
cgagccccugccccggcuccccgccaaagcaacccugcccacucaggcuucauccugcacaau

SEQ ID NO: 13455 - RNA, 63 nt, Human
agcaccguggugugaggcccccggaggcgcccaccugcccaguuagcccggccaaggacacug

SEQ ID NO: 13456 - RNA, 63 nt, Human
uccucugcccuggggccaccucggcugcugcagccugcccagcagcacauuccagucacugcc

SEQ ID NO: 13457 - RNA, 63 nt, Human
cuucucucuuggccuagccuggcccacucaggaccugcccagccucugccagcuccucuggca

SEQ ID NO: 13458 - RNA, 63 nt, Human
gaagccaccguuagcgcgagcugcuccguucgcccugcccacggccugcguggcuggggccga

SEQ ID NO: 13459 - RNA, 63 nt, Human
aggcccucccucugcccucccgucugugagcucccugcccagcaccaccuccugcacugcacu

SEQ ID NO: 13460 - RNA, 63 nt, Human
acuaccaaagccuucugggcugucggggcccaaccugcccaaccccagcacuccccaaagugc

SEQ ID NO: 13461 - RNA, 63 nt, Human
accgugauccucacuagacagaggagcuccaaaccugcccaucucaucccaugcaccgacggu

SEQ ID NO: 13462 - RNA, 63 nt, Human
cuuucucuucuugcuucaauugcuuacccacugccugcccagacuuucuauccagccucacug

SEQ ID NO: 13463 - RNA, 63 nt, Human
agucagacagaccuggguucaaguccucaguccccugcccacucccuacgugacuuugaucag

SEQ ID NO: 13464 - RNA, 63 nt, Human
gcagugcccaccgcccccccccccaccccccgcccugcccacagagcaccugcugguaacccu

SEQ ID NO: 13465 - RNA, 63 nt, Human
acccugagaggccuaauagggcagagauggaggccugcccagacuaggaggcagcggggauag

SEQ ID NO: 13466 - RNA, 63 nt, Human
ccacccaccuccgcauccacccccguccgccauccugcccaccaccaggucgguucccgaggc

SEQ ID NO: 13467 - RNA, 63 nt, Human
gcaggaggagggcuagaagccagucccuccccaccugcccagagcuccaggccagcacagaaa

SEQ ID NO: 13468 - RNA, 63 nt, Human
cgcuuucauguuacuguugcagcuugugcugagccugcccaguuggaggagacugggcacccc

SEQ ID NO: 13469 - RNA, 63 nt, Human
gggugagcgcucagagggccuggggcccucacuccugcccacgccucccagaccccagaacgg

SEQ ID NO: 13470 - RNA, 63 nt, Human
gagcccagugcuggcccccuacagguggcagccccugcccacucccaugcugguggcccuggc

SEQ ID NO: 13471 - RNA, 63 nt, Human
cagcccagcagcccacauguguucaggacccucccugcccacccccucccugccguaucgauc

SEQ ID NO: 13472 - RNA, 63 nt, Human
caucaucacagacacagagagcugcaggggaggccugcccacuguuuugucgacucugcccuc

SEQ ID NO: 13473 - RNA, 63 nt, Human
gcuggugcugaagaccaagggucccccuuguuaccugcccaaacuugugacugcaucccucug

SEQ ID NO: 13474 - RNA, 63 nt, Human
gugagccccaggccaggaggcuguuccaggaguccugcccagcagccucaguggccaagccca

SEQ ID NO: 13475 - RNA, 63 nt, Human
aacuggcuagagccuccaggcccuaugaugcucccugcccaggccauauccuuuauuccugcu

SEQ ID NO: 13476 - RNA, 63 nt, Human
gaaagccagauggcaccagcugcuccggaugugccugcccacauugggggacagggccgggcc

SEQ ID NO: 13477 - RNA, 51 nt, Human
uggcgucggccugcgagugagccugcccauucugcccugugggaccccagg

SEQ ID NO: 13478 - RNA, 63 nt, Human
cuggggaggcauccgugugccggcccugcagugccugcccacggucaggcauugaaaacuaag

SEQ ID NO: 13479 - RNA, 63 nt, Human
caggcuuggacuagcuguggcccagacaucggcccugcccagaauugccaggaggaggcuuug

SEQ ID NO: 13480 - RNA, 63 nt, Human
ugaccaugucuaugauucguguaauuacuuaucccugcccauuucauauucuuucaauucugu

SEQ ID NO: 13481 - RNA, 63 nt, Human
ucugaccuaugccuaccuucucuuucuucguucccugcccacugggcauggcagcugggggug

SEQ ID NO: 13482 - RNA, 63 nt, Human
aaaaagggcuucgggggagugguuacccugcucccugcccagugacaagcccuccuuuccccu

SEQ ID NO: 13483 - RNA, 63 nt, Human
ccuuuccccugggggcccuccuuuccccugcucccugcccagcuacggggcccuccuuucagc

SEQ ID NO: 13484 - RNA, 63 nt, Human
ccacaacccagacccagaaccgcucuccccuucccugcccagugccccuccuccccagcccag

SEQ ID NO: 13485 - RNA, 63 nt, Human
acuccgucuccaaaaaaaaaagaauuccuggggccugcccagucugugagcugccauguugau

SEQ ID NO: 13486 - RNA, 63 nt, Human
uucccucuacugccucuuccugccucuccccacccugcccacauccacagaggggagagaagg

SEQ ID NO: 13487 - RNA, 63 nt, Human
cccaugaugacaucauggggagccagcagaguuccugcccauggucuugagcugaaugagaga

SEQ ID NO: 13488 - RNA, 63 nt, Human
caagggggugaugaaaaggggaggggcggagcuccugcccaggagaggggcuguggggcccca

SEQ ID NO: 13489 - RNA, 63 nt, Human
aagguugugcucagccugucgggucucuuucuuccugcccauauauuauaccaguugcuucug

SEQ ID NO: 13490 - RNA, 63 nt, Human
aucccugcucagaaugcucccaguucccucgucccugcccaggucucuugucucuugggaagg

SEQ ID NO: 13491 - RNA, 63 nt, Human
cuuuguaccacaguggcucuggggccaggccugccugcccacuggccaucgccaccuucccca

SEQ ID NO: 13492 - RNA, 63 nt, Human
gcccaccuccucccugacccuuaacacuccuguccugcccagaccaacagagagagcuguccc

SEQ ID NO: 13493 - RNA, 63 nt, Human
ucuuuguccuggugcccaggagcccuccagcccccugcccacagaagggaaggccugcagagg

SEQ ID NO: 13494 - RNA, 63 nt, Human
agaagcagugaagguucuucucugugugggugcccugcccacccccuccuuugccuguguccu

SEQ ID NO: 13495 - RNA, 63 nt, Human
ugguccccucagcucugccucugcagcccacugccugcccagugccaucaggaugagcaguac

SEQ ID NO: 13496 - RNA, 63 nt, Human
cugagggauaugccuccgcaacucacacaccugccugcccacgcuccuucuuuagcucugaca

SEQ ID NO: 13497 - RNA, 63 nt, Human
acgggaccuccaucugacugcgccgccugcccuccugcccacccucccacccacccgaccagc

SEQ ID NO: 13498 - RNA, 63 nt, Human
ccugagugagacaaauacagaaaugacccauucccugcccaccagaaacucagaggugauugg

SEQ ID NO: 13499 - RNA, 63 nt, Human
agccuacacgcucauauugugcauauggcagacccugcccagcgugcgcuuugauacagcaaa

SEQ ID NO: 13500 - RNA, 63 nt, Human
gcagaauuuucuguuuagugggcagguguuauuccugcccacagcaaagcuuggacuugcagc

SEQ ID NO: 13501 - RNA, 63 nt, Human
gggaagcugguuacuuuuggccuccccagcaccccugcccaucuggugccacagccuugcccc

SEQ ID NO: 13502 - RNA, 63 nt, Human
acaaaauacuuuuuaaagcccucuugccucuucccugcccacuccugcccccugaccagaaga

SEQ ID NO: 13503 - RNA, 63 nt, Human
cuuuugcuucugauuucuucuccccugcuguuuccugcccaucagagaggccugauacaagca

SEQ ID NO: 13504 - RNA, 63 nt, Human
gggaagugagggaaaaacguuaggugcuaaccaccugcccagaagaguggaucucacagccca

SEQ ID NO: 13505 - RNA, 63 nt, Human
ggccaggaacccaagccaccccggcuccccucgccugcccaggggccguggugacucacgggc

SEQ ID NO: 13506 - RNA, 63 nt, Human
gcuggcugucccuguggacccgccauccaccguccugcccacgccgccucagccugccaccuc

SEQ ID NO: 13507 - RNA, 63 nt, Human
cagaaggucauuuuauacaacaggagauugguuccugcccagaugacagaaaaugggagcucu

SEQ ID NO: 13508 - RNA, 63 nt, Human
agcugugccuacuguuccccaccucagaagcuuccugcccagagagccagcagccuugggaua

SEQ ID NO: 13509 - RNA, 63 nt, Human
gccaucucuagaauugccacgagucucucucuuccugcccaguccagggcccuccuuuccuau

SEQ ID NO: 13510 - RNA, 63 nt, Human
agacgagucggagacuugaggaguccaaaggguccugcccacagcgcccuguaccugcuccca

SEQ ID NO: 13511 - RNA, 63 nt, Human
uccuggagcaggcacauagugagcccgggcagcccugcccagcucaggccccuuuccuucccc

SEQ ID NO: 13512 - RNA, 63 nt, Human
cuguacccccacuccaucccccaggggaacaccccugcccagcuacuuuccuaaugaaauaaa

SEQ ID NO: 13513 - RNA, 63 nt, Human
cugggacuggccuggauggcuguccugggagccccugcccacccugacagagggagcugggcc

SEQ ID NO: 13514 - RNA, 63 nt, Human
aacucguucccgaaugugcuuuccucccucuccccugcccaccucaaguuuaauaaauaaggu

SEQ ID NO: 13515 - RNA, 63 nt, Human
ccuggcccuucucaguuuucucccacauucaccccugcccagagauucccccuucuccucucc

SEQ ID NO: 13516 - RNA, 63 nt, Human
gccagauuacuuccuccaccccucccuaucucaccugcccagcccugugcuggggcccugcaa

SEQ ID NO: 13517 - RNA, 63 nt, Human
ccgcacugccacuuguccccccacacccguccaccugcccagagcucagagcuaaccaccauc

SEQ ID NO: 13518 - RNA, 63 nt, Human
cccuggccuugccagaguggcuucugaggacucccugcccagcccagcuuucacuggggggag

SEQ ID NO: 13519 - RNA, 63 nt, Human
gggcuuggcacugugccaagccuggggccaaucccugcccagucagcuggggucugguggggg

SEQ ID NO: 13520 - RNA, 63 nt, Human
aaccccaccugaagcagaaccacuuuggccuccccugcccaaaauggguagugucuacacguc

SEQ ID NO: 13521 - RNA, 63 nt, Human
cuugucaucucagccugagcccuggaggcugggccugcccacuccagcuccaucccuuauuua

SEQ ID NO: 13522 - RNA, 63 nt, Human
ugcacuggguucucuccuucuucuuccugcuguccugcccaagaacugagggucuccccggcc

SEQ ID NO: 13523 - RNA, 63 nt, Human
ccucugcccugccagagacagacccaugcgcugccugcccaccgugccccuuuguccccaugu

SEQ ID NO: 13524 - RNA, 63 nt, Human
ugcgggacucacccggccgccagacugccugggccugcccagauggccaccucguggugcugc

SEQ ID NO: 13525 - RNA, 63 nt, Human
uuuccacuuccagagggggccagagggacuuugccugcccagucuuuggagagcucaguacag

SEQ ID NO: 13526 - RNA, 63 nt, Human
cagaccuucucuuccuuuccuuuccuuuccucuccugcccauuuuccuguucuucuguccuuc

SEQ ID NO: 13527 - RNA, 63 nt, Human
aacaccuggccucaauguuggcuuguuauguuaccugcccacccucauccuuaccuccuccua

SEQ ID NO: 13528 - RNA, 63 nt, Human
uuccagccccugaggaaauggaaugaaccacucccugcccauucccuauaagaauaucccaag

SEQ ID NO: 13529 - RNA, 63 nt, Human
cccacacgccauggaccucagggcacucuccucccugcccacaaagaccuccugggugggaaa

SEQ ID NO: 13530 - RNA, 63 nt, Human
ugaucccggcaggacugugauacagagcccuagccugcccagccagccccaagaucucaggag

SEQ ID NO: 13531 - RNA, 63 nt, Human
gaaggcagcuuucccgcucuggguaccuuacguccugcccagcucugugcaccugaaccccag

SEQ ID NO: 13532 - RNA, 52 nt, Human
ccucccucauggcugucugacaccugcccaccuaccuggcucugaccguucc

SEQ ID NO: 13533 - RNA, 63 nt, Human
ccuuugcagugcugggagccgcuuccuuccugcccugcccaccuggggaucccccaaagucag

SEQ ID NO: 13534 - RNA, 63 nt, Human
aauauucagcuguacacacaaagucugguuuuuccugcccaacuucccccuggaagguguacu

SEQ ID NO: 13535 - RNA, 63 nt, Human
ggcugcugaccuccacagcuuccccucucuccuccugcccaccugucaaacaaagccagaagc

SEQ ID NO: 13536 - RNA, 63 nt, Human
augcaaagacuacugggaggcugcugccuccuuccugcccauggcacccuccucugcugucug

SEQ ID NO: 13537 - RNA, 63 nt, Human
ccucaaugucuaccucugaagccuccuucccugccugcccaccccuccaugcuccacgcaggc

SEQ ID NO: 13538 - RNA, 63 nt, Human
cccugagacuauuugcugugggcucuccuccagccugcccagggcccacccagaugccucugg

SEQ ID NO: 13539 - RNA, 63 nt, Human
uaguuccauuucacaggugcacauaaagaccuuccugcccaccuccuauggacauguccaggg

SEQ ID NO: 13540 - RNA, 63 nt, Human
gacgagacuucccugccguguuugugacccccuccugcccagcaaccugccagcuacaggagc

SEQ ID NO: 13541 - RNA, 63 nt, Human
cugaccacugaugauggggacccugggccagcgccugcccacuuggccucagucuccccaccu

SEQ ID NO: 13542 - RNA, 63 nt, Human
cuugcccuaacgcgcuuugcugugagccuggccccugcccagggcuugggucuggugagcuga

SEQ ID NO: 13543 - RNA, 63 nt, Human
ggcuuugcaggacucuuaccauggccaggcauuccugcccagccuuuaccuccuuuuccuggc

SEQ ID NO: 13544 - RNA, 63 nt, Human
caagagaaauucagugcagcagggggacacagaccugcccaagccaccccacugccguucccu

SEQ ID NO: 13545 - RNA, 63 nt, Human
cccuggggaaacaucagugaauaaaacacggucccugcccacagugcuuagggccuacugagg

SEQ ID NO: 13546 - RNA, 63 nt, Human
ccuuuggguuccacugacaccccugccccugccccugcccagaaccaagugccauuucucacu

SEQ ID NO: 13547 - RNA, 63 nt, Human
ucaagacuugaggccauugaagcugcaggaagcccugcccagggaugguccugccaugaggag

SEQ ID NO: 13548 - RNA, 63 nt, Human
ccuggccuccaggcccgucuguccaucugcccgccugcccaccugccuggccggccagccagc

SEQ ID NO: 13549 - RNA, 63 nt, Human
cugacaacaaguuaucccagggccugagguucuccugcccaguccccucuugcagggguugcu

SEQ ID NO: 13550 - RNA, 63 nt, Human
ugccagagcccaagugccaucccacauucggacccugcccauaccccugccuggguuuucuaa

SEQ ID NO: 13551 - RNA, 63 nt, Human
ccaugucuuauguguguccugaaaaaauaagagccugcccaagacuuugggccucuugacaga

SEQ ID NO: 13552 - RNA, 63 nt, Human
caagaaggccuaguugcccgcugggccuggggcccugcccaugccugggccagaguggcgcug

SEQ ID NO: 13553 - RNA, 63 nt, Human
gcucccugcgcgguaaccccaccacuccugaagccugcccagucuccuuccuucccugcuugg

SEQ ID NO: 13554 - RNA, 63 nt, Human
caggucguccucaccauagccaaggccuuggggccugcccagggcugcuccccugggcccagc

SEQ ID NO: 13555 - RNA, 63 nt, Human
cuguuggugucuguccaguccauucaaggcuagccugcccaugcacuguggcagggguuggau

SEQ ID NO: 13556 - RNA, 60 nt, Human
augccuaucuucaccaauaacaacagccacccugcccagucuggaagaagaggaggaaga

SEQ ID NO: 13557 - RNA, 63 nt, Human
ucaggcacagaccuugugggacugggccccaggccugcccaggaugugguuuuccaaguccug

SEQ ID NO: 13558 - RNA, 63 nt, Human
gugaaggugucuccaucaccaccaccagagccuccugcccagcccuggccaguucaaagguuc

SEQ ID NO: 13559 - RNA, 63 nt, Human
ucuccccuucccacccuccagccaaggagcagcccugcccagggggcauuagguguggguacc

SEQ ID NO: 13560 - RNA, 63 nt, Human
ccccucucucuccucccuguuggugcuguucuuccugcccaacaccuguuucucuuuuccuca

SEQ ID NO: 13561 - RNA, 63 nt, Human
gcaggguaggugaaagucuagagaaagaggcuaccugcccagggucacagcaaggcugggacc

SEQ ID NO: 13562 - RNA, 63 nt, Human
uugaugcugagugauccccuccagggacacuucccugcccaggccaccucccacagcccucca

SEQ ID NO: 13563 - RNA, 63 nt, Human
uacccugaccccagugcugcucuaagcaccgucccugcccagccccacuucuccaucgcagcc

SEQ ID NO: 13564 - RNA, 63 nt, Human
ugccugcccgcacagcagccugcuucccaccucccugcccaggccggccagccucacccuugc

SEQ ID NO: 13565 - RNA, 57 nt, Human
gccaucugggggaccccugaggaucuaccugcccaggcccauucccagcuccuuguc

SEQ ID NO: 13566 - RNA, 63 nt, Human
acuaacacuugccuccccacugcagccugcgguccugcccaccucccgugaugugugugugug

SEQ ID NO: 13567 - RNA, 63 nt, Human
uuuccgggcacaagaaaccagaguccugcccagccugcccauccccuucccagucagggcucc

SEQ ID NO: 13568 - RNA, 63 nt, Human
acuguagucuuuccgggcacaagaaaccagaguccugcccagccugcccauccccuucccagu

SEQ ID NO: 13569 - RNA, 63 nt, Human
gugggcagggguagaggagggggccgcuguccaccugcccagugcuuggccuggcaguggcuu

SEQ ID NO: 13570 - RNA, 63 nt, Human
ucggggaaacagcauccugccgccuccucucugccugcccacucaccggcaagguugucccuc

SEQ ID NO: 13571 - RNA, 63 nt, Human
cgucgggccggcaguggugcggcucacuccgucccugcccaccugcgacgggaucccccgacc

SEQ ID NO: 13572 - RNA, 63 nt, Human
uggauggaaguggcuguccccuccucuccagccccugcccacccacugguggaggugcuaacu

SEQ ID NO: 13573 - RNA, 63 nt, Human
uucuuccauugugagaccacugccaucuauccaccugcccaccuccccuuuuguuucucagua

SEQ ID NO: 13574 - RNA, 63 nt, Human
ggggcacaagggcaccuucucccuugaggcugcccugcccacgugggauucacaggggccuga

SEQ ID NO: 13575 - RNA, 63 nt, Human
guaaggcaaggaacuggguggaaugucagguugccugcccaaugggagagguaggguuuuucu

SEQ ID NO: 13576 - RNA, 63 nt, Human
guccaccucagcgggccagcagcccagggaaccccugcccaccaggauugcuggaagugugac

SEQ ID NO: 13577 - RNA, 63 nt, Human
cgucacaccaagcccuuaucuggggcgcgucuuccugcccagguggaacacuggcauuuuguu

SEQ ID NO: 13578 - RNA, 63 nt, Human
uggcagcuguggcauccacuguggcaucuccguccugcccaccuucuuaagaggcgagaugga

SEQ ID NO: 13579 - RNA, 63 nt, Human
ucucaauuuaaaaugauccauggccacagggcuccugcccaggggcuugucaccuuccccucc

SEQ ID NO: 13580 - RNA, 63 nt, Human
ucaggcuggcacuaggcucagcccccaaaacccccugcccagccccagcuucagggcugccug

SEQ ID NO: 13581 - RNA, 63 nt, Human
ugccauaccuagaggucgggacagacgacgcuaccugcccagacaccaccaaguucucugccu

SEQ ID NO: 13582 - RNA, 63 nt, Human
gaggacacaaggagggugcguggugcccucaccccugcccagagcgagggggcaaggacucug

SEQ ID NO: 13583 - RNA, 63 nt, Human
auugaauugccuugggauuuccuucucccuuucccugcccacccuguccccuacaauuugugc

SEQ ID NO: 13584 - RNA, 63 nt, Human
caugugcaaagaagcuaaagaaaaggaauaagcccugcccaguauguagacaaccaauucaaa

SEQ ID NO: 13585 - RNA, 63 nt, Human
gguuguuuuuaccacaguggucuuuuuaaaccaccugcccacucccuuaacaagaguuuuaua

SEQ ID NO: 13586 - RNA, 63 nt, Human
cuucaccauccgcaagcgggagccaggcggccgccugcccaccuccuccaccugcuucaaccu

SEQ ID NO: 13587 - RNA, 63 nt, Human
uccccauaccgggccucuggcccagaccuaagcccugcccacaaagacuaauggaugccagug

SEQ ID NO: 13588 - RNA, 63 nt, Human
gggcaaguacagccacuguaaauaacccucgucccugcccaggaacccagacuggacuucagu

SEQ ID NO: 13589 - RNA, 63 nt, Human
ugucaauggcguuagacucccaggaagacuagcccugcccacagggccaccuguugguuugag

SEQ ID NO: 13590 - RNA, 63 nt, Human
cuucggcucccaggacauggcugacuuugccaaccugcccagcugcugccgcuggaggauccg

SEQ ID NO: 13591 - RNA, 63 nt, Human
gggccggggcucaggagccaugaccuggugucuccugcccacccuggucccagguaaauguga

SEQ ID NO: 13592 - RNA, 63 nt, Human
caaccaaggguacacgcaggcaugcacggguuuccugcccagcgacggcuuaagccagccccc

SEQ ID NO: 13593 - RNA, 63 nt, Human
uccuuucgcccuuguuucccacauucccuucguccugcccaagggcgggacugaagagcugga

SEQ ID NO: 13594 - RNA, 63 nt, Human
gcuggcgucuauucugcccacaccccagcccaaccugcccacguucucuauuguuuugagacc

SEQ ID NO: 13595 - RNA, 63 nt, Human
aggagcagacugguuccuaacucucucccuccuccugcccacacacaucaaaagaaucuuccc

SEQ ID NO: 13596 - RNA, 63 nt, Human
ucuucucuucuugguuucauaccguucuuaucuccugcccaagcauauaucgucucuuuacuc

SEQ ID NO: 13597 - RNA, 63 nt, Human
cgaccucguccucccccugccagugccuuaccuccugcccaggagagccagcccucccugucc

SEQ ID NO: 13598 - RNA, 63 nt, Human
gagaaguugugagugucugcuguccuuggcaccccugcccacuccacacuccuggaauaccuc

SEQ ID NO: 13599 - RNA, 63 nt, Human
agaugaggaguccucucuuuaauugcuaaccauccugcccauuauagcuacacucaggaguuc

SEQ ID NO: 13600 - RNA, 63 nt, Human
ggagccaauccacuccuuccuuucuaucauuccccugcccaccuccuuccagcacugacugga

SEQ ID NO: 13601 - RNA, 63 nt, Human
accuuugccuccugaggcgcagcgcacuccuccccugcccaagccuacugccucccgcugccg

SEQ ID NO: 13602 - RNA, 63 nt, Human
gggcggcgcugcucagcuugggcugguccagggccugcccaggcuggggcaccuuugccuccu

SEQ ID NO: 13603 - RNA, 63 nt, Human
uaaccucucccacagccagugccaaguccucccccugcccauucucauggggcaggaaauggg

SEQ ID NO: 13604 - RNA, 63 nt, Human
uaguucucaggcagagacaucuuugggccugucccugcccaggccucuggcuuuuuauauuga

SEQ ID NO: 13605 - RNA, 63 nt, Human
ggccagcugccccauucuuuuaacguuguagggccugcccauggagcggacccuccucuuugg

SEQ ID NO: 13606 - RNA, 63 nt, Human
ugcuuuuuaggccucacucccaucagaacccugccugcccaccugcaacucccccccaacaau

SEQ ID NO: 13607 - RNA, 63 nt, Human
aacuguggucaaaccagguacccaagccaccucccugcccaacgccuuuccggcuuuuccccu

SEQ ID NO: 13608 - RNA, 63 nt, Human
aacuacugggcucaagccuuccucccgccucagccugcccaguaacugguacuacagaugugc

SEQ ID NO: 13609 - RNA, 63 nt, Human
cuaccuugcucacugccuuaaucagaccgauuuccugcccaccugaccagcccagcgugguaa

SEQ ID NO: 13610 - RNA, 63 nt, Human
ucucaggcccucagggucaaggccuugguuggaccugcccacuccaaaaacccaguguggggg

SEQ ID NO: 13611 - RNA, 63 nt, Human
aggacuucucagacaaaggcaaggccucgugccccugcccagcccauucauggagcccugggc

SEQ ID NO: 13612 - RNA, 63 nt, Human
ccacucaguggggaaagcaggggcagaugccacccugcccaggguuggcaugacugucugugc

SEQ ID NO: 13613 - RNA, 63 nt, Human
cgcccgcuccaucacggauaacaucuccuacggccugcccacugugccuuucgagaugguggu

SEQ ID NO: 13614 - RNA, 63 nt, Human
gaaaggcuguaucuuaauuucugcaccccggacccugcccaccugucugccugccccgccugg

SEQ ID NO: 13615 - RNA, 63 nt, Human
aauggacucuccucggguggguccagcaggggcccugcccaccagaacacaguccgugcugug

SEQ ID NO: 13616 - RNA, 63 nt, Human
cgaggguacuaugauauuuugguuuggaauugcccugcccaagucacugucuuuuaacuuuua

SEQ ID NO: 13617 - RNA, 63 nt, Human
auguugguuucagucaucaacuacccaugaauuccugcccaaggauacuuaaucaggauuaaa

SEQ ID NO: 13618 - RNA, 63 nt, Human
accccauucuuuccagcgccccgcaccauagcaccugcccaccugagaaccaggaacgcaccc

SEQ ID NO: 13619 - RNA, 63 nt, Human
ggugcaagcacucggggucccuggagggcaagcccugcccacagaaagccaggagcagcccug

SEQ ID NO: 13620 - RNA, 63 nt, Human
gagguccuuguguggccgcccuggcuuggcagcccugcccacgcugcccccgcaaacaauggu

SEQ ID NO: 13621 - RNA, 63 nt, Human
agguucucgcgauucaggacguccuuccauaucccugcccagccuguggugcuugaaacguuu

SEQ ID NO: 13622 - RNA, 63 nt, Human
accugcccccagagcugaggccaucugcaagccccugcccauggcccaauggggagccuccag

SEQ ID NO: 13623 - RNA, 63 nt, Human
gucuccuucggaacccgaacugcaagcugagcgccugcccagauucucccauggguauuucac

SEQ ID NO: 13624 - RNA, 63 nt, Human
uaggaaguauaaguaagccaagagaagucagccccugcccagaagaucugaaacuaauaguag

SEQ ID NO: 13625 - RNA, 63 nt, Human
cauccuuccccucaagccugggcucauggagccccugcccagggcccucaggugggcggaaag

SEQ ID NO: 13626 - RNA, 63 nt, Human
caccuuaacuuaugacucaggauuuauucacguccugcccacucuaggcucacaggaauaaaa

SEQ ID NO: 13627 - RNA, 63 nt, Human
cuaaagaaagauuacguugaugaaaaagaacauccugcccaggacccaucauacauauuuuca

SEQ ID NO: 13628 - RNA, 63 nt, Human
cugaugcccccacccaccucgguccagcgcggcccugcccaggaggcggcagccgggcgcacc

SEQ ID NO: 13629 - RNA, 63 nt, Human
ggaugcugcuuccgguagggaggcagccuccagccugcccaagcccaggccacccuaucgccc

SEQ ID NO: 13630 - RNA, 63 nt, Human
gucuccgguaaaacaccggagacuaauuccugcccugcccaauuuugcagggagcauggcugu

SEQ ID NO: 13631 - RNA, 63 nt, Human
ccugcaguguugucggccgaggccugagcucgcccugcccagcuacugaccucaggucgaggg

SEQ ID NO: 13632 - RNA, 63 nt, Human
gcagacacugcuccuugugcagcucugguaccuccugcccacugcugucacuucaagccacug

SEQ ID NO: 13633 - RNA, 63 nt, Human
cuagaaccaguauguggcauuccugucaaauggccugcccaugaagcccuggaauuccagcuc

SEQ ID NO: 13634 - RNA, 63 nt, Human
ggaacagagaauauccaaugcagucaaguccacccugcccagacuuugccacugacuucuccc

SEQ ID NO: 13635 - RNA, 63 nt, Human
auagauuaggaccucuauccgagaugcuuuuucccugcccaacccuguggccuucagggcuca

SEQ ID NO: 13636 - RNA, 61 nt, Human
cugcaggcugcagccaguccagagagaauagagccugcccaggccuuaagaccaccucuca

SEQ ID NO: 13637 - RNA, 63 nt, Human
ugaggccccugacuuccuucuagggcagucuggccugcccacaaacugacuuugugaccuguc

SEQ ID NO: 13638 - RNA, 63 nt, Human
cggaacaaguaauuuaccaguucuacugggguuccugcccaccgucccaaggugggcgaggcc

SEQ ID NO: 13639 - RNA, 63 nt, Human
gcccugccgggcacaugcccgggggacgccugcccugcccagguggccuccuggcccgcccuc

SEQ ID NO: 13640 - RNA, 63 nt, Human
agacggccggccggaccucugagcacauaguguccugcccacccuaccagcuccuccagcccu

SEQ ID NO: 13641 - RNA, 63 nt, Human
accauuuaucauggaugaaagagaucuguaaaaccugcccaggaacuuacagaauuuacuuug

SEQ ID NO: 13642 - RNA, 63 nt, Human
gucaugccuuaagaagcagagcuaccuuacgugccugcccaggcuguuccugccuaaaucucc

SEQ ID NO: 13643 - RNA, 63 nt, Human
aauaucaguauuuuuuuccucccuauacagugcccugcccacccuuaucugcacccaccuccc

SEQ ID NO: 13644 - RNA, 63 nt, Human
gagauggcugagcuuccagcgccuucuguccugccugcccagucccuucacugcuuuccugcc

SEQ ID NO: 13645 - RNA, 63 nt, Human
ucccacugccuucuaaggagccaaggagaauucccugcccacuuucuguuccuccaugcccaa

SEQ ID NO: 13646 - RNA, 63 nt, Human
ugcuguugcacgggagaacuuuccucacccgccccugcccagacagggugaggaaagggcucc

SEQ ID NO: 13647 - RNA, 63 nt, Human
ccuaaucaaguaucugagccagaugcugcgggaccugcccagcugcccgugugccuacccacu

SEQ ID NO: 13648 - RNA, 63 nt, Human
auggccacuguggaccgggacccuugggggaagccugcccaugucgggcugugggaggcugau

SEQ ID NO: 13649 - RNA, 63 nt, Human
gcugccugcccguaaacacgccugcaaacgcugccugcccacacagguucacgugcagcucaa

SEQ ID NO: 13650 - RNA, 63 nt, Human
augcgcaauguggcauuggggggccgggcagguccugcccauguguccccucacucugucagc

SEQ ID NO: 13651 - RNA, 63 nt, Human
gccaguccacccugccugccgucugugcuuccuccugcccagaacgcccgcuccagcgaucuc

SEQ ID NO: 13652 - RNA, 63 nt, Human
gggcagauuccuaagcagcuggccugaccucuuccugcccagcccccaacccagucucuggcc

SEQ ID NO: 13653 - RNA, 63 nt, Human
ucuugggaaguagagauguggcggcuuucccacccugcccacagcaggcccuccugcccagcu

SEQ ID NO: 13654 - RNA, 63 nt, Human
ggcggcuuucccacccugcccacagcaggcccuccugcccagcugcucuugucagcccucugg

SEQ ID NO: 13655 - RNA, 63 nt, Human
uguuguauacuguuaacgauugucugcccauguccugcccaaaauaccaugauucuuuaugga

SEQ ID NO: 13656 - RNA, 63 nt, Human
acaguuauucuaucaacuuuuaaagguuuuaaaccugcccagaaauuaccuugguaucugaag

SEQ ID NO: 13657 - RNA, 63 nt, Human
gggccucuggggugagagcagcuuccgauaggaccugcccagauuucugcaugugcacuuuug

SEQ ID NO: 13658 - RNA, 63 nt, Human
gguggggcauugagaauggaggcucccagggucccugcccacuucuguuuuccuaauguuuuu

SEQ ID NO: 13659 - RNA, 63 nt, Human
gccccucaugagguuagggucccccacccuccaccugcccagaggccaacucuguucccuucu

SEQ ID NO: 13660 - RNA, 63 nt, Human
uuugaccugaugaggaggauguuagaauuugacccugcccagcgcaucacacuggccgaggcc

SEQ ID NO: 13661 - RNA, 63 nt, Human
caaugcccagagugaccaagcagcaccagcaggccugcccaggaugcugaaagcagauuucuu

SEQ ID NO: 13662 - RNA, 63 nt, Human
uccuugccccacuggugagaggaggaccuugugccugcccagagccugcaggacagcacgccu

SEQ ID NO: 13663 - RNA, 63 nt, Human
agaugcugcuugcucagaaacaacccgugcaucccugcccauggauucugcaggaccuagaag

SEQ ID NO: 13664 - RNA, 63 nt, Human
gcacauggcccuuugcuugagggcuccccacucccugcccaccaauacccaggugaggaacag

SEQ ID NO: 13665 - RNA, 63 nt, Human
auuguccuucuccaucugggccaauuguccuucccugcccauucagaguucaauuugagccuc

SEQ ID NO: 13666 - RNA, 63 nt, Human
uccuuuuuucaauaugcaagcagcuuuuuauucccugcccaaacccuuaacugacaugggccu

SEQ ID NO: 13667 - RNA, 63 nt, Human
gggaaguccuuccagugccacauggagugaggcccugcccaugcuggggacuuuggggaggaa

SEQ ID NO: 13668 - RNA, 63 nt, Human
ugauuucggaccgaaggugacagccgucccaacccugcccagccugaugccaccuccucuguu

SEQ ID NO: 13669 - RNA, 63 nt, Human
auuaugaguuuuaaaacuuuuaacccgcuucuaccugcccaacugugaccaacuaaaugacag

SEQ ID NO: 13670 - RNA, 63 nt, Human
cucccugccugggggcuaugugcacuccagaccccugcccaggcucaggcccaugagguaugg

SEQ ID NO: 13671 - RNA, 63 nt, Human
ggggcagaggccaggaggggaccuggugugucaccugcccaccaccuggcucaucccucaggc

SEQ ID NO: 13672 - RNA, 63 nt, Human
ugcccagcccugagggcagggaaggucaacccaccugcccaucugugcugaggcauguuccug

SEQ ID NO: 13673 - RNA, 63 nt, Human
ggaaaacaggaaaggagguuccagccccacccaccugcccaccccgccccaggcaccaucagg

SEQ ID NO: 13674 - RNA, 54 nt, Human
cauguucaaggaacccauagagauccugcccaaugugugcuacacagcaugugc

SEQ ID NO: 13675 - RNA, 63 nt, Human
ucgggggccuccggagcugggcuuugggccucuccugcccaccucuacuucucugugaagccg

SEQ ID NO: 13676 - RNA, 63 nt, Human
gugcccgccuggugccuucuggccuguggccucccugcccauguucaccuggcugcugugggu

SEQ ID NO: 13677 - RNA, 58 nt, Human
agcaggacacacaggccugagcaaagggccugcccagacaagauuuuuuaauuguuua

SEQ ID NO: 13678 - RNA, 63 nt, Human
agcagccccucugcacggucaccaucgccugggccugcccacagcacuggugcucaccucuac

SEQ ID NO: 13679 - RNA, 63 nt, Human
gccugacgccugcaccgggcccuccagcccuccccugcccagauagcugguggugggcgcuaa

SEQ ID NO: 13680 - RNA, 63 nt, Human
ccucuauccugucuguccccaccccagcuguccccugcccagggagcuggcauaaaagcacga

SEQ ID NO: 13681 - RNA, 63 nt, Human
gcagcugcuugagaacagagacugcuaccccauccugcccaugcaggcaggcucuugccagcc

SEQ ID NO: 13682 - RNA, 63 nt, Human
cgcagagggcagacgccacccuggacugcucucccugcccagcugggccucucuggccuauuc

SEQ ID NO: 13683 - RNA, 63 nt, Human
cugggcugccccuugacauucaggauguagcuuccugcccaccgcauacccuggcgccucacu

SEQ ID NO: 13684 - RNA, 63 nt, Human
ccacaagcugcuccucucucuguggccccggccccugcccaggugugggugguucuggccagg

SEQ ID NO: 13685 - RNA, 63 nt, Human
agccgcacaugcucaggcagcuaagggaggacgccugcccacgccugggacagaaggcuucac

SEQ ID NO: 13686 - RNA, 63 nt, Human
gacagccgacggcagcgccuugcccagaccuccccugcccaccugcuggagcccagccugugc

SEQ ID NO: 13687 - RNA, 63 nt, Human
gugugaccuggguagucagacaccacuugagccccugcccacaucugcugguuuggggcuuca

SEQ ID NO: 13688 - RNA, 63 nt, Human
ccugguggccuggcaggucugggcccuucucucccugcccagguugucccuggagggcagccc

SEQ ID NO: 13689 - RNA, 63 nt, Human
acgccuguccccgggacugagcugccaugccagccugcccacagcagccuccuagaguuagca

SEQ ID NO: 13690 - RNA, 63 nt, Human
gagaguagugacacucaggauccaaaagcuagcccugcccaccccagccccuggaccugcuua

SEQ ID NO: 13691 - RNA, 63 nt, Human
augcccucccaacccuggaguugucagggagggccugcccaucaccucccucuccccaacauc

SEQ ID NO: 13692 - RNA, 63 nt, Human
ucggagcucgccugcccugcuuggcucugaggaccugcccagcgcucaaagggaacggaagcc

SEQ ID NO: 13693 - RNA, 63 nt, Human
ccuacuugcccuagcaugaggcucugagagccaccugcccaccaaucuggugaggauaauggu

SEQ ID NO: 13694 - RNA, 63 nt, Human
uucagaggagccuguuggcaagagcugguauucccugcccagccgaccaaaugaccucugcau

SEQ ID NO: 13695 - RNA, 63 nt, Human
gccagagggagugacagaggcagccccauucugccugcccaggccccugccacccuggggaga

SEQ ID NO: 13696 - RNA, 63 nt, Human
cuaauuuuauuuaugauucaaaugugacucgugccugcccaucccuguaauagauggaagguc

SEQ ID NO: 13697 - RNA, 63 nt, Human
auggggggaaggauuauuauucauguuauuuucccugcccaagacuuuauuuaacccuggacu

SEQ ID NO: 13698 - RNA, 57 nt, Human
gugagggugaugccaucuaacccugccccugcccaccccgggcggcugaaacucacu

SEQ ID NO: 13699 - RNA, 63 nt, Human
ccacccuccauuccggaccccaugggcccagccccugcccaucuaguugguuuggggacccug

SEQ ID NO: 13700 - RNA, 63 nt, Human
ugacacccugugacugagccuguguccugucugccugcccagccaugcuccaucggcugugag

SEQ ID NO: 13701 - RNA, 63 nt, Human
caggaagguagagaguuuuccuguucagauuacccugcccagcaggaacuggaauacaguguu

SEQ ID NO: 13702 - RNA, 63 nt, Human
cugcacuuccugcuggacucaggccuccagcucccugcccagcgagcggccucagccaccgcc

SEQ ID NO: 13703 - RNA, 63 nt, Human
cccucuggaucuggguuccaucucugucuccagccugcccacuucccuucaugaauguugggu

SEQ ID NO: 13704 - RNA, 63 nt, Human
cucugguccauagagagcaagacgcugugcugcccugcccaccuggccucugcacuccccugc

SEQ ID NO: 13705 - RNA, 62 nt, Human
ccucguccagccgcaucuaggccuccagcccaccugcccaugugaugaagcagagauucggc

SEQ ID NO: 13706 - RNA, 63 nt, Human
cucaggcacaccuugcagaaggcaaggcccugcccugcccaaccucuguggucacccaugcau

SEQ ID NO: 13707 - RNA, 63 nt, Human
aagcugcaaaccacuguaccugccucagucaggccugcccacuaugggcagaccucucgcuca

SEQ ID NO: 13708 - RNA, 63 nt, Human
caggccccgguggguuugucugcacuuggugcuccugcccacaccagccacuuuggugacaau

SEQ ID NO: 13709 - RNA, 63 nt, Human
gcagaacaccugaggacaggaguuugagaccagccugcccaacguggugaaaccccaucucua

SEQ ID NO: 13710 - RNA, 63 nt, Human
cauccuccuggaaugggggaaccuuccuuauccccugcccacauccccucuccaauaaagcac

SEQ ID NO: 13711 - RNA, 63 nt, Human
cugggagugaucacugcacgcccaucgugcacaccugcccaucgugcacacccacccauggug

SEQ ID NO: 13712 - RNA, 63 nt, Human
agaguauugggauuacagacaugagccacugcaccugcccagcuccccaacucccugccauuu

SEQ ID NO: 13713 - RNA, 63 nt, Human
cuggggggcuguccugagcccccugcacccaccccugcccaggcagucuuugcucaguggauc

SEQ ID NO: 13714 - RNA, 63 nt, Human
ugguggcagccgccaggcgagcaggcugcuuucccugcccagucaugcaccucccccucuggg

SEQ ID NO: 13715 - RNA, 63 nt, Human
gugcuggcaaucagggccgcaguguguucugcgccugcccagagcugacuccugauuuaaccg

SEQ ID NO: 13716 - RNA, 63 nt, Human
ccacugcacuuggaaggauauauuaugccuaacccugcccaacaaauuaagguuugugccuaa

SEQ ID NO: 13717 - RNA, 63 nt, Human
aucuuguaccaagccaacggcguuccuggcucuccugcccacaggaugaacauuuucggcuuc

SEQ ID NO: 13718 - RNA, 63 nt, Human
aggguggauccuugccaggcgucccugauccucccugcccaagucuuccuucgugagcuggcc

SEQ ID NO: 13719 - RNA, 63 nt, Human
ggugcacagccucccucccuccagcaagcccucccugcccagaaggaauggguccaggugugg

SEQ ID NO: 13720 - RNA, 63 nt, Human
gccgugggacugaugcgggaucccgagggccuuccugcccacaugccccgggagaaaccgagg

SEQ ID NO: 13721 - RNA, 63 nt, Human
gccugacgccugcaccgggcccuccggcccuccccugcccaggcagcugguggugggcgcuaa

SEQ ID NO: 13722 - RNA, 58 nt, Human
ucucgcuggcccagacgugaggcccagcccugcccauaaugggcacuggcgcuggcac

SEQ ID NO: 13723 - RNA, 63 nt, Human
gugcuggggacagguccucaguguccucaggggccugcccagugcacuugcuggaagacgcaa

SEQ ID NO: 13724 - RNA, 63 nt, Human
uaaauguuaaugauuuuuauagguauuuguaacccugcccacauaucuuauuuauuccuccaa

SEQ ID NO: 13725 - RNA, 63 nt, Human
ggaaaauuaaacaaaaccccagguuauuucuucccugcccagagccagccugggauugucagc

SEQ ID NO: 13726 - RNA, 63 nt, Human
gagaagcccacaagaucugagugaaaaaagucaccugcccaauaaagcuugacaagacacucg

SEQ ID NO: 13727 - RNA, 63 nt, Human
ucaagcccccagcuggaaguuaagagaaagucaccugcccaagaaacaccgagugaggccaua

SEQ ID NO: 13728 - RNA, 63 nt, Human
uguacuggaacucuggaaagaggggcuccccgaccugcccaucccccaggcucuucugggccu

SEQ ID NO: 13729 - RNA, 63 nt, Human
gggcuccagcccuccccugcccccagcccguccccugcccagggcacagcggagccauggggg

SEQ ID NO: 13730 - RNA, 63 nt, Human
uaccuccuuaacuuuguacuagacuggccugggccugcccagcucagcguuaucagucuguuu

SEQ ID NO: 13731 - RNA, 63 nt, Human
cccaccuguuucuggaagacugcucccggcccgccugcccagacugaugagcacaucucucug

SEQ ID NO: 13732 - RNA, 63 nt, Human
acugagggccagggacccaggugugccugugcuccugcccaggagcagcuuuuggucuccuug

SEQ ID NO: 13733 - RNA, 63 nt, Human
cgcagucgagccgggaggaacccaggcugcugcccugcccagcccgacccugccccggcccca

SEQ ID NO: 13734 - RNA, 63 nt, Human
caccugcagacgcagggggacugcacaauuccaccugcccaggaccugacccuggcgugugcu

SEQ ID NO: 13735 - RNA, 63 nt, Human
gaaggauggcucuggccucgguccucccccaacccugcccaagccagacagacagcaccugca

SEQ ID NO: 13736 - RNA, 63 nt, Human
uucuaucagacgugcucccucccauccuccagcccugcccacccucccuccacuccucucaac

SEQ ID NO: 13737 - RNA, 63 nt, Human
gaagacccugaccguguacauagcccuggugcuccugcccagccaccccucagaugcguucgc

SEQ ID NO: 13738 - RNA, 63 nt, Human
gccccucuucaguccugcccuccccuccucaguccugcccaccccgugcagcccaugcugagg

SEQ ID NO: 13739 - RNA, 63 nt, Human
cagggaagcucgggaaggggaagggagacuggcccugcccagccggucucuagccccucagcc

SEQ ID NO: 13740 - RNA, 63 nt, Human
aagggccccgcagcccuucugcacccagcacagccugcccagcccagcccugcccccgggcac

SEQ ID NO: 13741 - RNA, 63 nt, Human
agggcaggcugcaugcaguggcggcuacugggcccugcccagccccggaacucugcgcgauau

SEQ ID NO: 13742 - RNA, 63 nt, Human
ggucucagccacagcaccccuuauuccagcugcccugcccaaccugcucaccccacaugaccu

SEQ ID NO: 13743 - RNA, 63 nt, Human
gccucccccuguauucccccucccagggcagccccugcccagcacaaaaccccaggacccugg

SEQ ID NO: 13744 - RNA, 63 nt, Human
agagguggcacaugcuuggccacacaucuacucccugcccacaccaucuaugcucuugguugg

SEQ ID NO: 13745 - RNA, 63 nt, Human
acuugguaccaauccaccaggcagcucagggcuccugcccagcccagcagcuucuguugucua

SEQ ID NO: 13746 - RNA, 63 nt, Human
uagcuggccuggcccuguugagucugcacagucccugcccagcugugucuucuguuggaagaa

SEQ ID NO: 13747 - RNA, 63 nt, Human
agcagccuuaggacccugggaccaagggcagacccugcccaaggaugcaggccuaagccgggc

SEQ ID NO: 13748 - RNA, 63 nt, Human
gagugggcaauucucaccuucaaagaguccccgccugcccaggccuuuggcacagaggcugag

SEQ ID NO: 13749 - RNA, 63 nt, Human
caccugccccucuguucucuccccucacauccuccugcccagcuccucacauacccacacauu

SEQ ID NO: 13750 - RNA, 63 nt, Human
cgcgcguuccuucgcacacugugauuuugcccuccugcccacgcagaccugcagcgggcaaag

SEQ ID NO: 13751 - RNA, 63 nt, Human
acagcacuggggagucuuuguggauucugaggcccugcccaaugagacucuaggguccagugg

SEQ ID NO: 13752 - RNA, 63 nt, Human
ucucagcuggucacccaugauaaccaacuuccaccugcccaaccauauaucacccccuacccc

SEQ ID NO: 13753 - RNA, 63 nt, Human
aauggggacaggcucuuucccccuuggggguccccugcccagggcacuguccccauuuuccca

SEQ ID NO: 13754 - RNA, 63 nt, Human
agucuuggcugcugcuuaccccuagccuugaugccugcccagggacccccagcccccucccgu

SEQ ID NO: 13755 - RNA, 63 nt, Human
cgggguuggcuucuucccaggccuugcaugggcccugcccacaagcacacccucaggccgagg

SEQ ID NO: 13756 - RNA, 63 nt, Human
uuccagugggguuugaagcagaguucagggaacccugcccaagguccuccuguucagacauuc

SEQ ID NO: 13757 - RNA, 63 nt, Human
caaccuuuuccaagauaugcaauggccuuugugccugcccaaaggcuucgcccccuccagugc

SEQ ID NO: 13758 - RNA, 63 nt, Human
cuggacaggcaaagacugcaguauccauaacccccugcccacguccccacccacgggggagac

SEQ ID NO: 13759 - RNA, 63 nt, Human
caggacugggccgggcccagggccucuggcuucccugcccaauccucccuggagaagggacau

SEQ ID NO: 13760 - RNA, 63 nt, Human
aggaccacuagcuaagcaagccaggagaagaccccugcccaaguggcucuugggacaacgugc

SEQ ID NO: 13761 - RNA, 63 nt, Human
cuccagguguggaccggccgcagcccccacugaccugcccauguccagagggacuggacagcc

SEQ ID NO: 13762 - RNA, 63 nt, Human
gccuuggcccuuccccucaccacgagcucccggccugcccagacuguggacacuggccgugcc

SEQ ID NO: 13763 - RNA, 63 nt, Human
gggaaccucucugugacacccuccguguucuugccugcccaucuucuccgcuuuugggaugaa

SEQ ID NO: 13764 - RNA, 63 nt, Human
cgcugucuccagacccccaccccuuccccacugccugcccacccguggagaugggaugcuugc

SEQ ID NO: 13765 - RNA, 63 nt, Human
ccacagaggccaggccagggcuggaaggacaggccugcccaugcaggagaccaucuggacacc

SEQ ID NO: 13766 - RNA, 63 nt, Human
ggaggaggagcgcuacccaccuccagggagcacccugcccaccaagaagcacugggugaccag

SEQ ID NO: 13767 - RNA, 63 nt, Human
auccugaucaggccccaucucaagguuggcacuccugcccaucacccuuagaaggaucuuuuc

SEQ ID NO: 13768 - RNA, 63 nt, Human
gcauguuuaucauguuacaauuuaauauuccauccugcccaacccuuccucucccauccucaa

SEQ ID NO: 13769 - RNA, 63 nt, Human
gggcccgagcucaucgaccugagggggcccaucccugcccaccuccuggguaaaggcccugcu

SEQ ID NO: 13770 - RNA, 63 nt, Human
agaaagagccuaggagacaaaagggccagucccccugcccagaauggagcagcagcaggacag

SEQ ID NO: 13771 - RNA, 63 nt, Human
uaaggugggaaaaaaaaaaguguggcauagcuaccugcccauccccaacccucagcaaaguag

SEQ ID NO: 13772 - RNA, 63 nt, Human
cgaacugggcagcacggggaggguuuggcuaccccugcccaucccugagccagguaccaccau

SEQ ID NO: 13773 - RNA, 63 nt, Human
ggcuugggauggacccucagccccaugguacgcccugcccaguuuccaguugcccuguccacu

SEQ ID NO: 13774 - RNA, 57 nt, Human
cagaagccccggagauguagacgccacccugcccacccccgggauccugcccccaag

SEQ ID NO: 13775 - RNA, 63 nt, Human
uggucagaguggcgugagcugcccggcgccugcccugcccaagugaccagggaagugugugug

SEQ ID NO: 13776 - RNA, 63 nt, Human
ugaguggccagcgccagggcccaggccauguggccugcccagccucaaugucacuugguggcg

SEQ ID NO: 13777 - RNA, 63 nt, Human
agcaggguugcggugucuccacggugcucucgcccugcccauggccaccccagacucugaucu

SEQ ID NO: 13778 - RNA, 63 nt, Human
ccagccaacaacucccuacguccuguguggggcccugcccaaguggaugaggcauuccuugag

SEQ ID NO: 13779 - RNA, 63 nt, Human
cauguuggcaacacacgcauccgcaucggccucccugcccacaaagcgccacaacggugacca

SEQ ID NO: 13780 - RNA, 63 nt, Human
ccuugucuuucugucuguuuaccugucucccugccugcccaucugcaucuuuugcagcccacu

SEQ ID NO: 13781 - RNA, 63 nt, Human
gacaccccgaagcccaccugcaaucucccaccuccugcccaucccucucuugagggagcagca

SEQ ID NO: 13782 - RNA, 63 nt, Human
uuguaauuccagcccccugucgccuguccagggccugcccacccguuggaggccgguggagaa

SEQ ID NO: 13783 - RNA, 63 nt, Human
gugccggcuacugggggcccagcugcaacgccuccugcccagccgguuuccauggaaacaacu

SEQ ID NO: 13784 - RNA, 63 nt, Human
gagcagccucguggagcucgccccuccccucagccugcccaccucucccugcauccugaggcc

SEQ ID NO: 13785 - RNA, 63 nt, Human
cagugcucugucagcagccuggccuggucugugccugcccagcauguucccaaaucugugcug

SEQ ID NO: 13786 - RNA, 63 nt, Human
uaaagugggggagauggcagacgcuuucugggaccugcccaagauauguauucucugacacuc

SEQ ID NO: 13787 - RNA, 63 nt, Human
agcagaggccugaagcggaagcaccacaucgucccugcccaucucacucucucccuugaugau

SEQ ID NO: 13788 - RNA, 63 nt, Human
gcugccacaggcauaugguggagagggggguacccugcccaccuuggggugguggcaccagag

SEQ ID NO: 13789 - RNA, 63 nt, Human
cccagcacaccucuggcuaacccauaccccacaccugcccagcucuggcuucucuguugagga

SEQ ID NO: 13790 - RNA, 63 nt, Human
gggcccccacuguaagcccccgcacccccacccccugcccagagcaacagccuaaaggccugc

SEQ ID NO: 13791 - RNA, 63 nt, Human
gagaaugugccaugaucagggauaugagcagggccugcccagagccugggcaccuuugggaga

SEQ ID NO: 13792 - RNA, 63 nt, Human
gggucacacguaggggcuagagccagccugcauccugcccaccgggcuccacuuggagaucag

SEQ ID NO: 13793 - RNA, 63 nt, Human
uauuacaguuaugugauaaaggaaaaauucuuuccugcccaggaccugcgccauccuuuaggc

SEQ ID NO: 13794 - RNA, 63 nt, Human
ugacuagaucaggcagggauccauucccuguccccugcccacuaccuucaggccauuuagagu

SEQ ID NO: 13795 - RNA, 63 nt, Human
uucaguucuugugucguuugugaaaguucuuaaccugcccaaaaacccccuuuuccccaagcu

SEQ ID NO: 13796 - RNA, 63 nt, Human
ggggaauuuauuugcugcuucucccagccuuccccugcccacaccaccugcgcaugccuggca

SEQ ID NO: 13797 - RNA, 63 nt, Human
gaaucaauaaguacugagagugcagccccuuccccugcccaggguggcaggggagggguaggg

SEQ ID NO: 13798 - RNA, 63 nt, Human
cuccaaggacccucugaccccaucgaccugggcccugcccacacaacagucugagcaagagac

SEQ ID NO: 13799 - RNA, 63 nt, Human
ccuuucgcgauacuagagccucuguaaacuucuccugcccagccccagcugagcauccccaga

SEQ ID NO: 13800 - RNA, 63 nt, Human
uguggacacagaucccacuggaagauccccucuccugcccaagcacuucacagcuggacccug

SEQ ID NO: 13801 - RNA, 63 nt, Human
gcuccuagaacugagcugccucuaccacagccuccugcccaccagcuggccucaccuccugaa

SEQ ID NO: 13802 - RNA, 63 nt, Human
uuuccguguccuucugauacaguugaucagaccccugcccaccgcccaggccaggccuguggu

SEQ ID NO: 13803 - RNA, 63 nt, Human
ggcugggaaggucucugaucacacagaagcagcccugcccagccuggucauuugcuguccgcu

SEQ ID NO: 13804 - RNA, 63 nt, Human
caagcagggaagugaaaggucccaggcacacacccugcccauugcagguggcucuuacagcuc

SEQ ID NO: 13805 - RNA, 63 nt, Human
uggguggggacguccugccaccuggggcagucaccugcccagaucccagaaggaccuccugag

SEQ ID NO: 13806 - RNA, 63 nt, Human
uaaaaauuggcucacuauugcuuuguaguaaccccugcccagguauuuuuucacuugugaaaa

SEQ ID NO: 13807 - RNA, 63 nt, Human
uuccccugccuggagccuccaaaagaaaccagcccugcccacgccuugacuugagcccauuga

SEQ ID NO: 13808 - RNA, 63 nt, Human
ugugccaagggaaugccucuugccacccaccauccugcccaggcccugagaggcuggaggagg

SEQ ID NO: 13809 - RNA, 63 nt, Human
gugcaccuaggccucauuccuuaccccccagccccugcccaccuucagcaggaugaggcccug

SEQ ID NO: 13810 - RNA, 63 nt, Human
cgcuaagugagaaagagagcaggcucgggaggcccugcccaggguaggaggagcuuccugcuu

SEQ ID NO: 13811 - RNA, 63 nt, Human
caccauaauccagugggggugacugggugcacaccugcccaggugaacacagcggcugccagu

SEQ ID NO: 13812 - RNA, 63 nt, Human
cugcauugguuauaauaacaguuaucaguaauuccugcccagaagacuuuuauuuauuuuuuu

SEQ ID NO: 13813 - RNA, 63 nt, Human
ucaacaucuggagauacaggcccaccccucaguccugcccacagagaggcuuggucggucucc

SEQ ID NO: 13814 - RNA, 63 nt, Human
acgaggcccugcugaaguccagacccucccccuccugcccacugugcucuaaacccugcucag

SEQ ID NO: 13815 - RNA, 63 nt, Human
uuguacccugauacggccuggccaucgaggacaccugcccauccggccucugugucaagaggu

SEQ ID NO: 13816 - RNA, 63 nt, Human
guguuugacaaacagcagcuggcagcgcugccuccugcccacauuccugccacccgacaucaa

SEQ ID NO: 13817 - RNA, 63 nt, Human
aguggacaaugaugccuccuccgggaagccuucccugcccagcccacgccgccaccgggagga

SEQ ID NO: 13818 - RNA, 63 nt, Human
uuuagagaaaguuuccuauucucuuccauuuccccugcccaaagugcugacauaggcagugau

SEQ ID NO: 13819 - RNA, 63 nt, Human
cugucuggccacagacaggggcugccuguggagccugcccaccggcccccggcagugcagucc

SEQ ID NO: 13820 - RNA, 63 nt, Human
acauacacaugcaucagugucugccugccuccaccugcccagccuguucuucuucuucuucuu

SEQ ID NO: 13821 - RNA, 63 nt, Human
cuguccuuccucacaccagauuguucccaggggccugcccaccccagugccauccaguggcac

SEQ ID NO: 13822 - RNA, 63 nt, Human
ugguaucaacuagccagugacucgcucaucugcccugcccaggcccacguuuugaaguuggag

SEQ ID NO: 13823 - RNA, 63 nt, Human
augaucaguggaucaggaaugcaauugugaauuccugcccauugccucucuuggugaaugugg

SEQ ID NO: 13824 - RNA, 63 nt, Human
cacagacacccaccagcccggccccucccggcgccugcccacccuccacccacagccucacgg

SEQ ID NO: 13825 - RNA, 63 nt, Human
gcccacagggcuguguggauggaggaagcugucccugcccagugcaucccccaggucaucacg

SEQ ID NO: 13826 - RNA, 63 nt, Human
cuagcuccacaaguguguggccccgcccgagccccugcccacgcccuuggagccuuccaccgg

SEQ ID NO: 13827 - RNA, 63 nt, Human
ccugggacccucacugccuccgucuguucaucaccugcccaccggagccgcaugcucuuccug

SEQ ID NO: 13828 - RNA, 50 nt, Human
cguucaucgaacugcacugaccugcccagaacgccugcacccucaccucu

SEQ ID NO: 13829 - RNA, 63 nt, Human
guguguggaggccauccuggaaggaaguuuagaccugcccagguguggagcgaggggcacagg

SEQ ID NO: 13830 - RNA, 63 nt, Human
cccucaggacuccaaggagacggugcagggcugccugcccaucuagguccccucuccugcauc

SEQ ID NO: 13831 - RNA, 63 nt, Human
gacguggcgugaacaucugccuggagucccgucccugcccagaacccuuccugagaccucgcc

SEQ ID NO: 13832 - RNA, 63 nt, Human
ggggcugcauucccuggagacucacugcaaguuccugcccaggaggcugagggcaccccaucc

SEQ ID NO: 13833 - RNA, 63 nt, Human
guagucguacacggagacuggcagcgccgacguccugcccaccacgcacucccggagagcacg

SEQ ID NO: 13834 - RNA, 63 nt, Human
cucuccauggcucuggucacccugacccucugcccugcccaccgcaggucccccggggucccg

SEQ ID NO: 13835 - RNA, 63 nt, Human
ggaaugggcucaagguuccugagacacccgauuccugcccaaacagcuguauuuauauaaguc

SEQ ID NO: 13836 - RNA, 63 nt, Human
aaauaaggugguucuuuccuugaagggcagccuccugcccaggccccguggcccuggagccuc

SEQ ID NO: 13837 - RNA, 63 nt, Human
gagaugccaccacuugugucuccacaaugugcuccugcccacccggguuccgcacuguccgac

SEQ ID NO: 13838 - RNA, 63 nt, Human
caccgcccuccuccacuuggaaacgguauccucccugcccauccgucugucugucgcccuucu

SEQ ID NO: 13839 - RNA, 63 nt, Human
agggaggcaaugaacccucucccccaccucuucccugcccaaaucugucuccuagaaucuuau

SEQ ID NO: 13840 - RNA, 52 nt, Human
gggcccacggcucccacuaaggccugcccaccaccgcccgccugggcagcca

SEQ ID NO: 13841 - RNA, 63 nt, Human
uggacauacgaggacccucagaccggaggaacaccugcccaaccccaacacgugcuuauguaa

SEQ ID NO: 13842 - RNA, 63 nt, Human
cccuccagcugcccacucaugggcccuucaccaccugcccaggaucucacccaguacugacag

SEQ ID NO: 13843 - RNA, 63 nt, Human
ccucagccuccugaguagcugggacuacaggccccugcccagcuaauuuuuuguauuuuuuuu

SEQ ID NO: 13844 - RNA, 63 nt, Human
caggagaggggccccucucuccucuauguacccccugcccaccucgggccuaccucagcccuc

SEQ ID NO: 13845 - RNA, 63 nt, Human
cugcccaggucgaucaaguggcuuuuccugggaccugcccagcuuugagaaucucuucucauc

SEQ ID NO: 13846 - RNA, 63 nt, Human
gcuuguccagaauggggacguggggcagccaccccugcccagcgagagcgcagacaccgugug

SEQ ID NO: 13847 - RNA, 63 nt, Human
ccggaagcagcacgugugagcugggccaggagcccugcccaccuccgugcagcugaccugccc

SEQ ID NO: 13848 - RNA, 63 nt, Human
cacaugcugauacacacuguuguuaggccugcaccugcccauccagaaagcagcagcugccuu

SEQ ID NO: 13849 - RNA, 63 nt, Human
cugcuccggcucacacacgcccugccugcccucccugcccagcuguaaggaccgggggucucc

SEQ ID NO: 13850 - RNA, 63 nt, Human
cagauaaacagacccccuucugcuccgcuuccuccugcccagccaggcaacacccucaaccgg

SEQ ID NO: 13851 - RNA, 63 nt, Human
ucguccucuccaucugcuguguuuggacgcguuccugcccagccccuugcugucauccccucc

SEQ ID NO: 13852 - RNA, 63 nt, Human
gcaugcggggagaggcugcucccuccccuuuuuccugcccagucgcggggcccaagucuuccu

SEQ ID NO: 13853 - RNA, 63 nt, Human
auaagccccaguccagguccaggaggcucccucccugcccagcgagucuuccagaagggguga

SEQ ID NO: 13854 - RNA, 63 nt, Human
cccauggccccaugcagccccaggggcuuccccccugcccauggaguagagcccgagauccug

SEQ ID NO: 13855 - RNA, 63 nt, Human
guuccccuucuagcggggccgguaccccgccucccugcccaucccaccacccggccuuucccu

SEQ ID NO: 13856 - RNA, 63 nt, Human
cagccccccaaggggccccauugccaaagcaugccugcccacccucgcugugccuuagucagu

SEQ ID NO: 13857 - RNA, 63 nt, Human
ucuacccacccccuucccccgcaugcugaucccccugcccaggugagggcccugcccuggaag

SEQ ID NO: 13858 - RNA, 63 nt, Human
ugcuuagcccacaauucuccauuucacuugaccccugcccaccucuccaaccuaacuggcuua

SEQ ID NO: 13859 - RNA, 63 nt, Human
uuccaaaugcugagcccugauccaaaguugucuccugcccaugagcaccacagucaggccuug

SEQ ID NO: 13860 - RNA, 63 nt, Human; identical to SEQ ID NO: 13858

SEQ ID NO: 13861 - RNA, 63 nt, Human
ugcuuaacccacaguucuccauuucacuugaccccugcccaccucuccaaccuaacuggcuua

SEQ ID NO: 13862 - RNA, 63 nt, Human
ugcuuagcccacaauucucuauuucacuugaccccugcccaccucuccaaccuaacuggcuua

SEQ ID NO: 13863 - RNA, 63 nt, Human
ugcuuagcccacaguucuccauuucacuugaccccugcccaccucuccaaccuaacuggcuua

SEQ ID NO: 13864 - RNA, 63 nt, Human; identical to SEQ ID NO: 13858

SEQ ID NO: 13865 - RNA, 63 nt, Human
ugcuuagcccacaaguaucuauuucacuugaccccugcccaccucuccaaccuaacuggcuua

SEQ ID NO: 13866 - RNA, 63 nt, Human
ggaagcauguguagcuauguuguacucucuaaaccugcccagggaccuuaccagauucguguc

SEQ ID NO: 13867 - RNA, 63 nt, Human
ccagguaugugggaacugcauaguauuuuucgaccugcccaggucucuugcuagacuucugug

SEQ ID NO: 13868 - RNA, 63 nt, Human
guuuccugucguaaucaguggugcugcuugacaccugcccagcauguuccugucucuccuuuu

SEQ ID NO: 13869 - RNA, 63 nt, Human
gggccagggcccacggacccgcagcucagggcgccugcccacgucgucugccggcggugcgcc

SEQ ID NO: 13870 - RNA, 63 nt, Human
acgguggucagcgugcagcgggacgggacuggcccugcccagccaugaaucgcuuggccaugc

SEQ ID NO: 13871 - RNA, 63 nt, Human
ggccacgcauccaucuccaaguuaacagcccguccugcccaaguucuggggcagguaggagag

SEQ ID NO: 13872 - RNA, 63 nt, Human
ggacacacccugauagcacaaucuccuuggggcccugcccaccuccaggccucucccaccuca

SEQ ID NO: 13873 - RNA, 63 nt, Human
gaaaccgaggccaccgccccccccuccgcugccccugcccaccccgaggcagggcuggggcuu

SEQ ID NO: 13874 - RNA, 63 nt, Human
cacaccaguccucccagggaguccucgagucgcccugcccagagcccuggcaccagagacgcc

SEQ ID NO: 13875 - RNA, 63 nt, Human
gacacaaacaaaccaaccagagggagaagagccccugcccacugcacucuuugguucucugcu

SEQ ID NO: 13876 - RNA, 63 nt, Human
acaguggccgggcucccugcgucccgcuggugaccugcccaccgucccuguccaugccccgcc

SEQ ID NO: 13877 - RNA, 51 nt, Human
uucuacaggaauaccucugagccugcccaccgggagccgccacaucacagc

SEQ ID NO: 13878 - RNA, 63 nt, Human
ccugccuuuguggggagcagccagcccucugccccugcccagggcuccccaacuauaggccug

SEQ ID NO: 13879 - RNA, 63 nt, Human
auagccuaaaaguccaguccuuuggccuccaguccugcccaggcccugggucaccaggucacu

SEQ ID NO: 13880 - RNA, 63 nt, Human
acucgcuuguugaagaugaauucuugaauucugccugcccacccccggccagaucccuggagc

SEQ ID NO: 13881 - RNA, 63 nt, Human
auuugcugcaggcauggcugucuccugccccugccugcccaucuggccuauaccccagccgug

SEQ ID NO: 13882 - RNA, 63 nt, Human
agaggggaagaaacacuuucucuucuuguuucuccugcccacugcugcaguaggggaggagca

SEQ ID NO: 13883 - RNA, 63 nt, Human
cucggccccuggugaaaugacgccccucccccaccugcccauggccugggacucucugcgaug

SEQ ID NO: 13884 - RNA, 63 nt, Human
gugugcuccgcgugcuauagcuuuuggggcggcccugcccaguccccgugcccacggggcucc

SEQ ID NO: 13885 - RNA, 63 nt, Human
ggggcugaggcacacagagaggccaacuuccucccugcccagccuuccuuguaucucuccaga

SEQ ID NO: 13886 - RNA, 63 nt, Human
ugcaagaccugcuggacuagugguccuugcuggccugcccaggaggcauggauacucaggaag

SEQ ID NO: 13887 - RNA, 63 nt, Human
ucuguagcccacggcaccccaaacuuggagggaccugcccacuccccucccccauucccaagg

SEQ ID NO: 13888 - RNA, 63 nt, Human
augucaccgggcaccacugauggugauuccaccccugcccaucacugggggcugcgcuagcug

SEQ ID NO: 13889 - RNA, 63 nt, Human
gaccugccggccucccgggccagcugccccaccccugcccaugccuguccugcacggcucugc

SEQ ID NO: 13890 - RNA, 63 nt, Human
caccuugcccacacaucuccagccagccagggcccugcccagcuucaauuuacagaccugacu

SEQ ID NO: 13891 - RNA, 53 nt, Human
ugauccccgcccagaaguaggcgccugcccaccugccaccgacugcuggaacc

SEQ ID NO: 13892 - RNA, 63 nt, Human
ccaccaucaucacaucccccagcaagccagccaccugcccagccgggccugggaugggccacc

SEQ ID NO: 13893 - RNA, 63 nt, Human
cccagcaaugaacuguucuagggaaaguggcuuccugcccaaacuggaugggacacgugggga

SEQ ID NO: 13894 - RNA, 63 nt, Human
uaggccaucugcauuuucuuacuguugauguuuccugcccaaaggacacauuugggcagugcc

SEQ ID NO: 13895 - RNA, 63 nt, Human
cgucucucaccuagaccuugccuccccuccucuccugcccagcucugacccugaugcuuaaua

SEQ ID NO: 13896 - RNA, 63 nt, Human
acaggugcacugaggagaugaaggccgggacccccugcccaaccuguauggcgggucuguacu

SEQ ID NO: 13897 - RNA, 63 nt, Human
ccagguaugugugaacugcauugcaccuuuugcccugcccagggcccaugucagauuuauguc

SEQ ID NO: 13898 - RNA, 63 nt, Human
ucaggaacaaacggucccagaguccuccggaccccugcccagggucucugcaggucucugccc

SEQ ID NO: 13899 - RNA, 63 nt, Human
uuugaguuucuguagggcugaaugacucuuuuuccugcccagggcccauucuugcuucucagg

SEQ ID NO: 13900 - RNA, 63 nt, Human
cagccuucugugaccccgcugugguaaguccagccugcccagggcugcugagggcugccucuu

SEQ ID NO: 13901 - RNA, 63 nt, Human
uucuggcucaggcuguaaaaguagcugagccauccugcccauuccuggagguccuacagguga

SEQ ID NO: 13902 - RNA, 63 nt, Human
caguauagacguauccaaugggaaaacagcggaccugcccagagcagggaggugucguggaac

SEQ ID NO: 13903 - RNA, 63 nt, Human
gugcaucgucucaacaccaccaaguuuguaggaccugcccaaguucuaguaguauucaaaacu

SEQ ID NO: 13904 - RNA, 63 nt, Human
gcccuugccugguuccauauggcuccuuccagcccugcccaccaagugcagcucccacuuucc

SEQ ID NO: 13905 - RNA, 63 nt, Human
cccugcccaccaagugcagcucccacuuuccauccugcccauacgccccucuucccccgacau

SEQ ID NO: 13906 - RNA, 63 nt, Human
acugagagggguggauuuggccccuguccuccuccugcccauucuuugucucuuccacauggg

SEQ ID NO: 13907 - RNA, 63 nt, Human
auaaugacugucauacauccagaggagaccgaaccugcccagcugauguacuguuuuauggaa

SEQ ID NO: 13908 - RNA, 63 nt, Human
gggaagggccaagccccauguagccccagucauccugcccagcccugccuccuggccaugccg

SEQ ID NO: 13909 - RNA, 63 nt, Human
cgccagagcuucagugagguuuccgagccucucccugcccauccucaccacugaggccacgac

SEQ ID NO: 13910 - RNA, 63 nt, Human
gguaccgcucuccaaggugugcuagcagugggcccugcccaacuucaggcagaacagggaggc

SEQ ID NO: 13911 - RNA, 63 nt, Human
uggaccugcugcagccugcagagccacagucagccugcccacaugccaccgagcaaacgcauc

SEQ ID NO: 13912 - RNA, 63 nt, Human
cagucccagagaggcucggccuggaaacaguccccugcccagaguccccucagccuccaugac

SEQ ID NO: 13913 - RNA, 63 nt, Human
gcacgggccagauggccagcugucgagagcagcccugcccagauugcggugggggcugugcca

SEQ ID NO: 13914 - RNA, 63 nt, Human
cucggccugggagucgggcggccccggucaggcccugcccagagagcuccugguuccugaacu

SEQ ID NO: 13915 - RNA, 63 nt, Human
cucacccacccgaggcucugcccaccgccuggaccugcccaccccugaaagacuggccccugg

SEQ ID NO: 13916 - RNA, 63 nt, Human
ccccuccccgcacacacccguccauaccagcucccugcccaugacccucgcucagggaucccc

SEQ ID NO: 13917 - RNA, 63 nt, Human
uucaccuuucuuuaaauuagaauuacagaagccccugcccagugaacagauaacgauuggucu

SEQ ID NO: 13918 - RNA, 63 nt, Human
cagugugacaggacugugauugugcuagauguaccugcccaagucugcuggucacauuuggca

SEQ ID NO: 13919 - RNA, 63 nt, Human
agccucagaaaccagacucguucuucugggaacccugcccacucccaggaccaagauuggccu

SEQ ID NO: 13920 - RNA, 63 nt, Human
uaguuucagauucuugguccauggaugacaccaccugcccaugcuuccuugaauuaggcuuuc

SEQ ID NO: 13921 - RNA, 63 nt, Human
aguaaacagaauggauugccaguuacauguaugccugcccaguucccuuuuuauuugcagaag

SEQ ID NO: 13922 - RNA, 63 nt, Human
uuccauugaaucucgcacccagucuugcguaugccugcccaguuuucagccucuuaacgggag

SEQ ID NO: 13923 - RNA, 63 nt, Human
guccaaacagcucaugggcuuaguguccaaaccccugcccagccuucccuuuccaaguuggug

SEQ ID NO: 13924 - RNA, 63 nt, Human
gggcggaugagcagagccggcccugaggacaguccugcccauccacgcggagauguggcugcc

SEQ ID NO: 13925 - RNA, 61 nt, Human
cgguaccgcggcccgcaugacuaggcguggaccugcccauggugccugucagcccgcagag

SEQ ID NO: 13926 - RNA, 63 nt, Human
cccgauccuggagagcugugaggauccauucagccugcccagcucuggcuggucagagacaag

SEQ ID NO: 13927 - RNA, 63 nt, Human
cgcagcgcccucgcccagccccggcugcguuucccugcccaugacccucucguggggaccccc

SEQ ID NO: 13928 - RNA, 63 nt, Human
cagcuccaaacgccuccucucccaggucaucugccugcccacacgcuccuguuccaccuucac

SEQ ID NO: 13929 - RNA, 63 nt, Human
uggcuccaaacaucuccccucccaagacaucugccugcccacaggcuccuguugcuccuucac

SEQ ID NO: 13930 - RNA, 63 nt, Human
gagagguuccuggcgcccugagguggcucagcaccugcccaggguaggccuggcaugaggggu

SEQ ID NO: 13931 - RNA, 63 nt, Human
gagcagauggccugccuuuggcugagagggcuaccugcccagccccucccccaacaagaucuc

SEQ ID NO: 13932 - RNA, 59 nt, Human
acgcugagcacaggccuugacuggcagacccugcccacgccccauucgccagcccucca

SEQ ID NO: 13933 - RNA, 63 nt, Human
agccgacacggucucggaucaggcucccaggagccugcccagcccccuggucuuugagcuccc

SEQ ID NO: 13934 - RNA, 63 nt, Human
gaauguggccccugaacaagaauuggaagcugcccugcccaugggagcugguuagaaaugcag

SEQ ID NO: 13935 - RNA, 63 nt, Human
accaggagaaccacuacaugcagcccaugcccaccugcccaucacaggguugggcccagaucu

SEQ ID NO: 13936 - RNA, 63 nt, Human
cucucuaguagccuggauuuaucauucucucugccugcccacccccuuuuuuguauagcccaa

SEQ ID NO: 13937 - RNA, 63 nt, Human
uggggugagagaggaaagaccuacauucccucuccugcccagaugcccuuuggaaagccauug

SEQ ID NO: 13938 - RNA, 63 nt, Human
cugcccugguauguuuuucuuauagauguuagcccugcccaacagccagggcuacacuacaaa

SEQ ID NO: 13939 - RNA, 63 nt, Human
cgcagacagcccagagccugccgcuacccucggccugcccaccaccaagcaagcagcaagcaa

SEQ ID NO: 13940 - RNA, 63 nt, Human
acagauccucaucagcaaagcauuuggcuuuguccugcccaagugggcugcagacugagugcu

SEQ ID NO: 13941 - RNA, 63 nt, Human
ggcccaaggcuuccgcagccgcccguuccgggaccugcccagcguccucccugccuccuuccg

SEQ ID NO: 13942 - RNA, 63 nt, Human
gggcuguggguggaggccugacuccaggccucuccugcccacacccucugggcugaguuccuu

SEQ ID NO: 13943 - RNA, 63 nt, Human
guucuuccucagucuggcugugggcaggagcggccugcccagugucacccagggugagugcaa

SEQ ID NO: 13944 - RNA, 63 nt, Human
uggguuuuguaccagucccugcucucaggccacccugcccaggacccaggcccgccucccccu

SEQ ID NO: 13945 - RNA, 63 nt, Human
gccgggccaagcgcuggccccucagcggugagcccugcccacucuuaccgagcaaggugggug

SEQ ID NO: 13946 - RNA, 63 nt, Human
uagcuuguacacauauacauaugaucaaauacuccugcccaugauccauucccuuuuguuauu

SEQ ID NO: 13947 - RNA, 63 nt, Human
uuggaauguucugaauugaccaaauuuaaugaaccugcccaaaguuagcuaccguuccauggu

SEQ ID NO: 13948 - RNA, 63 nt, Human
cugacacaccugcagccucccuccgcggcgggcccugcccacaccuccuggggcgcgugaggc

SEQ ID NO: 13949 - RNA, 63 nt, Human
ugugcaaguuguggagagaaggagcaccggguuccugcccagcacugugcuugcgggaggcgg

SEQ ID NO: 13950 - RNA, 63 nt, Human
caggaggacagagugcccuggggcauccaccuuccugcccaggggacguggcgcugucggugu

SEQ ID NO: 13951 - RNA, 63 nt, Human
gaugccccuggcccugccucacugugaccugcuccugcccacgugcagcaccugucaccuuuu

SEQ ID NO: 13952 - RNA, 63 nt, Human
gauuagcgaagcuguggagacugcacauccggaccugcccaugucucaaaacaaacacaugua

SEQ ID NO: 13953 - RNA, 63 nt, Human
uuucuccucaguguaauccaccuauggguucuuccugcccacugcacagacaaaaccaauuca

SEQ ID NO: 13954 - RNA, 63 nt, Human
agaucucucgaauuauauuuauagaugcaguguccugcccaguuuuguuugccuccuacauuu

SEQ ID NO: 13955 - RNA, 63 nt, Human
ucucugccauucugugcaggcugcaguggcuccccugcccagccugcucucccuaaccccuug

SEQ ID NO: 13956 - RNA, 63 nt, Human
cuucucugggagcucuccaguggcacugcuggaccugcccacguuucuguaaaaucaggauac

SEQ ID NO: 13957 - RNA, 63 nt, Human
uucagaauaaagggcgcccgcggucccccagcaccugcccaagccacaccccuagcuucccuc

SEQ ID NO: 13958 - RNA, 63 nt, Human
guacgccugggccucuguuccuccaaagaccugccugcccaucugcauaggagaugaaggcug

SEQ ID NO: 13959 - RNA, 63 nt, Human
cuccugggagacuuuuccucccugccucagcucccugcccagccagccuccugucuccagaga

SEQ ID NO: 13960 - RNA, 63 nt, Human
ucugcgucuggacacccucagauccugucauugccugcccagaguccuucaggggcaccccuc

SEQ ID NO: 13961 - RNA, 63 nt, Human
caccugcaggcccagaccacgugggacagaacuccugcccacccuaccccgagggaggcgaac

SEQ ID NO: 13962 - RNA, 62 nt, Human
agcugggcgccgacaucugaggcccuguggcgccugcccauugugaagaaucgccgugccug

SEQ ID NO: 13963 - RNA, 63 nt, Human
ucaggcugcucucggacuccugaucucaggugaccugcccaccucggccucccgaagugcugg

SEQ ID NO: 13964 - RNA, 63 nt, Human
uuugcugggcauaagcuucacaggacgggagaaccugcccaugguggacugucguucuccaca

SEQ ID NO: 13965 - RNA, 63 nt, Human
cacauggaugccacuccccacacagcccccaggccugcccagcccaccuccucauggcauccu

SEQ ID NO: 13966 - RNA, 63 nt, Human
ucuucuccgagccccaggcagcggugauucagcccugcccaaccugauucugaugacugcgga

SEQ ID NO: 13967 - RNA, 63 nt, Human
gaggggcgccugcugagcacuuccgccccucacccugcccagccccugccaugagcucugggc

SEQ ID NO: 13968 - RNA, 63 nt, Human
ugcuccucuguccucgcacagcgaaccugggcuccugcccaggacaggcaccagggucauggc

SEQ ID NO: 13969 - RNA, 63 nt, Human
aucuguccccucucuccacacccagccccugcuccugcccaggcugcccugcccagcgccuca

SEQ ID NO: 13970 - RNA, 63 nt, Human
uccacacccagccccugcuccugcccaggcugcccugcccagcgccucaucagccucugccuu

SEQ ID NO: 13971 - RNA, 63 nt, Human
gaucuuccccaucaggcugggcucuggcagggaccugcccaggauggagaugagagaggguga

SEQ ID NO: 13972 - RNA, 63 nt, Human
gccugugcccaggaagagccauucacuccugccccugcccacacggcagguagcagggggagu

SEQ ID NO: 13973 - RNA, 63 nt, Human
cgcuccuccugccccagcccucugguguccacaccugcccacagagaauguaaacccaguggg

SEQ ID NO: 13974 - RNA, 63 nt, Human
acagcuauggcugagguggggccgggccacaccccugcccaucccagccagggugcugugccc

SEQ ID NO: 13975 - RNA, 50 nt, Human
aggacaucuaccuggaguagccugcccaccgcucugucuccuggccgucu

SEQ ID NO: 13976 - RNA, 63 nt, Human
accccacgcacgccccgugcuguguuccugggcccugcccauggccucaauaaacucucugcu

SEQ ID NO: 13977 - RNA, 63 nt, Human
agcugcuggaggugaggucaggugccucccagcccugcccagaguaugggcacucaggugugg

SEQ ID NO: 13978 - RNA, 63 nt, Human
agugcgagcuggcugacaauaagaacguggccaccugcccagcuucacaccucccccgacuuc

SEQ ID NO: 13979 - RNA, 63 nt, Human
cugaggugcuacccggagccccauucacccccaccugcccacuugggaaucugaggcagagga

SEQ ID NO: 13980 - RNA, 63 nt, Human
cucauccuggccccaccagggccuugggcaaguccugcccaccauaggccucugcuaccugcc

SEQ ID NO: 13981 - RNA, 63 nt, Human
gggucuugucuaucuugauggagaagagggguuccugcccaggaucuuacaacacagcaagua

SEQ ID NO: 13982 - RNA, 63 nt, Human
uaacuacacgguucaugaacugacauuccacauccugcccacccucugagggccaagcugccu

SEQ ID NO: 13983 - RNA, 63 nt, Human
agggggacugaaggcaggagagagagcagcuccccugcccaccugccccucaacccuguagcu

SEQ ID NO: 13984 - RNA, 63 nt, Human
aaagagaaaaaucccagccaggggaacucgccaccugcccacgcuaguuccauccacgcucaa

SEQ ID NO: 13985 - RNA, 63 nt, Human
aggggcagguaucuccuucccguuccucauccaccugcccagugcucaucguuacagcaaacc

SEQ ID NO: 13986 - RNA, 63 nt, Human
gaggcgggguccgaggucguaccccacagugcaccugcccaggggcuguucagagcuggcaau

SEQ ID NO: 13987 - RNA, 63 nt, Human
cacugcacuggaguugucucuuaccccacccucccugcccaucaacuguaucugauuucacua

SEQ ID NO: 13988 - RNA, 63 nt, Human
guggggaggagcgucucaagugaacagugggagccugcccaccuggcacugcacuggaguugu

SEQ ID NO: 13989 - RNA, 63 nt, Human
ggggacuugaggggggucauauucccuccucagccugcccacgcacuggccuucccuccugcc

SEQ ID NO: 13990 - RNA, 63 nt, Human
cacccuggaauggggcaggggaagggcacacccccugcccaugcaugguagcccacugggugg

SEQ ID NO: 13991 - RNA, 63 nt, Human
cccugcccugccccgccccgccccgcccgcgugccugcccaugccagcacuuccuuaaguucu

SEQ ID NO: 13992 - RNA, 63 nt, Human
uugauggguguaccuggagagggggucuggcuuccugcccaagaugccucccagcccugccag

SEQ ID NO: 13993 - RNA, 63 nt, Human
guggaucaccuaaggucaggaguuugagaucagccugcccaacauggugaaaccucgucucua

SEQ ID NO: 13994 - RNA, 63 nt, Human
ccaggcaccugucugccaggaggccacguguguccugcccacccagggggagcuguauuuugg

SEQ ID NO: 13995 - RNA, 63 nt, Human
cuggaccugaccagacugugggucccugcgucuccugcccacucugaccgggcuuccucccuc

SEQ ID NO: 13996 - RNA, 63 nt, Human
auggagcugauccaguaaccucggagacgggacccugcccagagcugaguuggggguguggcu

SEQ ID NO: 13997 - RNA, 63 nt, Human
caaccugcucuuccgcugcucgcucccggaccaccugcccagcguuggcgaggagccccggga

SEQ ID NO: 13998 - RNA, 63 nt, Human
uccuugugcuauaaaauaaaugcagacuaauuuccugcccaaaguggucuucuccagcuagcc

SEQ ID NO: 13999 - RNA, 63 nt, Human
uuacucucugccuaccugccugagccauguucaccugcccacuuguccccugcugccugccca

SEQ ID NO: 14000 - RNA, 63 nt, Human
agccauguucaccugcccacuuguccccugcugccugcccaaacaccccaccauuggccuguc

SEQ ID NO: 14001 - RNA, 63 nt, Human
aagagaacugcgacgauuaauuguggaucucccccugcccauugccugcuugaggggcaccac

SEQ ID NO: 14002 - RNA, 63 nt, Human
cauuccuuuuguugccaagauccuuaauucccuccugcccauaucccuacaggcgacggcaga

SEQ ID NO: 14003 - RNA, 63 nt, Human
gggguagaaguucuuccuuuccuaacccgggccccugcccagcucuccaaagucuuucagaaa

SEQ ID NO: 14004 - RNA, 63 nt, Human
augagggugaggaguagggagugcagcccugagccugcccacuccucauuacgaaaugacugu

SEQ ID NO: 14005 - RNA, 63 nt, Human
acugcuuucugucuguccggccugcacccagccccugcccacaaaaccccagggacagcaguc

SEQ ID NO: 14006 - RNA, 63 nt, Human
ucaagagcaugaagcacucuuggaguuguggguccugcccagaguccagagagcagccucagc

SEQ ID NO: 14007 - RNA, 63 nt, Human
ccggccccugccccacccccacccacgggugucccugcccacucguguggcaagggaggggag

SEQ ID NO: 14008 - RNA, 63 nt, Human
gcugcacuccuccugccccugccacgcccacccccugcccaccucuccaggcucugcucugca

SEQ ID NO: 14009 - RNA, 63 nt, Human
auggaggggucagggccgcucccuagggucccuccugcccaacauguggagguggcugguucc

SEQ ID NO: 14010 - RNA, 63 nt, Human
cccgccuuuucccccacccucccaugagacugcccugcccagguauccugggggaagaggaga

SEQ ID NO: 14011 - RNA, 63 nt, Human
uuucccagcacuuaaaacaggagccuagagcccccugcccaaacaaaacaggacaucugugac

SEQ ID NO: 14012 - RNA, 56 nt, Human
aaggcuuugggcuggccuaauaaggcccugcccaacuccgugggguuuuuuuuacc

SEQ ID NO: 14013 - RNA, 63 nt, Human
cacuuucugcaacucuagcccuauauccagaagccugcccaccuccacccauucuguuugccc

SEQ ID NO: 14014 - RNA, 63 nt, Human
aguccccaccagcuaucagauaaggcaaacuacccugcccaucuuuguugccauucagugcua

SEQ ID NO: 14015 - RNA, 63 nt, Human
gagaaagcaccugugauauauggcaagugucccccugcccaaacuuuaacaucagacccucuc

SEQ ID NO: 14016 - RNA, 63 nt, Human
gccuggcuggggccucugcaccccacccucccaccugcccaccuggcccugccuuuguuuucc

SEQ ID NO: 14017 - RNA, 63 nt, Human
auccaucugcaugauuggcauuaguuaccacagccugcccagagagaaacuaucuucucccaa

SEQ ID NO: 14018 - RNA, 63 nt, Human
gcggaucaccugaggucaggaguucaagaccagccugcccaacauggugaaaccccaucugga

SEQ ID NO: 14019 - RNA, 63 nt, Human
aagggugcagcuugauucgggaguuccccaccuccugcccauucuccgcguccuuuuacccca

SEQ ID NO: 14020 - RNA, 63 nt, Human
cauaugucacugggaccaucacccagaugauguccugcccacuaaaagaauugugacauaacg

SEQ ID NO: 14021 - RNA, 63 nt, Human
aggacucaggccacccucgcuuguccuggcgcccggcggcagcugcccagaaacuuccuggga

SEQ ID NO: 14022 - RNA, 63 nt, Human
uggagacggacguguagcccuggcgaggccagccggcggcagcacagccugucuccaaucagc

SEQ ID NO: 14023 - RNA, 63 nt, Human
ccagaaaaugcagcugugauuuguugcugggagcggcggcagcgagucccugcaacagcaaua

SEQ ID NO: 14024 - RNA, 63 nt, Human
aucucauuuagacuuuaauuuuuuugagauuaucggcggcacaaucacuuuguagaaacugua

SEQ ID NO: 14025 - RNA, 63 nt, Human
gaaggaguggcugcucuccaaacuaugccaaggcggcggcagagcuggucuucuggucuccuu

SEQ ID NO: 14026 - RNA, 63 nt, Human
aggcguccuggagucacuccccgagcagcgcggcggcggcagggaguuggguuggggugggca

SEQ ID NO: 14027 - RNA, 63 nt, Human
uuuguuccuuucuggaauugggcuccgugguggcggcggcacuucaagcaaagacaguuucuu

SEQ ID NO: 14028 - RNA, 63 nt, Human
auugcugggcaggcuaaguguggagcuggacuacggcggcaguauggaauuccagugccaggc

SEQ ID NO: 14029 - RNA, 63 nt, Human
cgugaacugcaggccacguacccaugacguaaacggcggcacuggagcaagcuggggcggggg

SEQ ID NO: 14030 - RNA, 63 nt, Human
gcccagcuacgcagaaagcagccggagccucggcggcggcagaaaggggacaaccagggccuc

SEQ ID NO: 14031 - RNA, 63 nt, Human
gcccugguuucgagucucugucacagccucuuccggcggcagcgugcaccgggcgggccuccg

SEQ ID NO: 14032 - RNA, 63 nt, Human
gcuucggcugggccacgggcucgcgggcacucucggcggcagccucgggggcuccgacuccag

SEQ ID NO: 14033 - RNA, 50 nt, Human
ucuacaaggacauguacuaacggcggcacccaggccucccugcagacucc

SEQ ID NO: 14034 - RNA, 63 nt, Human
accucgccgcaaagcgaaagaaacuggagcagccggcggcaggagagggcaaaaagccaagag

SEQ ID NO: 14035 - RNA, 63 nt, Human
uuagacgcguugugggucggggagaggggcggacggcggcacccccucccucggguugcuucu

SEQ ID NO: 14036 - RNA, 52 nt, Human
agcuccaagacucaaaguagcccggcggcaagaggcccauguuccggagaga

SEQ ID NO: 14037 - RNA, 63 nt, Human
uggaugauauuuauuaaauagcuucuaagaguccggcggcaucugucuugucccuauuccugc

SEQ ID NO: 14038 - RNA, 63 nt, Human
ugugaacgugagcaaccuaggaggcuucggcagcggcggcagcgcacagccguugcaccaggg

SEQ ID NO: 14039 - RNA, 63 nt, Human
uagcggggaugauguuaaguguggccaagcgcacggcggcaaguuuucaagcacugaguuucu

SEQ ID NO: 14040 - RNA, 63 nt, Human
uccuggucugugcugcccugcucuggggaugcacggcggcagggugggggagggagguuccuc

SEQ ID NO: 14041 - RNA, 63 nt, Human
aacagagccccucuaggagaagccacgggaucccggcggcaaggagaacagaacacugaagac

SEQ ID NO: 14042 - RNA, 63 nt, Human
uaaggcacugagugggcgggggaggcugggagccggcggcaggauuagcuggugcugaacuuu

SEQ ID NO: 14043 - RNA, 63 nt, Human
uccaaggaggguguaauggagcaucaagccacucggcggcagcauggagcuauaacuaagcau

SEQ ID NO: 14044 - RNA, 63 nt, Human
cggugugaccgccgggggcggcccggggccgcucggcggcaccuccacacccgccccaacgcg

SEQ ID NO: 14045 - RNA, 63 nt, Human
cccuuccugcugcgcaguucucccauccugggacggcggcaguauugaagcucgugacaagug

SEQ ID NO: 14046 - RNA, 63 nt, Human
acaggacacucgcugggggcccugugcccuugccggcggcagguugcagccaccgcggcccaa

SEQ ID NO: 14047 - RNA, 63 nt, Human
agcccacaccugugggaccgcgggucuuagucacggcggcaggggcuuucuggcccccuccca

SEQ ID NO: 14048 - RNA, 63 nt, Human
cccccaggcuuguucuuguuuuacuguauugagcggcggcacccgccggacccgcauuauggc

SEQ ID NO: 14049 - RNA, 63 nt, Human
gagcacaaugagaaacggcagcgccgacaggagcggcggcagaugaagcgguuauagccauug

SEQ ID NO: 14050 - RNA, 63 nt, Human
cuggcgguuccgugagcucaggcaggccugacccggcggcacagccuggcagggaccucgucc

SEQ ID NO: 14051 - RNA, 63 nt, Human
ggccuacucccuggucucaccuccgaccacagucggcggcaccuucucagagugccccgcacu

SEQ ID NO: 14052 - RNA, 63 nt, Human
caggcuagguggccauggugaaggugucaguggcggcggcagcgauggcaagcaggcggcguu

SEQ ID NO: 14053 - RNA, 63 nt, Human
cuccacuggcaacagugggacaauugcccccgacggcggcaccggggcucuguggaaucccga

SEQ ID NO: 14054 - RNA, 63 nt, Human
caaggcaguuuuuaaagaagucuuggaaacagacggcggcaccuuuccucuaauccagcaaag

SEQ ID NO: 14055 - RNA, 63 nt, Human
cgcgccaaccucccucccccccagugccuaugacggcggcacagcagccagcgggugggggac

SEQ ID NO: 14056 - RNA, 63 nt, Human
gggagaaccccggaccccuggcaugcaugcuggcggcggcaugccucccuuccacaagcccau

SEQ ID NO: 14057 - RNA, 63 nt, Human
ucccuccgugccagggucggggggcccccccgccggcggcagcggcuuuggacgagggcagaa

SEQ ID NO: 14058 - RNA, 63 nt, Human
gaggcaaggacggacgggagcuccacugugaaucggcggcacgcgccgcaggaggcugggacu

SEQ ID NO: 14059 - RNA, 63 nt, Human
uggcuggacauggccaagacacaaggcauuccacggcggcaagcugaccgcacagcagucugg

SEQ ID NO: 14060 - RNA, 63 nt, Human
cacuagguguccccaacguccccuccgccgugccggcggcagccccacuucacccccaacuuc

SEQ ID NO: 14061 - RNA, 63 nt, Human
gggcccgccuggagcugcguuucgcggcggcggcggcggcagccccggagggcggcugggagc

SEQ ID NO: 14062 - RNA, 63 nt, Human
ggcugaggcacagacucauuugucaccuucuggcggcggcagcccuggccccggccuccaagc

SEQ ID NO: 14063 - RNA, 63 nt, Human
aagugcugggauuacaggcgugagccacuggcccggcggcacaaccaaaucuuauuaaacuca

SEQ ID NO: 14064 - RNA, 63 nt, Human
cccccaucuccaccccaucauguuuacaggguucggcggcagcguuuguuccagaacgccgcc

SEQ ID NO: 14065 - RNA, 63 nt, Human
aggcccggaggcggccgcgggcacccuggaacccggcggcauuuugcacauccacuccucacc

SEQ ID NO: 14066 - RNA, 64 nt, Human; identical to SEQ ID NO: 11476

SEQ ID NO: 14067 - RNA, 64 nt, Human; identical to SEQ ID NO: 11477

SEQ ID NO: 14068 - RNA, 64 nt, Human; identical to SEQ ID NO: 11478

SEQ ID NO: 14069 - RNA, 64 nt, Human; identical to SEQ ID NO: 11479

SEQ ID NO: 14070 - RNA, 64 nt, Human; identical to SEQ ID NO: 11480

SEQ ID NO: 14071 - RNA, 64 nt, Human; identical to SEQ ID NO: 11481

SEQ ID NO: 14072 - RNA, 64 nt, Human; identical to SEQ ID NO: 11482

SEQ ID NO: 14073 - RNA, 64 nt, Human; identical to SEQ ID NO: 11483

SEQ ID NO: 14074 - RNA, 64 nt, Human; identical to SEQ ID NO: 11484

SEQ ID NO: 14075 - RNA, 64 nt, Human; identical to SEQ ID NO: 11485

SEQ ID NO: 14076 - RNA, 64 nt, Human; identical to SEQ ID NO: 11486

SEQ ID NO: 14077 - RNA, 64 nt, Human; identical to SEQ ID NO: 11487

SEQ ID NO: 14078 - RNA, 64 nt, Human; identical to SEQ ID NO: 11488

SEQ ID NO: 14079 - RNA, 64 nt, Human; identical to SEQ ID NO: 11489

SEQ ID NO: 14080 - RNA, 64 nt, Human; identical to SEQ ID NO: 11490

SEQ ID NO: 14081 - RNA, 64 nt, Human; identical to SEQ ID NO: 11491

SEQ ID NO: 14082 - RNA, 64 nt, Human; identical to SEQ ID NO: 11492

SEQ ID NO: 14083 - RNA, 64 nt, Human; identical to SEQ ID NO: 11493

SEQ ID NO: 14084 - RNA, 64 nt, Human; identical to SEQ ID NO: 11494

SEQ ID NO: 14085 - RNA, 64 nt, Human; identical to SEQ ID NO: 11495

SEQ ID NO: 14086 - RNA, 64 nt, Human; identical to SEQ ID NO: 11496

SEQ ID NO: 14087 - RNA, 64 nt, Human; identical to SEQ ID NO: 11497

SEQ ID NO: 14088 - RNA, 64 nt, Human; identical to SEQ ID NO: 11498

SEQ ID NO: 14089 - RNA, 64 nt, Human; identical to SEQ ID NO: 11499

SEQ ID NO: 14090 - RNA, 64 nt, Human; identical to SEQ ID NO: 11500

SEQ ID NO: 14091 - RNA, 64 nt, Human; identical to SEQ ID NO: 11502

SEQ ID NO: 14092 - RNA, 64 nt, Human; identical to SEQ ID NO: 11503

SEQ ID NO: 14093 - RNA, 64 nt, Human; identical to SEQ ID NO: 11504

SEQ ID NO: 14094 - RNA, 64 nt, Human; identical to SEQ ID NO: 11505

SEQ ID NO: 14095 - RNA, 64 nt, Human; identical to SEQ ID NO: 11506

SEQ ID NO: 14096 - RNA, 64 nt, Human; identical to SEQ ID NO: 11507

SEQ ID NO: 14097 - RNA, 64 nt, Human; identical to SEQ ID NO: 11508

SEQ ID NO: 14098 - RNA, 64 nt, Human; identical to SEQ ID NO: 11509

SEQ ID NO: 14099 - RNA, 64 nt, Human; identical to SEQ ID NO: 11510

SEQ ID NO: 14100 - RNA, 64 nt, Human; identical to SEQ ID NO: 11511

SEQ ID NO: 14101 - RNA, 64 nt, Human; identical to SEQ ID NO: 11512

SEQ ID NO: 14102 - RNA, 64 nt, Human; identical to SEQ ID NO: 11513

SEQ ID NO: 14103 - RNA, 64 nt, Human; identical to SEQ ID NO: 11514

SEQ ID NO: 14104 - RNA, 64 nt, Human; identical to SEQ ID NO: 11515

SEQ ID NO: 14105 - RNA, 64 nt, Human; identical to SEQ ID NO: 11516

SEQ ID NO: 14106 - RNA, 64 nt, Human; identical to SEQ ID NO: 11517

SEQ ID NO: 14107 - RNA, 64 nt, Human; identical to SEQ ID NO: 11518

SEQ ID NO: 14108 - RNA, 64 nt, Human; identical to SEQ ID NO: 11519

SEQ ID NO: 14109 - RNA, 64 nt, Human; identical to SEQ ID NO: 11521

SEQ ID NO: 14110 - RNA, 64 nt, Human; identical to SEQ ID NO: 11522

SEQ ID NO: 14111 - RNA, 64 nt, Human; identical to SEQ ID NO: 11523

SEQ ID NO: 14112 - RNA, 64 nt, Human; identical to SEQ ID NO: 11524

SEQ ID NO: 14113 - RNA, 64 nt, Human; identical to SEQ ID NO: 11525

SEQ ID NO: 14114 - RNA, 64 nt, Human; identical to SEQ ID NO: 11526

SEQ ID NO: 14115 - RNA, 64 nt, Human; identical to SEQ ID NO: 11527

SEQ ID NO: 14116 - RNA, 64 nt, Human; identical to SEQ ID NO: 11528

SEQ ID NO: 14117 - RNA, 53 nt, Human; identical to SEQ ID NO: 11529

SEQ ID NO: 14118 - RNA, 64 nt, Human; identical to SEQ ID NO: 11530

SEQ ID NO: 14119 - RNA, 64 nt, Human; identical to SEQ ID NO: 11531

SEQ ID NO: 14120 - RNA, 64 nt, Human; identical to SEQ ID NO: 11532

SEQ ID NO: 14121 - RNA, 64 nt, Human; identical to SEQ ID NO: 11533

SEQ ID NO: 14122 - RNA, 64 nt, Human; identical to SEQ ID NO: 11534

SEQ ID NO: 14123 - RNA, 64 nt, Human; identical to SEQ ID NO: 11535

SEQ ID NO: 14124 - RNA, 64 nt, Human; identical to SEQ ID NO: 11536

SEQ ID NO: 14125 - RNA, 64 nt, Human; identical to SEQ ID NO: 11537

SEQ ID NO: 14126 - RNA, 64 nt, Human; identical to SEQ ID NO: 11538

SEQ ID NO: 14127 - RNA, 64 nt, Human; identical to SEQ ID NO: 11539

SEQ ID NO: 14128 - RNA, 64 nt, Human; identical to SEQ ID NO: 11540

SEQ ID NO: 14129 - RNA, 64 nt, Human; identical to SEQ ID NO: 11541

SEQ ID NO: 14130 - RNA, 64 nt, Human; identical to SEQ ID NO: 11542

SEQ ID NO: 14131 - RNA, 64 nt, Human; identical to SEQ ID NO: 11543

SEQ ID NO: 14132 - RNA, 64 nt, Human; identical to SEQ ID NO: 11544

SEQ ID NO: 14133 - RNA, 64 nt, Human; identical to SEQ ID NO: 11545

SEQ ID NO: 14134 - RNA, 64 nt, Human; identical to SEQ ID NO: 11546

SEQ ID NO: 14135 - RNA, 64 nt, Human; identical to SEQ ID NO: 11547

SEQ ID NO: 14136 - RNA, 64 nt, Human; identical to SEQ ID NO: 11548

SEQ ID NO: 14137 - RNA, 64 nt, Human; identical to SEQ ID NO: 11549

SEQ ID NO: 14138 - RNA, 64 nt, Human; identical to SEQ ID NO: 11550

SEQ ID NO: 14139 - RNA, 64 nt, Human; identical to SEQ ID NO: 11551

SEQ ID NO: 14140 - RNA, 64 nt, Human; identical to SEQ ID NO: 11552

SEQ ID NO: 14141 - RNA, 64 nt, Human; identical to SEQ ID NO: 11553

SEQ ID NO: 14142 - RNA, 64 nt, Human; identical to SEQ ID NO: 11554

SEQ ID NO: 14143 - RNA, 64 nt, Human; identical to SEQ ID NO: 11555

SEQ ID NO: 14144 - RNA, 64 nt, Human; identical to SEQ ID NO: 11556

SEQ ID NO: 14145 - RNA, 64 nt, Human; identical to SEQ ID NO: 11557

SEQ ID NO: 14146 - RNA, 64 nt, Human; identical to SEQ ID NO: 11559

SEQ ID NO: 14147 - RNA, 64 nt, Human; identical to SEQ ID NO: 11560

SEQ ID NO: 14148 - RNA, 64 nt, Human; identical to SEQ ID NO: 11561

SEQ ID NO: 14149 - RNA, 64 nt, Human; identical to SEQ ID NO: 11562

SEQ ID NO: 14150 - RNA, 64 nt, Human; identical to SEQ ID NO: 11563

SEQ ID NO: 14151 - RNA, 62 nt, Human; identical to SEQ ID NO: 11564

SEQ ID NO: 14152 - RNA, 64 nt, Human; identical to SEQ ID NO: 11565

SEQ ID NO: 14153 - RNA, 64 nt, Human; identical to SEQ ID NO: 11566

SEQ ID NO: 14154 - RNA, 64 nt, Human; identical to SEQ ID NO: 11567

SEQ ID NO: 14155 - RNA, 64 nt, Human; identical to SEQ ID NO: 11568

SEQ ID NO: 14156 - RNA, 64 nt, Human; identical to SEQ ID NO: 11569

SEQ ID NO: 14157 - RNA, 64 nt, Human; identical to SEQ ID NO: 11570

SEQ ID NO: 14158 - RNA, 64 nt, Human; identical to SEQ ID NO: 11571

SEQ ID NO: 14159 - RNA, 64 nt, Human; identical to SEQ ID NO: 11572

SEQ ID NO: 14160 - RNA, 64 nt, Human; identical to SEQ ID NO: 11573

SEQ ID NO: 14161 - RNA, 64 nt, Human; identical to SEQ ID NO: 11574

SEQ ID NO: 14162 - RNA, 64 nt, Human; identical to SEQ ID NO: 11575

SEQ ID NO: 14163 - RNA, 64 nt, Human; identical to SEQ ID NO: 11576

SEQ ID NO: 14164 - RNA, 64 nt, Human; identical to SEQ ID NO: 11577

SEQ ID NO: 14165 - RNA, 64 nt, Human; identical to SEQ ID NO: 11578

SEQ ID NO: 14166 - RNA, 64 nt, Human; identical to SEQ ID NO: 11579

SEQ ID NO: 14167 - RNA, 64 nt, Human; identical to SEQ ID NO: 11580

SEQ ID NO: 14168 - RNA, 64 nt, Human; identical to SEQ ID NO: 11581

SEQ ID NO: 14169 - RNA, 64 nt, Human; identical to SEQ ID NO: 11582

SEQ ID NO: 14170 - RNA, 64 nt, Human; identical to SEQ ID NO: 11583

SEQ ID NO: 14171 - RNA, 64 nt, Human; identical to SEQ ID NO: 11584

SEQ ID NO: 14172 - RNA, 64 nt, Human; identical to SEQ ID NO: 11585

SEQ ID NO: 14173 - RNA, 64 nt, Human; identical to SEQ ID NO: 11586

SEQ ID NO: 14174 - RNA, 64 nt, Human; identical to SEQ ID NO: 11587

SEQ ID NO: 14175 - RNA, 64 nt, Human; identical to SEQ ID NO: 11588

SEQ ID NO: 14176 - RNA, 64 nt, Human; identical to SEQ ID NO: 11589

SEQ ID NO: 14177 - RNA, 64 nt, Human; identical to SEQ ID NO: 11590

SEQ ID NO: 14178 - RNA, 64 nt, Human; identical to SEQ ID NO: 11591

SEQ ID NO: 14179 - RNA, 64 nt, Human; identical to SEQ ID NO: 11592

SEQ ID NO: 14180 - RNA, 64 nt, Human; identical to SEQ ID NO: 11593

SEQ ID NO: 14181 - RNA, 64 nt, Human; identical to SEQ ID NO: 11594

SEQ ID NO: 14182 - RNA, 64 nt, Human; identical to SEQ ID NO: 11595

SEQ ID NO: 14183 - RNA, 64 nt, Human; identical to SEQ ID NO: 11597

SEQ ID NO: 14184 - RNA, 64 nt, Human; identical to SEQ ID NO: 11598

SEQ ID NO: 14185 - RNA, 64 nt, Human; identical to SEQ ID NO: 11599

SEQ ID NO: 14186 - RNA, 64 nt, Human; identical to SEQ ID NO: 11600

SEQ ID NO: 14187 - RNA, 64 nt, Human; identical to SEQ ID NO: 11601

SEQ ID NO: 14188 - RNA, 64 nt, Human; identical to SEQ ID NO: 11602

SEQ ID NO: 14189 - RNA, 64 nt, Human; identical to SEQ ID NO: 11603

SEQ ID NO: 14190 - RNA, 64 nt, Human; identical to SEQ ID NO: 11604

SEQ ID NO: 14191 - RNA, 64 nt, Human; identical to SEQ ID NO: 11605

SEQ ID NO: 14192 - RNA, 64 nt, Human; identical to SEQ ID NO: 11606

SEQ ID NO: 14193 - RNA, 64 nt, Human; identical to SEQ ID NO: 11607

SEQ ID NO: 14194 - RNA, 64 nt, Human; identical to SEQ ID NO: 11608

SEQ ID NO: 14195 - RNA, 64 nt, Human; identical to SEQ ID NO: 11609

SEQ ID NO: 14196 - RNA, 64 nt, Human; identical to SEQ ID NO: 11610

SEQ ID NO: 14197 - RNA, 64 nt, Human; identical to SEQ ID NO: 11611

SEQ ID NO: 14198 - RNA, 64 nt, Human; identical to SEQ ID NO: 11612

SEQ ID NO: 14199 - RNA, 64 nt, Human; identical to SEQ ID NO: 11613

SEQ ID NO: 14200 - RNA, 64 nt, Human; identical to SEQ ID NO: 11614

SEQ ID NO: 14201 - RNA, 64 nt, Human; identical to SEQ ID NO: 11615

SEQ ID NO: 14202 - RNA, 64 nt, Human; identical to SEQ ID NO: 11616

SEQ ID NO: 14203 - RNA, 64 nt, Human; identical to SEQ ID NO: 11617

SEQ ID NO: 14204 - RNA, 64 nt, Human; identical to SEQ ID NO: 11618

SEQ ID NO: 14205 - RNA, 64 nt, Human; identical to SEQ ID NO: 11619

SEQ ID NO: 14206 - RNA, 64 nt, Human; identical to SEQ ID NO: 11620

SEQ ID NO: 14207 - RNA, 64 nt, Human; identical to SEQ ID NO: 11621

SEQ ID NO: 14208 - RNA, 64 nt, Human; identical to SEQ ID NO: 11622

SEQ ID NO: 14209 - RNA, 64 nt, Human; identical to SEQ ID NO: 11623

SEQ ID NO: 14210 - RNA, 64 nt, Human; identical to SEQ ID NO: 11624

SEQ ID NO: 14211 - RNA, 64 nt, Human; identical to SEQ ID NO: 11625

SEQ ID NO: 14212 - RNA, 64 nt, Human; identical to SEQ ID NO: 11626

SEQ ID NO: 14213 - RNA, 64 nt, Human; identical to SEQ ID NO: 11627

SEQ ID NO: 14214 - RNA, 64 nt, Human; identical to SEQ ID NO: 11628

SEQ ID NO: 14215 - RNA, 64 nt, Human; identical to SEQ ID NO: 11629

SEQ ID NO: 14216 - RNA, 64 nt, Human; identical to SEQ ID NO: 11630

SEQ ID NO: 14217 - RNA, 64 nt, Human; identical to SEQ ID NO: 11631

SEQ ID NO: 14218 - RNA, 64 nt, Human; identical to SEQ ID NO: 11632

SEQ ID NO: 14219 - RNA, 64 nt, Human; identical to SEQ ID NO: 11633

SEQ ID NO: 14220 - RNA, 64 nt, Human; identical to SEQ ID NO: 11635

SEQ ID NO: 14221 - RNA, 64 nt, Human; identical to SEQ ID NO: 11636

SEQ ID NO: 14222 - RNA, 64 nt, Human; identical to SEQ ID NO: 11637

SEQ ID NO: 14223 - RNA, 64 nt, Human; identical to SEQ ID NO: 11638

SEQ ID NO: 14224 - RNA, 64 nt, Human; identical to SEQ ID NO: 11639

SEQ ID NO: 14225 - RNA, 64 nt, Human; identical to SEQ ID NO: 11640

SEQ ID NO: 14226 - RNA, 64 nt, Human; identical to SEQ ID NO: 11641

SEQ ID NO: 14227 - RNA, 64 nt, Human; identical to SEQ ID NO: 11642

SEQ ID NO: 14228 - RNA, 64 nt, Human; identical to SEQ ID NO: 11643

SEQ ID NO: 14229 - RNA, 64 nt, Human; identical to SEQ ID NO: 11644

SEQ ID NO: 14230 - RNA, 64 nt, Human; identical to SEQ ID NO: 11645

SEQ ID NO: 14231 - RNA, 64 nt, Human; identical to SEQ ID NO: 11646

SEQ ID NO: 14232 - RNA, 64 nt, Human; identical to SEQ ID NO: 11647

SEQ ID NO: 14233 - RNA, 64 nt, Human; identical to SEQ ID NO: 11648

SEQ ID NO: 14234 - RNA, 64 nt, Human; identical to SEQ ID NO: 11649

SEQ ID NO: 14235 - RNA, 64 nt, Human; identical to SEQ ID NO: 11650

SEQ ID NO: 14236 - RNA, 64 nt, Human; identical to SEQ ID NO: 11651

SEQ ID NO: 14237 - RNA, 64 nt, Human; identical to SEQ ID NO: 11652

SEQ ID NO: 14238 - RNA, 64 nt, Human; identical to SEQ ID NO: 11654

SEQ ID NO: 14239 - RNA, 64 nt, Human; identical to SEQ ID NO: 11655

SEQ ID NO: 14240 - RNA, 64 nt, Human; identical to SEQ ID NO: 11656

SEQ ID NO: 14241 - RNA, 64 nt, Human; identical to SEQ ID NO: 11657

SEQ ID NO: 14242 - RNA, 64 nt, Human; identical to SEQ ID NO: 11658

SEQ ID NO: 14243 - RNA, 64 nt, Human; identical to SEQ ID NO: 11659

SEQ ID NO: 14244 - RNA, 64 nt, Human; identical to SEQ ID NO: 11660

SEQ ID NO: 14245 - RNA, 64 nt, Human; identical to SEQ ID NO: 11661

SEQ ID NO: 14246 - RNA, 64 nt, Human; identical to SEQ ID NO: 11662

SEQ ID NO: 14247 - RNA, 64 nt, Human; identical to SEQ ID NO: 11663

SEQ ID NO: 14248 - RNA, 64 nt, Human; identical to SEQ ID NO: 11664

SEQ ID NO: 14249 - RNA, 64 nt, Human; identical to SEQ ID NO: 11665

SEQ ID NO: 14250 - RNA, 64 nt, Human; identical to SEQ ID NO: 11666

SEQ ID NO: 14251 - RNA, 64 nt, Human; identical to SEQ ID NO: 11667

SEQ ID NO: 14252 - RNA, 64 nt, Human; identical to SEQ ID NO: 11668

SEQ ID NO: 14253 - RNA, 64 nt, Human; identical to SEQ ID NO: 11669

SEQ ID NO: 14254 - RNA, 64 nt, Human; identical to SEQ ID NO: 11670

SEQ ID NO: 14255 - RNA, 64 nt, Human; identical to SEQ ID NO: 11671

SEQ ID NO: 14256 - RNA, 64 nt, Human; identical to SEQ ID NO: 11673

SEQ ID NO: 14257 - RNA, 64 nt, Human; identical to SEQ ID NO: 11674

SEQ ID NO: 14258 - RNA, 64 nt, Human; identical to SEQ ID NO: 11675

SEQ ID NO: 14259 - RNA, 64 nt, Human; identical to SEQ ID NO: 11676

SEQ ID NO: 14260 - RNA, 64 nt, Human; identical to SEQ ID NO: 11677

SEQ ID NO: 14261 - RNA, 64 nt, Human; identical to SEQ ID NO: 11678

SEQ ID NO: 14262 - RNA, 64 nt, Human; identical to SEQ ID NO: 11679

SEQ ID NO: 14263 - RNA, 64 nt, Human; identical to SEQ ID NO: 11680

SEQ ID NO: 14264 - RNA, 64 nt, Human; identical to SEQ ID NO: 11681

SEQ ID NO: 14265 - RNA, 64 nt, Human; identical to SEQ ID NO: 11682

SEQ ID NO: 14266 - RNA, 64 nt, Human; identical to SEQ ID NO: 11683

SEQ ID NO: 14267 - RNA, 64 nt, Human; identical to SEQ ID NO: 11684

SEQ ID NO: 14268 - RNA, 64 nt, Human; identical to SEQ ID NO: 11685

SEQ ID NO: 14269 - RNA, 64 nt, Human; identical to SEQ ID NO: 11686

SEQ ID NO: 14270 - RNA, 64 nt, Human; identical to SEQ ID NO: 11687

SEQ ID NO: 14271 - RNA, 50 nt, Human; identical to SEQ ID NO: 11688

SEQ ID NO: 14272 - RNA, 64 nt, Human; identical to SEQ ID NO: 11689

SEQ ID NO: 14273 - RNA, 64 nt, Human; identical to SEQ ID NO: 11690

SEQ ID NO: 14274 - RNA, 64 nt, Human; identical to SEQ ID NO: 11691

SEQ ID NO: 14275 - RNA, 64 nt, Human; identical to SEQ ID NO: 11692

SEQ ID NO: 14276 - RNA, 64 nt, Human; identical to SEQ ID NO: 11693

SEQ ID NO: 14277 - RNA, 64 nt, Human; identical to SEQ ID NO: 11694

SEQ ID NO: 14278 - RNA, 64 nt, Human; identical to SEQ ID NO: 11695

SEQ ID NO: 14279 - RNA, 64 nt, Human; identical to SEQ ID NO: 11696

SEQ ID NO: 14280 - RNA, 64 nt, Human; identical to SEQ ID NO: 11697

SEQ ID NO: 14281 - RNA, 64 nt, Human; identical to SEQ ID NO: 11698

SEQ ID NO: 14282 - RNA, 64 nt, Human; identical to SEQ ID NO: 11699

SEQ ID NO: 14283 - RNA, 64 nt, Human; identical to SEQ ID NO: 11700

SEQ ID NO: 14284 - RNA, 64 nt, Human; identical to SEQ ID NO: 11701

SEQ ID NO: 14285 - RNA, 64 nt, Human; identical to SEQ ID NO: 11702

SEQ ID NO: 14286 - RNA, 64 nt, Human; identical to SEQ ID NO: 11703

SEQ ID NO: 14287 - RNA, 64 nt, Human; identical to SEQ ID NO: 11704

SEQ ID NO: 14288 - RNA, 64 nt, Human; identical to SEQ ID NO: 11705

SEQ ID NO: 14289 - RNA, 64 nt, Human; identical to SEQ ID NO: 11706

SEQ ID NO: 14290 - RNA, 64 nt, Human; identical to SEQ ID NO: 11707

SEQ ID NO: 14291 - RNA, 64 nt, Human; identical to SEQ ID NO: 11708

SEQ ID NO: 14292 - RNA, 64 nt, Human; identical to SEQ ID NO: 11709

SEQ ID NO: 14293 - RNA, 64 nt, Human; identical to SEQ ID NO: 11711

SEQ ID NO: 14294 - RNA, 64 nt, Human; identical to SEQ ID NO: 11712

SEQ ID NO: 14295 - RNA, 64 nt, Human; identical to SEQ ID NO: 11713

SEQ ID NO: 14296 - RNA, 64 nt, Human; identical to SEQ ID NO: 11714

SEQ ID NO: 14297 - RNA, 64 nt, Human; identical to SEQ ID NO: 11715

SEQ ID NO: 14298 - RNA, 64 nt, Human; identical to SEQ ID NO: 11716

SEQ ID NO: 14299 - RNA, 64 nt, Human; identical to SEQ ID NO: 11717

SEQ ID NO: 14300 - RNA, 64 nt, Human; identical to SEQ ID NO: 11718

SEQ ID NO: 14301 - RNA, 64 nt, Human; identical to SEQ ID NO: 11719

SEQ ID NO: 14302 - RNA, 64 nt, Human; identical to SEQ ID NO: 11720

SEQ ID NO: 14303 - RNA, 64 nt, Human; identical to SEQ ID NO: 11721

SEQ ID NO: 14304 - RNA, 64 nt, Human; identical to SEQ ID NO: 11722

SEQ ID NO: 14305 - RNA, 64 nt, Human; identical to SEQ ID NO: 11723

SEQ ID NO: 14306 - RNA, 64 nt, Human; identical to SEQ ID NO: 11724

SEQ ID NO: 14307 - RNA, 64 nt, Human; identical to SEQ ID NO: 11725

SEQ ID NO: 14308 - RNA, 64 nt, Human; identical to SEQ ID NO: 11726

SEQ ID NO: 14309 - RNA, 64 nt, Human; identical to SEQ ID NO: 11727

SEQ ID NO: 14310 - RNA, 64 nt, Human; identical to SEQ ID NO: 11728

SEQ ID NO: 14311 - RNA, 64 nt, Human; identical to SEQ ID NO: 11730

SEQ ID NO: 14312 - RNA, 64 nt, Human; identical to SEQ ID NO: 11731

SEQ ID NO: 14313 - RNA, 64 nt, Human; identical to SEQ ID NO: 11732

SEQ ID NO: 14314 - RNA, 64 nt, Human; identical to SEQ ID NO: 11733

SEQ ID NO: 14315 - RNA, 64 nt, Human; identical to SEQ ID NO: 11734

SEQ ID NO: 14316 - RNA, 64 nt, Human; identical to SEQ ID NO: 11735

SEQ ID NO: 14317 - RNA, 64 nt, Human; identical to SEQ ID NO: 11736

SEQ ID NO: 14318 - RNA, 64 nt, Human; identical to SEQ ID NO: 11737

SEQ ID NO: 14319 - RNA, 64 nt, Human; identical to SEQ ID NO: 11738

SEQ ID NO: 14320 - RNA, 64 nt, Human; identical to SEQ ID NO: 11739

SEQ ID NO: 14321 - RNA, 64 nt, Human; identical to SEQ ID NO: 11740

SEQ ID NO: 14322 - RNA, 64 nt, Human; identical to SEQ ID NO: 11741

SEQ ID NO: 14323 - RNA, 64 nt, Human; identical to SEQ ID NO: 11742

SEQ ID NO: 14324 - RNA, 64 nt, Human; identical to SEQ ID NO: 11743

SEQ ID NO: 14325 - RNA, 64 nt, Human; identical to SEQ ID NO: 11744

SEQ ID NO: 14326 - RNA, 64 nt, Human; identical to SEQ ID NO: 11745

SEQ ID NO: 14327 - RNA, 64 nt, Human; identical to SEQ ID NO: 11746

SEQ ID NO: 14328 - RNA, 64 nt, Human; identical to SEQ ID NO: 11747

SEQ ID NO: 14329 - RNA, 64 nt, Human; identical to SEQ ID NO: 11749

SEQ ID NO: 14330 - RNA, 64 nt, Human; identical to SEQ ID NO: 11750

SEQ ID NO: 14331 - RNA, 64 nt, Human; identical to SEQ ID NO: 11751

SEQ ID NO: 14332 - RNA, 64 nt, Human; identical to SEQ ID NO: 11752

SEQ ID NO: 14333 - RNA, 64 nt, Human; identical to SEQ ID NO: 11753

SEQ ID NO: 14334 - RNA, 64 nt, Human; identical to SEQ ID NO: 11754

SEQ ID NO: 14335 - RNA, 64 nt, Human; identical to SEQ ID NO: 11755

SEQ ID NO: 14336 - RNA, 64 nt, Human; identical to SEQ ID NO: 11756

SEQ ID NO: 14337 - RNA, 64 nt, Human; identical to SEQ ID NO: 11757

SEQ ID NO: 14338 - RNA, 64 nt, Human; identical to SEQ ID NO: 11758

SEQ ID NO: 14339 - RNA, 64 nt, Human; identical to SEQ ID NO: 11759

SEQ ID NO: 14340 - RNA, 64 nt, Human; identical to SEQ ID NO: 11760

SEQ ID NO: 14341 - RNA, 64 nt, Human; identical to SEQ ID NO: 11761

SEQ ID NO: 14342 - RNA, 51 nt, Human; identical to SEQ ID NO: 11762

SEQ ID NO: 14343 - RNA, 64 nt, Human; identical to SEQ ID NO: 11763

SEQ ID NO: 14344 - RNA, 64 nt, Human; identical to SEQ ID NO: 11764

SEQ ID NO: 14345 - RNA, 64 nt, Human; identical to SEQ ID NO: 11765

SEQ ID NO: 14346 - RNA, 64 nt, Human; identical to SEQ ID NO: 11766

SEQ ID NO: 14347 - RNA, 64 nt, Human; identical to SEQ ID NO: 11767

SEQ ID NO: 14348 - RNA, 64 nt, Human; identical to SEQ ID NO: 11768

SEQ ID NO: 14349 - RNA, 64 nt, Human; identical to SEQ ID NO: 11769

SEQ ID NO: 14350 - RNA, 64 nt, Human; identical to SEQ ID NO: 11770

SEQ ID NO: 14351 - RNA, 64 nt, Human; identical to SEQ ID NO: 11771

SEQ ID NO: 14352 - RNA, 64 nt, Human; identical to SEQ ID NO: 11772

SEQ ID NO: 14353 - RNA, 64 nt, Human; identical to SEQ ID NO: 11773

SEQ ID NO: 14354 - RNA, 64 nt, Human; identical to SEQ ID NO: 11774

SEQ ID NO: 14355 - RNA, 64 nt, Human; identical to SEQ ID NO: 11775

SEQ ID NO: 14356 - RNA, 64 nt, Human; identical to SEQ ID NO: 11776

SEQ ID NO: 14357 - RNA, 64 nt, Human; identical to SEQ ID NO: 11777

SEQ ID NO: 14358 - RNA, 64 nt, Human; identical to SEQ ID NO: 11778

SEQ ID NO: 14359 - RNA, 64 nt, Human; identical to SEQ ID NO: 11779

SEQ ID NO: 14360 - RNA, 64 nt, Human; identical to SEQ ID NO: 11780

SEQ ID NO: 14361 - RNA, 64 nt, Human; identical to SEQ ID NO: 11781

SEQ ID NO: 14362 - RNA, 64 nt, Human; identical to SEQ ID NO: 11782

SEQ ID NO: 14363 - RNA, 64 nt, Human; identical to SEQ ID NO: 11783

SEQ ID NO: 14364 - RNA, 64 nt, Human; identical to SEQ ID NO: 11784

SEQ ID NO: 14365 - RNA, 64 nt, Human; identical to SEQ ID NO: 11785

SEQ ID NO: 14366 - RNA, 64 nt, Human; identical to SEQ ID NO: 11786

SEQ ID NO: 14367 - RNA, 64 nt, Human; identical to SEQ ID NO: 11787

SEQ ID NO: 14368 - RNA, 64 nt, Human; identical to SEQ ID NO: 11788

SEQ ID NO: 14369 - RNA, 64 nt, Human; identical to SEQ ID NO: 11789

SEQ ID NO: 14370 - RNA, 64 nt, Human; identical to SEQ ID NO: 11790

SEQ ID NO: 14371 - RNA, 64 nt, Human; identical to SEQ ID NO: 11791

SEQ ID NO: 14372 - RNA, 64 nt, Human; identical to SEQ ID NO: 11792

SEQ ID NO: 14373 - RNA, 64 nt, Human; identical to SEQ ID NO: 11793

SEQ ID NO: 14374 - RNA, 64 nt, Human; identical to SEQ ID NO: 11794

SEQ ID NO: 14375 - RNA, 64 nt, Human; identical to SEQ ID NO: 11795

SEQ ID NO: 14376 - RNA, 64 nt, Human; identical to SEQ ID NO: 11796

SEQ ID NO: 14377 - RNA, 64 nt, Human; identical to SEQ ID NO: 11797

SEQ ID NO: 14378 - RNA, 64 nt, Human; identical to SEQ ID NO: 11798

SEQ ID NO: 14379 - RNA, 64 nt, Human; identical to SEQ ID NO: 11799

SEQ ID NO: 14380 - RNA, 64 nt, Human; identical to SEQ ID NO: 11800

SEQ ID NO: 14381 - RNA, 64 nt, Human; identical to SEQ ID NO: 11801

SEQ ID NO: 14382 - RNA, 64 nt, Human; identical to SEQ ID NO: 11802

SEQ ID NO: 14383 - RNA, 64 nt, Human; identical to SEQ ID NO: 11803

SEQ ID NO: 14384 - RNA, 64 nt, Human; identical to SEQ ID NO: 11804

SEQ ID NO: 14385 - RNA, 64 nt, Human; identical to SEQ ID NO: 11806

SEQ ID NO: 14386 - RNA, 64 nt, Human; identical to SEQ ID NO: 11807

SEQ ID NO: 14387 - RNA, 64 nt, Human; identical to SEQ ID NO: 11808

SEQ ID NO: 14388 - RNA, 64 nt, Human; identical to SEQ ID NO: 11809

SEQ ID NO: 14389 - RNA, 64 nt, Human; identical to SEQ ID NO: 11810

SEQ ID NO: 14390 - RNA, 64 nt, Human; identical to SEQ ID NO: 11811

SEQ ID NO: 14391 - RNA, 64 nt, Human; identical to SEQ ID NO: 11812

SEQ ID NO: 14392 - RNA, 64 nt, Human; identical to SEQ ID NO: 11813

SEQ ID NO: 14393 - RNA, 64 nt, Human; identical to SEQ ID NO: 11814

SEQ ID NO: 14394 - RNA, 64 nt, Human; identical to SEQ ID NO: 11815

SEQ ID NO: 14395 - RNA, 64 nt, Human; identical to SEQ ID NO: 11816

SEQ ID NO: 14396 - RNA, 64 nt, Human; identical to SEQ ID NO: 11817

SEQ ID NO: 14397 - RNA, 64 nt, Human; identical to SEQ ID NO: 11818

SEQ ID NO: 14398 - RNA, 64 nt, Human; identical to SEQ ID NO: 11819

SEQ ID NO: 14399 - RNA, 64 nt, Human; identical to SEQ ID NO: 11820

SEQ ID NO: 14400 - RNA, 64 nt, Human; identical to SEQ ID NO: 11821

SEQ ID NO: 14401 - RNA, 64 nt, Human; identical to SEQ ID NO: 11822

SEQ ID NO: 14402 - RNA, 64 nt, Human; identical to SEQ ID NO: 11823

SEQ ID NO: 14403 - RNA, 64 nt, Human; identical to SEQ ID NO: 11824

SEQ ID NO: 14404 - RNA, 64 nt, Human; identical to SEQ ID NO: 11825

SEQ ID NO: 14405 - RNA, 64 nt, Human; identical to SEQ ID NO: 11826

SEQ ID NO: 14406 - RNA, 64 nt, Human; identical to SEQ ID NO: 11827

SEQ ID NO: 14407 - RNA, 64 nt, Human; identical to SEQ ID NO: 11828

SEQ ID NO: 14408 - RNA, 64 nt, Human; identical to SEQ ID NO: 11829

SEQ ID NO: 14409 - RNA, 64 nt, Human; identical to SEQ ID NO: 11830

SEQ ID NO: 14410 - RNA, 64 nt, Human; identical to SEQ ID NO: 11831

SEQ ID NO: 14411 - RNA, 64 nt, Human; identical to SEQ ID NO: 11832

SEQ ID NO: 14412 - RNA, 64 nt, Human; identical to SEQ ID NO: 11833

SEQ ID NO: 14413 - RNA, 64 nt, Human; identical to SEQ ID NO: 11834

SEQ ID NO: 14414 - RNA, 64 nt, Human; identical to SEQ ID NO: 11835

SEQ ID NO: 14415 - RNA, 64 nt, Human; identical to SEQ ID NO: 11836

SEQ ID NO: 14416 - RNA, 64 nt, Human; identical to SEQ ID NO: 11837

SEQ ID NO: 14417 - RNA, 64 nt, Human; identical to SEQ ID NO: 11838

SEQ ID NO: 14418 - RNA, 64 nt, Human; identical to SEQ ID NO: 11839

SEQ ID NO: 14419 - RNA, 64 nt, Human; identical to SEQ ID NO: 11840

SEQ ID NO: 14420 - RNA, 64 nt, Human; identical to SEQ ID NO: 11841

SEQ ID NO: 14421 - RNA, 64 nt, Human; identical to SEQ ID NO: 11842

SEQ ID NO: 14422 - RNA, 64 nt, Human; identical to SEQ ID NO: 11844

SEQ ID NO: 14423 - RNA, 64 nt, Human; identical to SEQ ID NO: 11845

SEQ ID NO: 14424 - RNA, 59 nt, Human; identical to SEQ ID NO: 11846

SEQ ID NO: 14425 - RNA, 64 nt, Human; identical to SEQ ID NO: 11847

SEQ ID NO: 14426 - RNA, 64 nt, Human; identical to SEQ ID NO: 11848

SEQ ID NO: 14427 - RNA, 64 nt, Human; identical to SEQ ID NO: 11849

SEQ ID NO: 14428 - RNA, 64 nt, Human; identical to SEQ ID NO: 11850

SEQ ID NO: 14429 - RNA, 64 nt, Human; identical to SEQ ID NO: 11851

SEQ ID NO: 14430 - RNA, 64 nt, Human; identical to SEQ ID NO: 11852

SEQ ID NO: 14431 - RNA, 64 nt, Human; identical to SEQ ID NO: 11853

SEQ ID NO: 14432 - RNA, 64 nt, Human; identical to SEQ ID NO: 11854

SEQ ID NO: 14433 - RNA, 64 nt, Human; identical to SEQ ID NO: 11855

SEQ ID NO: 14434 - RNA, 64 nt, Human; identical to SEQ ID NO: 11856

SEQ ID NO: 14435 - RNA, 64 nt, Human; identical to SEQ ID NO: 11857

SEQ ID NO: 14436 - RNA, 64 nt, Human; identical to SEQ ID NO: 11858

SEQ ID NO: 14437 - RNA, 64 nt, Human; identical to SEQ ID NO: 11859

SEQ ID NO: 14438 - RNA, 64 nt, Human; identical to SEQ ID NO: 11860

SEQ ID NO: 14439 - RNA, 64 nt, Human; identical to SEQ ID NO: 11861

SEQ ID NO: 14440 - RNA, 64 nt, Human; identical to SEQ ID NO: 11863

SEQ ID NO: 14441 - RNA, 64 nt, Human; identical to SEQ ID NO: 11864

SEQ ID NO: 14442 - RNA, 64 nt, Human; identical to SEQ ID NO: 11865

SEQ ID NO: 14443 - RNA, 64 nt, Human; identical to SEQ ID NO: 11866

SEQ ID NO: 14444 - RNA, 64 nt, Human; identical to SEQ ID NO: 11867

SEQ ID NO: 14445 - RNA, 62 nt, Human; identical to SEQ ID NO: 11868

SEQ ID NO: 14446 - RNA, 64 nt, Human; identical to SEQ ID NO: 11869

SEQ ID NO: 14447 - RNA, 64 nt, Human; identical to SEQ ID NO: 11870

SEQ ID NO: 14448 - RNA, 64 nt, Human; identical to SEQ ID NO: 11871

SEQ ID NO: 14449 - RNA, 64 nt, Human; identical to SEQ ID NO: 11872

SEQ ID NO: 14450 - RNA, 64 nt, Human; identical to SEQ ID NO: 11873

SEQ ID NO: 14451 - RNA, 64 nt, Human; identical to SEQ ID NO: 11874

SEQ ID NO: 14452 - RNA, 64 nt, Human; identical to SEQ ID NO: 11875

SEQ ID NO: 14453 - RNA, 64 nt, Human; identical to SEQ ID NO: 11876

SEQ ID NO: 14454 - RNA, 64 nt, Human; identical to SEQ ID NO: 11877

SEQ ID NO: 14455 - RNA, 64 nt, Human; identical to SEQ ID NO: 11878

SEQ ID NO: 14456 - RNA, 64 nt, Human; identical to SEQ ID NO: 11879

SEQ ID NO: 14457 - RNA, 64 nt, Human; identical to SEQ ID NO: 11880

SEQ ID NO: 14458 - RNA, 64 nt, Human; identical to SEQ ID NO: 11882

SEQ ID NO: 14459 - RNA, 64 nt, Human; identical to SEQ ID NO: 11883

SEQ ID NO: 14460 - RNA, 64 nt, Human; identical to SEQ ID NO: 11884

SEQ ID NO: 14461 - RNA, 64 nt, Human; identical to SEQ ID NO: 11885

SEQ ID NO: 14462 - RNA, 64 nt, Human; identical to SEQ ID NO: 11886

SEQ ID NO: 14463 - RNA, 64 nt, Human; identical to SEQ ID NO: 11887

SEQ ID NO: 14464 - RNA, 64 nt, Human; identical to SEQ ID NO: 11888

SEQ ID NO: 14465 - RNA, 64 nt, Human; identical to SEQ ID NO: 11889

SEQ ID NO: 14466 - RNA, 64 nt, Human; identical to SEQ ID NO: 11890

SEQ ID NO: 14467 - RNA, 64 nt, Human; identical to SEQ ID NO: 11891

SEQ ID NO: 14468 - RNA, 64 nt, Human; identical to SEQ ID NO: 11892

SEQ ID NO: 14469 - RNA, 64 nt, Human; identical to SEQ ID NO: 11893

SEQ ID NO: 14470 - RNA, 64 nt, Human; identical to SEQ ID NO: 11894

SEQ ID NO: 14471 - RNA, 64 nt, Human; identical to SEQ ID NO: 11895

SEQ ID NO: 14472 - RNA, 64 nt, Human; identical to SEQ ID NO: 11896

SEQ ID NO: 14473 - RNA, 64 nt, Human; identical to SEQ ID NO: 11897

SEQ ID NO: 14474 - RNA, 64 nt, Human; identical to SEQ ID NO: 11898

SEQ ID NO: 14475 - RNA, 64 nt, Human; identical to SEQ ID NO: 11899

SEQ ID NO: 14476 - RNA, 64 nt, Human; identical to SEQ ID NO: 11901

SEQ ID NO: 14477 - RNA, 64 nt, Human; identical to SEQ ID NO: 11902

SEQ ID NO: 14478 - RNA, 64 nt, Human; identical to SEQ ID NO: 11903

SEQ ID NO: 14479 - RNA, 64 nt, Human; identical to SEQ ID NO: 11904

SEQ ID NO: 14480 - RNA, 64 nt, Human; identical to SEQ ID NO: 11905

SEQ ID NO: 14481 - RNA, 64 nt, Human; identical to SEQ ID NO: 11906

SEQ ID NO: 14482 - RNA, 64 nt, Human; identical to SEQ ID NO: 11907

SEQ ID NO: 14483 - RNA, 64 nt, Human; identical to SEQ ID NO: 11908

SEQ ID NO: 14484 - RNA, 64 nt, Human; identical to SEQ ID NO: 11909

SEQ ID NO: 14485 - RNA, 64 nt, Human; identical to SEQ ID NO: 11910

SEQ ID NO: 14486 - RNA, 64 nt, Human; identical to SEQ ID NO: 11911

SEQ ID NO: 14487 - RNA, 64 nt, Human; identical to SEQ ID NO: 11912

SEQ ID NO: 14488 - RNA, 64 nt, Human; identical to SEQ ID NO: 11913

SEQ ID NO: 14489 - RNA, 64 nt, Human; identical to SEQ ID NO: 11914

SEQ ID NO: 14490 - RNA, 64 nt, Human; identical to SEQ ID NO: 11915

SEQ ID NO: 14491 - RNA, 64 nt, Human; identical to SEQ ID NO: 11916

SEQ ID NO: 14492 - RNA, 64 nt, Human; identical to SEQ ID NO: 11917

SEQ ID NO: 14493 - RNA, 64 nt, Human; identical to SEQ ID NO: 11918

SEQ ID NO: 14494 - RNA, 64 nt, Human; identical to SEQ ID NO: 11920

SEQ ID NO: 14495 - RNA, 64 nt, Human; identical to SEQ ID NO: 11921

SEQ ID NO: 14496 - RNA, 64 nt, Human; identical to SEQ ID NO: 11922

SEQ ID NO: 14497 - RNA, 64 nt, Human; identical to SEQ ID NO: 11923

SEQ ID NO: 14498 - RNA, 64 nt, Human; identical to SEQ ID NO: 11924

SEQ ID NO: 14499 - RNA, 64 nt, Human; identical to SEQ ID NO: 11925

SEQ ID NO: 14500 - RNA, 64 nt, Human; identical to SEQ ID NO: 11926

SEQ ID NO: 14501 - RNA, 64 nt, Human; identical to SEQ ID NO: 11927

SEQ ID NO: 14502 - RNA, 64 nt, Human; identical to SEQ ID NO: 11928

SEQ ID NO: 14503 - RNA, 64 nt, Human; identical to SEQ ID NO: 11929

SEQ ID NO: 14504 - RNA, 64 nt, Human; identical to SEQ ID NO: 11930

SEQ ID NO: 14505 - RNA, 64 nt, Human; identical to SEQ ID NO: 11931

SEQ ID NO: 14506 - RNA, 64 nt, Human; identical to SEQ ID NO: 11932

SEQ ID NO: 14507 - RNA, 64 nt, Human; identical to SEQ ID NO: 11933

SEQ ID NO: 14508 - RNA, 64 nt, Human; identical to SEQ ID NO: 11934

SEQ ID NO: 14509 - RNA, 64 nt, Human; identical to SEQ ID NO: 11935

SEQ ID NO: 14510 - RNA, 64 nt, Human; identical to SEQ ID NO: 11936

SEQ ID NO: 14511 - RNA, 64 nt, Human; identical to SEQ ID NO: 11937

SEQ ID NO: 14512 - RNA, 64 nt, Human; identical to SEQ ID NO: 11939

SEQ ID NO: 14513 - RNA, 64 nt, Human; identical to SEQ ID NO: 11940

SEQ ID NO: 14514 - RNA, 64 nt, Human; identical to SEQ ID NO: 11941

SEQ ID NO: 14515 - RNA, 64 nt, Human; identical to SEQ ID NO: 11942

SEQ ID NO: 14516 - RNA, 64 nt, Human; identical to SEQ ID NO: 11943

SEQ ID NO: 14517 - RNA, 64 nt, Human; identical to SEQ ID NO: 11944

SEQ ID NO: 14518 - RNA, 64 nt, Human; identical to SEQ ID NO: 11945

SEQ ID NO: 14519 - RNA, 64 nt, Human; identical to SEQ ID NO: 11946

SEQ ID NO: 14520 - RNA, 64 nt, Human; identical to SEQ ID NO: 11947

SEQ ID NO: 14521 - RNA, 64 nt, Human; identical to SEQ ID NO: 11948

SEQ ID NO: 14522 - RNA, 64 nt, Human; identical to SEQ ID NO: 11949

SEQ ID NO: 14523 - RNA, 64 nt, Human; identical to SEQ ID NO: 11950

SEQ ID NO: 14524 - RNA, 64 nt, Human; identical to SEQ ID NO: 11951

SEQ ID NO: 14525 - RNA, 64 nt, Human; identical to SEQ ID NO: 11952

SEQ ID NO: 14526 - RNA, 64 nt, Human; identical to SEQ ID NO: 11953

SEQ ID NO: 14527 - RNA, 64 nt, Human; identical to SEQ ID NO: 11954

SEQ ID NO: 14528 - RNA, 64 nt, Human; identical to SEQ ID NO: 11955

SEQ ID NO: 14529 - RNA, 64 nt, Human; identical to SEQ ID NO: 11956

SEQ ID NO: 14530 - RNA, 64 nt, Human; identical to SEQ ID NO: 11957

SEQ ID NO: 14531 - RNA, 64 nt, Human; identical to SEQ ID NO: 11958

SEQ ID NO: 14532 - RNA, 64 nt, Human; identical to SEQ ID NO: 11959

SEQ ID NO: 14533 - RNA, 64 nt, Human; identical to SEQ ID NO: 11960

SEQ ID NO: 14534 - RNA, 64 nt, Human; identical to SEQ ID NO: 11961

SEQ ID NO: 14535 - RNA, 64 nt, Human; identical to SEQ ID NO: 11962

SEQ ID NO: 14536 - RNA, 64 nt, Human; identical to SEQ ID NO: 11963

SEQ ID NO: 14537 - RNA, 64 nt, Human; identical to SEQ ID NO: 11964

SEQ ID NO: 14538 - RNA, 64 nt, Human; identical to SEQ ID NO: 11965

SEQ ID NO: 14539 - RNA, 64 nt, Human; identical to SEQ ID NO: 11966

SEQ ID NO: 14540 - RNA, 64 nt, Human; identical to SEQ ID NO: 11967

SEQ ID NO: 14541 - RNA, 64 nt, Human; identical to SEQ ID NO: 11968

SEQ ID NO: 14542 - RNA, 64 nt, Human; identical to SEQ ID NO: 11969

SEQ ID NO: 14543 - RNA, 64 nt, Human; identical to SEQ ID NO: 11970

SEQ ID NO: 14544 - RNA, 64 nt, Human; identical to SEQ ID NO: 11971

SEQ ID NO: 14545 - RNA, 64 nt, Human; identical to SEQ ID NO: 11972

SEQ ID NO: 14546 - RNA, 64 nt, Human; identical to SEQ ID NO: 11973

SEQ ID NO: 14547 - RNA, 64 nt, Human; identical to SEQ ID NO: 11974

SEQ ID NO: 14548 - RNA, 64 nt, Human; identical to SEQ ID NO: 11975

SEQ ID NO: 14549 - RNA, 64 nt, Human; identical to SEQ ID NO: 11977

SEQ ID NO: 14550 - RNA, 64 nt, Human; identical to SEQ ID NO: 11978

SEQ ID NO: 14551 - RNA, 64 nt, Human; identical to SEQ ID NO: 11979

SEQ ID NO: 14552 - RNA, 64 nt, Human; identical to SEQ ID NO: 11980

SEQ ID NO: 14553 - RNA, 64 nt, Human; identical to SEQ ID NO: 11981

SEQ ID NO: 14554 - RNA, 64 nt, Human; identical to SEQ ID NO: 11982

SEQ ID NO: 14555 - RNA, 64 nt, Human; identical to SEQ ID NO: 11983

SEQ ID NO: 14556 - RNA, 64 nt, Human; identical to SEQ ID NO: 11984

SEQ ID NO: 14557 - RNA, 64 nt, Human; identical to SEQ ID NO: 11985

SEQ ID NO: 14558 - RNA, 64 nt, Human; identical to SEQ ID NO: 11986

SEQ ID NO: 14559 - RNA, 64 nt, Human; identical to SEQ ID NO: 11987

SEQ ID NO: 14560 - RNA, 64 nt, Human; identical to SEQ ID NO: 11988

SEQ ID NO: 14561 - RNA, 64 nt, Human; identical to SEQ ID NO: 11989

SEQ ID NO: 14562 - RNA, 64 nt, Human; identical to SEQ ID NO: 11990

SEQ ID NO: 14563 - RNA, 64 nt, Human; identical to SEQ ID NO: 11991

SEQ ID NO: 14564 - RNA, 64 nt, Human; identical to SEQ ID NO: 11992

SEQ ID NO: 14565 - RNA, 64 nt, Human; identical to SEQ ID NO: 11993

SEQ ID NO: 14566 - RNA, 64 nt, Human; identical to SEQ ID NO: 11994

SEQ ID NO: 14567 - RNA, 64 nt, Human; identical to SEQ ID NO: 11995

SEQ ID NO: 14568 - RNA, 64 nt, Human; identical to SEQ ID NO: 11996

SEQ ID NO: 14569 - RNA, 64 nt, Human; identical to SEQ ID NO: 11997

SEQ ID NO: 14570 - RNA, 64 nt, Human; identical to SEQ ID NO: 11998

SEQ ID NO: 14571 - RNA, 64 nt, Human; identical to SEQ ID NO: 11999

SEQ ID NO: 14572 - RNA, 64 nt, Human; identical to SEQ ID NO: 12000

SEQ ID NO: 14573 - RNA, 64 nt, Human; identical to SEQ ID NO: 12001

SEQ ID NO: 14574 - RNA, 64 nt, Human; identical to SEQ ID NO: 12002

SEQ ID NO: 14575 - RNA, 64 nt, Human; identical to SEQ ID NO: 12003

SEQ ID NO: 14576 - RNA, 64 nt, Human; identical to SEQ ID NO: 12004

SEQ ID NO: 14577 - RNA, 64 nt, Human; identical to SEQ ID NO: 12005

SEQ ID NO: 14578 - RNA, 64 nt, Human; identical to SEQ ID NO: 12006

SEQ ID NO: 14579 - RNA, 64 nt, Human; identical to SEQ ID NO: 12007

SEQ ID NO: 14580 - RNA, 54 nt, Human; identical to SEQ ID NO: 12008

SEQ ID NO: 14581 - RNA, 64 nt, Human; identical to SEQ ID NO: 12009

SEQ ID NO: 14582 - RNA, 64 nt, Human; identical to SEQ ID NO: 12010

SEQ ID NO: 14583 - RNA, 64 nt, Human; identical to SEQ ID NO: 12011

SEQ ID NO: 14584 - RNA, 64 nt, Human; identical to SEQ ID NO: 12012

SEQ ID NO: 14585 - RNA, 64 nt, Human; identical to SEQ ID NO: 12013

SEQ ID NO: 14586 - RNA, 64 nt, Human; identical to SEQ ID NO: 12014

SEQ ID NO: 14587 - RNA, 64 nt, Human; identical to SEQ ID NO: 12015

SEQ ID NO: 14588 - RNA, 64 nt, Human; identical to SEQ ID NO: 12016

SEQ ID NO: 14589 - RNA, 63 nt, Human
gaaggaggccuccucgcaccugcccuccgcugcuccucagaccccagcccccagcgagccgac

SEQ ID NO: 14590 - RNA, 63 nt, Human
uuuugcuuuucuagcugagauuucccaagugcauccucagaagcucugggugugccagaggac

SEQ ID NO: 14591 - RNA, 63 nt, Human
cuccgccuuaguuaagagcaugugucgggaaauuccucagagugcucagagucccuguauuuu

SEQ ID NO: 14592 - RNA, 63 nt, Human
ucuuccuucuccucuucagcuuuuuaaaaacaguccucagaggauccaugauccccagcacug

SEQ ID NO: 14593 - RNA, 63 nt, Human
auugacagaagcuucugcccaccuacuuuucuuuccucagaucauccagaaguuccucaaggg

SEQ ID NO: 14594 - RNA, 63 nt, Human
guccaggccagugggccugguagcacaugucuguccucagagcaggggccagaugauuuuccu

SEQ ID NO: 14595 - RNA, 63 nt, Human
uugcacauauccaaaaggugcaucccguaaugauccucagauuuggggacugaguuuggauag

SEQ ID NO: 14596 - RNA, 63 nt, Human
cccaccacaucgcagcacuuuuaccacguuuuguccucagaccccgcccaugcuguguggucu

SEQ ID NO: 14597 - RNA, 63 nt, Human
agggccuccccugcugguggcccuguccugggauccucagaagccugacuguccuaugggcuu

SEQ ID NO: 14598 - RNA, 63 nt, Human
gacagaaagacaaugugaguucauuuuccuccauccucagaccgugacaucuccccuaggcuc

SEQ ID NO: 14599 - RNA, 63 nt, Human
cagccauguggucaacaucuggaguuuuuggucuccucagagagcuccaucacaccaguaagg

SEQ ID NO: 14600 - RNA, 63 nt, Human
uaaaaaggacuguaaaaauuacccagaacagcguccucagacuuaaccuucugcaaguuaugu

SEQ ID NO: 14601 - RNA, 63 nt, Human
uuuuuuuugauccugcucuuauauucuuuuuuuuccucagagaaaucaggaggguaguuagag

SEQ ID NO: 14602 - RNA, 63 nt, Human
ucugcauugcugguacugguugcaucauccucauccucagagcuggcuucacaggcagugugg

SEQ ID NO: 14603 - RNA, 63 nt, Human
acuuaauaacacuucaccuucuguaauacuaaguccucagagcuccaugcuguucugaaaggg

SEQ ID NO: 14604 - RNA, 63 nt, Human
aaauggcauaauuauuugaaagugacaggaaucuccucagaaugaagaauaaagccuacuagg

SEQ ID NO: 14605 - RNA, 63 nt, Human
ccccgggcccucuaugccuggccagccuccagcuccucagaccuccugggugggguuuggcuu

SEQ ID NO: 14606 - RNA, 63 nt, Human
auguccuugcuacuuuuaaaaacuugcauuuauuccucagauuuuaaaaauaaauaaauaauu

SEQ ID NO: 14607 - RNA, 63 nt, Human
ucuugugagggagaucugggggaggcaggaagcuccucagauuuucucacagacccuucccaa

SEQ ID NO: 14608 - RNA, 63 nt, Human
ucaauagaccagggaaagggguuacagagagccuccucagaucuguuugugccuuucaaaagu

SEQ ID NO: 14609 - RNA, 63 nt, Human
uggguagcaucaguuaacaguuuuauggacgauuccucagaugaaaagcuucagaaaagcaua

SEQ ID NO: 14610 - RNA, 63 nt, Human
gcugaucugagcgcuuggccaaguacaaccagcuccucagaauugaagaggagcugggcagca

SEQ ID NO: 14611 - RNA, 63 nt, Human
ccugucccugccccacagaacuuccggcugguguccucagagcaagcccucaaagagcugggu

SEQ ID NO: 14612 - RNA, 63 nt, Human
agagaacaguuugugugccauuaaaacagagauuccucagaaaguucuucagggaccugguua

SEQ ID NO: 14613 - RNA, 63 nt, Human
aucaaaauagcuuuaaagaaaaaugcauacacuuccucagaucaucaaacagacucuggucca

SEQ ID NO: 14614 - RNA, 63 nt, Human
gggggcagcugucauggcuguggcgggcacuuuuccucagaguuucugccuugcgcuggucca

SEQ ID NO: 14615 - RNA, 63 nt, Human
aagacccuuccccagaggccuaccccccauauguccucagagaggcugaguguccccuccagg

SEQ ID NO: 14616 - RNA, 63 nt, Human
caggcucucaggccagcugcuugggcuucauccuccucagaucuucuguggguuucuaaagcu

SEQ ID NO: 14617 - RNA, 63 nt, Human
ugguggucugccuucuuuuuaaugguauuuucuuccucagagcagaagggcugcauuuugcuu

SEQ ID NO: 14618 - RNA, 63 nt, Human
gcuucccugccuccuccuaccuuucucuuccacuccucagaguuuucuucuccaguauccuga

SEQ ID NO: 14619 - RNA, 63 nt, Human
auaagauauacugagccucaacagauugccugcuccucagagucucuccuauuuuuguauuac

SEQ ID NO: 14620 - RNA, 60 nt, Human
agguuaucaaggacauuuaaggaauccugauccucagaacuucucugggacaauuucagu

SEQ ID NO: 14621 - RNA, 63 nt, Human
ccaugaagagacagugauccagaagaagcaucuuccucagaagaucuggggggauggaaagca

SEQ ID NO: 14622 - RNA, 62 nt, Human
agaaaauugucauuaaaugaagagaugucuaguccucagaaacuucuuuccugcccugauug

SEQ ID NO: 14623 - RNA, 63 nt, Human
uggaggguggacucuguccuggcuuguuugguguccucagauaucuuucacacaguagagcaa

SEQ ID NO: 14624 - RNA, 63 nt, Human
uugccccaccccacagcuuagguuuuucugucauccucagaucccacaggcauugcgaagaag

SEQ ID NO: 14625 - RNA, 63 nt, Human
ugaaaagcagugucuuugaucugcaacagcaaauccucagagaaaaagauucugggguuacuu

SEQ ID NO: 14626 - RNA, 63 nt, Human
cugcuauuuucuuguuuucucuaguuucucaaguccucagaacaguuucaaaucaagaaaacu

SEQ ID NO: 14627 - RNA, 63 nt, Human
cagcuucugcuccugacccccaucaggucucuuuccucagacauccccaaagcuugucugccu

SEQ ID NO: 14628 - RNA, 63 nt, Human
ggccagggcucuguucuugccacaccugcuugauccucagauguggagggagguaggcacugc

SEQ ID NO: 14629 - RNA, 63 nt, Human
cacuauuugaguuggccaagaaauaaauucacauccucagaaagugcagcauggaggaaaauc

SEQ ID NO: 14630 - RNA, 63 nt, Human
caguacucaagcacuauaagccuuagauuccuuuccucagaguuucagguuuuuucaguuaca

SEQ ID NO: 14631 - RNA, 63 nt, Human
agaaagagagagagagagagagagagagagagauccucagaguggaaggagggggaagcagca

SEQ ID NO: 14632 - RNA, 63 nt, Human
cugcucuaacaccugccuagguuuuuccuacuguccucagaggcgugcugguccccuccucag

SEQ ID NO: 14633 - RNA, 63 nt, Human
uugagauuucaucuagcucugugagagagcagcuccucagacugaccaacuccuagacaaagu

SEQ ID NO: 14634 - RNA, 63 nt, Human
cuuuagcauucauacuuugggguuaaaggagauuccucagacucauccagcccuugggugcug

SEQ ID NO: 14635 - RNA, 63 nt, Human
ucccuucccuuugaaaaucuaagaagcucccaguccucagagacccugcugguacccagaccc

SEQ ID NO: 14636 - RNA, 63 nt, Human
ugggggaugcagagccucagagcaaauaaaucuuccucagagccagcuucuccucucaauguc

SEQ ID NO: 14637 - RNA, 63 nt, Human
cucugaacugggggcucccauaagggauaauuuuccucagaguagcaaaguuucucuuauuag

SEQ ID NO: 14638 - RNA, 63 nt, Human
agcaguucaaaacuugaaagaaaacaaaaccuguccucagaauucuauaaaguguauuaagaa

SEQ ID NO: 14639 - RNA, 63 nt, Human
cuguaaggauaauggaguuccucuccucugcuuuccucagaggaugguccuuuaacauagcca

SEQ ID NO: 14640 - RNA, 63 nt, Human
uacaugugacaauugccuuaaaaccuagcacaguccucagaaaugaauaccguguuuccacug

SEQ ID NO: 14641 - RNA, 63 nt, Human
gaaaaguucccugggacugacacaaguuuauuuuccucagagccuuggaauucuauuuuauga

SEQ ID NO: 14642 - RNA, 63 nt, Human
caccuuguccuguggaagaagcacaggcuccuguccucagaucccgggaaccucagcaaccuc

SEQ ID NO: 14643 - RNA, 63 nt, Human
uuagauggcccuuguaguugcggguccuggguguccucagaacuagacaucaaugccuggauc

SEQ ID NO: 14644 - RNA, 63 nt, Human
aauaaagaagggacaacaaucugggacagugucuccucagaaacaaucggccuggaagguagu

SEQ ID NO: 14645 - RNA, 63 nt, Human
cagaguggcugcgugaaacgggaggcuggcagguccucagauagguucugcaguguuaccugu

SEQ ID NO: 14646 - RNA, 63 nt, Human
uuuaugggcauccucucuggucuuuuggauuauuccucagaacaaugaaaaaagucuccauag

SEQ ID NO: 14647 - RNA, 63 nt, Human
caacguggcuguuguucugggaaauugggaaccuccucagaucacuggauucugauggcaucg

SEQ ID NO: 14648 - RNA, 63 nt, Human
cagucugacccccuaccccuuucacccugucccuccucagaguauuuuuugaagugguugcau

SEQ ID NO: 14649 - RNA, 63 nt, Human
ugggcuucagaaguaucugcacaauuagaaaaguccucagaagcuuuuucuuggaggguacac

SEQ ID NO: 14650 - RNA, 63 nt, Human
cucuccucugauuuccagacccccucaauauccuccucagauuugcccugcacuucuuguucc

SEQ ID NO: 14651 - RNA, 63 nt, Human
aucaauuuguguagauaugucugucuuuuuggguccucagagaaaaugcccauuuucucggag

SEQ ID NO: 14652 - RNA, 63 nt, Human
uugcuucugauaaaagccuggaauuucaucugguccucagagcauugcgugugugucuugcug

SEQ ID NO: 14653 - RNA, 63 nt, Human
ggggcucucagggcugggaggaccccagugcccuccucagaagaagcacaugggcuccugcag

SEQ ID NO: 14654 - RNA, 63 nt, Human
acauugccugcuuccccccagcgccggcuucucuccucagagcgccugucacuccauccccgg

SEQ ID NO: 14655 - RNA, 63 nt, Human
agugcaagauccuguggauuagaaacaaguugcuccucagagcucucaagcagggacugcucu

SEQ ID NO: 14656 - RNA, 63 nt, Human
uuuuacuauagaucagucucaugggccaucucuuccucagauguaaaugauaucugguuaagu

SEQ ID NO: 14657 - RNA, 63 nt, Human
gacuguagaugcauuuuaaauauuuaaauaugauccucagacaugcagcuguguguggcagua

SEQ ID NO: 14658 - RNA, 63 nt, Human
ucauuugcuuuaguucuagaaucaccuguugacuccucagacuucaccuaacuuuggaaacuc

SEQ ID NO: 14659 - RNA, 63 nt, Human
uaugaccacuuuuaauacacuuuuuugagugguuccucagagaccuacuacccugguauagga

SEQ ID NO: 14660 - RNA, 63 nt, Human
ccuucagugccuucaugaauucaccuuccagcuuccucagaauaaaaugcugccugggucaag

SEQ ID NO: 14661 - RNA, 63 nt, Human
cacaguccccucaccucuggcagggcugcuaccuccucagaguuucagaagcccccacauggg

SEQ ID NO: 14662 - RNA, 63 nt, Human
ccauaauaauuguauuuguuugaaacuaagcuguccucagauuuuaacuugacucaaacauuu

SEQ ID NO: 14663 - RNA, 63 nt, Human
gagugugccauuccaggauaacagcuugcacccuccucagaauguuuucagcgaaagaguggg

SEQ ID NO: 14664 - RNA, 63 nt, Human
aggaauccaagaccccaccucuuaaggacugguuccucagaaagcacccucagggaaaaaggu

SEQ ID NO: 14665 - RNA, 63 nt, Human
agcugauguucaggccccacccacucccuacaguccucagaccaaggagggguuuggguagua

SEQ ID NO: 14666 - RNA, 63 nt, Human
ucucagaaaucuuaaugcagaaauuauauagucuccucagauuuuaauauuuuuauuucuuuc

SEQ ID NO: 14667 - RNA, 63 nt, Human
uuuccugccucagauuucagcuuaaauuuugccuccucagagagaugccuucccaaacucccc

SEQ ID NO: 14668 - RNA, 63 nt, Human
auauuuuccugacagacuugaaaacuaggaucuuccucagaugucuguaaauaacucugguau

SEQ ID NO: 14669 - RNA, 63 nt, Human
gagugcaggaucuguucugaaaggcagacgugcuccucagacaucagaacaucacauuggaac

SEQ ID NO: 14670 - RNA, 63 nt, Human
cauuucuaauaaguugaaauggucuuucucccuuccucagagagcaaccagcuucuuuuuuuu

SEQ ID NO: 14671 - RNA, 63 nt, Human
ccacuaacugaugguuccccaucucucucccucuccucagaccucacuauucucucagacaca

SEQ ID NO: 14672 - RNA, 63 nt, Human
cuuuacaacuuaacuaggaaacccaugugaggcuccucagacaggaucuugaacagcccaaag

SEQ ID NO: 14673 - RNA, 63 nt, Human
aaaacggggucuguggcgguacucugaacaauuuccucagaaccucuuaauaaauaaguuugg

SEQ ID NO: 14674 - RNA, 63 nt, Human
cacucugccaucugaguccucugccuaaagcauuccucagaacugucccauuugaagggcaag

SEQ ID NO: 14675 - RNA, 63 nt, Human
ccuccagcacccaugcccgcugcaccgcugccauccucagauucaccgcgugcucugcgcggc

SEQ ID NO: 14676 - RNA, 63 nt, Human
auguuagguuuaucauauauagucuagguguaauccucagacuaucauuuucaucuggguucc

SEQ ID NO: 14677 - RNA, 63 nt, Human
gcaugaggacauggacaauaaaguaguauaugauccucagauacagggagaaggacaaggcau

SEQ ID NO: 14678 - RNA, 63 nt, Human
cuccaauuugccucaaaccucuuacggagcuucuccucagaagugguaccaucgccuuccaaa

SEQ ID NO: 14679 - RNA, 63 nt, Human
uucaaaagauacuauucaauuuaaagcuauuuuuccucagaguuuuuguuuucuauauauuaa

SEQ ID NO: 14680 - RNA, 63 nt, Human
ccucaugaauuaaaaccucccccaagcagagcuuccucagagaaagugguucuaugaugacgu

SEQ ID NO: 14681 - RNA, 63 nt, Human
gccaugccagggaugacuagcucuuugagccuguccucagaggauggcgaggcagccgggcag

SEQ ID NO: 14682 - RNA, 63 nt, Human
ugaugaaauuuacuacuucagaaaaccaauuguuccucagaaggagccaucaccuuugcugga

SEQ ID NO: 14683 - RNA, 63 nt, Human
gaaggaauguuuguuuguacugugccaaacuguuccucagauccaauuguuagcacaaaauga

SEQ ID NO: 14684 - RNA, 63 nt, Human
agauccuuugacauguuaauucaauucuagaaauccucagaaauguuuuuauauuaugcagag

SEQ ID NO: 14685 - RNA, 63 nt, Human
accuccauuugcaauugaccucuucugggaacuuccucagauggacaagauuaccccaccuug

SEQ ID NO: 14686 - RNA, 63 nt, Human
uuacacagcaaggacugcuguguguggguguguuccucagaccaucucuacucuuuuugguua

SEQ ID NO: 14687 - RNA, 63 nt, Human
uguguguguuucaccaagauguccuuuacuguguccucagauugcagucacaaauguagucau

SEQ ID NO: 14688 - RNA, 63 nt, Human
cucuccagccagaggcugaccugagggccacuguccucagaugacaccacccaggagcacccu

SEQ ID NO: 14689 - RNA, 63 nt, Human
gugccggcaugccuccucuuccacugucguccuuccucagagggccucacgccaaacaaacgg

SEQ ID NO: 14690 - RNA, 63 nt, Human
aaguaaaaaaucugucuugauuuuguuacuuauuccucagaauauuaaacauugaucacauau

SEQ ID NO: 14691 - RNA, 63 nt, Human
aucagcaaggacccaucucugcccugggucagcuccucagaaccaacccccagcaucucuaaa

SEQ ID NO: 14692 - RNA, 63 nt, Human
agggaugaaaugaugaaugaggcauggaccuguuccucagaguuuauggcccaguagacauaa

SEQ ID NO: 14693 - RNA, 63 nt, Human
uucccucugcacccucuggaacccuggcccaauuccucagaccccagaguggccugggaccca

SEQ ID NO: 14694 - RNA, 63 nt, Human
gagcggcaacuccuggagaccacauagccugaauccucagaauuucaggccugcugggagcuu

SEQ ID NO: 14695 - RNA, 63 nt, Human
cccaagacaucauguaucgcauauuaguuaaucuccucagacaguaaccauggggaagaaauc

SEQ ID NO: 14696 - RNA, 63 nt, Human
caucauuguuauuuuaacgauaguaauucacaguccucagaagccuauuuuuaaagcagaagc

SEQ ID NO: 14697 - RNA, 63 nt, Human
ugccuucccuguccguucaccugugcaaaggcuuccucagacaugccacucuguggcucccaa

SEQ ID NO: 14698 - RNA, 63 nt, Human
aaaccuagacacaaggucaaauugcuggaagaguccucagagguccaccucuuacccuacaga

SEQ ID NO: 14699 - RNA, 63 nt, Human
ggaaccccgucaccuaauuaaaguuucucggcuuccucagagaaaugaaaacgccaugcauuc

SEQ ID NO: 14700 - RNA, 63 nt, Human
uucagagaggucucagguucuuuccaugcagacuccucagaucugaacacaguuuagugcuuu

SEQ ID NO: 14701 - RNA, 63 nt, Human
gauuuauuuagugaaggcaagugcaauaauccuuccucagaugauguuugcuuuucuaagaua

SEQ ID NO: 14702 - RNA, 60 nt, Human
cuguuaagaccuccuauugaguuuuccagguccucagaugggaauugcacaguaggaugu

SEQ ID NO: 14703 - RNA, 63 nt, Human
aaaauagucgugaaucuuguucaaaaugcagauuccucagauucaauaaugagagcucagacu

SEQ ID NO: 14704 - RNA, 63 nt, Human
caccccuccucgaagucccggcuuccaccccucuccucagagucccggcguuuaccucguggu

SEQ ID NO: 14705 - RNA, 63 nt, Human
auauccaagauuuaaaugccauagaaauguagguccucagaaaguguauaauaagaaacuuau

SEQ ID NO: 14706 - RNA, 63 nt, Human
agaauuuggccagggugggggguugagucagccuccucagagaaacugcgugagagugugugc

SEQ ID NO: 14707 - RNA, 63 nt, Human
gcauugcugcccuggggccugauguucuuggcuuccucagagcauguaacaggaaauuaaaug

SEQ ID NO: 14708 - RNA, 63 nt, Human
ccuaccccugccccaugugucccccguuaccuguccucagagccucagguaugguccaggcuc

SEQ ID NO: 14709 - RNA, 63 nt, Human
gcagagcuaagagucaaauccaggucuaugugauccucagagauuggaggccgggauggagaa

SEQ ID NO: 14710 - RNA, 63 nt, Human
cagaaggaccauucaagguucacuguuguuuuguccucagaaccaggagcuucagauccuaag

SEQ ID NO: 14711 - RNA, 63 nt, Human
cauuagugaauagaugauguuggaagucauggguccucagagugggggcuccuuaagccucca

SEQ ID NO: 14712 - RNA, 63 nt, Human
guccucccacccuuggggggcuccugccugagguccucagaaucccacugcaauggacccagg

SEQ ID NO: 14713 - RNA, 63 nt, Human
cacuguguguugacacuguuuuccuuaccuauuuccucagauccccagcuuucuccucugcua

SEQ ID NO: 14714 - RNA, 63 nt, Human
gccaguaaguacgggaaaaaauguuuacuaacuuccucagagauucgugauacgcguuucucc

SEQ ID NO: 14715 - RNA, 63 nt, Human
ugugcccacguggggacauguccuuggcgugcuuccucagaguggcuuuuccuccauuaauac

SEQ ID NO: 14716 - RNA, 63 nt, Human
gccagauuaacauuaggaaucucagugcagagguccucagaggcuccagcaucucuaguacua

SEQ ID NO: 14717 - RNA, 63 nt, Human
augugucuaaaaaagcauagcugcccuuugcuguccucagagugcauuuccuggagacggcag

SEQ ID NO: 14718 - RNA, 63 nt, Human
uuuugauucauuaaaacauuaaauaaaaagcccuccucagauuggaacccccaaaucgaugga

SEQ ID NO: 14719 - RNA, 63 nt, Human
ucagaaguguacugaagggacuggagaugguuuuccucagaugagggggccccaaaauugaua

SEQ ID NO: 14720 - RNA, 63 nt, Human
ggcacgcaagagagcuucccauugcuucugcucuccucagaggucccgggcuggauggaggcu

SEQ ID NO: 14721 - RNA, 63 nt, Human
guuguauauuuuucaugccacugcuuuguuuucuccucagaagucggguagauagcauuucua

SEQ ID NO: 14722 - RNA, 63 nt, Human
gaggccaagcgauggccgcucucuccucuccccuccucagagggggcagauagaaacugggac

SEQ ID NO: 14723 - RNA, 63 nt, Human
caguguugagaggaaaggggagguccugcugauuccucagaauggcuucuggaccuuggagau

SEQ ID NO: 14724 - RNA, 63 nt, Human
gagacaugaagauucugcucaucauugcucagcuccucagagugggccgggaggggacuagaa

SEQ ID NO: 14725 - RNA, 63 nt, Human
cuacuuugcuuccgccacucagccauuucccccuccucagauggggcaccaauaacaaggagc

SEQ ID NO: 14726 - RNA, 63 nt, Human
agcuucggcugcagccugagguguguccugggcuccucagagccugaagcaagcuuuuggaag

SEQ ID NO: 14727 - RNA, 63 nt, Human
ggaccaguagaggacacggaggguucagaccccuccucagacccuccccacaucugaaacugc

SEQ ID NO: 14728 - RNA, 63 nt, Human
cauaguguuuaaucuauggcaccaagcaucguuuccucagauuaaugagacccuucaacaagc

SEQ ID NO: 14729 - RNA, 63 nt, Human
ggugaaaaauuauccauuuccuaugcguuuuacuccucagagaaugaaaaaaacugcauccca

SEQ ID NO: 14730 - RNA, 63 nt, Human
aaaagggaugggggaaauggagauggcacgggcuccucagagcgugguagccgacugugagga

SEQ ID NO: 14731 - RNA, 63 nt, Human
uuagcauagauugagaacaguugaacucuuaaauccucagaugccaggggucugcucuagcau

SEQ ID NO: 14732 - RNA, 63 nt, Human
cuggugcccagacuccuugcauggcuugugugguccucagacuccgcacagcgagcguagguc

SEQ ID NO: 14733 - RNA, 63 nt, Human
guuuuuguuguaguuaucuucugggguuucaauuccucagaaacaacuuuuuucacaacggaa

SEQ ID NO: 14734 - RNA, 63 nt, Human
ucuggcaaguaaaggcugaggacuccucuuuaauccucagaucuagauaacucaugacauuuu

SEQ ID NO: 14735 - RNA, 63 nt, Human
gcuacuuuuaugaguuagccagaugcuuguguauccucagaccaaacugauucauguacaaau

SEQ ID NO: 14736 - RNA, 63 nt, Human
uccuguuuacugauuagagugguuauucauuauuccucagauugcugaaucccaucaggcugu

SEQ ID NO: 14737 - RNA, 63 nt, Human
gguagucuaguauggcuuuaacugaauauuugauccucagagacaguaucaugagacugcauu

SEQ ID NO: 14738 - RNA, 63 nt, Human
uaagaaagcccauaauguauuuagaaacaggaauccucagagcaauucucuguauucucauau

SEQ ID NO: 14739 - RNA, 63 nt, Human
uucuugacaagaugugauaauuccacacuuacauccucagaucucccauccagggcaaggaca

SEQ ID NO: 14740 - RNA, 63 nt, Human
accuguggugaccugacagagagaacauucagauccucagauugcacccugaugcccugguuu

SEQ ID NO: 14741 - RNA, 63 nt, Human
cccagcucuucugaguggggagucuuccaggccuccucagaggucuucccuuugccuccccag

SEQ ID NO: 14742 - RNA, 63 nt, Human
caagcaaaaggcugcaaacaacccagaagcccauccucagaagacuggagaaaugauugagga

SEQ ID NO: 14743 - RNA, 63 nt, Human
uucuuucuuuuugaaucucucaaacggcaacauuccucagaaaccaaagcuuuauuucaaauc

SEQ ID NO: 14744 - RNA, 63 nt, Human
gcccucagcugggacaguggggacccaggcuucuccucagagccaggcccugacuugccuucu

SEQ ID NO: 14745 - RNA, 63 nt, Human
ugcgagcuccacagcaacauggcaggcaggagguccucagaaggugucaggagguuccacacu

SEQ ID NO: 14746 - RNA, 63 nt, Human
acagacucugaaugccgacuguguggacucucuuccucagacuguggggacagauacaauucc

SEQ ID NO: 14747 - RNA, 63 nt, Human
uccgcccucgcccucaucuacgcugcuccgcuuuccucagaccccuuuuugccgugcaaaggg

SEQ ID NO: 14748 - RNA, 63 nt, Human
ucaguccuagauguuggcacccuuugcugugucuccucagaguauccuguuccgccuccugcc

SEQ ID NO: 14749 - RNA, 63 nt, Human
gacacauugaauccugcccgucagggcaccuuuuccucagagcaauccggccacacgaauaga

SEQ ID NO: 14750 - RNA, 63 nt, Human
accccgccaggaaacgacgagaaggccgaggaauccucagagaaguccagcucuucgcccugc

SEQ ID NO: 14751 - RNA, 63 nt, Human
aaguauuuauaaaaacacugcccucuaaaaauuuccucagaucugaaguauggucuugguccu

SEQ ID NO: 14752 - RNA, 63 nt, Human
uucuuuaacaggauuacaagugagcuggcuucauccucagaccuuuauuuugcuuugagguac

SEQ ID NO: 14753 - RNA, 63 nt, Human
auacuuuuucauucaaaauggguauucuugauuuccucagaacugauaaaaaauaaugcaaca

SEQ ID NO: 14754 - RNA, 63 nt, Human
aucaaaagccacuugcuuugaaauauguagaguuccucagaauugacggugcuagaaauaucc

SEQ ID NO: 14755 - RNA, 63 nt, Human
uucuccagcauuuuauggcuccucccucccauguccucagacccagcaaaagcguagaggcag

SEQ ID NO: 14756 - RNA, 63 nt, Human
gaucaccacaauccucuauugaacauauaaggauccucagauuuaaauaaguacuuuuuuuuu

SEQ ID NO: 14757 - RNA, 63 nt, Human
cccuaauuuauacuuacucaucuggacagcaucuccucagauggugaauuaugugcacgggga

SEQ ID NO: 14758 - RNA, 63 nt, Human
uuuauuccccagugggcaguuacugagcuuuccuccucagagccaugcuggcagcccugggac

SEQ ID NO: 14759 - RNA, 63 nt, Human
guuauguucccagcagugggggucagacgcccuuccucagaacuuucuaguugcccucuaccu

SEQ ID NO: 14760 - RNA, 63 nt, Human
uacuaucuccuuggaauccacauuuggguuaacuccucagauuuggaguggcaaggauaaaag

SEQ ID NO: 14761 - RNA, 63 nt, Human
cagcuuuaauggguguggccccuuuaggguuaguccucagacuaaugauagugucugcuuucu

SEQ ID NO: 14762 - RNA, 63 nt, Human
ugagagugagcugcuuuuaaagaaaguggagccuccucagaccccugccuuggcuuucccaga

SEQ ID NO: 14763 - RNA, 63 nt, Human
aucugaggcaaaagaaacacaauuacaguuagcuccucagaaaggugaaugugagcaagaacg

SEQ ID NO: 14764 - RNA, 63 nt, Human
uagucuuaaaauguaaauaaaaugugaaacguguccucagagacugugccauuucuauuaugu

SEQ ID NO: 14765 - RNA, 63 nt, Human
aguguuacacacuuccuggaggagcuaaggaaauccucagacuccuggguuuuuguuguugcu

SEQ ID NO: 14766 - RNA, 63 nt, Human
aagaagagcaagagaaaaagcaaauuugaaaaauccucagaucauguaucuagaacaggaguu

SEQ ID NO: 14767 - RNA, 63 nt, Human
gugauguaccuaaaagucagaaaccacauuuucuccucagaaguagggaccgcuuucuuaccu

SEQ ID NO: 14768 - RNA, 63 nt, Human
gcugaguucuggguuucuagaggucaggacggcuccucagagcgccaggaagccagagcccca

SEQ ID NO: 14769 - RNA, 63 nt, Human
gagagccaguccggucccagcuccuuugucccuuccucagaggccuuccuugaagaugcaucu

SEQ ID NO: 14770 - RNA, 63 nt, Human
cucugguuacagauugucuugaucucuuggaucuccucagaucuuugguuuuugcuuuaauuu

SEQ ID NO: 14771 - RNA, 51 nt, Human
cacaccaucuugagccuuagcuccucagaccuucagugaggcuucuaaugg

SEQ ID NO: 14772 - RNA, 63 nt, Human
acuaguuugcuuguguguagagaguguauugcuuccucagauuucacuguuuucaucuccuuu

SEQ ID NO: 14773 - RNA, 63 nt, Human
agacaacacaaccaacgcgaaaccaauuccucauccucagaugcucaaaguuguuuuuuuugu

SEQ ID NO: 14774 - RNA, 63 nt, Human
uuuuuaccuguuaacaucucacccagcuaguguuccucagaacaaagauuggaaaaagcuggc

SEQ ID NO: 14775 - RNA, 63 nt, Human
auuguuugucucauaugcauuauuugcauuuuguccucagagauuuccaauggugaauuuacu

SEQ ID NO: 14776 - RNA, 63 nt, Human
gcugaaccugucugacccggucacguucuuggauccucagaacucuuugcucuugucggggug

SEQ ID NO: 14777 - RNA, 63 nt, Human
cuggaggcgucagggaccccacauccucccugcuccucagacucacagccccuccauguuacc

SEQ ID NO: 14778 - RNA, 63 nt, Human
aagaaauccuuuaaauuaccuauggaagugauguccucagauaaucuuaaugacuauuuuggc

SEQ ID NO: 14779 - RNA, 63 nt, Human
uugcuucaguuuuuuaucauggggagaucuuuuuccucagaauuguuuucuuuucacuguagg

SEQ ID NO: 14780 - RNA, 63 nt, Human
uuaggagcccuagggccuggaaggagaguaugguccucagaucccccuucucuccugcuuccu

SEQ ID NO: 14781 - RNA, 63 nt, Human
auuaggcccagaauggcugaggcuuggagcaucuccucagacagagcagaggcgacaccucuu

SEQ ID NO: 14782 - RNA, 63 nt, Human
aacaucugagaaaauguaccaagugguuguguguccucagauguguggggaggauccaucccc

SEQ ID NO: 14783 - RNA, 63 nt, Human
cccccaagcaguggcccuggcccuaccccagccuccucagaacaggggugaccacugcagggg

SEQ ID NO: 14784 - RNA, 63 nt, Human
gauucuccaaagaaauauaauuuugguuuuuguuccucagagagaguuugaaagaaauuuuca

SEQ ID NO: 14785 - RNA, 63 nt, Human
aaaucuaaauccguuuagaaucaucuauuuaacuccucagagacaugcacaaacuauucuaga

SEQ ID NO: 14786 - RNA, 63 nt, Human
aaguauucuuguugcacuuaauuagccuguauauccucagaacuuuguguaaugccuggagca

SEQ ID NO: 14787 - RNA, 63 nt, Human
ugucccucccagaugggcugggccuuugggcccuccucagaguaugccuggguacaaaccuca

SEQ ID NO: 14788 - RNA, 63 nt, Human
ucuguggugucaggcacugggcuguguccugauuccucagaguauggggaccugacaucuuug

SEQ ID NO: 14789 - RNA, 63 nt, Human
uuuguguuuucugcgucgugucauuggauauaauccucagaaauaaugcacacuagccucuga

SEQ ID NO: 14790 - RNA, 63 nt, Human
gcuggagcggggaggcgaggagggggcugugaguccucagaggcccugggccaccacauuucu

SEQ ID NO: 14791 - RNA, 63 nt, Human
uucacugucacgggggaaggagccaccagccaguccucagauuucagagacugcggaggggcu

SEQ ID NO: 14792 - RNA, 63 nt, Human
auuguuugugccaguacaugaccuuaacuuccuuccucagagcacugagcugccaucugggcu

SEQ ID NO: 14793 - RNA, 63 nt, Human
gacuggcagcuccacugccgucaacuccuguucuccucagagccugguaacucacuuuuauuu

SEQ ID NO: 14794 - RNA, 63 nt, Human
cuaccggcccauguuucuauuugcauuucccccuccucagaugggaagccuggcaaagcugcc

SEQ ID NO: 14795 - RNA, 63 nt, Human
ugugccccuccuuccuaaccugaggccugggguuccucagaccaucuccuucauucugggcag

SEQ ID NO: 14796 - RNA, 63 nt, Human
guuaaaaacuaaagcucaaguucacuaccucuuuccucagaauaaaggaagaaggggaggaag

SEQ ID NO: 14797 - RNA, 63 nt, Human
acauacuauugugaguucucagagcaugaacuguccucagaagagcagggcuaggacuugucc

SEQ ID NO: 14798 - RNA, 63 nt, Human
uaauaaccagggauuaaugaaaaucaaguuccauccucagacaagagguaaaguucacacauu

SEQ ID NO: 14799 - RNA, 63 nt, Human
agcccggcccagggugaaggaagaggcacgugcuccucagagcagccggagggaggggggagg

SEQ ID NO: 14800 - RNA, 63 nt, Human
cugcacugcagccaggggggauaccagcuucauuccucagaguaaaccaaccuugggagcugu

SEQ ID NO: 14801 - RNA, 63 nt, Human
uggggaaggcuggcacccaccaagaaguggaaguccucagaaauucucggcacacccuagagu

SEQ ID NO: 14802 - RNA, 63 nt, Human
acccacaugugagcagcccaggcccaucggugcuccucagagguaggugcucccucaggauca

SEQ ID NO: 14803 - RNA, 63 nt, Human
aaagucccaguacaacuuccauugcugagaaaauccucagaggacuuucccacuucgcuccug

SEQ ID NO: 14804 - RNA, 63 nt, Human
aagguuguuuaagaugcagauuccagcauccccuccucagagaucaauuucagcagggccagg

SEQ ID NO: 14805 - RNA, 63 nt, Human
cugccucgcagagcccuacacucccgcagccgcuccucagaggccugugcccaucgcaggccu

SEQ ID NO: 14806 - RNA, 63 nt, Human
gauugauauuuuugugguagggaagugggaugcuccucagauauuaaagguguuagcugauug

SEQ ID NO: 14807 - RNA, 63 nt, Human
ucacaucacauuuccaugacaauccccuuugauuccucagaaucuggccuuccuuuauagcac

SEQ ID NO: 14808 - RNA, 63 nt, Human
uaagaaaaauaggauuaagcuauucuguuccaguccucagagaaauaaucacuuucuuaaacu

SEQ ID NO: 14809 - RNA, 63 nt, Human
cuucugaaaaaagagucguucccucuguuucuguccucagaugaugucccucccccuaccugu

SEQ ID NO: 14810 - RNA, 63 nt, Human
cuaucuuccagggggagggcccugcagccucgcuccucagaugucugcacugagccaguucag

SEQ ID NO: 14811 - RNA, 63 nt, Human
ucaaaagaggcucacucaaaccagcacagggaguccucagaguugcaguucaauucauuuuaa

SEQ ID NO: 14812 - RNA, 63 nt, Human
gccccagggcgcuuagggagaaaugacccagccuccucagaccccgccugccuguccugugcc

SEQ ID NO: 14813 - RNA, 50 nt, Human
cgccaggguuggaugauuaauccucagaacaauggagcaauaaagcagaa

SEQ ID NO: 14814 - RNA, 63 nt, Human
gugaugcggucacccugcaaaagacuugcacuuuccucagaaccaacaugacgcagcucaaua

SEQ ID NO: 14815 - RNA, 63 nt, Human
ccuaagauuucugguaaaccugaaggguggcccuccucagacaauuuaucucccagcaaugac

SEQ ID NO: 14816 - RNA, 63 nt, Human
gggcaaaauagauagaauuaaaugcaugaauuuuccucagacuuauuuuaucugccucuguaa

SEQ ID NO: 14817 - RNA, 63 nt, Human
uacauauacggagggggaucuuacucuucccauuccucagaccagcaggaaaagaggggagac

SEQ ID NO: 14818 - RNA, 63 nt, Human
uucccaucgcuggaaaacagcugcuguuagauguccucagaagucaguugcaaauuuuagcgu

SEQ ID NO: 14819 - RNA, 63 nt, Human
cuggggagcggcgucucagugaaaucggcuuucuccucagacucugucccugguaaggaguga

SEQ ID NO: 14820 - RNA, 63 nt, Human
ccgccucaccucacaggagggccaggcauguauuccucagaggcgaaacugccaaacucuuuc

SEQ ID NO: 14821 - RNA, 63 nt, Human
uucugccugaagaaggcuuucccaggaugcacguccucagagggagcagccuaucucccccaa

SEQ ID NO: 14822 - RNA, 63 nt, Human
ugccaagugguuuauaugcccagccucauuuaauccucagaaugacuccaugagguagcuacu

SEQ ID NO: 14823 - RNA, 63 nt, Human
auuugucugcuuuuuauuuacccuuguauguuauccucagagggaagaugauaauauauaaau

SEQ ID NO: 14824 - RNA, 63 nt, Human
cugggucuaaccuacauagguaauuuaagaacauccucagaaaggacagcugaaggcaauagg

SEQ ID NO: 14825 - RNA, 63 nt, Human
uuaucucugacaguuuuuaguuaaauguuuagauccucagaacuacauuagugccuacuauua

SEQ ID NO: 14826 - RNA, 63 nt, Human
cuggcucuuaucaguguuaauagcaucucagcuuccucagaucaguucuaucacuggcacuac

SEQ ID NO: 14827 - RNA, 63 nt, Human
gguuccaucaacuuggacaaccugcagucccuguccucagacagugccaccauggccaugcag

SEQ ID NO: 14828 - RNA, 63 nt, Human
auccauuacucaagucccaaggugaccucucucuccucagauuuccuucuuggcccugugccc

SEQ ID NO: 14829 - RNA, 63 nt, Human
gccucuccuuuguagucguacauuauguguuucuccucagaagugaucaggucuuuacugaau

SEQ ID NO: 14830 - RNA, 63 nt, Human
ccuaggcauacucuccaggauuguccacaaauguccucagagggucccuaggugggucaacuc

SEQ ID NO: 14831 - RNA, 63 nt, Human
uuuacucucccuuccugaaccgcucuggucugcuccucagagagggcagcggugccaggccuc

SEQ ID NO: 14832 - RNA, 63 nt, Human
ugaaaccuacaguaaauggguaugauuguagcuuccucagaaaucccuuggccuccagagauu

SEQ ID NO: 14833 - RNA, 63 nt, Human
uauauauuugugugaggaggaaauucauaacuuuccucagauuuucaaaaguauuuuuaaugc

SEQ ID NO: 14834 - RNA, 63 nt, Human
aaacacugacucugagaccaugaccuuggaagauccucagagaucaacuagccaagucacuca

SEQ ID NO: 14835 - RNA, 63 nt, Human
uggagaucugagccucaggaugcaggagccuccuccucagacccuguucuuggccuuccaucc

SEQ ID NO: 14836 - RNA, 63 nt, Human
caccccuuccugcugacauucccaucacaacauuccucagacaagccuguaaacuaaaaucug

SEQ ID NO: 14837 - RNA, 50 nt, Human
gucagaccaacagccagugauccucagauggugcuggaucugggucauca

SEQ ID NO: 14838 - RNA, 63 nt, Human
uggggucccagcugccugccugccucuuaggaguccucagagagccuucugugccccuggcca

SEQ ID NO: 14839 - RNA, 63 nt, Human
auaaaauugaaaauguuaaaaaaucauuuuuuuuccucagaguuaaaauuauuucccucauac

SEQ ID NO: 14840 - RNA, 63 nt, Human
cccaccccacagcccacucucaggcaggaacaauccucagaggggaagugcccaucuagccau

SEQ ID NO: 14841 - RNA, 63 nt, Human
aggaucuuuggaaucucuugguuccuaagaguuuccucagagaucauaccuccccagagggaa

SEQ ID NO: 14842 - RNA, 63 nt, Human
aaccccuuuuagcuucuccuagcaacaucuguguccucagaaaccucugguucucccccuucc

SEQ ID NO: 14843 - RNA, 63 nt, Human
gacccuggcccccaguaguguguccuggggacuuccucagagcgagaaaccucccccaauguc

SEQ ID NO: 14844 - RNA, 63 nt, Human
uuguaauguccucuccaucauccucagugugaguccucagagccuccaucugccaagaacauu

SEQ ID NO: 14845 - RNA, 63 nt, Human
ugcggcugucaccuuccuccucccacuucuguauccucagagaugcugcguggauguuuccuu

SEQ ID NO: 14846 - RNA, 63 nt, Human
aacucaacaauaccugcuucccaauuacucauuuccucagauaagaagaaaucaucucuacaa

SEQ ID NO: 14847 - RNA, 63 nt, Human
guccagcauccaagacguuucgguuaugucggguccucagaucgccucugacuuguuaccaca

SEQ ID NO: 14848 - RNA, 63 nt, Human
uucccugcagccaugcggcagagcuggcauuucuccucagagaagcgcugugcuaaggugauc

SEQ ID NO: 14849 - RNA, 63 nt, Human
gaggccugguuugcucuuaauuaauauaugaacuccucagaccuuaaaccuuuuccuaagcuu

SEQ ID NO: 14850 - RNA, 63 nt, Human
uggaagacaagcagaaaagcugaagacaauaguuccucagacagaccucaauaugguaagaaa

SEQ ID NO: 14851 - RNA, 63 nt, Human
caguauuaugaaaauagcuugaccucguggacuuccucagaggguuggucccuggaucacacu

SEQ ID NO: 14852 - RNA, 63 nt, Human
ucccucagcuacccuggaucuuugcccaccucuuccucagagcccccacugaggggccguagc

SEQ ID NO: 14853 - RNA, 63 nt, Human
uccugagugcagggguagucccucucaccugcuuccucagacgacucuggaagcuucccucua

SEQ ID NO: 14854 - RNA, 63 nt, Human
augcuucccuccauacuuuuuauuugcucuguuuccucagauuuauuuugucuugccccauug

SEQ ID NO: 14855 - RNA, 63 nt, Human
gagacagagugcugaggggcacucuccccugaauccucagagaguugucuguccaggcccuua

SEQ ID NO: 14856 - RNA, 63 nt, Human
cuggagguugggggcaggaucuggcccgagcucuccucagaccuccccagaccugucuucuca

SEQ ID NO: 14857 - RNA, 63 nt, Human
aaaguugaacugggcuaccucucuacagcuguuuccucagagggaaaaaucuugagaccagau

SEQ ID NO: 14858 - RNA, 63 nt, Human
agguggugcuuacuaauuaccuucucaggauuuuccucagauugaaaagcuuaugaggauuuc

SEQ ID NO: 14859 - RNA, 63 nt, Human
gggcugccagggugggagaggagcaucaccagcuccucagagccacuccgcuccauaucagua

SEQ ID NO: 14860 - RNA, 63 nt, Human
augaagggccuggagguugggguaucuuggagcuccucagagcccuucuucccaucaaaaagg

SEQ ID NO: 14861 - RNA, 63 nt, Human
ucucagccagcucuuuuaauugacacagaaacauccucagagaucagugggaucaacauugug

SEQ ID NO: 14862 - RNA, 63 nt, Human
uccuguccuuucacauuguuuuuugcuaccucuuccucagaauauauuugccaccauggucaa

SEQ ID NO: 14863 - RNA, 63 nt, Human
uugauauuccuuguuccacagugcuauggaucuuccucagaagaacaugaaguugcuucugug

SEQ ID NO: 14864 - RNA, 63 nt, Human
gacagaugguuuccccauccacugaguguagcauccucagagguaggcaaguuugcuucuagg

SEQ ID NO: 14865 - RNA, 63 nt, Human
uggucuggccuuuccugagaggcaggucuuccguccucagagccuuucuggaacaaggagaau

SEQ ID NO: 14866 - RNA, 63 nt, Human
guuuuccaaagugucugagcauaugccuggcuguccucagaucaucaccaugccacaucccug

SEQ ID NO: 14867 - RNA, 63 nt, Human
uucagcgccgaccuggaaugguaacuuuuucccuccucagaugaccuuacuuccacugccucc

SEQ ID NO: 14868 - RNA, 63 nt, Human
acuauaguacaggcuuuuagcaccgaagugugguccucagaccagugccugccaaccagaugu

SEQ ID NO: 14869 - RNA, 63 nt, Human
ugucagugauuuauaagcuauaaaugaccaagguccucagacugcuuuuagcaucugcaacuu

SEQ ID NO: 14870 - RNA, 63 nt, Human
caaucacuauuuauaaacagagcuuucaaacacuccucagaauauucuucuaaguauuuugau

SEQ ID NO: 14871 - RNA, 63 nt, Human
agaaccuaucagcaacuagaaagucuaugcacauccucagauauugguagaguauucagugcu

SEQ ID NO: 14872 - RNA, 63 nt, Human
caauugaucuaagcauagccugaauuaugauguuccucagagaagugaggugggaaauaugac

SEQ ID NO: 14873 - RNA, 63 nt, Human
uugcauuucuuccauugugaauacgaauuuucuuccucagaaaugcuccaccuguaagaacag

SEQ ID NO: 14874 - RNA, 63 nt, Human
guccugcagcccuuauucccuccauagaaagcauccucagagcaccuucccuggcuuccuacu

SEQ ID NO: 14875 - RNA, 63 nt, Human
ugaaagauuuucuaaaguagucuuucaaacuguuccucagaggccuaggauuuuccaaaagua

SEQ ID NO: 14876 - RNA, 63 nt, Human
acaaccugacugcacaaggacuggguagcagacuccucagaguccucuugacacaaaugucag

SEQ ID NO: 14877 - RNA, 63 nt, Human
augcugcuggcggacauccuaaaaccagaugcauccucagaggacgagucuacuaauuauugc

SEQ ID NO: 14878 - RNA, 63 nt, Human
uugaaugcugcauguaaagccuuuaaagcaaaauccucagaaauggucuaaauaaaacacuug

SEQ ID NO: 14879 - RNA, 63 nt, Human
uuucuucuccgagaucccaggacuaucuuauuuuccucagaggggcagguuacaagaacuuca

SEQ ID NO: 14880 - RNA, 63 nt, Human
cccaucuuccauuucuuagguaagaagagcauuuccucagacucccaggcggaggacugagcc

SEQ ID NO: 14881 - RNA, 63 nt, Human
aggucaagugcccaacugcagaccaacuaccccuccucagacaacagccucuacaccaacgcc

SEQ ID NO: 14882 - RNA, 63 nt, Human
guacugcuuuggagagugaaugcugccaagaguuccucagauuacaaacagcaguggugccau

SEQ ID NO: 14883 - RNA, 63 nt, Human
uggcucagccugcagcgacugugaggccacagcuccucagauucacugcccgcugugugccag

SEQ ID NO: 14884 - RNA, 63 nt, Human
uuuaugaagccuuaacuaauucuuguuuuugcuuccucagaaacuuuuuauugcaucugccau

SEQ ID NO: 14885 - RNA, 63 nt, Human
accaggauguagaaaacuagaaagaacugcccuuccucagauauacucuugggagagagcaug

SEQ ID NO: 14886 - RNA, 63 nt, Human
guugauuuguagcuguggaucaugaacacugaauccucagaucacucugacuucuuaugcuuc

SEQ ID NO: 14887 - RNA, 63 nt, Human
cuucagaagagaauccccaccaacuucugugccuccucagauggggauuuaucuggaucucug

SEQ ID NO: 14888 - RNA, 63 nt, Human
gagguucccgcuugcugccuucagccagggcgcuccucagagcucuauuuuccugcagacacc

SEQ ID NO: 14889 - RNA, 63 nt, Human
uuucucugcuuucagagaaacccuucccgccuuuccucagagugcuucccaaacugagguccc

SEQ ID NO: 14890 - RNA, 63 nt, Human
ggagcccccgcauaucagcaguucacccaguacuccucagagacugguuucccucuaaaccca

SEQ ID NO: 14891 - RNA, 63 nt, Human
augcgucccagccagccccgucgcucucguccauccucagagacaaagaagagggcagggagu

SEQ ID NO: 14892 - RNA, 63 nt, Human
auuuuggaagacagguuuuuuaaagaaacauuuuccucagauuaaaagaugaugcuauuacaa

SEQ ID NO: 14893 - RNA, 63 nt, Human
uccucagccucacccugcauagcuugcacaacauccucagaaccauucacuggcaaauggagg

SEQ ID NO: 14894 - RNA, 63 nt, Human
ggaagaguuugccaggcagcuacagcucucugauccucagacgguggcuggugccuuuggcua

SEQ ID NO: 14895 - RNA, 63 nt, Human
aggguugagaagaaagagaaauuguccaaagaguccucagaaccugccuggagaaaugcgcau

SEQ ID NO: 14896 - RNA, 63 nt, Human
gaggaggaggcugggauccucuggcugagaaucuccucagagcccagugcagaagcugugaug

SEQ ID NO: 14897 - RNA, 63 nt, Human
cucuggcuuugcaggcccagcuccaggcccugcuccucagagagacucuuccagagcuggagc

SEQ ID NO: 14898 - RNA, 63 nt, Human
uuucuaaguaucaguuugauaacuuuauauuauuccucagaagcauuaguuaaaagucuacua

SEQ ID NO: 14899 - RNA, 63 nt, Human
uaacaguugaagaaaaaauggcaagagaucauauccucagaccagguggaauuacuuaaauuu

SEQ ID NO: 14900 - RNA, 63 nt, Human
uucuccauaaaaugggcuuuccucugucugccauccucagagucuggggugggaguguggacu

SEQ ID NO: 14901 - RNA, 63 nt, Human
gccacuuuuagguggaucaaaagaccuuucagauccucagaaccuugagacauaauacaguug

SEQ ID NO: 14902 - RNA, 63 nt, Human
ccgagugcccugggggucaccccuccccuccccuccucagagcccacccugagaggcagcagu

SEQ ID NO: 14903 - RNA, 63 nt, Human
cuggguggugggaugggagaccauccucagcccuccucagaccuuaucaauucauugagagau

SEQ ID NO: 14904 - RNA, 63 nt, Human
ucuggcccucgcaccacugugacucugccaucuuccucagacggaggcugggcgugggggggg

SEQ ID NO: 14905 - RNA, 63 nt, Human
gcugcuacucggggcuccaggugugugaauugguccucagauagucaggccuggguggaggga

SEQ ID NO: 14906 - RNA, 63 nt, Human
ucccccuuuacuaccuguucuuguagaucuagcuccucagaguuggaggaaggcugacagaga

SEQ ID NO: 14907 - RNA, 63 nt, Human
gaguggacgugcccagcuguccccccaggccucuccucagagggcggcacaggcugggcucca

SEQ ID NO: 14908 - RNA, 63 nt, Human
agaaagccugggcaccucccacucgauuccugcuccucagaccuccgggaaucagugucuuac

SEQ ID NO: 14909 - RNA, 63 nt, Human
aaaagauugagagaauuugugcccccaaccauuuccucagacucuaagaaagaacacgcucuc

SEQ ID NO: 14910 - RNA, 63 nt, Human
cuuugagguaacauggucuggugguggcaugaguccucagaagguauuuguaauaagguucca

SEQ ID NO: 14911 - RNA, 63 nt, Human
cgcggagaccuccugacaacgucucuucaagcauccucagaagccucgacugagcuuuagaca

SEQ ID NO: 14912 - RNA, 63 nt, Human
ugccgucauacaguuacaggaaaaauaagaacuuccucagaaagaacagguccgaauucuucc

SEQ ID NO: 14913 - RNA, 63 nt, Human
cuccucuccaggcccuuguucgccuccccacccuccucagaggcccggggaagggaagagcag

SEQ ID NO: 14914 - RNA, 63 nt, Human
ccacuuaagaaauaaagagcugguagaauugcauccucagaugauuauugacugugugugugu

SEQ ID NO: 14915 - RNA, 63 nt, Human
uggaggcaucuuacauuuaggcuacuucaaguauccucagaaauguauucugcacccccggcc

SEQ ID NO: 14916 - RNA, 63 nt, Human
auggacacacauaccuggccacgaacccacaccuccucagacacucagacaccacuccaggcu

SEQ ID NO: 14917 - RNA, 63 nt, Human
gcucuaggauaacuggcacccagagaaaaggacuccucagaaaaaacaggcccccaugugccu

SEQ ID NO: 14918 - RNA, 63 nt, Human
ugaucaaagaugauguuucccucuuuuuacuuuuccucagaagauugagcugucuuuuauuug

SEQ ID NO: 14919 - RNA, 63 nt, Human
ggagauuuuaaaaauucugaugauuagacugaauccucagacguucugguuugauuguugugg

SEQ ID NO: 14920 - RNA, 63 nt, Human
gaggguaugaagagcugucuuccccugagaguuuccucagaacccacagugagaggggagggc

SEQ ID NO: 14921 - RNA, 63 nt, Human
cucccacacacacacccgcacugcccaggucccuccucagaccuccagcccugggacagggca

SEQ ID NO: 14922 - RNA, 63 nt, Human
aucaccagcaaacgccaggacuuggcucccccauccucagaacucacaagccauugcucccca

SEQ ID NO: 14923 - RNA, 63 nt, Human
cuccagaccccaccuugucuucccucccuggcguccucagacuuagucccacggucuccugca

SEQ ID NO: 14924 - RNA, 63 nt, Human
uuggucuuuaaugaaaagcugaauccagaucauuccucagaaugaggacccgaggacaguggc

SEQ ID NO: 14925 - RNA, 63 nt, Human
ucacguaccggggcacuuaaugauaagcagucauccucagaucauuaucagccugugccacga

SEQ ID NO: 14926 - RNA, 63 nt, Human
accagcugccuccacagacagcugagugcccuguccucagauggggagggacagggucggccu

SEQ ID NO: 14927 - RNA, 63 nt, Human
uugcuucuuguaugcauugugaccgaccccacuuccucagaauguaacggggccagagggaaa

SEQ ID NO: 14928 - RNA, 63 nt, Human
cgcgcugcuuuggugagacacccccaugcaagguccucagaguagccggguucuaccacaaac

SEQ ID NO: 14929 - RNA, 63 nt, Human
agagaguguuuugccagggacacagucuguuccuccucagaaaacaccccccaaaugcuaaca

SEQ ID NO: 14930 - RNA, 63 nt, Human
aacugaugacacaguagcacugauucugucuuuuccucagaaucuggccuuuuuccauggcaa

SEQ ID NO: 14931 - RNA, 63 nt, Human
gccaucuccucugugcccucugguggcucauuguccucagagcccagacaguuccagccacua

SEQ ID NO: 14932 - RNA, 63 nt, Human
agcugcagguuccuuaucugucacaccugugccuccucagaggacaguuuuuuuguuguugug

SEQ ID NO: 14933 - RNA, 63 nt, Human
uguuugaugcugccguuugccgcugccggccccuccucagacuccgccuuugggagcacaccu

SEQ ID NO: 14934 - RNA, 63 nt, Human
uggguaaagggacaguuacaaaccaggucaccauccucagaggcugagcccuguacccacccc

SEQ ID NO: 14935 - RNA, 63 nt, Human
gguugaagugcucuggggagaauucguagaucauccucagaaaagccuugcccugguguucua

SEQ ID NO: 14936 - RNA, 63 nt, Human
ugcaaacuuuaaagucugucguggauuuauuuauccucagauuauuguuacugcauuaaaucu

SEQ ID NO: 14937 - RNA, 63 nt, Human
uggaggcaucuuacauuuaggauacuucagguauccucagaaauguauucugcaccccccggc

SEQ ID NO: 14938 - RNA, 63 nt, Human
acaaucacucucugugggggguggcccugcugcuccucagaauccuggugccuugaaguucuc

SEQ ID NO: 14939 - RNA, 63 nt, Human
cagcuccugccaaauuaugcauuaguaacuuuuuccucagagacaccccuaaaggcucccauu

SEQ ID NO: 14940 - RNA, 63 nt, Human
cuucccagcucuugccaguuuuaaagacacgauuccucagaccagugagcaaaaggaauauga

SEQ ID NO: 14941 - RNA, 51 nt, Human
auacuccucugucuaccuaaauccucagaaagccuugccuuuagagaacgu

SEQ ID NO: 14942 - RNA, 63 nt, Human
caggguuaccgaagaggggccaagaaauuagaguccucagaagagaacuuaucuagugaggau

SEQ ID NO: 14943 - RNA, 63 nt, Human
auuauucucugcauuccuuccggggggagccuguccucagaggggacaaccugugacacccug

SEQ ID NO: 14944 - RNA, 63 nt, Human
gcgugaaccccagggaacagcgggucccuucccuccucagacacaagccaccucagcuugugg

SEQ ID NO: 14945 - RNA, 63 nt, Human
uggaggcaucuuacauuuaggauacuucaaguauccucagaaauguauucugcacccccggcc

SEQ ID NO: 14946 - RNA, 63 nt, Human
gaauaauggcccccaaagauaucuguguccuaauccucagaaccugugacuguuaccuucugu

SEQ ID NO: 14947 - RNA, 63 nt, Human
ccugccaacuuguaacuuaauaaauacaggaaauccucagagaaggugauauuuucaggaaaa

SEQ ID NO: 14948 - RNA, 63 nt, Human
cagcgggaccccuucaucuguuggccuuaccuguccucagaaaggaagaggugaccccaccca

SEQ ID NO: 14949 - RNA, 63 nt, Human
uaguucuugaaggagccccaucaauccuauuaauccucagaauuccagugggagccucccucu

SEQ ID NO: 14950 - RNA, 63 nt, Human
ggcccccgacaccggacagggguugaggggaccuccucagaggcccugggcacgggagggggu

SEQ ID NO: 14951 - RNA, 63 nt, Human
ccccaggacggcccugcccucgaccuucccaccuccucagauccugcaaggcuggggucugcc

SEQ ID NO: 14952 - RNA, 63 nt, Human
uagauauaaaaaugauugugcccuaaccaaacuuccucagauugugcacuguuuguuuaaaau

SEQ ID NO: 14953 - RNA, 63 nt, Human
agaaauguacaccacuccucaugugccauuuuguccucagagggcggcuuuacuuuuuuggua

SEQ ID NO: 14954 - RNA, 63 nt, Human
aagcugucuagguccguccggugugucagauuuuccucagauuagaugugccaauaaccaagu

SEQ ID NO: 14955 - RNA, 63 nt, Human
aaaguauggaugacucgguaucugcuuuguuauuccucagaaauacugcacugaguauaugcc

SEQ ID NO: 14956 - RNA, 63 nt, Human
cgcacugaaagcagacaagacuccuuagaacuguccucagauuuccuuccacccauuaaggaa

SEQ ID NO: 14957 - RNA, 63 nt, Human
gauuaaguucauuucucuuuuacacuuuuguacuccucagagcagugcucccagcauuguuuu

SEQ ID NO: 14958 - RNA, 63 nt, Human
guaucgccuauacauggcagaggacugaacaccuccucagaagucagcgcaggaagagccugc

SEQ ID NO: 14959 - RNA, 63 nt, Human
ugaguggcaggggcaggagaggggagaaccccauccucagagcugcucccagccagcgaguca

SEQ ID NO: 14960 - RNA, 63 nt, Human
aggggugcucuucaagacuuagacuucccauuuuccucagaaaauccacacagcacagaauau

SEQ ID NO: 14961 - RNA, 63 nt, Human
uggggggcucagaggggagacacaccuacugcuuccucagaugggccccuccgcagccccuuc

SEQ ID NO: 14962 - RNA, 63 nt, Human
cgaguauggaguacuugaauaauugaccugaaguccucagaccugagguucccuagaguucaa

SEQ ID NO: 14963 - RNA, 63 nt, Human
gcuguuccaccuucccucgugcuguuccaccuuuccucagacuauuuuucagccuucuggcau

SEQ ID NO: 14964 - RNA, 63 nt, Human
caaagagugacgaggccccgugggagaacggacuccucagacucuccccaauagcggaagucg

SEQ ID NO: 14965 - RNA, 63 nt, Human
ugggugugguggugcaccgccuguggucccagcuccucagagguugaguagaggcugagguga

SEQ ID NO: 14966 - RNA, 63 nt, Human
agcggucuuaacaauguaaagaaugugcaaauguccucagacaagaugcacaccuugcucauu

SEQ ID NO: 14967 - RNA, 63 nt, Human
ugcguccuccccaaagccaugggagggguguccuccucagaccaugcccccagaugauuuuuu

SEQ ID NO: 14968 - RNA, 63 nt, Human
uagauauauauauauauauaaauaauauacuuuuccucagaggagcaggcaacagugugggau

SEQ ID NO: 14969 - RNA, 63 nt, Human
aucgagaauaucccccaaaucacuugucucuguuccucagaguuguaggucuccagauauguc

SEQ ID NO: 14970 - RNA, 63 nt, Human
ggggccucccggggcccaggacucuggcuucucuccucagacuucuauuuuuuaaagacugug

SEQ ID NO: 14971 - RNA, 63 nt, Human
gcugggcuggcauucccucccaaccugaacugcuccucagagccaucuccugaacccacaaau

SEQ ID NO: 14972 - RNA, 63 nt, Human
gggcgaggaggccagugguggggacgcagaggguccucagagcaggagugacaagggaggaaa

SEQ ID NO: 14973 - RNA, 63 nt, Human
accuuacuauuucuuuuguuccaaguuuguauuuccucagaguucucacauauggaaaggaua

SEQ ID NO: 14974 - RNA, 63 nt, Human
ugaugcagccgcgggcccagggugcuguugguguccucagaagugccggggauucuggacugg

SEQ ID NO: 14975 - RNA, 63 nt, Human
uccugugccgcgcacucacggagcugcguagucuccucagacauagucaaagcuuugccgaga

SEQ ID NO: 14976 - RNA, 63 nt, Human
gacagcaaucacgguucugccccucucucccuguccucagacccuggaaaagugaaccacaag

SEQ ID NO: 14977 - RNA, 63 nt, Human
ucaugacuuccucucggcuaucacucaccccuguccucagagugauaaacuaagucacauaca

SEQ ID NO: 14978 - RNA, 63 nt, Human
guugcaccuuuucacagacgguuccccacagcauccucagacagcucugugauguagcuuuua

SEQ ID NO: 14979 - RNA, 63 nt, Human
ggggagcccaagggcuguuucugccacuugcucuccucagaguuggcuuuugaaccaaagugc

SEQ ID NO: 14980 - RNA, 63 nt, Human
aacaaaaaaaaaauaaauuuuuuugcaauccuuuccucagaccuggcuccaggcuaacuggaa

SEQ ID NO: 14981 - RNA, 63 nt, Human
cugccuacauucuuguucuagaagcacaaaaaauccucagaugaauuagaagaaagagguuug

SEQ ID NO: 14982 - RNA, 63 nt, Human
cuugguaauaaguuucuuuuagcuuguacagcauccucagaccaacugaggagcuuuccuugu

SEQ ID NO: 14983 - RNA, 63 nt, Human
ccacugacccacaucuggucuuagucauuggucuccucagauuucuggggccaccugcaagcc

SEQ ID NO: 14984 - RNA, 63 nt, Human
uucaagcacauuccauuuucuucugaucauacuuccucagaaaaccuuuuuuuggcugggugu

SEQ ID NO: 14985 - RNA, 63 nt, Human
aggaugcccaauuagggccuagccuuaaucagguccucagagaauuucuaccauuucagagag

SEQ ID NO: 14986 - RNA, 63 nt, Human
uggcccuagagacacuagagucaccagccaccauccucagagcuuugaacuccccauuccaaa

SEQ ID NO: 14987 - RNA, 63 nt, Human
ggaggugagcuggcgcccucuaguggagaagaauccucagagcauccugaagccccauucucc

SEQ ID NO: 14988 - RNA, 63 nt, Human
ccucguggucucuugucucuuuuuggaccaauauccucagauuggugcagcuuuuucaguuca

SEQ ID NO: 14989 - RNA, 63 nt, Human
uacugcucuucccccacauuaauaccuuuuccuuccucagagagaaaucuccccuaaccugaa

SEQ ID NO: 14990 - RNA, 63 nt, Human
caggagucggcaugugcccaucagagagacggcuccucagaugcucagcuaagccuaagcgcu

SEQ ID NO: 14991 - RNA, 63 nt, Human
caagucuuuaguguucaaauacuucaaaucauauccucagauauauuuuuagcccaugguuuu

SEQ ID NO: 14992 - RNA, 63 nt, Human
gaaggccagcaggagccgggggcaggcccaggauccucagaggaagauggagaggagcuucgg

SEQ ID NO: 14993 - RNA, 63 nt, Human
gagcacagacgcgccagggagcccccucugugcuccucagaguucaauaaaugucguggcccc

SEQ ID NO: 14994 - RNA, 63 nt, Human
ugugucuuacuagaaacaacgcaaaccucuccuuccucagaauagugauguguucgacguuuu

SEQ ID NO: 14995 - RNA, 63 nt, Human
cgguuucauugaaauuaaauccaaaaaguuauuuccucagaaaaaucaaauaaaguuugcaug

SEQ ID NO: 14996 - RNA, 63 nt, Human
cuaauaugaucuaaaacccuaaaugguuauuuuuccucagaaugauuuguaaauagcuacugg

SEQ ID NO: 14997 - RNA, 63 nt, Human
uuucuuguguuugagaaccaugacuuaugacuuuccucagaacaugagacuguaaaacaaaaa

SEQ ID NO: 14998 - RNA, 63 nt, Human
cugcuucugcaacacaaaucggaacaggagcgauccucagagaguuuacaaugugcuuuuucc

SEQ ID NO: 14999 - RNA, 63 nt, Human
gaaggaugaagagcaaggcccucaggacccguguccucagagcaccacacacugagcacccag

SEQ ID NO: 15000 - RNA, 63 nt, Human
uugucauuuuacaaggaagaaccucuuaagaaguccucagaaccagaagcaaugugaacucuc

SEQ ID NO: 15001 - RNA, 63 nt, Human
cucccucgugggccagugaaaauagacuguagguccucagagccuucagagaugauccagccc

SEQ ID NO: 15002 - RNA, 63 nt, Human
uuucucaacuuuuaauagcaaaaagugccaaaguccucagagaccuaacagccuuggucuacc

SEQ ID NO: 15003 - RNA, 63 nt, Human
cagcccccgccgaccguggcguuggcccugcuguccucagaggaggaggaggaggaggcagcu

SEQ ID NO: 15004 - RNA, 63 nt, Human
ugcgggggaguggagcccccgugccccugcuuuuccucagauccguucuuucucuguguuguc

SEQ ID NO: 15005 - RNA, 63 nt, Human
uggggaucucuuuaguccuggcuucccuugggcuccucagagcuaguggggaaggaggcaguc

SEQ ID NO: 15006 - RNA, 63 nt, Human
cgcuccacuuugagcucccccacccccuccagguccucagaguuugcagaucugggcuuucua

SEQ ID NO: 15007 - RNA, 63 nt, Human
cuacagcuuggaaacuaugcaaauggucuagauuccucagagcucacaugauaggauauaguu

SEQ ID NO: 15008 - RNA, 63 nt, Human
acauuuuuuuuaaaggccagucuuauccugaauuccucagagcagucuguaugguaggccauc

SEQ ID NO: 15009 - RNA, 63 nt, Human
gacaacuccuaugauugaaucuaugggaauuauuccucagaagagaauuuaaagguguaccca

SEQ ID NO: 15010 - RNA, 63 nt, Human
uacuuguuuaaaaauccacauucuuggacccaauccucagaugcacggauucagucuucaggg

SEQ ID NO: 15011 - RNA, 63 nt, Human
uccugccagucuuucucuucaagccagggugcauccucagaaaccuacucaacacagcacucu

SEQ ID NO: 15012 - RNA, 63 nt, Human
agagacccuagguacugccuucuaacuccugcauccucagaaggggaaaagggacugggaagu

SEQ ID NO: 15013 - RNA, 63 nt, Human
aaauuucugacugucaguagaagugagauaagauccucagaggaaacaguaagaagggauaau

SEQ ID NO: 15014 - RNA, 63 nt, Human
ugaauaucucuuuugugucuccuuccuaagccauccucagagaguccuuagcagacaaauggu

SEQ ID NO: 15015 - RNA, 63 nt, Human
gggucacauuuugucuaucuucaaccuaguuccuccucagaucacucugggcuacagcauccc

SEQ ID NO: 15016 - RNA, 63 nt, Human
ugugugugugugugugugugugugucuugugcuuccucagaccuuucucgcuucugagcuugg

SEQ ID NO: 15017 - RNA, 63 nt, Human
accagcagcacuuggggugaggccuccaaagcuuccucagaauuguggcugugccacgcugga

SEQ ID NO: 15018 - RNA, 63 nt, Human
gaaggggaugugcuggggguccagaccccauauuccucagacucaacaauucuuguucuuuag

SEQ ID NO: 15019 - RNA, 63 nt, Human
ccacagucgggaagguuuaauguuuagacucuuuccucagaggcuuuuaacuacacacaauuu

SEQ ID NO: 15020 - RNA, 63 nt, Human
cagagaagccucaccauugacuucuuccccccauccucagacauuaaagagccugaaugccuu

SEQ ID NO: 15021 - RNA, 63 nt, Human
gaccugucugucccaacuguuugaacagugugcuccucagauucuguguucagaaggauuugc

SEQ ID NO: 15022 - RNA, 63 nt, Human
cucaguuuucaacucuucccugaacuuccugcuuccucagagggccauugaacucugagagau

SEQ ID NO: 15023 - RNA, 63 nt, Human
ugccguuuuuaaaaucuuccaaaugccuuuuuuuccucagaggcagagaaugacuaaguacgg

SEQ ID NO: 15024 - RNA, 63 nt, Human
cuggggacuugagacuuuggucccagcccagacuccucagacuuuucucucaguugggaugcu

SEQ ID NO: 15025 - RNA, 63 nt, Human
ugcuggucuuguugccgcacagauuccugaccauccucagaaucucaugccauuuucccgcag

SEQ ID NO: 15026 - RNA, 63 nt, Human
aguaauaaaagucugcacuuuggucauuucuuuuccucagaggaagccugagugcucacuuaa

SEQ ID NO: 15027 - RNA, 63 nt, Human
ccuuuaaaaguuccgaguugaaacugaaggcucuccucagaccuggcuuuuuccucagucccu

SEQ ID NO: 15028 - RNA, 64 nt, Human
cuggggcuucccaagagccuguggcuguggugccgggcuccagacacuucacggaaggaagauc

SEQ ID NO: 15029 - RNA, 64 nt, Human
cacugggggucuuccuccaccucccacuuuccaagggcuccaggaaucuggggccugaccacag

SEQ ID NO: 15030 - RNA, 64 nt, Human
agcaguacccaggcuuugcagaccacgcggggcagggcuccacugaagccacccccaccccucg

SEQ ID NO: 15031 - RNA, 64 nt, Human
gccaccugccacuuugcccugcccucugccuccagggcuccacuccccuuccuuuucuugguga

SEQ ID NO: 15032 - RNA, 64 nt, Human
cuuuuuuauggaguuggccaauaggauugaguuggggcuccaguagagaaggcaggguuggugg

SEQ ID NO: 15033 - RNA, 64 nt, Human
cccugggguuuugugcccacucucugagaaguuggggcuccaucaagccccauucuagucaugu

SEQ ID NO: 15034 - RNA, 64 nt, Human
ucaucagugccugccagaagcugugucucucauugggcuccaaagaggugggauuuuuuaaaac

SEQ ID NO: 15035 - RNA, 64 nt, Human
accuugccucucuggaaucugucaacccaguuuugggcuccagguggauggguugcuuuauaaa

SEQ ID NO: 15036 - RNA, 64 nt, Human
uggggagaggcauggagaagaaacucucauucaggggcuccaggauccuucuccuugaggcuuc

SEQ ID NO: 15037 - RNA, 64 nt, Human
cuucuccuuuuggggugagagaccagcagcccaagggcuccagacacaccugaacacaucguga

SEQ ID NO: 15038 - RNA, 64 nt, Human
aucaccuggagggcuugguaaaacacagauuuuugggcuccacuccaaggguuucugacccaag

SEQ ID NO: 15039 - RNA, 64 nt, Human
cuaggggagcaccgugauggagaggacagagcaggggcuccagcaccuucuuucuggacuggcg

SEQ ID NO: 15040 - RNA, 64 nt, Human
ucuggacuggcguucaccucccugcucagugcuugggcuccacgggcaggggucagagcacucc

SEQ ID NO: 15041 - RNA, 64 nt, Human
cgggcaugcgccgggggccgucccaaaccucgcagggcuccagcaggccaaccggcaccacgga

SEQ ID NO: 15042 - RNA, 64 nt, Human
gccuggccugagcuggggccacaaaucaaagcaagggcuccagcauccagccuguguguucugu

SEQ ID NO: 15043 - RNA, 59 nt, Human
gcuacgcguacaugcagugagccccucucgggcuccaccguccagcugucuguccgucc

SEQ ID NO: 15044 - RNA, 64 nt, Human
aaucacucguguccccagggacuucuaaagcuuggggcuccaggaaaucauccaguagaguugg

SEQ ID NO: 15045 - RNA, 64 nt, Human
cugggcccgcuuagcccaccaggcaugaggccaagggcuccacugaccaggaggccgaggucuc

SEQ ID NO: 15046 - RNA, 64 nt, Human
ggggccggggacccagugagccgagaggcccucugggcuccacuuaugcauaugcaccaaaaaa

SEQ ID NO: 15047 - RNA, 64 nt, Human
gccuggcagccaugaagcaggcugaaaggcagaggggcuccagguccuguuuccagcuccccuc

SEQ ID NO: 15048 - RNA, 64 nt, Human
agcuccccccgccaaaaaaaaugggucuccuucugggcuccaggauugucuccccacuccagca

SEQ ID NO: 15049 - RNA, 64 nt, Human
accagggucccugucugggagcucagacuuagcugggcuccagcagccuggcuccggacucucg

SEQ ID NO: 15050 - RNA, 64 nt, Human
auuuggggauucacugcaugaaguuguucauuuggggcuccaguuuuugugcauuuccagacca

SEQ ID NO: 15051 - RNA, 64 nt, Human
gcauaauugccugcagcaggaacaucucuucacugggcuccaccugcucacccgccugcagauc

SEQ ID NO: 15052 - RNA, 64 nt, Human
cagaaauuaucccccuacaaccccagccuccugagggcuccaugcugaaggcucccauuuucag

SEQ ID NO: 15053 - RNA, 64 nt, Human
uccuuuccaaacagcagggugacuuuagaggcaugggcuccaaccccuuagcucugucugagaa

SEQ ID NO: 15054 - RNA, 64 nt, Human
ugaccuuuaccuccaacccuucuguucaucgggagggcuccaccaauugagucucucccaccau

SEQ ID NO: 15055 - RNA, 64 nt, Human
ucuacuuagccagaugcuuggccuggugggaccagggcuccacagaggccacaaaauguugcaa

SEQ ID NO: 15056 - RNA, 64 nt, Human
acugcuucuagaauuacaugcugggcacugggccgggcuccagggauaagguggggaaaaagac

SEQ ID NO: 15057 - RNA, 64 nt, Human
gaagacuuggggcuugggaagagagggcugugcugggcuccagucacccugucugcaguccgga

SEQ ID NO: 15058 - RNA, 64 nt, Human
gguuucagucuggacuuauacagggaggccagaagggcuccaugcacuggaaugcggggacucu

SEQ ID NO: 15059 - RNA, 64 nt, Human
uuuugcacauagaucaaaauagaguggagaauuugggcuccaaaaaucagguuaguaggcucau

SEQ ID NO: 15060 - RNA, 64 nt, Human
cgcucccuccacuggcccuccaggucgauucccugggcuccaggcucccccgcgcgggcgccgc

SEQ ID NO: 15061 - RNA, 64 nt, Human
caagaugccaucccuucuuuuuguguggggucaugggcuccaaaagccaacgugaacaauuaaa

SEQ ID NO: 15062 - RNA, 64 nt, Human
uuagucaucugaauaugcugugcagaaaaaauaugggcuccagugguuuuuaccaugucauucu

SEQ ID NO: 15063 - RNA, 64 nt, Human
cuccagagcaaggagaauucugccuuaaucuguugggcuccagucuccggguugaauuccagug

SEQ ID NO: 15064 - RNA, 64 nt, Human
ucugucaucccgcuccugcugaaacaccucccaggggcuccaccuguucaggagcugaagccca

SEQ ID NO: 15065 - RNA, 64 nt, Human
ggcuauggugugagagcccccguccugcccucuggggcuccacaggccccuggcaaggccgaug

SEQ ID NO: 15066 - RNA, 64 nt, Human
ggcuuuucuaucacucccaccucccccagagucagggcuccauugcugagugccccauccugga

SEQ ID NO: 15067 - RNA, 64 nt, Human
uguauuaaacaccagguaauaugugcaaaaccgagggcuccaguaacaccuucuaaccugugaa

SEQ ID NO: 15068 - RNA, 64 nt, Human
ucccuccuuccccaguuguucccuucagacucaggggcuccaccaaugccaucccaaaacaggg

SEQ ID NO: 15069 - RNA, 64 nt, Human
augggguccuugugcgguggggaccggggccggcgggcuccaggccagcacaccuaacccaugg

SEQ ID NO: 15070 - RNA, 64 nt, Human
gaagcagggaaggcuggugcgaucuccauuccuugggcuccacguccgaguucauggugcgccg

SEQ ID NO: 15071 - RNA, 64 nt, Human
aauguacaauauguguccaugagaauguaggaaugggcuccagagagaagacauuuauauuaug

SEQ ID NO: 15072 - RNA, 64 nt, Human
ccucuguugggaggaaucucuguaauuccugcuugggcuccaaauuucugaagaguaauauuuu

SEQ ID NO: 15073 - RNA, 64 nt, Human
cacaagucccagcgcggcugcuucugccacugcugggcuccacuuggcuccucucacuucccag

SEQ ID NO: 15074 - RNA, 64 nt, Human
accagaagccaccuuuuucucccccgcuggccaggggcuccacacagacuaacguaggcacuau

SEQ ID NO: 15075 - RNA, 64 nt, Human
guguccuacauagagcagcaacuuuaucugcggugggcuccaagcuagauuuccgacagcauua

SEQ ID NO: 15076 - RNA, 64 nt, Human
guaaaaagcuucuuuuaccuaacccaccucccaagggcuccauuuguaaaaguacagaccagaa

SEQ ID NO: 15077 - RNA, 64 nt, Human
ccuuccgcugcggcuccagauagauggggaugccgggcuccaggccgaccagcacuugggaucu

SEQ ID NO: 15078 - RNA, 64 nt, Human
ccucccucuccuggcccagcaguauugcucacgggggcuccagccgccggcguggcccucauga

SEQ ID NO: 15079 - RNA, 64 nt, Human
gaacccuaaagaguagaugguugcccugcaucuugggcuccaucggccgaaacuuucccaagcc

SEQ ID NO: 15080 - RNA, 64 nt, Human
ucauuaguaauaaggagaggguugggggugggcagggcuccagaaagucagcagugugccuggg

SEQ ID NO: 15081 - RNA, 64 nt, Human
ccauccugcgacccucacuggccuggccuugugggggcuccagaaaagaggcuaggagaggcca

SEQ ID NO: 15082 - RNA, 64 nt, Human
acucuucuuggugggggcuccuagcuguggcugggggcuccaggcgccccugugauuaccuccu

SEQ ID NO: 15083 - RNA, 64 nt, Human
agauucaauuccuguaacccaagacugagucuuagggcuccagucuccaccugcuugguuuccu

SEQ ID NO: 15084 - RNA, 64 nt, Human
gauaucggaugucguuuaaccugggcucgugguagggcuccagcauuucucccuccuuccuggu

SEQ ID NO: 15085 - RNA, 64 nt, Human
aucagugcucugaguaggcugucaucagaacaaagggcuccacugcugacaagguuugagaacu

SEQ ID NO: 15086 - RNA, 64 nt, Human
ccacucguuccccuccucuuccgagcugcuuugugggcuccaggccuguacucaucggcaggcg

SEQ ID NO: 15087 - RNA, 64 nt, Human
agaaggcaaaaagacauuaccaugaguaauaagggggcuccaggacucccucuaaguggaauag

SEQ ID NO: 15088 - RNA, 64 nt, Human
gcuggccccaugugcucaaggggaucuaauguuugggcuccaaacuaaccaucucggagcuggg

SEQ ID NO: 15089 - RNA, 64 nt, Human
gcacaaaccaauuaaacccaguaguggugacugugggcuccauucaaagugagcuccuaagcca

SEQ ID NO: 15090 - RNA, 64 nt, Human
guagguuucccagggaagggggguggggguaggugggcuccacaggaugggggaggagcauguc

SEQ ID NO: 15091 - RNA, 64 nt, Human
agccacagugggaugaaccagccggggccuuaucgggcuccagccaucucaugaggggagagga

SEQ ID NO: 15092 - RNA, 64 nt, Human
ccaccuuccgcucccugccaccauccuccuuccugggcuccaggaaaguguuucugggagguca

SEQ ID NO: 15093 - RNA, 64 nt, Human
auauauuuuaccuaucagagacaucuauuuuucugggcuccaacccaacaugccaccauguuga

SEQ ID NO: 15094 - RNA, 64 nt, Human
uuuauaauaaaagccuuacggacaaaccuacugugggcuccagccuuuguccugagauagccaa

SEQ ID NO: 15095 - RNA, 64 nt, Human
guuuaacuuccacuuccaugcuaucggauguguugggcuccaugcaagaacuuggaagaaaaac

SEQ ID NO: 15096 - RNA, 64 nt, Human
cccaaucccagaaacccaggaccaagcugugccugggcuccaaggacaggaacacugguccccc

SEQ ID NO: 15097 - RNA, 64 nt, Human
ugcggcagggcaggagcuuggcagagagauagccgggcuccagggaguggggaggagagagggg

SEQ ID NO: 15098 - RNA, 64 nt, Human
acagucacaguguagaggcugcaggugcacacgugggcuccagugggacugcgcucugggagac

SEQ ID NO: 15099 - RNA, 64 nt, Human
cucuuguaaaaacagcccugaguagguauuuccagggcuccacaaaguugcuuaugggaauccu

SEQ ID NO: 15100 - RNA, 64 nt, Human
ugcuucucccccaugccucacuggucccagaucagggcuccagggacagaugaugagucucaaa

SEQ ID NO: 15101 - RNA, 58 nt, Human
cauguccaaaaggaaaauaagacucuaggggcuccagauaauaagguaaauuuaagag

SEQ ID NO: 15102 - RNA, 64 nt, Human
caaaguagacacuuggucucaugaagccacugcugggcuccagagagaagggaaaacuaagagg

SEQ ID NO: 15103 - RNA, 64 nt, Human
gggcuucuuagauaagaaaacguagcuucagugggggcuccaggguugcagaguaugagugaca

SEQ ID NO: 15104 - RNA, 64 nt, Human
aggaccgaggcacagaggugcggugacuugcccggggcuccagguagccugcagguuaacuggc

SEQ ID NO: 15105 - RNA, 64 nt, Human
cauuccccaccccaccuugccucuguccugcgcugggcuccaggacggucaguccucccggauc

SEQ ID NO: 15106 - RNA, 64 nt, Human
gggccagucauggcuguccccugcaaguggacgugggcuccagggacuggaguguaaugcucgg

SEQ ID NO: 15107 - RNA, 64 nt, Human
uuaaacuccugggcuccagcaauuaucccagcuugggcuccaaaagugcugggauuacaggcau

SEQ ID NO: 15108 - RNA, 64 nt, Human
guucccuauguugcccagcuggucuuaaacuccugggcuccagcaauuaucccagcuugggcuc

SEQ ID NO: 15109 - RNA, 64 nt, Human
uaagaugugcugcuuaccgagguaucacgggguggggcuccagcuugggucguugaagcugggg

SEQ ID NO: 15110 - RNA, 64 nt, Human
cuuccuguucaagcuguguccagcuuuuccccuggggcuccaggaccuucccuaccuccaccac

SEQ ID NO: 15111 - RNA, 64 nt, Human
augucaccacuucacucaggcugcagcccucuuggggcuccaggauuugcugaaagagaaaaag

SEQ ID NO: 15112 - RNA, 64 nt, Human
aaguccacaggacgcacagcccaggccacagccagggcuccacggggcgcccuugucucaguca

SEQ ID NO: 15113 - RNA, 64 nt, Human
gcacagaggccagucccacuaaggugaccagagugggcuccaagcacaaacugccauuggcuau

SEQ ID NO: 15114 - RNA, 64 nt, Human
gcacaaacauggcucacuacagccucgcucucccgggcuccagugauccucccgccucagccuc

SEQ ID NO: 15115 - RNA, 64 nt, Human
caaccuaacccccucaggggcagggaacaggggagggcuccacaagcgugucuggcauucccac

SEQ ID NO: 15116 - RNA, 64 nt, Human
agugaccugcaaggagagaaaugcaaccauacaugggcuccagucaacuaugggacugaagguc

SEQ ID NO: 15117 - RNA, 64 nt, Human
uagcccucagcucuccggucucugcugaugaaaugggcuccagguggcagugcccgggucccag

SEQ ID NO: 15118 - RNA, 64 nt, Human
cacucaaguggacaggggaaaaaguaauugccaugggcuccaaagaauuugcuuuauguuuuua

SEQ ID NO: 15119 - RNA, 64 nt, Human
auauuccggguaauugaaagaaaauauaauggaugggcuccauuaaaaccagcucaaaaauaaa

SEQ ID NO: 15120 - RNA, 64 nt, Human
caugaaggccauguagcccggccugcggaacccggggcuccagggucuggggcagcuugggcac

SEQ ID NO: 15121 - RNA, 64 nt, Human
gacuuaggugugaagacccagacaggacugcagagggcuccagaguggagaucccacauauuuc

SEQ ID NO: 15122 - RNA, 64 nt, Human
gcgggcgggaggaagggcacagcaggagcggucagggcuccaggcauccccggggaagaaagga

SEQ ID NO: 15123 - RNA, 64 nt, Human
ggacuuggggcucucucccccagcuucuacaccugggcuccaagucugaguucccacaggggac

SEQ ID NO: 15124 - RNA, 64 nt, Human
accgacugaagccaggcagggucugggauccucagggcuccaccucuccaucuggaagccggag

SEQ ID NO: 15125 - RNA, 50 nt, Human
auuggucaguguuuuccuaggggcuccaaggcuguuccuagaagagggca

SEQ ID NO: 15126 - RNA, 64 nt, Human
ugauuguguucagagagaaagguuaugauuaaaugggcuccagaucucuuauugcccuuauucc

SEQ ID NO: 15127 - RNA, 64 nt, Human
ucacuacaaggacacccaaggggugucugagucagggcuccaauagugcaguuaucguggccuc

SEQ ID NO: 15128 - RNA, 64 nt, Human
gacuagcugugcauggcaccugcucugauccggugggcuccacggguagugcgaccucgguucu

SEQ ID NO: 15129 - RNA, 64 nt, Human
ucauuaagugguuaaacauaauacuuggaagaaagggcuccaugugccuagaagagagguacug

SEQ ID NO: 15130 - RNA, 64 nt, Human
ccaacccucccugcuaaccccuucuccgccaggugggcuccagggcgggaggcaagcccccuug

SEQ ID NO: 15131 - RNA, 64 nt, Human
uggcagcacagcccagggccugcaugggggcaccgggcuccaugccucuggaggccucuggccc

SEQ ID NO: 15132 - RNA, 64 nt, Human
acugguccgagaagggacaugugggacgugagccgggcuccaacagccucugugagagaugccc

SEQ ID NO: 15133 - RNA, 64 nt, Human
uuccuccagugacagcagccucaguagcuuuccugggcuccaggcggcuggcugcacacccugc

SEQ ID NO: 15134 - RNA, 64 nt, Human
uuuuucaccuaucuccuuccugucaaggcaggccgggcuccagggcuccccuugcguggggcau

SEQ ID NO: 15135 - RNA, 64 nt, Human
gacgggcugggggagggacggccauggcacuugggggcuccagggugacucccaugaggccucc

SEQ ID NO: 15136 - RNA, 64 nt, Human
cuggaagcucggcgaauucucaggauggcggcuggggcuccaggcggcugcggcagcucuggua

SEQ ID NO: 15137 - RNA, 64 nt, Human
cuguguccccuccccagccauccucccgccuugggggcuccaugaaggaugcaggcuuccaggc

SEQ ID NO: 15138 - RNA, 64 nt, Human
cugaggcucaagaggcccagggagcaaugggagggggcuccauggaggaggugucccaagcuuu

SEQ ID NO: 15139 - RNA, 64 nt, Human
cucagcugcccugggggcugcuuucccugggcacgggcuccagggaucaucucugggcacuccc

SEQ ID NO: 15140 - RNA, 64 nt, Human
gggucccucggucucccuugcaccaggcacccuugggcuccaggggagggugcgugggggcggu

SEQ ID NO: 15141 - RNA, 64 nt, Human
cguuaggcagagagcucagauggcccuuuuaagggggcuccaagaaccaacaucacugcucuuu

SEQ ID NO: 15142 - RNA, 64 nt, Human
uucagccgugucccgggccccagcauuuugccccgggcuccagcaucacuccucugccaccuug

SEQ ID NO: 15143 - RNA, 64 nt, Human
agauguucuagcugagagggccuggcccuggggugggcuccaggaaaacgcugguuaggccugg

SEQ ID NO: 15144 - RNA, 64 nt, Human
gcugcucggccucccugcagcucagcgcagcccagggcuccaagugaggcccagaagcccaugg

SEQ ID NO: 15145 - RNA, 64 nt, Human
uggcagcuucaaaacagaacggguucucccaugggggcuccagacauuguauuuuacuuugugc

SEQ ID NO: 15146 - RNA, 64 nt, Human
uucaacauauuauccaggcuggugucgaauuccugggcuccagggauccacagucccccuuggc

SEQ ID NO: 15147 - RNA, 64 nt, Human
gcccugcccagcccugcucugcccagcccagcaggggcuccaggccuuggcuggccccacaucg

SEQ ID NO: 15148 - RNA, 64 nt, Human
ugggcccccccaguuauugauaccccucugugcugggcuccacgcuaggcagaaggaggagugg

SEQ ID NO: 15149 - RNA, 64 nt, Human
cugcaucugcccccuucuuaccucgugcccugcagggcuccagggcuauuuggagggaccuugg

SEQ ID NO: 15150 - RNA, 64 nt, Human
aaguuggccaauuucaccccauuuucugugguuugggcuccacauugcaauguucaaugccacg

SEQ ID NO: 15151 - RNA, 64 nt, Human
gaggucuggcagagcugagagccauggccugcaggggcuccauaugucccuacgcgugcagcag

SEQ ID NO: 15152 - RNA, 64 nt, Human
ccgcacccagcggcaaagagcccuccccccugcagggcuccacccaucacccucccuccgucug

SEQ ID NO: 15153 - RNA, 64 nt, Human
gugguccccagcuggugacugcucaggaguuugggggcuccaggacagugggcccggggccugg

SEQ ID NO: 15154 - RNA, 64 nt, Human
ugggaagcuaccacggauugggcugcggggucaggggcuccagcauccgagcuggcgaggaaac

SEQ ID NO: 15155 - RNA, 64 nt, Human
cauuguauuuauaugugagggauggauggcugcggggcuccaaguaaguuauugggauguuuuu

SEQ ID NO: 15156 - RNA, 64 nt, Human
cgcuucaguguaaacaacgugccuuguccacuuugggcuccagagucuuucagauguacuaagc

SEQ ID NO: 15157 - RNA, 64 nt, Human
cucccucucucucccucucucuuuacccuccccagggcuccaucuccgccucaggggcuucucc

SEQ ID NO: 15158 - RNA, 64 nt, Human
gagaaucguagccccagagcugcccaaguucacugggcuccacccccaccuccaggaggggagg

SEQ ID NO: 15159 - RNA, 64 nt, Human
ccccagccucaguuccugcuucuggucuucuccugggcuccacucaggggaggugcuuggccaa

SEQ ID NO: 15160 - RNA, 64 nt, Human
guuuuaauccuugcuuugguuuggaacugccuucgggcuccagaacuuaaauugcuugguccgu

SEQ ID NO: 15161 - RNA, 64 nt, Human
cucgcuucaugcucacacaggcuauggggauggugggcuccaggucagcucugcaaggggcuug

SEQ ID NO: 15162 - RNA, 64 nt, Human
ggacgccuccaccuuucagccugcccucggucuugggcuccacugggccccuggccucgggagc

SEQ ID NO: 15163 - RNA, 64 nt, Human
uugcuuugaagauggcgcucugggcaugagcauggggcuccaugacuucccuucuauccccaug

SEQ ID NO: 15164 - RNA, 64 nt, Human
acaaccgaucuggucuguugguuugaggaugaaggggcuccauuucugcugccucccugcugag

SEQ ID NO: 15165 - RNA, 64 nt, Human
gagccugccccuuuucuucaagggacugucuugagggcuccaaaguauagcuaacuagucaccu

SEQ ID NO: 15166 - RNA, 64 nt, Human
gggaacccaggagacugcugugugaccucagacugggcuccacacucuugggcuucagucugcc

SEQ ID NO: 15167 - RNA, 64 nt, Human
auuucuucuguuuugagagccuccaguuaaaauggggcuccaguaccagagcagcuagcaacuc

SEQ ID NO: 15168 - RNA, 64 nt, Human
cgagauuccucagcuucugaguaggaaacacuccgggcuccagguuucugguugggaagggaag

SEQ ID NO: 15169 - RNA, 64 nt, Human
ggaccuguggguggcucaggcccaagcagaccccgggcuccaccccagccccgcccaggcugcu

SEQ ID NO: 15170 - RNA, 64 nt, Human
uacuccccggccugcacacacccacagucucacugggcuccacccucacuuacugcccgccgug

SEQ ID NO: 15171 - RNA, 64 nt, Human
cacccaccccacagcaccaucaggcagcacccaugggcuccaccagcccagcucugucccuccc

SEQ ID NO: 15172 - RNA, 64 nt, Human
ugcucagccgccugggacccaccagggugcagcugggcuccaggguccagcccacaagcugcau

SEQ ID NO: 15173 - RNA, 64 nt, Human
auguuuugaugcugugugcuuuuggcugggccucgggcuccaggcccugggaccccuugccagg

SEQ ID NO: 15174 - RNA, 64 nt, Human
auaagcuggcuugcuacuucccuacaucucugaagggcuccaccauuccucuagcaaccaugcu

SEQ ID NO: 15175 - RNA, 64 nt, Human
gagaugucuucugggagccacugggcaauugccagggcuccaggaagggcucuggcucagguug

SEQ ID NO: 15176 - RNA, 64 nt, Human
gggggcaggcagaggggguggggagaaguuuccugggcuccaucaauggcugcaucuuuucugg

SEQ ID NO: 15177 - RNA, 64 nt, Human
ccacuaccugaugggcacauggacaggcugcagagggcuccagguucugggccccuggcugaga

SEQ ID NO: 15178 - RNA, 64 nt, Human
gcaugcccagugauccugguucccuggcuuguaggggcuccagagccugcuuccugguuccuca

SEQ ID NO: 15179 - RNA, 64 nt, Human
aaauugcaaaaacccaucuucauuccuuuuuauggggcuccaggucauaaggaugagauauauu

SEQ ID NO: 15180 - RNA, 64 nt, Human
ggaugauuuuugccauucccagaacuuuaaagaugggcuccacugucuucuggcucccaugugu

SEQ ID NO: 15181 - RNA, 64 nt, Human
uuagcgccgacucuuccuguggagucugagggaggggcuccauucaggcaaagggguuuuagcu

SEQ ID NO: 15182 - RNA, 64 nt, Human
agcuaaagacgacugagaagaggugcaaggaagcgggcuccaggagcaagcucaccaggccucu

SEQ ID NO: 15183 - RNA, 64 nt, Human
uugaacaucccacguuggaagaagauacauuugggggcuccaggacuacaguagaaaaguauag

SEQ ID NO: 15184 - RNA, 64 nt, Human
uaucugccugcggggcuggggaggcaggccaaaggggcuccacaugagagguccugcaugcccc

SEQ ID NO: 15185 - RNA, 64 nt, Human
acauuaugaggcucugauuuccuaucccaguuuagggcuccagaaaagccauucucccaaacua

SEQ ID NO: 15186 - RNA, 64 nt, Human
uuggcuuggcaugccuucucagacagcacggccugggcuccaacucuucaccacacccuguauu

SEQ ID NO: 15187 - RNA, 64 nt, Human
auucccuccacagcucucaccucaugucguggcugggcuccaugagguugcccgauguguggau

SEQ ID NO: 15188 - RNA, 64 nt, Human
ggucccuguuaggguucuacucgggggagggagggggcuccaugaaagguacgucugaaaaguu

SEQ ID NO: 15189 - RNA, 64 nt, Human
cgcagaguucugcucccugaggggggcccgggaggggcuccagcaggaggccgugggugccauu

SEQ ID NO: 15190 - RNA, 64 nt, Human
gcauagcuccuuucagccucuagccuucacuccugggcuccaaaagcuaucccaguugccuguu

SEQ ID NO: 15191 - RNA, 64 nt, Human
uccccauugagguugggguaggugggggcggugagggcuccacguugucagcgcucaggaaugu

SEQ ID NO: 15192 - RNA, 64 nt, Human
cucuugcccauggcuaugaugucagacaguggaugggcuccagcaacaagagacaaaauaacua

SEQ ID NO: 15193 - RNA, 64 nt, Human
ccaccuccgggcucuggguuccucugcccuggaagggcuccaggacccgucccaauaaccaccc

SEQ ID NO: 15194 - RNA, 64 nt, Human
gccagggccaggcgcaccaggagaggcguuucuggggcuccagagaagugccacgggaggcaga

SEQ ID NO: 15195 - RNA, 64 nt, Human
cuuacacaucuugauuggaacucaaauauuucaagggcuccauagccacguggccagcagcuac

SEQ ID NO: 15196 - RNA, 64 nt, Human
ccagacuagcccacuaaagcuccccuguaaaugggggcuccauuaguucugcugccgagacuaa

SEQ ID NO: 15197 - RNA, 64 nt, Human
cgggcguuacacagaaggcuggcugacaugcccagggcuccacucucaucuaaugucacagccc

SEQ ID NO: 15198 - RNA, 64 nt, Human
cggacugcgcucccagccugggcucugggagugggggcuccagcccuccccacuaugcccagga

SEQ ID NO: 15199 - RNA, 64 nt, Human
gcccccagaacauacacugugaacucaaucuccagggcuccaaaucugccuagaaaaccucucg

SEQ ID NO: 15200 - RNA, 64 nt, Human
aagggcagccagggucuucccugccugguguuuugggcuccagaggacuuaccuacaaaauacu

SEQ ID NO: 15201 - RNA, 64 nt, Human
ggccccggggccugacccacaccacgcagaccccgggcuccaguuuuuaacgaugguuccauca

SEQ ID NO: 15202 - RNA, 64 nt, Human
gccaacauuugggcaggaugagagggcugacccugggcuccaaauuccucuugugaucuccuca

SEQ ID NO: 15203 - RNA, 64 nt, Human
cucacucugagcccugacguccuccaccaaccacgggcuccaggaccccuuugcuggccauccc

SEQ ID NO: 15204 - RNA, 64 nt, Human
cggguaauggcugugaagugcugggcuuugucuggggcuccagggcuggacaugcagacagugg

SEQ ID NO: 15205 - RNA, 64 nt, Human
agugcucugggagcgggcuccacagccuccuugugggcuccagccccuugucagccgcagccuc

SEQ ID NO: 15206 - RNA, 64 nt, Human
ggaagugugucugaacucggagugcucugggagcgggcuccacagccuccuugugggcuccagc

SEQ ID NO: 15207 - RNA, 64 nt, Human
gcagugugcuuagggccugaggugugaaagcccagggcuccagagcucggcaggccccgcuggu

SEQ ID NO: 15208 - RNA, 64 nt, Human
ccaguuucaaagucagcugaggggcugagggguggggcuccauggugaaugcagguugcugcag

SEQ ID NO: 15209 - RNA, 64 nt, Human
ucuguucuugucccucauacaucuuuggagaaccgggcuccagacuuuguucccugacucauag

SEQ ID NO: 15210 - RNA, 64 nt, Human
guugcccuguagcacuacagaaacccugguucuugggcuccacugagccccaggucagucccca

SEQ ID NO: 15211 - RNA, 64 nt, Human
aauuucaguuccuuucuaagcuuugucagucaaggggcuccacugacuuccuaggcccuguaau

SEQ ID NO: 15212 - RNA, 64 nt, Human
aagagagagccccagugacacaucucuccauggugggcuccagucagucuuacacugcccuucu

SEQ ID NO: 15213 - RNA, 64 nt, Human
ccauccucugaaugccagugcaucuugggggaaagggcuccaguguuaucuggaccaguuccuu

SEQ ID NO: 15214 - RNA, 64 nt, Human
cgcacucagccagcgucuccccuguggagagucggggcuccagccaggagcgcuccagguaacc

SEQ ID NO: 15215 - RNA, 64 nt, Human
gccuuaccccauuacugcgguucuuccuguaagggggcuccauuuuccucccucucuuuaaaug

SEQ ID NO: 15216 - RNA, 64 nt, Human
uucacuucuucaguucugccaucuuguuuucaaagggcuccagccucacucagucccuaauuau

SEQ ID NO: 15217 - RNA, 64 nt, Human
acuucaggccucaccccucaccuuguuuuuuugggggcuccagggaccaaucuggggcuggaaa

SEQ ID NO: 15218 - RNA, 64 nt, Human
gccaggagugcugcaccgcccaguggucccccucgggcuccaggcccccacugagacccucucg

SEQ ID NO: 15219 - RNA, 64 nt, Human
cccagaagccccucaugccaagccugucccacuggggcuccagggccucugcccugaacaucug

SEQ ID NO: 15220 - RNA, 64 nt, Human
acacuuagguuucaugcccauuuucuaucacacugggcuccaugauauucuguucccuaagaac

SEQ ID NO: 15221 - RNA, 64 nt, Human
aggccugugccguguccagcugugacugugcggugggcuccaucugcuggacaaaaggggaacu

SEQ ID NO: 15222 - RNA, 64 nt, Human
gaagcaggggccucugagugccaagcgacguggcgggcuccacguuagcccaggcucugagagc

SEQ ID NO: 15223 - RNA, 64 nt, Human
guuuuuaaaugucuuucuucaugaaugcuucauggggcuccaggaagccuguaucaccugugua

SEQ ID NO: 15224 - RNA, 64 nt, Human
cccacucuccauccuccccagggguagaggcugggggcuccaccccagcccauguacgucccca

SEQ ID NO: 15225 - RNA, 64 nt, Human
ccaaggacacagcuuguaugaaaggguugaauuugggcuccaucaguaauuuuugacauuuuca

SEQ ID NO: 15226 - RNA, 64 nt, Human
uucuguccacagagucccuuggagggaaaggugugggcuccagcuucuccaggcgucugcggag

SEQ ID NO: 15227 - RNA, 64 nt, Human
cucuuggaagggguaacagugaaccgcccuccaugggcuccacaucuuuuccuuuggcuuccaa

SEQ ID NO: 15228 - RNA, 64 nt, Human
uuuaaagaaaggagaaagccauuggaaaaaugaugggcuccauuaaggagacuaaugaaucugg

SEQ ID NO: 15229 - RNA, 64 nt, Human
ucccauauuugcaaggggaggggauuuggggcuggggcuccauucaccaaagcugagguggcuu

SEQ ID NO: 15230 - RNA, 64 nt, Human
agggagagagcuccacacuguaaccacugggucugggcuccauccugcgcccaaagacauccac

SEQ ID NO: 15231 - RNA, 64 nt, Human
uccucucccaacccucugguuggugauucaacuugggcuccaagacuuggguaagcucugggcc

SEQ ID NO: 15232 - RNA, 64 nt, Human
cuuuuauuuaugaaggcccugggagcagcguuaagggcuccaggauccagcucucuuugcauuu

SEQ ID NO: 15233 - RNA, 64 nt, Human
cuugggggggagggcaggggccccuguggguucugggcuccaggggagggagcuggggaggcca

SEQ ID NO: 15234 - RNA, 64 nt, Human
ccuguuucccaggcccacugugccucagagaccagggcuccagccccucuuggagaagucucag

SEQ ID NO: 15235 - RNA, 64 nt, Human
gcuaguuggggcaugcuuuugugcacacucucuggggcuccagugugaagggugcccuggggcu

SEQ ID NO: 15236 - RNA, 64 nt, Human
ugggugaagacuacagacucccugggguuggcaggggcuccaucucaguggaccaggaagcaag

SEQ ID NO: 15237 - RNA, 64 nt, Human
gcagaggaggacgaggacgacugggaauccuagggggcuccaugacaccuucccccccagaccc

SEQ ID NO: 15238 - RNA, 64 nt, Human
cagaggcuuccagucucacugacacaggagggcugggcuccacuucauccagaugaaggaaagg

SEQ ID NO: 15239 - RNA, 63 nt, Human
gaccccaauugccaucuuaaucacagaccucaggggcuccaacagggagaaaaaacaaucacu

SEQ ID NO: 15240 - RNA, 64 nt, Human
gcagaagaaaguugucacuccagugaguuacccagggcuccagggagcccacagcagcaucaga

SEQ ID NO: 15241 - RNA, 64 nt, Human
uguaggggcuuggagguguucuggacaguggggagggcuccagacccaaccuggucacagaaga

SEQ ID NO: 15242 - RNA, 64 nt, Human
ccagaguaucaccugggaguucagguucucuccagggcuccagguguguguuuaucucgccccc

SEQ ID NO: 15243 - RNA, 64 nt, Human
ggaugaugugcucccggggccugccuccugcacggggcuccacggagcccagcucccagacacg

SEQ ID NO: 15244 - RNA, 64 nt, Human
ugcccgccuacuagcggcuggcaggcacagaccagggcuccaaggccaccccaccaacgcaggc

SEQ ID NO: 15245 - RNA, 64 nt, Human
ggcgccauuccgaggccgggccuucuucugacacgggcuccaaccccaccugaccaagcccggg

SEQ ID NO: 15246 - RNA, 64 nt, Human
accugucagagucuggggacucggcgugcagggcgggcuccaagcgcuuugcuuccggaacucc

SEQ ID NO: 15247 - RNA, 64 nt, Human
acauggucaugcgucacugcagccuccaccucccgggcuccagcgauucuccugccucccugcc

SEQ ID NO: 15248 - RNA, 64 nt, Human
agcaccaucuucacagauguucaggggcaguggggggcuccaggcacggucaaugaaggaaaca

SEQ ID NO: 15249 - RNA, 64 nt, Human
caaccagaaaaguggcucucuuugguagggagaggggcuccaauauuucguucucuccccaugg

SEQ ID NO: 15250 - RNA, 64 nt, Human
acacuacagguccccuccccagggcaggggauuugggcuccaugagcuccuugaggggcucuuc

SEQ ID NO: 15251 - RNA, 64 nt, Human
cccucccacucuugaagaggaggccgccuccucggggcuccaggcuggcuugcccgcgcucuuu

SEQ ID NO: 15252 - RNA, 64 nt, Human
gcucugccucccaucacccgcuaagagggagggagggcuccagacacauguccaagaagcccag

SEQ ID NO: 15253 - RNA, 64 nt, Human
agugaguggcguaggcucuggagccaggcugccugggcuccaaugccagcucugccacuugcua

SEQ ID NO: 15254 - RNA, 64 nt, Human
gcuugcaucugcacauaggcaguagccuccuccugggcuccagagggcacucagaaguugugcu

SEQ ID NO: 15255 - RNA, 64 nt, Human
aaauccaggcacuccccaugucaacagccagacagggcuccagggcuugucccagucaauacag

SEQ ID NO: 15256 - RNA, 64 nt, Human
cuaccuccuuagcauuccuucaggcugcuacucggggcuccaggugugugaauugguccucaga

SEQ ID NO: 15257 - RNA, 64 nt, Human
guuuuuccucuuaggaaagcugcaggaaccucgugggcuccagggacccaggcccacauccauc

SEQ ID NO: 15258 - RNA, 64 nt, Human
gucucaccugcgguggggugucggcucugccugggggcuccaucccuuucagccacucguggcc

SEQ ID NO: 15259 - RNA, 64 nt, Human
uuuaccugaggagcucuguccugcucccuguggagggcuccagauagcucagaaaugaccagcc

SEQ ID NO: 15260 - RNA, 59 nt, Human
uggacgcucagcuccacugagcuggcugcgggcuccagcggccgugugcuccagcaggc

SEQ ID NO: 15261 - RNA, 64 nt, Human
ccccaugccacaaccugggcuccuggcuacagcagggcuccagggacuccaaauaaauguucag

SEQ ID NO: 15262 - RNA, 64 nt, Human
cccccaggccucuccucagagggcggcacaggcugggcuccagcaggugggcaggggaggucug

SEQ ID NO: 15263 - RNA, 64 nt, Human
gggccggggcgcccaccggggaccgccuggccgggggcuccaagggcucuaggcagacccugcg

SEQ ID NO: 15264 - RNA, 64 nt, Human
uccucaguaguuacucugcucaugagacagaucugggcuccaagccaggaaaggugaacagaaa

SEQ ID NO: 15265 - RNA, 64 nt, Human
gguuucucaccuggggcucuacgagauguugcuggggcuccaccuuaaauugugacuaaaaaca

SEQ ID NO: 15266 - RNA, 64 nt, Human
ggccugcggcuuucuggcugcugugcugccuccugggcuccagcccuccccugcccccagcccg

SEQ ID NO: 15267 - RNA, 64 nt, Human
gccucuugccugcccuccucucagaccuaaggccgggcuccaccuacuccugugggacucuccc

SEQ ID NO: 15268 - RNA, 64 nt, Human
agacacaggacccuuaacuuugccccaaagugaggggcuccacaccaaccccaggcggaggaac

SEQ ID NO: 15269 - RNA, 64 nt, Human
gcacugucacugcaaguccagcccccuuugccaggggcuccauuccaccccuuuccugcaggga

SEQ ID NO: 15270 - RNA, 64 nt, Human
accgcggccaggcacccaugugggcgcccacccugggcuccacacagcaguguccccugcccca

SEQ ID NO: 15271 - RNA, 64 nt, Human
gagggggcagccucugggcccugaaccccugcuggggcuccacgacccugagagaaggggugag

SEQ ID NO: 15272 - RNA, 64 nt, Human
cugcccugccccugcugccaguguaccgugagcggggcuccagccaguucaagcucagagccag

SEQ ID NO: 15273 - RNA, 64 nt, Human
ugacacuccaccccagcucaggccaugggcagcagggcuccauucucuggccuggcccaggccu

SEQ ID NO: 15274 - RNA, 64 nt, Human
cggggauugccuuccucagccgcagcagcaccuggggcuccagcugcuggaauccuaccauccc

SEQ ID NO: 15275 - RNA, 64 nt, Human
caggccuggguuuggauuucagaauccuagcuccgggcuccacucguguggcagcaagacugcu

SEQ ID NO: 15276 - RNA, 64 nt, Human
ggaggccuucaccuuauaucuguguuguuauccagggcuccagacuuccuccucugccugcccc

SEQ ID NO: 15277 - RNA, 64 nt, Human
ggcuuggaagaagcacaugaccguacucugcguggggcuccaccucacacccaccccugggcau

SEQ ID NO: 15278 - RNA, 64 nt, Human
acuucuuuuuuuccgacagcaggauggggcucuugggcuccacacaccagaugcuuugguuuuc

SEQ ID NO: 15279 - RNA, 64 nt, Human
aacuaggcgguccugggauggggcauguggccaagggcuccagggccagggugugagggauggg

SEQ ID NO: 15280 - RNA, 64 nt, Human
cuggguggggcagggccuggccugguccaggcuugggcuccauucccaucacugcugucccucc

SEQ ID NO: 15281 - RNA, 64 nt, Human
aacugagaugagaguguauuaaucacguaucgcagggcuccagcuguuuuagaagccacaucau

SEQ ID NO: 15282 - RNA, 64 nt, Human
gccccuccgcccggguuuggcucgcccggcccgcgggcuccaccucagguuuucacuuuucgcu

SEQ ID NO: 15283 - RNA, 64 nt, Human
uacaaacuggacuggcucaggcagggccacggcugggcuccagcugccggcccagcggaucguc

SEQ ID NO: 15284 - RNA, 64 nt, Human
ugaagcugcaggucugggggacacugaccagcuugggcuccacgcugcccugccguucccucag

SEQ ID NO: 15285 - RNA, 64 nt, Human
cucacugggaauagcauugugcguguccggaaaagggcuccauuugguuccagcccacuccccu

SEQ ID NO: 15286 - RNA, 64 nt, Human
auccaaagccccucagccugccuugcagaccaaugggcuccauguucuguagcccccuccccua

SEQ ID NO: 15287 - RNA, 64 nt, Human
agaagcacccaggacuuccauuugcuuugucccggggcuccacugaacaaguuggccugcacug

SEQ ID NO: 15288 - RNA, 64 nt, Human
ccgagaggcacaugguucuagccuggaccuggcugggcuccaugagaaugaguugccuccaacc

SEQ ID NO: 15289 - RNA, 64 nt, Human
guaggggcuagagccagccugcauccugcccaccgggcuccacuuggagaucagcaggagggcc

SEQ ID NO: 15290 - RNA, 64 nt, Human
cauuuagaguuguaaauuuacaaagauccacggugggcuccagcugccaagccacccaagggag

SEQ ID NO: 15291 - RNA, 64 nt, Human
ccacuuuguacauguaauguauuauauggggucugggcuccagccagagaacaaucuuuuauuu

SEQ ID NO: 15292 - RNA, 64 nt, Human
aauccguuugauugauaugaauaccaaccaucgugggcuccagcuuaaaggagagcagagguau

SEQ ID NO: 15293 - RNA, 64 nt, Human
ccaggaggccucaccauacucccuuucagggccagggcuccagcaagcccagggcaaggauccu

SEQ ID NO: 15294 - RNA, 64 nt, Human
gccagcugccuccgcgugaucaaagccacacucugggcuccagaguggggaugacaugcacuca

SEQ ID NO: 15295 - RNA, 64 nt, Human
auauuaaugaaguagguuccaguacuaaugaagugggcuccaguauuaaugaaauagguuccag

SEQ ID NO: 15296 - RNA, 64 nt, Human
gccugggcaaggggagaagguggucccugcagaggggcuccaggcuggugagagccccccugcu

SEQ ID NO: 15297 - RNA, 64 nt, Human
auuuggccuccugcuuccuucuguggccucugccgggcuccauucccaaggaaaagagaggagc

SEQ ID NO: 15298 - RNA, 64 nt, Human
ccacaucauauuggagaugaccccaucaaccccagggcuccagcacuaccaaguuggaauucca

SEQ ID NO: 15299 - RNA, 64 nt, Human
cucucccugccucacuccuccgugagcaccaccagggcuccaggagccucauccagccucagag

SEQ ID NO: 15300 - RNA, 64 nt, Human
uucccagaccaugggaaaugggaauugcgcucaggggcuccaugcugggucugaggccccugcc

SEQ ID NO: 15301 - RNA, 64 nt, Human
cagacaccccaccaccuaggcaggggcugggccagggcuccaaggcuugccccagaggccacau

SEQ ID NO: 15302 - RNA, 64 nt, Human
cuggggaagagaggaccggccaccuguccagcaugggcuccagagccuuccucucucacagggc

SEQ ID NO: 15303 - RNA, 64 nt, Human
cuucaguggcuccgccgcauccucacacugacgggggcuccauacggaccuggggacugggcug

SEQ ID NO: 15304 - RNA, 64 nt, Human
ggcaugugguggcugaaacugagcuuuuuugugugggcuccaguucucacuguucugcaaugcu

SEQ ID NO: 15305 - RNA, 64 nt, Human
caauaaccggcauccguuuuggaaccugcgucuggggcuccagucgcugcucuugcuggcgucc

SEQ ID NO: 15306 - RNA, 64 nt, Human
uugcuucugcaggacugugagccggcucauuucugggcuccaucggcacaggaggggccggauc

SEQ ID NO: 15307 - RNA, 64 nt, Human
ugcccgaggauguggccguucccugccugggcaggggcuccaaggaggggccaucuggaaacuu

SEQ ID NO: 15308 - RNA, 64 nt, Human
cggcugggccugacggaggccgaggggcagaccggggcuccagccagaccccugaaaggaaggu

SEQ ID NO: 15309 - RNA, 64 nt, Human
gugccaggccugaacugagcuaagcaccugccccgggcuccacacuuccaucuuucuuuugucu

SEQ ID NO: 15310 - RNA, 64 nt, Human
ugcccacguacauacguaugucuccaugaguucugggcuccacugguuccaauugagcuccagc

SEQ ID NO: 15311 - RNA, 64 nt, Human
gcucccagccagcgagucaggagcgggggagacagggcuccagggaugaggccgcauucugcuc

SEQ ID NO: 15312 - RNA, 64 nt, Human
augugaagggcagcacucccuguccccaugucccgggcuccacugggcaccaacauaaccuugu

SEQ ID NO: 15313 - RNA, 64 nt, Human
aucucucccuccugcccucugcuugggggacucagggcuccauucuggagggcaccacggugac

SEQ ID NO: 15314 - RNA, 64 nt, Human
uggacacaaaaaccggccuugcccugcagggauggggcuccacaggccgugcccaacugggggu

SEQ ID NO: 15315 - RNA, 64 nt, Human
cuccagcccugguuaggcacugagggcucuggacgggcuccaggaacccugggcugaugggagc

SEQ ID NO: 15316 - RNA, 64 nt, Human
cagggguuacaccugcccuccguggucccucccugggcuccaggggccucuggugcgguuccgg

SEQ ID NO: 15317 - RNA, 64 nt, Human
acccuuggcgacagaagacagccuccgagagcgcgggcuccaagggcaauaaagcagcuccacu

SEQ ID NO: 15318 - RNA, 64 nt, Human
ccacccucgaccacccccgaugggauggcuuggggggcuccagggggugcccucccagaccccc

SEQ ID NO: 15319 - RNA, 64 nt, Human
caagcacugacagaccucacaaucaagccagccugggcuccacccacccuggcuuccuccagcu

SEQ ID NO: 15320 - RNA, 64 nt, Human
acccggcgcacggacuggccaggccccgcgggccgggcuccaggaagggccugcacgaacccua

SEQ ID NO: 15321 - RNA, 64 nt, Human
cagaguuccaguuucaaccagaguuccaaccaaugggcuccauccucuggauucuggccaauga

SEQ ID NO: 15322 - RNA, 64 nt, Human
ccgaucccuaggugaggagaagcggcuugaagcagggcuccauucauucaacacacaugaccac

SEQ ID NO: 15323 - RNA, 64 nt, Human
acauacuggccucuuucuucaaccucucuaauaugggcuccagacggaucucuaagguucccag

SEQ ID NO: 15324 - RNA, 64 nt, Human
gaccugggcccugcucaaugccaccugucugccugggcuccaagugggcaggaccaggacagaa

SEQ ID NO: 15325 - RNA, 64 nt, Human
uucugagaguuggcgggucacugaggugcauucugggcuccagggacgccacugcggggcaaag

SEQ ID NO: 15326 - RNA, 64 nt, Human
gccuggauccauccugcuagcaccuccccagacagggcuccagccugucggccacaccccagac

SEQ ID NO: 15327 - RNA, 64 nt, Human
acagccuuacacuaggcacacacuuuagagucuggggcuccaguggggcccgccuaauuuuuuu

SEQ ID NO: 15328 - RNA, 64 nt, Human
cacaucuggaacgcugugggcaucuucugcccaugggcuccauuuggcaccugcugagccacag

SEQ ID NO: 15329 - RNA, 64 nt, Human
ucauugugcuucccuaauuuaaagccauguugaggggcuccauucccaauuccugggucaaggu

SEQ ID NO: 15330 - RNA, 64 nt, Human
gcaggaaguuaucuagcaagccgcuggggcuugggggcuccacuggcuccccccagcccccuaa

SEQ ID NO: 15331 - RNA, 64 nt, Human
ggggacuuuccuucucuccaugauggcuuugcaggggcuccaugguccuucucucugugauggg

SEQ ID NO: 15332 - RNA, 64 nt, Human
cugcguuguuaguuuugaagaguggaggagcuaggggcuccagaaagaaucuuacacauguguu

SEQ ID NO: 15333 - RNA, 64 nt, Human
ugccccccaugugcugugugcuguuugcauggcagggcuccagcugccuucagcccugugacgu

SEQ ID NO: 15334 - RNA, 64 nt, Human
cuggaggcaccccugcagcaggggcacuucccuagggcuccagaggggugaaugggccuuugcu

SEQ ID NO: 15335 - RNA, 64 nt, Human
ccauccagacugcucgccuccuggggauucucaggggcuccauuauggcuugauuuacuccacg

SEQ ID NO: 15336 - RNA, 64 nt, Human
gccugcaccagguuugcugaaacugacagagccugggcuccagaccucucucccuccuacagug

SEQ ID NO: 15337 - RNA, 64 nt, Human
cuuugguggggggaccccaaagccauucugggaagggcuccagaagaagguccagccuaggccc

SEQ ID NO: 15338 - RNA, 64 nt, Human
aggcccugagaaggagccaccagcuggaggaaaggggcuccaagccuugcuuuuaacaccccug

SEQ ID NO: 15339 - RNA, 64 nt, Human
agaagcauuucccggcaagagaggggcaagucuggggcuccaacuggguacagccugggugcag

SEQ ID NO: 15340 - RNA, 64 nt, Human
cuggccucgaagcccugggcugcacagcccuacugggcuccaccucuauaaaccagugacuucu

SEQ ID NO: 15341 - RNA, 64 nt, Human
ccccucagcaagggugcaaagggggaagaacuaggggcuccauuguucuucaggcgacaggaga

SEQ ID NO: 15342 - RNA, 64 nt, Human
aagugaccaugaaaaauaaauucgcuggggaagggggcuccaugcugguguggccaaggcugag

SEQ ID NO: 15343 - RNA, 64 nt, Human
ccaggcguagggccagggcucuggcagguggccagggcuccacgggggccuaguggcuucagcc

SEQ ID NO: 15344 - RNA, 64 nt, Human
ggacaucuaccgccaacccagcugcuucuggcaggggcuccaagccccagcguggggaagggcc

SEQ ID NO: 15345 - RNA, 64 nt, Human
cuggggggucugagggagaccugguugggaauuggggcuccagugcucaggcuggcuugggcug

SEQ ID NO: 15346 - RNA, 64 nt, Human
acacaacacagcugcagacccugcuggaggccgagggcuccaggugcuaucuuagguggacaca

SEQ ID NO: 15347 - RNA, 64 nt, Human
uucgccauguugcucaggcugaucucaaacuccugggcuccaacgaucugcccaccuuggccuc

SEQ ID NO: 15348 - RNA, 64 nt, Human
uggaccugcuggaccuggacccacugaagaggucgggcuccauggagcagagguuggccucccu

SEQ ID NO: 15349 - RNA, 64 nt, Human
ggccaucggcagcaugucaaccauuugcauggcugggcuccagggaaacuacugacaacgacag

SEQ ID NO: 15350 - RNA, 64 nt, Human
caagaaaaugagcccaaccaguacaccaggaguggggcuccauaucagccccuaaggucaagcc

SEQ ID NO: 15351 - RNA, 64 nt, Human
ggucugggcgcaccuuuagcagguggacuccguggggcuccaccagccagaagccucuggaagg

SEQ ID NO: 15352 - RNA, 64 nt, Human
ccuguugacucacacggcuuuugcugaugacacggggcuccaguacacagucugauaaggacuu

SEQ ID NO: 15353 - RNA, 64 nt, Human
gccggguuggggagcccucccauaacccugucuugggcuccaaccccucaaccucuaucucaua

SEQ ID NO: 15354 - RNA, 64 nt, Human
cuccaucagaacucgcaauccgagccagcucugggggcuccagcguggccuccgugacccaugc

SEQ ID NO: 15355 - RNA, 64 nt, Human
ccauucucuguguuggggcuguccuguguguggugggcuccacccacuagaugccaguggcacc

SEQ ID NO: 15356 - RNA, 64 nt, Human
ccucuccaggaagcguguucaacacauggaaucagggcuccacccagaccugccgaggccacac

SEQ ID NO: 15357 - RNA, 64 nt, Human
gugcucugcgugucccacagacgcuuguuccagggggcuccagcaaaccccuucguggucucuc

SEQ ID NO: 15358 - RNA, 64 nt, Human
gggugagacccuuguuggcagccagacaaggguggggcuccacaggcagcacaggcgccccacc

SEQ ID NO: 15359 - RNA, 64 nt, Human
agcacaucuuccuccucgcaggagggaccaggcggggcuccaggccacucagugggcucccugg

SEQ ID NO: 15360 - RNA, 64 nt, Human
uaagucaccauaauuuugaagacuugcaugcagagggcuccaggaauuguagacauuaaggaau

SEQ ID NO: 15361 - RNA, 64 nt, Human
ccaagagcccccugagcucagcccucugccuggagggcuccagaccuuucugagcccugcuugg

SEQ ID NO: 15362 - RNA, 64 nt, Human
cugccauaggguccugaauguuucagaccacaaggggcuccacaccuuugcuguguguucuggg

SEQ ID NO: 15363 - RNA, 64 nt, Human
accuugagacgcaucccaggaggugacgaggcaggggcuccaggaaaggaaucagagacaauuc

SEQ ID NO: 15364 - RNA, 64 nt, Human
uggucugggguggucacucccgggguccacgucugggcuccaguugauccccugggugucuggg

SEQ ID NO: 15365 - RNA, 64 nt, Human
gaauggggggacaggacaauuucucccccuccaggggcuccaggacucucccuggggggcccac

SEQ ID NO: 15366 - RNA, 52 nt, Human
gcauuggggcgagcaagugagggggcuccaccaaggaggggggcuugggggg

SEQ ID NO: 15367 - RNA, 53 nt, Human
uggucuaugaaaaucucuaggaugggcuccaccgcucauagagcuugcccugg

SEQ ID NO: 15368 - RNA, 64 nt, Human
uugcccggugcucucagaaaccucagagcugguggggcuccagaucaggccuuggccucugagc

SEQ ID NO: 15369 - RNA, 64 nt, Human
gcuuggauggccuccagcaacucagggauaacaugggcuccaggagggacccucugguccagcu

SEQ ID NO: 15370 - RNA, 64 nt, Human
acaugcuuauguauaaguaaaggggcaggugcuugggcuccagagagacccuagguacugccuu

SEQ ID NO: 15371 - RNA, 64 nt, Human
cauccccgggccaggaggaugagguuguccugaggggcuccaaagaagacaauaguucccacuc

SEQ ID NO: 15372 - RNA, 64 nt, Human
auauuucaaggccuggcaguaauccucuuucucagggcuccacccuuugggccuguagcucuuc

SEQ ID NO: 15373 - RNA, 64 nt, Human
ggaagaugcuccagaguggcuagagggcaucuaagggcuccagcauggcauauccaugcccacg

SEQ ID NO: 15374 - RNA, 64 nt, Human
acuguucucugauauucuagaagcagacgaucucgggcuccaaguauuucagaaugauuuaaaa

SEQ ID NO: 15375 - RNA, 64 nt, Human
cccugcugccccagccugugucuguucuccucgagggcuccagcauccucugcuucccccacca

SEQ ID NO: 15376 - RNA, 64 nt, Human
aaguaaggcuuugccucaggcacaaaauuuaagggggcuccaaaaaacucaggaaucaagauca

SEQ ID NO: 15377 - RNA, 64 nt, Human
ugcaucguggcuugaaggcaggccguccuggagggggcuccauucuccagucagaguagaugau

SEQ ID NO: 15378 - RNA, 64 nt, Human
agaaggggcgaggcuuuaagcgaggcagaauggugggcuccagaguaggugggucuuggauugg

SEQ ID NO: 15379 - RNA, 64 nt, Human
caccuccccagcagcccccacccuugccccagcugggcuccauuccaccgccucccgccucagc

SEQ ID NO: 15380 - RNA, 64 nt, Human
cucucauuuccucccuccuuggggcuucugcccagggcuccaggaucagggauauuacuucuca

SEQ ID NO: 15381 - RNA, 58 nt, Human
uggugagaaacaagccauaaggggcaaagggcuccaggauuugaaucuucucuuggug

SEQ ID NO: 15382 - RNA, 64 nt, Human
gguauuucagcaucucgggggguaauuuccggaagggcuccauacugucccaauaaggugaggc

SEQ ID NO: 15383 - RNA, 64 nt, Human
gcccugagcgcgggguggaagugcucccuucugugggcuccagcagaucccuuguuuuccuguc

SEQ ID NO: 15384 - RNA, 64 nt, Human
ccuguggccugccagucaucgaguggcccaacaggggcuccaugccagccgaccuugaccucac

SEQ ID NO: 15385 - RNA, 64 nt, Human
gaggccggggacgcagggcagcccacgccuccgugggcuccauucuguagcauugccagcguuc

SEQ ID NO: 15386 - RNA, 64 nt, Human
uggcccugccgagauuucaggauaaguuacccccaggcccgaagccccagcuugcccuggccug

SEQ ID NO: 15387 - RNA, 64 nt, Human
ucagucaggcccccuuacccacccaccagccccaaggcccgaccccucccccaaaggggcaguc

SEQ ID NO: 15388 - RNA, 64 nt, Human
uuuuuugucauugauuaaaagugauuuuagcccuaggcccgaaaugacuagcaaauaucauuuu

SEQ ID NO: 15389 - RNA, 64 nt, Human
agugacaaguggagggggugucuggaagcugagcaggcccgacagagagaugaagccaucagaa

SEQ ID NO: 15390 - RNA, 64 nt, Human
ggaggaggaggagggcuaggucaagccccuauccaggcccgaauccuuccgcugcccuccaagc

SEQ ID NO: 15391 - RNA, 64 nt, Human
agccucugacccucugagagaugauguccugcccaggcccgauggccacuaggacccugcaagc

SEQ ID NO: 15392 - RNA, 64 nt, Human
gaagcacucauagcucuuuuaggcagaagaauccaggcccgagcuggcagaagagacuuagaga

SEQ ID NO: 15393 - RNA, 64 nt, Human
ucccaccugugcccccuaaaccaggcgguggaucaggcccgaaggaaaaugcuggaaaaccacc

SEQ ID NO: 15394 - RNA, 64 nt, Human
uccugaccggccuguguccccgagcccucgcggcaggcccgagcaggcgaucgcggccgggcac

SEQ ID NO: 15395 - RNA, 64 nt, Human
cgaggagagcaaguuccugaacaugaugaccuagaggcccgagcgccuggugcugagugcaccc

SEQ ID NO: 15396 - RNA, 64 nt, Human
ggugaaaccacggccaauguuccuuagcugcaccaggcccgaagcuguucccaugcuugagcuu

SEQ ID NO: 15397 - RNA, 64 nt, Human
cccuuuauucucaaggucuuuugauugugaagcaaggcccgaggccuugacuggugagauuagc

SEQ ID NO: 15398 - RNA, 64 nt, Human
uggacggggcugugaggggugucuccaggcacaaaggcccgaacacaggaagccugugaccaug

SEQ ID NO: 15399 - RNA, 64 nt, Human
ccauugaacacugcacccuccacaggagccgcagaggcccgaggcaccggacgcuggagacccu

SEQ ID NO: 15400 - RNA, 64 nt, Human
ucugauuucauaacgaagccaggcugagggcaagaggcccgacaggcaggccaggguccccgga

SEQ ID NO: 15401 - RNA, 58 nt, Human
ugucggaggcugagugcugaggccggccaggcccgacaccuacacucucaccagcuuu

SEQ ID NO: 15402 - RNA, 64 nt, Human
agguagggugagagaggcccugaagauagaagccaggcccgaaggccagaauuaaagggguagc

SEQ ID NO: 15403 - RNA, 64 nt, Human
aagugcugggauuacaggcgugagccaccacaccaggcccgagaaaugcuuuuuuaaaaaacac

SEQ ID NO: 15404 - RNA, 64 nt, Human
ccacccccuuccugggagcagcgagcagugccccaggcccgaguuggagcacggucucuauggg

SEQ ID NO: 15405 - RNA, 64 nt, Human
ggaaguggauuugggccaagaaggagagggagaaaggcccgagccccugccuucccgggccuuu

SEQ ID NO: 15406 - RNA, 64 nt, Human
cagggagacaggggagcaaagaacgccaagccggaggcccgaggccagccggccucucgagagc

SEQ ID NO: 15407 - RNA, 64 nt, Human
acucggcuccugcccagcucccggcggccuucguaggcccgaagccuccuccaguccagcucuc

SEQ ID NO: 15408 - RNA, 64 nt, Human
agugagccgggcccugagggugggggaugcaccgaggcccgaggguccguccacugcugcgguu

SEQ ID NO: 15409 - RNA, 64 nt, Human
uucugcacacuuuuuugaugugaugcuugacgugaggcccgacacuaggauucucaaugcaaga

SEQ ID NO: 15410 - RNA, 64 nt, Human
ucacauggggccuggcccacgcccucccucucccaggcccgagaugugacccaccagugccuuc

SEQ ID NO: 15411 - RNA, 64 nt, Human
ucuuuauaaaauuucucccauccaaguacuaaccaggcccgacccugcuuagcuuccgagauca

SEQ ID NO: 15412 - RNA, 64 nt, Human
gagagugggggagggagggacagacagaaggccaaggcccgauguggugugcagagguggggag

SEQ ID NO: 15413 - RNA, 64 nt, Human
ccagcggccucuacggccccgacggacgcuugugaggcccgaggcagaagggcccaccccgucc

SEQ ID NO: 15414 - RNA, 64 nt, Human
uuggggcaggaguagcugagcucacaaggcagcaaggcccgagcagcugagcagggccggggaa

SEQ ID NO: 15415 - RNA, 64 nt, Human
ccugacccuuaucuucccagagaccaggccaggaaggcccgagauggagagcacuaaauucacg

SEQ ID NO: 15416 - RNA, 64 nt, Human
acaaaaagugaccuucguuuggauaaggcuggggaggcccgaaguccgcuagagcacaguccca

SEQ ID NO: 15417 - RNA, 64 nt, Human
gccacuuucccucagugggggugagccuggcggcaggcccgaagguguggaccccucagggcag

SEQ ID NO: 15418 - RNA, 64 nt, Human
uccucucagggaccaggggccuccugcuuuucagaggcccgagugcauuuaucccaaaacgagg

SEQ ID NO: 15419 - RNA, 64 nt, Human
agggagcuguacggaggcuggaagcugcaggguuaggcccgagagagcuuuugacaagccuggc

SEQ ID NO: 15420 - RNA, 64 nt, Human
ucccuggagcccgggaaggaggcugccuggcuggaggcccgagccgauggcgccugugcugagg

SEQ ID NO: 15421 - RNA, 64 nt, Human
aucaggccccccaucgaggagggagggcagacggaggcccgagagccuccccaggccucuucgu

SEQ ID NO: 15422 - RNA, 64 nt, Human
uacagcagguaguucugggggcgauacugccgaaaggcccgaacacauguauuuuggcugcaau

SEQ ID NO: 15423 - RNA, 64 nt, Human
guggauggucuggguggauggcucugucaaugucaggcccgagaacagccugcggaaugacagc

SEQ ID NO: 15424 - RNA, 64 nt, Human
uauagacaacucugacauugucaccccacugacgaggcccgauuccauaggguggauccuugcc

SEQ ID NO: 15425 - RNA, 64 nt, Human
uuauaguucauuuccaagacacaucuggagccaaaggcccgagggacccucagguggggagagc

SEQ ID NO: 15426 - RNA, 64 nt, Human
cuccacagggcugcaagugcccugccaggcucuaaggcccgaagaacaggugauaucgggggcg

SEQ ID NO: 15427 - RNA, 64 nt, Human
cugggagcagggagccacgggaugcugagagaggaggcccgagaggacaccccacccuccagcg

SEQ ID NO: 15428 - RNA, 64 nt, Human
ggccccggacuucucuggaaaaccgccugucugcaggcccgauucaaaucuaugggggcugcac

SEQ ID NO: 15429 - RNA, 64 nt, Human
ccacuugcccaccgggucccgccggauaaaugacaggcccgaggucagaauggccauccccggg

SEQ ID NO: 15430 - RNA, 64 nt, Human
ucgaccugcggcugcugugugccuucgcgguggaaggcccgaggggcgcgaucuugacccuaag

SEQ ID NO: 15431 - RNA, 64 nt, Human
aggcaucccugaggaggucagcggcgcccugccgaggcccgauggcuccaucaucuucuuccga

SEQ ID NO: 15432 - RNA, 56 nt, Human
gagccagcauggggagaugauucugaaggcccgaguuaggagauugaggcugguug

SEQ ID NO: 15433 - RNA, 64 nt, Human
agagaagugaaagguucaaggacacuggccuugcaggcccgagggagcagccaucacaaacuca

SEQ ID NO: 15434 - RNA, 64 nt, Human
gggacaggauuuggccacacuggggcugacacccaggcccgagcgccugcguucccagaccaug

SEQ ID NO: 15435 - RNA, 64 nt, Human
guguuauuauugaaauguauuguuugagcucaaaaggcccgaccaccccccuucgggcugcuau

SEQ ID NO: 15436 - RNA, 64 nt, Human
gaauaugacguuaccuugcagacuaaaagguugaaggcccgaaacuaacuuuuagcuaacaaua

SEQ ID NO: 15437 - RNA, 64 nt, Human
cggaagguugcauggcuggucccagggccagcacaggcccgaggccgggcugccugguuuuauu

SEQ ID NO: 15438 - RNA, 64 nt, Human
cuuaccuguuugccagccgugaccaccugcugugaggcccgaccacccacccagaaucugccca

SEQ ID NO: 15439 - RNA, 64 nt, Human
cggggggagcggggcagugagcggggcagggaugaggcccgaggugggggcgguggccaggaca

SEQ ID NO: 15440 - RNA, 64 nt, Human
ccuagccuggccgggggcgcggggggugcagggcaggcccgagcagcucgguuucccgcggacu

SEQ ID NO: 15441 - RNA, 64 nt, Human
gaccacuaugcaaccuaaagccaugguuccccccaggcccgacaccacuggccccggaugccuc

SEQ ID NO: 15442 - RNA, 64 nt, Human
ccaggcccugaacucccaugacugcccagcucugaggcccgaucuccacuguuggguggguggg

SEQ ID NO: 15443 - RNA, 64 nt, Human
uguaguccugcuccucuugggauggggcugggguaggcccgacugcacccuccccuucugguag

SEQ ID NO: 15444 - RNA, 64 nt, Human
cuuccagguuccucugugccaggaaugagaggccaggcccgauccuaccaccucgccuugaccc

SEQ ID NO: 15445 - RNA, 64 nt, Human
cacccuuggagcucugaguuccggcaccaguagcaggcccgaaagaggcacccuuccaucugau

SEQ ID NO: 15446 - RNA, 64 nt, Human
acugacauggugcugugugugagcgagugacagaaggcccgaggaggccgacugggcugcuggg

SEQ ID NO: 15447 - RNA, 64 nt, Human
cccggggaggcaagauugagggcccgggagagggaggcccgagcugccaccgggcuuaggcagg

SEQ ID NO: 15448 - RNA, 64 nt, Human
auagcuccgaccuccaugauccgagagugggaaaaggcccgauuauuacccauaaggcacacuc

SEQ ID NO: 15449 - RNA, 64 nt, Human
augagugcuaagagccucuggaagggagggcuucaggcccgaaggucucucuggcucuaggacc

SEQ ID NO: 15450 - RNA, 64 nt, Human
gugcagacaaucuucuguuggguggcaucauuccaggcccgaagcaugaacagugcaccuggga

SEQ ID NO: 15451 - RNA, 64 nt, Human
ugacuuuuaggagccguucuccccacaagacaccacaugacaagggguauaagccccagcccug

SEQ ID NO: 15452 - RNA, 64 nt, Human
uuuuuuuuuuuuuuucuuuuucuuuuuuuuuugcacaugacaguguuuguauugaggaccuucc

SEQ ID NO: 15453 - RNA, 64 nt, Human
gaugguuaaaauccauugacauuugcacuuucaaacaugacaagucucggagcugcugagauga

SEQ ID NO: 15454 - RNA, 64 nt, Human
acagacacacccagcugcacacaugaggcaucccacaugacacgggcugacacagucucauauc

SEQ ID NO: 15455 - RNA, 64 nt, Human
aacaugauggaucuacuuauggucuuguuuguugacaugacaaauuaacauucuuauaguuaca

SEQ ID NO: 15456 - RNA, 64 nt, Human
uauaauuuaacuggaauugagaugaaggccagugacaugacaacugugaccuaagaaaugggaa

SEQ ID NO: 15457 - RNA, 64 nt, Human
ggggcggcuuuugaaaaccuggaccucuaugucaacaugacagggugaaacuauucccccuaag

SEQ ID NO: 15458 - RNA, 64 nt, Human
gcugaagacaugugagacuucccugccccaccccacaugacauccgaggaucugagauuuccgu

SEQ ID NO: 15459 - RNA, 64 nt, Human
aacacugcugaaaagaacccaagagaauugucacacaugacacaagauguacauaauaucaugc

SEQ ID NO: 15460 - RNA, 64 nt, Human
aguuuuaccucgggaugguugguuagugcaugucacaugacauccacaugcacauguauucugu

SEQ ID NO: 15461 - RNA, 64 nt, Human
aucuccuuucuuccauggagcucucacgauucaaacaugacagauuugguaaaaugcugguuag

SEQ ID NO: 15462 - RNA, 64 nt, Human
auauuugucaaugaauguggaauagaaaaucuaaacaugacaauaauagacauaucuuuguaug

SEQ ID NO: 15463 - RNA, 64 nt, Human
acuagagaucacaggcacaaguugaaacaaacuaacaugacaagaaagcuauagaaaaaauaaa

SEQ ID NO: 15464 - RNA, 64 nt, Human
auauauacuaccucugucuguuaauucuuuccuaacaugacauguagcucuccaugguccuccc

SEQ ID NO: 15465 - RNA, 64 nt, Human
auggagcuguucuguaugguacugugugguggauacaugacaauauccauuugcaaacacaaga

SEQ ID NO: 15466 - RNA, 64 nt, Human
gccggggagggguccuuugcggugagcuauguuuacaugacacagugugccaaagugacuuacu

SEQ ID NO: 15467 - RNA, 64 nt, Human
aaucuuagcaaguguuuugaaucuuagcaacugaacaugacauugcacacugugauuauuuuuc

SEQ ID NO: 15468 - RNA, 64 nt, Human
gaauuaucuccuugauaacuugaucagauauaggacaugacacugaauagaguccaacaguaca

SEQ ID NO: 15469 - RNA, 64 nt, Human
gagaauuucuuucaagauuaucuaaacauuagaaacaugacauuuaaaaaaacuaugaaauaau

SEQ ID NO: 15470 - RNA, 64 nt, Human
ccacaggucugccgaugcccuguccacugccuacacaugacagacaaguaacccccucaugggg

SEQ ID NO: 15471 - RNA, 64 nt, Human
ucccugucacuuuuuaaaagccaggguagcaguaacaugacaaacggcugcuguggcuuccucu

SEQ ID NO: 15472 - RNA, 64 nt, Human
accccuugcccuuuccccaaaggaccuuuucuguacaugacacuuuuuuguuguuuuuuguuug

SEQ ID NO: 15473 - RNA, 64 nt, Human
gccucgucacuugugcuaauggucaguuguacacacaugacauguggaagugaccuguagcagc

SEQ ID NO: 15474 - RNA, 64 nt, Human
ccuaauuuaacccagcucauuauaaugucauuaaacaugacauuagcauugugguuuuagcacc

SEQ ID NO: 15475 - RNA, 64 nt, Human
agauuugucuuuuccucaccaccuucccuccaaaacaugacauaaacaauauuuuuugcacuug

SEQ ID NO: 15476 - RNA, 64 nt, Human
uuuguuuuguuguuguuuuuuuuucaagccaaauacaugacauaagaucaauaaagaggccaaa

SEQ ID NO: 15477 - RNA, 64 nt, Human
gucugaaugaauuauuauauacauuugcuaucauacaugacaguugugucauuauuagagauuu

SEQ ID NO: 15478 - RNA, 64 nt, Human
aacuugauaucuuaccuaggauugggaauuugggacaugacauguacuauaaaagucagucuau

SEQ ID NO: 15479 - RNA, 64 nt, Human
gaugucccaccacagucccucaccuccggccuccacaugacagaaccaauuuacacucaaccau

SEQ ID NO: 15480 - RNA, 64 nt, Human
aaugaagauacgguugcuucaccuuggagccugaacaugacauuucuaaguggggugcaucccc

SEQ ID NO: 15481 - RNA, 64 nt, Human
cgcccgcauagcacuugcagaccugccugaacgcacaugacauagcacuugccgaucugcgugu

SEQ ID NO: 15482 - RNA, 64 nt, Human
cuucuagucccagaaucuguguuuuuaaaauacuacaugacauucugucuauucaaucaccugg

SEQ ID NO: 15483 - RNA, 64 nt, Human
uuuguccauuuuaaaaaccaaucauuuuaagaagacaugacaaugcaaugaaacagaugauaaa

SEQ ID NO: 15484 - RNA, 64 nt, Human
ugucagauccauguucuaaaaaauuuuuguaaugacaugacauuacaagaguauaaaaauggac

SEQ ID NO: 15485 - RNA, 64 nt, Human
ugacaaacuuuuuugagcaccuacuuuauauaaaacaugacaaauugcagugugauguaaucaa

SEQ ID NO: 15486 - RNA, 64 nt, Human
gguaaagugcaacgugccaugugcaugcugagcaacaugacagccaucacuauggccugggccc

SEQ ID NO: 15487 - RNA, 64 nt, Human
aguugauguuuuacauucucccuuacugaaaucuacaugacaugaugcuucuugcuggguuuuu

SEQ ID NO: 15488 - RNA, 64 nt, Human
gggagcaacaaagcuccuaauucuauuacccacuacaugacaugugggccaaguggugaguuuc

SEQ ID NO: 15489 - RNA, 64 nt, Human
gagacccucaaccagcccaacaucuuccauggacacaugacauugaagaccaucccaagcuauc

SEQ ID NO: 15490 - RNA, 64 nt, Human
uuuucgaauauuuauauagaaaaaaagucuuuucacaugacaaaugacacucucacaccagucu

SEQ ID NO: 15491 - RNA, 64 nt, Human
uucuucuggcugcaaaggucugaguuauuacgcuacaugacaacguuucgacauuucaccggca

SEQ ID NO: 15492 - RNA, 64 nt, Human
aaaguugcaagauaaacagcuguaauucggacaaacaugacaaacacagugaagccaacuaucc

SEQ ID NO: 15493 - RNA, 64 nt, Human
gcaaaaauuuuuggauugacaguaacuugguuauacaugacacugaaaugccuuacuuuguaug

SEQ ID NO: 15494 - RNA, 64 nt, Human
guacagauuuauacauaaaccuaaaagcauuugaacaugacacccgaacacauacauauauguu

SEQ ID NO: 15495 - RNA, 64 nt, Human
ggggaccaagauccggaaagaugaauaaagacaaacaugacaaacuaagaaaacacagugugcu

SEQ ID NO: 15496 - RNA, 64 nt, Human
gaaacaaucaaaucaaagccuugugucaguuaacacaugacaaguggucucaaugcagcuagga

SEQ ID NO: 15497 - RNA, 64 nt, Human
gucuuuuauugucuuagauacuauaagaagaugaacaugacaauuuucuagaaccugguagcgu

SEQ ID NO: 15498 - RNA, 64 nt, Human
guuuucuucaaacagaugaaaacuuuauucucaaacaugacagagcguuccuuuuaucaauggc

SEQ ID NO: 15499 - RNA, 64 nt, Human
gggaccugcucagugcccccccugccuuacagcuacaugacagugcuguuuuauuugaacaacg

SEQ ID NO: 15500 - RNA, 64 nt, Human
ggagagcaagagaagguauguacugccugaggucacaugacagugaccaaguggagacaguaag

SEQ ID NO: 15501 - RNA, 64 nt, Human
aaucuguacuugggagcagccugcuggauccagaacaugacaacagagagcugcguccacaggg

SEQ ID NO: 15502 - RNA, 64 nt, Human
aucuuguguauuuagaaaaauguauuacuugaaaacaugacauagaacauugaguuagcaauuu

SEQ ID NO: 15503 - RNA, 64 nt, Human
ucaugacagaaggugaagggggagcaggcacaucacaugacaaaagcaggaacaagacucagag

SEQ ID NO: 15504 - RNA, 64 nt, Human
ugccccccgaccugcgggccgcuguuuugguuugacaugacaaggaaaggacuuccugcugacc

SEQ ID NO: 15505 - RNA, 64 nt, Human
uaauuugugauaucauguucuagaaauaccugcaacaugacagucuaaucaguagucuauuaaa

SEQ ID NO: 15506 - RNA, 64 nt, Human
aauuaugagaccaccuuggagaaaggugugugguacaugacauuggguuacaucauaacgugcu

SEQ ID NO: 15507 - RNA, 64 nt, Human
uccaaggaacaacaucaguucacuguuguuggagacaugacaaucauuuucaucccaagaacac

SEQ ID NO: 15508 - RNA, 64 nt, Human
uuuggggcuuuaucggaaucccgcucacaucagaacaugacagaaucuucagacuaugaggaag

SEQ ID NO: 15509 - RNA, 64 nt, Human
acugcugauaucaucuucaggaagcaaguccauaacaugacauaucuggauuuugugcuuagaa

SEQ ID NO: 15510 - RNA, 64 nt, Human
aaaucuuuuagucauuauagaucccccagacuuuacaugacacagcuuuaucaccagagaggga

SEQ ID NO: 15511 - RNA, 64 nt, Human
gaugucugugggccugcguggggacaacaggggcacaugacaucugccugggcccugaccaaua

SEQ ID NO: 15512 - RNA, 64 nt, Human
uucuggucagccacagaacacauacagaaaacagacaugacagaacuguuccugccguugccgc

SEQ ID NO: 15513 - RNA, 64 nt, Human
uggacaguaaaugaauuugaacuuuauguugaggacaugacauugguuugaaaauauaaacugc

SEQ ID NO: 15514 - RNA, 64 nt, Human
cauccaggaagcuagucccuuguuucuccuuucuacaugacauugcaguggugguuucuguaau

SEQ ID NO: 15515 - RNA, 64 nt, Human
guucguaucauauaugcgaacuuuuuagacaugaacaugacauguucagcuaggcagaguucuc

SEQ ID NO: 15516 - RNA, 63 nt, Human
agaagggcagcaguagcuaguuaaucuguacaaacaugacacagauguucucuaagauuacug

SEQ ID NO: 15517 - RNA, 64 nt, Human
ugcuuacuuaccucgagagaauuuacaggaguccacaugacaguguccugccugguuggcagcg

SEQ ID NO: 15518 - RNA, 64 nt, Human
ugguagcucaggcaauuauuuuuaccauaucagcacaugacaaggccaugaacacauggcucua

SEQ ID NO: 15519 - RNA, 64 nt, Human
gauggcucagugaauccuugcagaacuucugugcacaugacaucuuuuuccauguugugcagau

SEQ ID NO: 15520 - RNA, 64 nt, Human
uucaggagccaagucacaaucuuucuccuguuuaacaugacaaaauguauguacucacuucagu

SEQ ID NO: 15521 - RNA, 64 nt, Human
cauuuaucccuuacauuuuguuuuuagugacccuacaugacauuaaauuuaaaguaaaacauug

SEQ ID NO: 15522 - RNA, 64 nt, Human
cacuuuuuuugaugaaaugagucacagagaaguuacaugacaaagauaaaaucacaggguugga

SEQ ID NO: 15523 - RNA, 64 nt, Human
cuuauaaaaaacuagugucauguaccugccaugaacaugacaaaagguuagucuucaauagacu

SEQ ID NO: 15524 - RNA, 64 nt, Human
aaucccaaacucugcccucuuagcaucuuauucuacaugacaacucucaagguacucacagauc

SEQ ID NO: 15525 - RNA, 64 nt, Human
agaagcauagccacucccauuuuaugagcuacucacaugacaaaugucaucuuuugcuauaacc

SEQ ID NO: 15526 - RNA, 64 nt, Human
ucccaauauagggugcagacaagagcaaucccugacaugacauuauagccugggaaagggcugg

SEQ ID NO: 15527 - RNA, 54 nt, Human
aguuuuugcaaggauucuaagagcacaugacauguggcugccuccccuuucaga

SEQ ID NO: 15528 - RNA, 64 nt, Human
aacauugaagauugaaaagacuaaugagaagauaacaugacaauauaaaaagacagaaacucaa

SEQ ID NO: 15529 - RNA, 64 nt, Human
gaccugaccgcccaccaccuccuucccccucaucacaugacaaaggauaaugugcaagaaaagu

SEQ ID NO: 15530 - RNA, 64 nt, Human
ucugacagucaccugagccuuaaauguaaguauuacaugacaugcauucuguuucuuccagagu

SEQ ID NO: 15531 - RNA, 64 nt, Human
agacaagcucaggccuauucaauacaauuuacugacaugacaaccuagaacgaagauagcuaug

SEQ ID NO: 15532 - RNA, 64 nt, Human
uacauugacccacaggacauuguaaaauauuaucacaugacaucuuaaguagaaauaaguaggg

SEQ ID NO: 15533 - RNA, 64 nt, Human
uugaguuucacuuucuuuaagucucacauugcuaacaugacauuagcuguaagaaacaagauag

SEQ ID NO: 15534 - RNA, 64 nt, Human
uaacucauagucuacguaacuucagagucuuuaaacaugacaauccacauugucauaugugaaa

SEQ ID NO: 15535 - RNA, 64 nt, Human
gccacauuaauaauacuuuucaugccucacuuugacaugacagcauucgauuuuuuuaaagauc

SEQ ID NO: 15536 - RNA, 64 nt, Human
uuaacggugcuaaaaaugaaaauucuaacccaagacaugacauucuuagcuguaacuuaacuau

SEQ ID NO: 15537 - RNA, 64 nt, Human
aauggaacacaccgucaacaugaauucgcaccuuacaugacagaagugauucagggauuccuau

SEQ ID NO: 15538 - RNA, 64 nt, Human
agcaaaaagauuguguguauguauguuuaauauaacaugacaggcacuaggacgucugccuuuu

SEQ ID NO: 15539 - RNA, 64 nt, Human
gugucuugguugagagaauaaccucaccguacccacaugacacgugauuuggaaagagacuaga

SEQ ID NO: 15540 - RNA, 64 nt, Human
gggugcagaaaggugaauuaacuuuacaaaguagacaugacaagugaacagcagagcugggauc

SEQ ID NO: 15541 - RNA, 64 nt, Human
gugucuugguugagagaauaaccucauaguaccaacaugacaugugacuuggaaagagacuaga

SEQ ID NO: 15542 - RNA, 64 nt, Human
gauauguuaacuauuguauaauggggccuguuacacaugacacucuucugaauugacuguauuu

SEQ ID NO: 15543 - RNA, 64 nt, Human
caugucagccucccaaguagcugggacuacaugcacaugacacuaugcccagcuaauuuuuuau

SEQ ID NO: 15544 - RNA, 64 nt, Human
gaaugacugggugguggcugccacuagcccaggaacaugacaacgugaccacaccacacaugcc

SEQ ID NO: 15545 - RNA, 64 nt, Human
ccuaaaagucaagguacuucaguuuauuuggcaaacaugacaacauuuuuuuuggcccugggcc

SEQ ID NO: 15546 - RNA, 64 nt, Human
agaaaccgacccauuuuuuucccagaucaagaugacaugacaucacucccaauucucuccaaac

SEQ ID NO: 15547 - RNA, 64 nt, Human
uugaaaugaaugcaauauuaauagaugcauauauacaugacauauugugguuaauuuuaaaacu

SEQ ID NO: 15548 - RNA, 64 nt, Human
gaagucagucugcagaaaauaaauauuuaguaugacaugacacuuaucccauuuccuuucuccu

SEQ ID NO: 15549 - RNA, 64 nt, Human
caggcacaagagccacaguacccuagauagugucacaugacaccguugucauccaaggauaaua

SEQ ID NO: 15550 - RNA, 64 nt, Human
ugaacugagccacuggggaagggaaguuucaguaacaugacacuaaaauggcagagacguuaaa

SEQ ID NO: 15551 - RNA, 64 nt, Human
ggugcaaaaauaaaaggaaaaccagugaagugccacaugacagcaguguuaaguguuugaaaac

SEQ ID NO: 15552 - RNA, 64 nt, Human
acaaugcuaauuaggauugcauuccuggccaaagacaugacaucaaauaaguaauagacaucac

SEQ ID NO: 15553 - RNA, 64 nt, Human
cauuuccucuuuuccccgccugcacccacucugaacaugacaaaaguugccagaguuggggcau

SEQ ID NO: 15554 - RNA, 64 nt, Human
auguacuauucuauaaauugccuuucugaauagaacaugacaugccauuuucuagcagcugcca

SEQ ID NO: 15555 - RNA, 64 nt, Human
aauaaugugauggcaaucuuaauuuuuggguacaacaugacaagcugugaguuuguguguuugu

SEQ ID NO: 15556 - RNA, 64 nt, Human
uugcuggaacaguuuagguaccuaccacuucuucacaugacacaggggaauccugauuagucaa

SEQ ID NO: 15557 - RNA, 64 nt, Human
cuguuuguaacuaaaaccaucuacuauauguuagacaugacauucuuuuucucuccuuccugaa

SEQ ID NO: 15558 - RNA, 64 nt, Human
auugcgaaaguccaaauuuugauguggggcuauaacaugacacccuuggauugcgacugguuuu

SEQ ID NO: 15559 - RNA, 64 nt, Human
uucacccuuaaaauauuucagcagacaugucugcacaugacaguguaaaaaaguuuaaugucaa

SEQ ID NO: 15560 - RNA, 64 nt, Human
gaucagccacuugcugacccugguucuuaaggacacaugacauuaguccaaucuuucaaaaucu

SEQ ID NO: 15561 - RNA, 64 nt, Human
gaugugcaaaugcccuucagcacaggaccuggugacaugacauaaacuccaagacagaaccuca

SEQ ID NO: 15562 - RNA, 64 nt, Human
aaaguccaaaaaucagaagcugaggacugucuguacaugacauugaaucacaugaauggauuac

SEQ ID NO: 15563 - RNA, 64 nt, Human
gggaugugcuacauugucuauuuuuggcggcugcacaugacaucaaauuguuuccugaauuuau

SEQ ID NO: 15564 - RNA, 64 nt, Human
cccauuuccgugcuauuaaucacuuguuagagcaacaugacaugcccagcaucccacuucccga

SEQ ID NO: 15565 - RNA, 64 nt, Human
uggcucuaguuuuauagagcuccaaguguauuaaacaugacagccauucauucauaaagaucug

SEQ ID NO: 15566 - RNA, 64 nt, Human
aagcuccaaauccaaggaaacaugcagcucuucaacaugacauccagagaugacuauuacuuuu

SEQ ID NO: 15567 - RNA, 64 nt, Human
uccuuacgaaucaccgaggaacacugggcugagcacaugacagggagccuggagccccggggcc

SEQ ID NO: 15568 - RNA, 64 nt, Human
cgacucccuggugacgcuccucccagaucgcucuacaugacauucaggacacacacacacacac

SEQ ID NO: 15569 - RNA, 64 nt, Human
auccacuaugguuuaccuugaguggccugcacgaacaugacagcccugaucuguauuuccuuuc

SEQ ID NO: 15570 - RNA, 64 nt, Human
gaaacaacguuccucuccaccugcauuauguacuacaugacaggcaucaaucuggggaaauaau

SEQ ID NO: 15571 - RNA, 64 nt, Human
cuaucugggugauauauucuucuuuauaucucugacaugacauauuuucauuaauaguuuaaau

SEQ ID NO: 15572 - RNA, 64 nt, Human
guucaaaaggaaaagaguaugcccaauucucucuacaugacauauugagauuuuuuuuaaucaa

SEQ ID NO: 15573 - RNA, 64 nt, Human
gcugugguuaggcuugguuagagugcagcaagcaacaugacagaugguggcacgcuguuuuuac

SEQ ID NO: 15574 - RNA, 64 nt, Human
augcccaguuauuaaaauuacaucuuuaaagaauacaugacaacaugggaaauuacguaaguca

SEQ ID NO: 15575 - RNA, 64 nt, Human
acaagcuauuugaguuuugacuugacaaggcaaaacaugacaguggauucucuuuacaaaugga

SEQ ID NO: 15576 - RNA, 58 nt, Human
ucaacuuguucaaguucugaaucccagcacaugacaacacuucagaagggucccccug

SEQ ID NO: 15577 - RNA, 64 nt, Human
guauaaucaaccauacuguuagucacacacgcccacaugacaaucaucugaaaguccccaacua

SEQ ID NO: 15578 - RNA, 64 nt, Human
ccuaauagaaauacuuuuagauuugauuauguauacaugacaccuaaagagggaacaaaaguua

SEQ ID NO: 15579 - RNA, 64 nt, Human
cacguccaaaugguggacaguagcuccaacagugacaugacagagggagggccugugugugugg

SEQ ID NO: 15580 - RNA, 64 nt, Human
guugccgugagcugagaucacaccacugccauaaacaugacaggcuuuuggacuuuguauuacc

SEQ ID NO: 15581 - RNA, 64 nt, Human
gugagccugcauuaggagauagacugauuaccauacaugacauaaaaaggaacaguggauagcu

SEQ ID NO: 15582 - RNA, 64 nt, Human
ggagaguuuuuaauuaaaagaaugugugaaaaguacaugacacaguaguugcuugauaauaguu

SEQ ID NO: 15583 - RNA, 64 nt, Human
gguuguaggauugaggaacggaaucugccgacucacaugacagcccauucuuucuuucugggug

SEQ ID NO: 15584 - RNA, 64 nt, Human
aggaaaaacuucuguauggaggaaaagacaguaaacaugacagacugauagaaaguauuggcag

SEQ ID NO: 15585 - RNA, 64 nt, Human
aauauucccaaggaggauuugucaaucaaggaaaacaugacagauggugagguaaagucaaagg

SEQ ID NO: 15586 - RNA, 64 nt, Human
agggcaggggaaagaaacgcguuaaagggccaugacaugacacaguucccuggccggguuugga

SEQ ID NO: 15587 - RNA, 64 nt, Human
uaaguucagccauuauuacuuuugguaucccagaacaugacaaauuaugaauaaaacaaguaua

SEQ ID NO: 15588 - RNA, 64 nt, Human
gcuuaaaagaagcugaaaacuuaaugcaggaagaacaugacaaccaagcaaaugugaggagucu

SEQ ID NO: 15589 - RNA, 64 nt, Human
aaauuuaaauggacauuacaagcuaucaaauucuacaugacacaggacaugucacucccauggc

SEQ ID NO: 15590 - RNA, 64 nt, Human
gccauauuuucaccauuugauuauguagcaaaauacaugacauuuauuuuucauuuaguuugau

SEQ ID NO: 15591 - RNA, 64 nt, Human
cagaucauaaagaaagaaguaaaacuauaucugcacaugacauaaucuugucuauggaaaaucc

SEQ ID NO: 15592 - RNA, 64 nt, Human
aacaacuauuaauacagauacucagaagccaauaacaugacaggagcugggacugguuugaaca

SEQ ID NO: 15593 - RNA, 64 nt, Human
aaugcagcuucuguccuuucuugggaugucuaaaacaugacaaacagggugaucuguuguacac

SEQ ID NO: 15594 - RNA, 64 nt, Human
ccaggcaugagagacaugucauauucaacagggcacaugacauauacaugguggcagguccuag

SEQ ID NO: 15595 - RNA, 64 nt, Human
cagauuuuuauccacagauaguuguaguguuuagacaugacaggaccuaucguugagguuucua

SEQ ID NO: 15596 - RNA, 64 nt, Human
aaaagguguggaagugaauauaaaaugcaucuaaacaugacauuuaauuuguuuauaaaaauaa

SEQ ID NO: 15597 - RNA, 64 nt, Human
gccucugauaugggacugagccuggcccauagaaacaugacacugaccuuggagagacacagcg

SEQ ID NO: 15598 - RNA, 64 nt, Human
caucuuucuguuaauuucccucugccuaaagacuacaugacagaaaugaccuaucacuacuuau

SEQ ID NO: 15599 - RNA, 64 nt, Human
auuucuuuuuucucaaaaagaaacuguaggaaauacaugacagagaaaguuacacucagggagc

SEQ ID NO: 15600 - RNA, 64 nt, Human
aauuuauuaaauuucagucagaaggucagcauuuacaugacagaauguauguagagaguugggg

SEQ ID NO: 15601 - RNA, 64 nt, Human
uauuucaguacuaggagcuucuuugcagucauuaacaugacaaauuaaguaauaaauauaaaag

SEQ ID NO: 15602 - RNA, 64 nt, Human
uaaccagcacaaagcaaugucagggaggagugauacaugacaauaaaugagucagaugagcaag

SEQ ID NO: 15603 - RNA, 64 nt, Human
ggaagaagaaaagagugaggcugaaaguaaagccacaugacaagcauauaaaaaaaaaugcaga

SEQ ID NO: 15604 - RNA, 64 nt, Human
guaggaauuuguauuuuuugccuuuguucagaauacaugacauugguaaauaugccacaugccu

SEQ ID NO: 15605 - RNA, 64 nt, Human
uggggugggaguggggagcaggaauugcacucagacaugacauuucaauucaucucugcuaaug

SEQ ID NO: 15606 - RNA, 64 nt, Human
uucacuguaauaaacugacugugguuucuuaagaacaugacacuaaaaaaaaaguguuuuuuuu

SEQ ID NO: 15607 - RNA, 64 nt, Human
ugccauaaugauauguccauuauuagauuauguuacaugacaaaguugaaggaauuuggcagau

SEQ ID NO: 15608 - RNA, 64 nt, Human
auauuaaauagagaacaaauaagagagguccuuuacaugacaaauuugcaugaaauaagcagau

SEQ ID NO: 15609 - RNA, 64 nt, Human
aguuagccgagaucaugccacugcacuccagccuacaugacaaugugacacuccaucucaaaaa

SEQ ID NO: 15610 - RNA, 64 nt, Human
auuuuccaagcguguaauaaugauguuuuuccuaacaugacagaugaguaguaaauguugauau

SEQ ID NO: 15611 - RNA, 64 nt, Human
ugacagaugaguaguaaauguugauauauccuauacaugacagugugagacuuuuucauuaaau

SEQ ID NO: 15612 - RNA, 64 nt, Human
uagcagucuggcuguagagucaucaauaguuugcacaugacagaaagcuggaagaaauagucaa

SEQ ID NO: 15613 - RNA, 64 nt, Human
cuuaccaauagcaggggcugcaguagccauguuaacaugacauuuaccagcaacuugaacuuca

SEQ ID NO: 15614 - RNA, 64 nt, Human
cuaccuucauuucaggagggauuggccgcuuggcacaugacaacuuugccagcuuuuccucccu

SEQ ID NO: 15615 - RNA, 64 nt, Human; identical to SEQ ID NO: 15614

SEQ ID NO: 15616 - RNA, 64 nt, Human
uaaucauuuuaagugcaugaaauguaugcuuuguacaugacacuucaauaaagcuauccagaaa

SEQ ID NO: 15617 - RNA, 64 nt, Human
cagcaccaccucauacuaagaauuccucacucugacaugacaguauuuuuucugaccaggagcu

SEQ ID NO: 15618 - RNA, 64 nt, Human
gcuugagcccaggaguuugagaccgacaugggcaacaugacaagaccccaucucuacaaaaaaa

SEQ ID NO: 15619 - RNA, 64 nt, Human
ucccugagaaacaguucagcagugaccaccacccacaugacauuucaaagcaccuccuuaagcc

SEQ ID NO: 15620 - RNA, 64 nt, Human
aggugggucgcagcaccagauggggagcuuuaugacaugacaggcgggaguuuuguaccacuuu

SEQ ID NO: 15621 - RNA, 64 nt, Human
uuacaaccuaguaauaauguggauaaauguaucuacaugacacaugucaagaccaaaauaacug

SEQ ID NO: 15622 - RNA, 64 nt, Human
ucagggcucgggguagcuugaauuuguagcaggcacaugacagaaauuguauguauuguggauc

SEQ ID NO: 15623 - RNA, 64 nt, Human
gcacauugccauucuuugaaacucauguuucuagacaugacagcaguaauaaaaggaugaaaac

SEQ ID NO: 15624 - RNA, 64 nt, Human
gucagaucagauuugcuaacaggaagcauucuuuacaugacaguaucuugaguuaugugaguuu

SEQ ID NO: 15625 - RNA, 64 nt, Human
gaagaauuugaagagggcucaagauuuugaguccacaugacagaaggacuggaaugccaugaac

SEQ ID NO: 15626 - RNA, 64 nt, Human
gauuauuuuuuaaaaagguaaaugguuaaauuuuacaugacagauauuuuaucuauuggccugu

SEQ ID NO: 15627 - RNA, 64 nt, Human
ucuuguugauagcuuuuuguucucuaagguugaaacaugacagugcuuaucucaaacagauuac

SEQ ID NO: 15628 - RNA, 64 nt, Human
ggacuuuuauauauagaucuacauaaaaacugcuacaugacaaaaaccacaccuaaagaaauuu

SEQ ID NO: 15629 - RNA, 64 nt, Human
uaauaaagacugugaacugccuggugcaguguccacaugacaaaggggcagguagcacccucuc

SEQ ID NO: 15630 - RNA, 64 nt, Human
cagggacgccucagccccuuaacauggaugugccacaugacaggcaauaauauauuggccccau

SEQ ID NO: 15631 - RNA, 64 nt, Human
auuuuuuuuggccuaugaaauuguuaaaccuggaacaugacauuguuaaucauauaauaaugau

SEQ ID NO: 15632 - RNA, 64 nt, Human
ucuaugagaaguacacuggaagcguggggggaacacaugacaugauuugugaauaucaucaucu

SEQ ID NO: 15633 - RNA, 64 nt, Human
cgcgcugcugugaaacguccugaccugugaucacacaugacagugaggaaaccaagugcaacuc

SEQ ID NO: 15634 - RNA, 64 nt, Human
uccauucuuccuccagccaaccccugaaaauuuuacaugacauagaaacuguauuuuuccuuuc

SEQ ID NO: 15635 - RNA, 64 nt, Human
aguuuccuuauguuaauccuuuaacacuaagguaacaugacauaaucauaccauagaagggaac

SEQ ID NO: 15636 - RNA, 64 nt, Human
agcuucaaauggaauauuuaccgacauuccuuauacaugacagacacuuggcuacaugggaaga

SEQ ID NO: 15637 - RNA, 64 nt, Human
guacuaaaaaucaauuggaugaacuaaauccaaaacaugacacuguaggcagcaguuuuaaguc

SEQ ID NO: 15638 - RNA, 64 nt, Human
uucugagguuuuuuugaaacauuaaaguuccaaaacaugacauuuuuaagaauaaauuugaaau

SEQ ID NO: 15639 - RNA, 64 nt, Human
gugaaagguucuguaugacacugugaugguggguacaugacauugggcauuggucaaaacccau

SEQ ID NO: 15640 - RNA, 64 nt, Human
ucuugggcgaggaugugcuggauuaggaaaggugacaugacacaggcagagcagaguggcaccc

SEQ ID NO: 15641 - RNA, 64 nt, Human
uguauuuuaagcuuaccugugaauagcccaauaaacaugacacacuguguuggcaaaaggccuu

SEQ ID NO: 15642 - RNA, 64 nt, Human
uuuaaguaacuuggguuuaauuuacagagaugaaacaugacagucugaguaaaauacccaguga

SEQ ID NO: 15643 - RNA, 64 nt, Human
aauugaauuaggcuugugacaauuagaguaauuuacaugacagguaaaacuccuauuaaaaaug

SEQ ID NO: 15644 - RNA, 64 nt, Human
uuucaguguaagagcuuaaagcaagcucagucauacaugacaaaguguaauuaacacugauguu

SEQ ID NO: 15645 - RNA, 64 nt, Human
uggaaacuccugugucuguguauauuacaagccuacaugacacaguuggauuuauucugccaaa

SEQ ID NO: 15646 - RNA, 64 nt, Human
gugugcucacugugggggccaguuucuccucggaacaugacaaugaagcucuuuuagagaaaag

SEQ ID NO: 15647 - RNA, 64 nt, Human
auucauuugcugauuauauuucugagcugcuaccacaugacagacacaaggcucagaugaagag

SEQ ID NO: 15648 - RNA, 64 nt, Human
uccccuuguccccacccagucaccaaagccaccuacaugacaguccaucccuguugaauuaaua

SEQ ID NO: 15649 - RNA, 64 nt, Human
cuucuagauuacccccuccuccugccauacccgcacaugacaauggaccaaaugugccacacgc

SEQ ID NO: 15650 - RNA, 64 nt, Human
auuggaugagccuugagauugcuucuuaacugggacaugacauuuuucuagcucuuaucaagaa

SEQ ID NO: 15651 - RNA, 64 nt, Human
acgaaccgaugguugagggauugucacgggaggaacaugacacccgaagggacucuaggugccc

SEQ ID NO: 15652 - RNA, 64 nt, Human
caccaaagucuggcagacuuucugcauuugagaaacaugacaaagggccccgcagcccuucugc

SEQ ID NO: 15653 - RNA, 64 nt, Human
aacgagucuuucaugaugugacuuugaggccccaacaugacagccacugggccaccgggaccca

SEQ ID NO: 15654 - RNA, 64 nt, Human
ucugguugggcugggaggccacacacacacacugacaugacagggcuugggcaagacuccuguu

SEQ ID NO: 15655 - RNA, 64 nt, Human
ugcccaccuaagggcuaaggccucuugcuggugcacaugacauuuguccugcagagcugggggg

SEQ ID NO: 15656 - RNA, 64 nt, Human
gggagaggggagagagagagagaugcuguugagcacaugacaaaauaaaauaaaauggaugauu

SEQ ID NO: 15657 - RNA, 64 nt, Human
cgagaagggacaguggagucauccaggugcugccacaugacaggcacggugggcaccgauccac

SEQ ID NO: 15658 - RNA, 64 nt, Human
aacuguucagcuguccucccuccaccuaccacucacaugacacccgugagcgccugugcacaca

SEQ ID NO: 15659 - RNA, 64 nt, Human
acuucuuguggcgccaccuccacgucugucuuguacaugacacuccuccacgcgguuuccagug

SEQ ID NO: 15660 - RNA, 64 nt, Human
agauuuauaggaaugaggagguuuggcuauugucacaugacagacuguuagccaaggacaaaga

SEQ ID NO: 15661 - RNA, 64 nt, Human
agaguaacaagccaaaugaacagacaaguaaaagacaugacagcgauacuuucccagagcugaa

SEQ ID NO: 15662 - RNA, 64 nt, Human
uaauuguuaaaaaaaaaaaguuuuaaacagaagcacaugacauaugaaagccugcaggacuggu

SEQ ID NO: 15663 - RNA, 64 nt, Human
auaagaagcuaaaauaguaaacuuaaaaucacaaacaugacauugcugauaguggcugagaaau

SEQ ID NO: 15664 - RNA, 64 nt, Human
ugugacgauuucuaaauguaggaaggccugugaaacaugacacugcaguuaaauugguuggccu

SEQ ID NO: 15665 - RNA, 64 nt, Human
uugucagguuuaauuucaguuaacaaaauguaaaacaugacauucccugcagauauuguuguau

SEQ ID NO: 15666 - RNA, 64 nt, Human
agacaggagcguaugugaaaacaucaaacacugcacaugacaggauggguccucucauacagau

SEQ ID NO: 15667 - RNA, 64 nt, Human
aaacacagaaauaauuagacaauugucuauuauaacaugacaacccuauuaaucauuuggucuu

SEQ ID NO: 15668 - RNA, 64 nt, Human
uuugucucaguuuguacuccuaaauaaaaaguaaacaugacaccucuaaaagaaucgcuccauc

SEQ ID NO: 15669 - RNA, 64 nt, Human
cuauuuccccaccuuucguguaaggugcuacugaacaugacagcuucuugucaugacaggaaac

SEQ ID NO: 15670 - RNA, 64 nt, Human
uucccauuuuuguccucauaaucaaaacagcauaacaugacaucaucaccaguaauaguugcau

SEQ ID NO: 15671 - RNA, 64 nt, Human
guaaggucagaauuuagcaaaaguauaaugagggacaugacaaaaucuguguccacuagaaucu

SEQ ID NO: 15672 - RNA, 64 nt, Human
agaaaaaaaucauauacugagguugcuaagaucuacaugacaauaagauauuuugggagagaga

SEQ ID NO: 15673 - RNA, 64 nt, Human
caccugcaaaggacagggacugggaccguuacuuacaugacacugcacccaggagauacaaauc

SEQ ID NO: 15674 - RNA, 64 nt, Human
ugcaaggauucccuucauguaaauucuuggucucacaugacacuuggucauucuuccagccucc

SEQ ID NO: 15675 - RNA, 64 nt, Human
aucaucacugccagagcucaagaucccacacccgacaugacauaaauaaaaaaauaaauagugu

SEQ ID NO: 15676 - RNA, 64 nt, Human
aaggucuggccagugaaauguauguggaaauguuacaugacacuucuagaaggauucuuaaaag

SEQ ID NO: 15677 - RNA, 64 nt, Human
aaagcguuaucucauagcucaagcuuucgaagacacaugacaaugcacacuggagauggaccuc

SEQ ID NO: 15678 - RNA, 64 nt, Human
ugaggauguuuuuauauuuaaauguagcaaacauacaugacaguucuugcuguguaacagaugc

SEQ ID NO: 15679 - RNA, 64 nt, Human
ucauccacagacauuucauacauaucuuuaaagcacaugacaacauuagaaaauauuuucacuc

SEQ ID NO: 15680 - RNA, 64 nt, Human
uuuagagaaaauucaaggaauggaagaguaaauuacaugacacaaaaaggagcaauuaaaucua

SEQ ID NO: 15681 - RNA, 64 nt, Human
ugcacaaguacaguaacaaucugcuuucuuuguaacaugacacauuugaaaucauugguuauau

SEQ ID NO: 15682 - RNA, 64 nt, Human
gaaaagucuuuggggaugauucagucuguaccagacaugacaacacacacacuggaaugaaaug

SEQ ID NO: 15683 - RNA, 64 nt, Human
cacuguuagagagcaaaaucaucuaaguauugccacaugacaagauuaguaaacaggaauacua

SEQ ID NO: 15684 - RNA, 64 nt, Human
aaauaugcuuccacauuucaaaauauaaaauguaacaugacaagagauuuugcguuugacauug

SEQ ID NO: 15685 - RNA, 64 nt, Human
cauguagcaccaccugagccagaaacugcagaggacaugacaguguggcauuacugauaaguua

SEQ ID NO: 15686 - RNA, 64 nt, Human
gaggccugagaaagcaagcacgcacucucagucaacaugacagauucuggaggauaaccagcag

SEQ ID NO: 15687 - RNA, 64 nt, Human
uaaccucccuauucagaaagcuccacaucaauaaacaugacacucugaagugaaaguagccacg

SEQ ID NO: 15688 - RNA, 64 nt, Human
uguauuuugucaguaauuguacauaacuuuuggcacaugacauagaaauggcuauguaaacuau

SEQ ID NO: 15689 - RNA, 64 nt, Human
agugagucagaucuauugcuucucuguauuacccacaugacaacugucuauaaugaguuuacug

SEQ ID NO: 15690 - RNA, 64 nt, Human
augucuuaacaaaucagaucagauguucauccuaacaugacaguauuccauuucuggacaugac

SEQ ID NO: 15691 - RNA, 64 nt, Human
ugcuucccuuggugucagggaccugagaguaagcacaugacagcgucugcuugcguugugucug

SEQ ID NO: 15692 - RNA, 64 nt, Human
ccugacgccaccccgccccaucagcacuuaagccacaugacacaaagucuguaccgcacgggaa

SEQ ID NO: 15693 - RNA, 64 nt, Human
gcgugagcccaggaguuccagaccaggcugggucacaugacaaagccccaucucuacaaaaaaa

SEQ ID NO: 15694 - RNA, 64 nt, Human
gcuugagcccaggaauucgagaccagccugggccacaugacaaagccccaucucuacaaaaaaa

SEQ ID NO: 15695 - RNA, 64 nt, Human
gagagccuggacaucagggacuuuugcccacagcacaugacaccgacagcugcccagccuguuc

SEQ ID NO: 15696 - RNA, 64 nt, Human
gcagguagacauccgcgaggucagaugcuuuccaacaugacaccugaacaucuuccuuuaugca

SEQ ID NO: 15697 - RNA, 64 nt, Human
gcugcaaauagccuuccugaccuccauaugcuguacaugacaucaaaaugagucaggcaauuga

SEQ ID NO: 15698 - RNA, 64 nt, Human
gccucaaguugcgcccucuagguagcacuugaaaacaugacaagggcccguaguuguuuggaua

SEQ ID NO: 15699 - RNA, 64 nt, Human
cucagguggcauuugcaggugaccagaaugaggcacaugacagugguuauauuucaaccacacc

SEQ ID NO: 15700 - RNA, 64 nt, Human
gugauaaaauguacaauuuacgcucugaauagaaacaugacaccaaagaaagggcauugccaug

SEQ ID NO: 15701 - RNA, 64 nt, Human
cucuggaaauugaaaucauaaucugucaaugaauacaugacaagacagaacguuccuugccagg

SEQ ID NO: 15702 - RNA, 64 nt, Human
uaugauacgagcacaacuugagcuacaguaaacuacaugacaguguuuugauaauuguuguaua

SEQ ID NO: 15703 - RNA, 64 nt, Human
uaugauacaagcacaacuugagcuacaguaaacuacaugacaguguuuugauaauuguuguaua

SEQ ID NO: 15704 - RNA, 64 nt, Human
uaugauacaugcauaacuugagcuacacuaaaccacaugacaguguuuaguuaauucuuguaua

SEQ ID NO: 15705 - RNA, 64 nt, Human
acuuucaaaauuauuagugacuaguaaugguuuuacaugacaauuuguaaucauaagagauggu

SEQ ID NO: 15706 - RNA, 64 nt, Human
uauuaguggggaacagaaguauaugugcuuaagaacaugacagguucaugcaaauaugcucucu

SEQ ID NO: 15707 - RNA, 64 nt, Human
uuccaauugucuccugcuagcaauaugugccacaacaugacagucuugugacaucuuaaggaaa

SEQ ID NO: 15708 - RNA, 64 nt, Human
ucaauuacagaucuaaauugaaccaaguguuuuuacaugacaaguucucugaggaugguucuac

SEQ ID NO: 15709 - RNA, 64 nt, Human
accuuuauaucauuuucuauguuuuuauuuaaaaacaugacauuuggggccaggcgcgguggcu

SEQ ID NO: 15710 - RNA, 64 nt, Human
agucuggcuaucugagauacagcugugagagccggauccggaguuaccugagggaggugagccu

SEQ ID NO: 15711 - RNA, 64 nt, Human
augugaaacagucauccuucugcauaaauugaaggauccggauuccuuaaugauggacugaaug

SEQ ID NO: 15712 - RNA, 64 nt, Human
cugcgucgcccgagccccgggagagaggagcgaagauccggaacucgccaacucaccccgggca

SEQ ID NO: 15713 - RNA, 64 nt, Human
gggccgccugucccggcguccgcgaaacgcuacggauccggacgggcgccgucgcucggguggc

SEQ ID NO: 15714 - RNA, 64 nt, Human
gaguguggcugcaagagaaaaggggcuggaggaagauccggagggcagggguguucccucugcu

SEQ ID NO: 15715 - RNA, 64 nt, Human
cgguguaagaucuucucaucagcccucaauuugugauccggaauuuuaugagaaggauuagaaa

SEQ ID NO: 15716 - RNA, 64 nt, Human
cuucggaaauccugcaaauagaaagauaauucuagauccggaauaccuguaucugguggaaacc

SEQ ID NO: 15717 - RNA, 64 nt, Human
acgaugacaguguuccccgauaccaugcuguaaggauccggaaagaagagcgagagaucaaaga

SEQ ID NO: 15718 - RNA, 64 nt, Human
gguggggugggugggugcuggcgguggggaccaagauccggaaagaugaauaaagacaaacaug

SEQ ID NO: 15719 - RNA, 64 nt, Human
uccgccuggggcagaaagccacaaacuccauccagauccggaacgucagccagcucccagccac

SEQ ID NO: 15720 - RNA, 64 nt, Human
ggacgaccucguaucccgcguccccgccgcgcuggauccggacugaguggccgggccugcggac

SEQ ID NO: 15721 - RNA, 64 nt, Human
uguuuuuuaagauugagaauacauaccugacaacgauccggaaacugcuccucaccacucccgu

SEQ ID NO: 15722 - RNA, 64 nt, Human
uuccccccaucccucugagggccggcggaugcuggauccggagccccagguuccgccccagagc

SEQ ID NO: 15723 - RNA, 64 nt, Human
agaagucuguccgucuaugaacaugcgggggaaggauccggaaccaggacccagaagcaccucc

SEQ ID NO: 15724 - RNA, 64 nt, Human
agagggagccaggcagcuguguacagugagaagggauccggaugggggagcucuguacagaggg

SEQ ID NO: 15725 - RNA, 64 nt, Human
ggguggaagcagcggugccgcggagggccagccagauccggacccuucccuuaggguccagucu

SEQ ID NO: 15726 - RNA, 64 nt, Human
aacuaaauagcauguauugugucuuuugcaugaugauccggauuuaauuugauaucacagucua

SEQ ID NO: 15727 - RNA, 64 nt, Human
acuuugccaaccugcccagcugcugccgcuggaggauccggaaagaguuuccgaagagugaagg

SEQ ID NO: 15728 - RNA, 64 nt, Human
gaaucucgucauaagugaucucaggcucucacaggauccggagggaaauguguuagagggucug

SEQ ID NO: 15729 - RNA, 64 nt, Human
ucaguccccuccccaaccucagugacugacagaggauccggaucucagagccugagaccagguu

SEQ ID NO: 15730 - RNA, 64 nt, Human
cacccgcgggggcucccccugcacauuugcacacgauccggagagccgaaggccgcgugcuucc

SEQ ID NO: 15731 - RNA, 64 nt, Human
uuuagcggccugccaccacagcacgcggccuccugauccggaagcacgcagcauguucccugcu

SEQ ID NO: 15732 - RNA, 64 nt, Human
auuacuuucuuuucuggagugccaugcuggcgaggauccggaugcggcagcacccucuuucggg

SEQ ID NO: 15733 - RNA, 64 nt, Human
gaagaauuguaaagaccuguacauagcacaacaugauccggauaauauauauacuguucaugua

SEQ ID NO: 15734 - RNA, 64 nt, Human
uguucaacucuuaugcuacauuaaaaccacacuggauccggauacguaugguggcucacgccug

SEQ ID NO: 15735 - RNA, 64 nt, Human
ggacccugguggggguggcuccuucucacugcuggauccggacuuuuuaaauaaaaacaaguaa

SEQ ID NO: 15736 - RNA, 64 nt, Human
cagccugaaacagacccagacacagccugaaacagauccggacagacagacagaaacagccuga

SEQ ID NO: 15737 - RNA, 64 nt, Human
gggagggacgggagcugguugggguggcuuagcagauccggacagggcccucugucccuguguc

SEQ ID NO: 15738 - RNA, 64 nt, Human
gagucuacaccuauauuugcaaguauguggacuggauccggaugaucaugaggaacaacugacc

SEQ ID NO: 15739 - RNA, 64 nt, Human
uccugccccagagaugaaggggcagcuuugcaaggauccggagccagcucccaggggcccagag

SEQ ID NO: 15740 - RNA, 63 nt, Human
gccagaaguccagcugcugacagcccuggaugugauccggagucccuucccaccaggggcuga

SEQ ID NO: 15741 - RNA, 63 nt, Human; identical to SEQ ID NO: 15740

SEQ ID NO: 15742 - RNA, 64 nt, Human
agcauagccauacaccucagccugugaaaugaacgauccggacccucaccaacuuuccccaccu

SEQ ID NO: 15743 - RNA, 64 nt, Human
gaaaugacaccgcacgccagcgccccgcggccgcgauccggaccccaagcccacggcucccucg

SEQ ID NO: 15744 - RNA, 64 nt, Human
ccgacccgcgggcgaggccggguaccugggcugggauccggagcaagcgggcgagggcagcgcc

SEQ ID NO: 15745 - RNA, 64 nt, Human
ucgacagggacaucuuaggcucugucagugagcagauccggaagaacuuugcucggacacacug

SEQ ID NO: 15746 - RNA, 62 nt, Human
uugcucccucagcuccuccagauggagcaggugcgccggauccccgaggaauacucucuggg

SEQ ID NO: 15747 - RNA, 62 nt, Human
uaggucggggagccagagauccccgaggacgcgcgccggacagucggcacugaccggcccac

SEQ ID NO: 15748 - RNA, 62 nt, Human
agagacugguguaagagugugggguguggcaggcgccggaaauccucaaagcuuucagaagc

SEQ ID NO: 15749 - RNA, 62 nt, Human
ccccuaggcugcugugcggugggacuccacaugcgccggaaggagcuucaggugagcacugc

SEQ ID NO: 15750 - RNA, 62 nt, Human
ccgcccgacugccgugcaguccauggcuagacgcgccggacaggacugauggcgggaccgcg

SEQ ID NO: 15751 - RNA, 62 nt, Human
uccggcgggcaaggaccagggcgagcccuggagcgccggagcggacgcccccagggagcugg

SEQ ID NO: 15752 - RNA, 62 nt, Human
augacugucuggcaggcucugucaguuuagccgcgccggaccgugucaagcaucuaggagag

SEQ ID NO: 15753 - RNA, 62 nt, Human
cuguccggaaggaugggaucuuucugggagcugcgccggacagaguggggagcuccuaguuu

SEQ ID NO: 15754 - RNA, 62 nt, Human
gcugucacugcacagcgcccacggcuacagcugcgccggaucugggcgaccacguuuugccu

SEQ ID NO: 15755 - RNA, 62 nt, Human
gaggcccagaggaacgggaggaaagggaggcagcgccggacggcgcagcuggccaagaggcg

SEQ ID NO: 15756 - RNA, 62 nt, Human
cccucgcucccuuccugagcccagcucguguugcgccggaggcugcgcggccccugauuucu

SEQ ID NO: 15757 - RNA, 62 nt, Human
ccccccaucccugcuuacuuagaccucagccggcgccggacccgguaggggcagucugggca

SEQ ID NO: 15758 - RNA, 62 nt, Human
cugucccccuguguccaccagcuauucuccuggcgccggaacugccucuggucuugauagca

SEQ ID NO: 15759 - RNA, 62 nt, Human
uggccacaauccacgcuucuccggaucgcggugcgccggaaccacggaggaugaugccaguu

SEQ ID NO: 15760 - RNA, 62 nt, Human
gcccagaaucccagcccagaaucccgaccgccgcgccggacgcgccgucucccgggacaagc

SEQ ID NO: 15761 - RNA, 62 nt, Human
cccugccggacucgggcgcgaccugcuggcgcgcgccggauguuucugugacacacaaucag

SEQ ID NO: 15762 - RNA, 62 nt, Human
cccacgagggccucccggccuagggcccgaccgcgccggacgcgguguccggggcagggcag

SEQ ID NO: 15763 - RNA, 62 nt, Human
gagcugcagcgauacaucgaagggcucaagaagcgccggagcaagaggcuguacgugaauua

SEQ ID NO: 15764 - RNA, 62 nt, Human
ugaaaccccgcgggcccuuagcacgcgccccagcgccggagcacggucagggucuucuugcg

SEQ ID NO: 15765 - RNA, 62 nt, Human
ccaguaaaguggacuuaacucccaagugugucgcgccggacaccgggcccuggacaugcugc

SEQ ID NO: 15766 - RNA, 62 nt, Human
uucaacuucagcaccugccccggcaguggggagcgccggauuugcucccaccacggggugac

SEQ ID NO: 15767 - RNA, 62 nt, Human
agccccgccccgucccauaccggccugcgccugcgccggacgcuccgcggccccgccuccgg

SEQ ID NO: 15768 - RNA, 62 nt, Human
cucccucuuucuugaagaggguagaaguuagggcgccggagcccgggccuggaacgcccuca

SEQ ID NO: 15769 - RNA, 62 nt, Human
cgccccaagcagagccgccccugggcccgucugcgccggaggcugcggcggcgggagccacg

SEQ ID NO: 15770 - RNA, 62 nt, Human
ggaagggggacugaggacuggcagagcugccggcgccggacccugcgacaaccggggucccc

SEQ ID NO: 15771 - RNA, 62 nt, Human
uggcuccggagaauggguauuugauggaggcugcgccggagugaagaggucguccucuccau

SEQ ID NO: 15772 - RNA, 59 nt, Human
caggcaaggggcgggacugagccggccccgcgccggaguccaggggccccuucuggacg

SEQ ID NO: 15773 - RNA, 62 nt, Human
uggccugcuccgcguguccccucccuuccucugcgccggacuuggugcgucuaagaugaggg

SEQ ID NO: 15774 - RNA, 64 nt, Human
uucucuacuguaaagugauuuuguuugcagguaagaaaauaauagaugacucaccacaccucua

SEQ ID NO: 15775 - RNA, 64 nt, Human
uagcuugucuuuuccacaugauuugucugugaaagaaaauaauuuugagaucguuuuaucuauu

SEQ ID NO: 15776 - RNA, 64 nt, Human
ugggacuguuucagacuuggaaaggucacagaaggaaaauaauauaauaaagugacaacuaugc

SEQ ID NO: 15777 - RNA, 64 nt, Human
ugggacuguuucagacuuggaaaggucacagaaggaaaauaauauuauauaaagugacaacuau

SEQ ID NO: 15778 - RNA, 64 nt, Human
auuauuuguguucuaacaggaggaugaacuugcugaaaauaaaacuuugcuauguauuuacucu

SEQ ID NO: 15779 - RNA, 64 nt, Human
auagcauuuauuucugugcccuuaaacccauuuagaaaauaacuacaaaguaaaaauguagagg

SEQ ID NO: 15780 - RNA, 64 nt, Human
accaagggccauaucccaagugacuuuguacccagaaaauaacagcuguucaauaaauguguau

SEQ ID NO: 15781 - RNA, 64 nt, Human
gucccauucacacagauauuuugggauaauaaaggaaaauaagcuacaauugcuugucgucuuu

SEQ ID NO: 15782 - RNA, 64 nt, Human
caauuuuucagauuugauaaugcuuuuccaaagugaaaauaagauacacaauaaucauugcucu

SEQ ID NO: 15783 - RNA, 62 nt, Human
uuaaucucccugaacggugauggcaucugaaugaaaauaacugaaccaaauugcacugaagu

SEQ ID NO: 15784 - RNA, 64 nt, Human
acugagauaauacacaggugauaaacaguuucgagaaaauaaaaauuggcuagaaucucaaguu

SEQ ID NO: 15785 - RNA, 64 nt, Human
gaaccuagaauuuauuuuucuccuuagagauaaggaaaauaacauuugccaaauuucauauuuu

SEQ ID NO: 15786 - RNA, 64 nt, Human
aaggauggucuuggccauaugcuagggccccugugaaaauaaguaguuuugagaaguuuuucua

SEQ ID NO: 15787 - RNA, 64 nt, Human
accacuacacuaugguguuaaaccaaaauauagggaaaauaaacacuaacugcugcuuauggau

SEQ ID NO: 15788 - RNA, 64 nt, Human
auauggacugccuuauugcuguugcuuaucauuugaaaauaaaauccagcucagguuguaacuu

SEQ ID NO: 15789 - RNA, 64 nt, Human
uucucuaauaguccucaucauaaacuuuuuaaaggaaaauaagcaaacuaaaaagaacauuggu

SEQ ID NO: 15790 - RNA, 64 nt, Human
agaguaccaacuuaauguuuuucucgaagaaugugaaaauaauuagaccuguuaaauuauaaua

SEQ ID NO: 15791 - RNA, 64 nt, Human
gaaaaaucaugucaucuucuauuuguacagaaaugaaaauaaaauaugaaaauaaugaaagaaa

SEQ ID NO: 15792 - RNA, 64 nt, Human
aucuucuauuuguacagaaaugaaaauaaaauaugaaaauaaugaaagaaaugaaaagauagcu

SEQ ID NO: 15793 - RNA, 64 nt, Human
gugggcaaaugucauuguuaccucuguguguuaagaaaauaaaaauauuuucuaaaggucugua

SEQ ID NO: 15794 - RNA, 64 nt, Human
augaacauuuuucuuuuauuguuuuaucuucacagaaaauaaaagguguuaauuugcuuuuuaa

SEQ ID NO: 15795 - RNA, 64 nt, Human
aauuagaaaaccaaaaaucaugaacauucuaagagaaaauaaauauagaauuuaaaaaauuauu

SEQ ID NO: 15796 - RNA, 64 nt, Human
cuggagaaaaaaauugcucuguguauaucucuuggaaaauaagacaauaguauuucuccuuugc

SEQ ID NO: 15797 - RNA, 64 nt, Human
guauaaaauuuuucacugcaaaaaaauuucaguagaaaauaaggaugcagggccaguuacaaua

SEQ ID NO: 15798 - RNA, 64 nt, Human
accagaggagguauggauggaaacaagcucuauggaaaauaaagcaugaggcaggacggggcug

SEQ ID NO: 15799 - RNA, 64 nt, Human
aacaggaggaaauauuauggaaaaugaaaauagggaaaauaauugaaucauuuuagaaguagcu

SEQ ID NO: 15800 - RNA, 64 nt, Human
cccaugaaauguaaauacuguaucauaaguagaagaaaauaauuuuuguuuucuaaaaaugcau

SEQ ID NO: 15801 - RNA, 64 nt, Human
uaagacauuaguuugagguacuaccuauguacuugaaaauaauaaaguggcauuucuuuaugaa

SEQ ID NO: 15802 - RNA, 64 nt, Human
agaaccuaacagcugauccccaacucucauucaugaaaauaaaaauugcuggagcuuggcuugg

SEQ ID NO: 15803 - RNA, 64 nt, Human
agggaaaagaaaaaaaaugggcgaagagaggguggaaaauaaaaggauucuuuuuucuuccuuu

SEQ ID NO: 15804 - RNA, 64 nt, Human
uuguuuuauuuuaucaaacauuaagcuuuuuuaagaaaauaauugggcagugaaauaaauguau

SEQ ID NO: 15805 - RNA, 64 nt, Human
auuagaggaauuuaaagaggaaaaaaauuacaaagaaaauaauaaaaguguuuguacguuuuca

SEQ ID NO: 15806 - RNA, 64 nt, Human
cucuauaauagaauucuguuuauagaauaagggagaaaauaauccagucuucacuggguuccca

SEQ ID NO: 15807 - RNA, 64 nt, Human
uguaauguaugaaauaaaccaaagucacuuguuugaaaauaaaucuuuauuuugaacuuuauaa

SEQ ID NO: 15808 - RNA, 64 nt, Human
auuuagacaauuaaaacauuucuaaagugagacugaaaauaauauagaaaaucucauugcuacu

SEQ ID NO: 15809 - RNA, 64 nt, Human
uccuuaugauuagaugaaacaccaaaaauauaaggaaaauaacacagcagaggaauagcucagc

SEQ ID NO: 15810 - RNA, 64 nt, Human
accuccagcuuggugagguugccugaagauuagggaaaauaaaaauguccuucccaucuugucc

SEQ ID NO: 15811 - RNA, 64 nt, Human
cauaauuuaaaaaaucaguguuuuuaggauuugggaaaauaaacuguaaauguuuauuugauag

SEQ ID NO: 15812 - RNA, 64 nt, Human
caucuggccaacauggugaaacccugucucuacugaaaauaaaaaaaacuagcugggcauggug

SEQ ID NO: 15813 - RNA, 64 nt, Human
cccucagccugcacuuacucuucuauuaagaccagaaaauaaaauaauuuuccguugagucaca

SEQ ID NO: 15814 - RNA, 64 nt, Human
cuugguauuuuccuggcuuucguuuaauacaauagaaaauaaaguauuacaccgaauacuugcc

SEQ ID NO: 15815 - RNA, 64 nt, Human
cgacgucguccauuuuggaagagacgaaagaaaggaaaauaaacucuuuguaugauauuuauua

SEQ ID NO: 15816 - RNA, 64 nt, Human
auuuugaaucccucuuccucacuuuuuuuucuaagaaaauaaacauuuuacuguuuuuauggau

SEQ ID NO: 15817 - RNA, 64 nt, Human
aaauauugucacaaguaaauagcaaucaaaaggagaaaauaacuuuuguauuuuuuuaaugugu

SEQ ID NO: 15818 - RNA, 64 nt, Human
guuaaauuagcauuacuuaaaauuuguuucuuuagaaaauaaaugcagguuauaaaugugugua

SEQ ID NO: 15819 - RNA, 64 nt, Human
ggcacuggaagaguuuaguguuucuuguaugcuugaaaauaaaguauguacuguuuugaaugug

SEQ ID NO: 15820 - RNA, 64 nt, Human
aagagugguuaagacuacugaagagaaauauuuggaaaauaagauuucgauaucuucuuuuuuu

SEQ ID NO: 15821 - RNA, 64 nt, Human
aucuuuugacucuguauuuaaauucuaugauacugaaaauaaaggcauucuggaaaaauacuga

SEQ ID NO: 15822 - RNA, 64 nt, Human
aacagaaaguguauucaaauuuuaucaguuuaaagaaaauaaagcugugauaaauacuguaauu

SEQ ID NO: 15823 - RNA, 64 nt, Human
augggaacauuuacuuaaacggaugaucauagcugaaaauaaugauacugucaauuugagauag

SEQ ID NO: 15824 - RNA, 64 nt, Human
cuugaaaauguaauuuuccagaaaaacaccuaaagaaaauaaaacauggacaugccuaguaaau

SEQ ID NO: 15825 - RNA, 64 nt, Human
gauugacaaacuuaugauagagauggauggaacagaaaauaaaucuaaauuuggugcaaaugcc

SEQ ID NO: 15826 - RNA, 64 nt, Human
ucuauuucaauuuuucuaggauguuaauuuauaugaaaauaaaaugaauaauaaaagaauaaag

SEQ ID NO: 15827 - RNA, 64 nt, Human
cauuuuaucaacguaagcacacccuguucauagggaaaauaaaccuuggguuauaagcauuagc

SEQ ID NO: 15828 - RNA, 64 nt, Human
uuuguguaugaaacaauguacaaaucaauguuuugaaaauaaugaucucagacuuucuaaguua

SEQ ID NO: 15829 - RNA, 64 nt, Human
guguggaacuuacuggagauguuuuuauauauuugaaaauaauggccuguauuucucacgcuau

SEQ ID NO: 15830 - RNA, 64 nt, Human
acuaggcaaacuacacccuguucauuguuaccuggaaaauaaauccucuauguuuugcacauau

SEQ ID NO: 15831 - RNA, 64 nt, Human
uuauucaaaagugggaaauguaccuggcacguuugaaaauaaaaaaucugacuaccuaucagaa

SEQ ID NO: 15832 - RNA, 64 nt, Human
auagauuuuauuuuuaaguguccucagcauugcagaaaauaacauuguaauagcaaguaaaggc

SEQ ID NO: 15833 - RNA, 64 nt, Human
ggaugggucuccauucuguguggcaccuugauuggaaaauaauauccaugcguuucuuccacug

SEQ ID NO: 15834 - RNA, 64 nt, Human
aauuaaagcaaacaaauuuaaguuuucuuguauugaaaauaaccuaugauuguauguuuugcau

SEQ ID NO: 15835 - RNA, 64 nt, Human
acuccaaugugagaaauguccuuuuuucauuauggaaaauaauuuaaacacuagugcuuuagug

SEQ ID NO: 15836 - RNA, 64 nt, Human
uuguaaaauuuuggaaaacccuggaaauuauagagaaaauaaacauaaucuauacucccaacac

SEQ ID NO: 15837 - RNA, 64 nt, Human
uuuuaucuguuuuauauuuuaaaagauucugccagaaaauaaaaccagaccuuguucuaaagcc

SEQ ID NO: 15838 - RNA, 64 nt, Human
augaggauuaagagcaagaaguugggggggaugugaaaauaauuuuaugagguugucuaaaaua

SEQ ID NO: 15839 - RNA, 64 nt, Human
guaaguugacuugaacaacuuucuuuugcacugggaaaauaagcaaauguuuaaaugcuucaaa

SEQ ID NO: 15840 - RNA, 64 nt, Human
ugaaagauuggauuuucuauaacaccuuguguaagaaaauaaaaaacuugaucuaacugaaaaa

SEQ ID NO: 15841 - RNA, 64 nt, Human
uccagaguuuauaauuacguaguuuuuaguagaugaaaauaauggauucuuguaccuaacauuu

SEQ ID NO: 15842 - RNA, 64 nt, Human
gaaccuaacuuucucuuauugguggguaauaacugaaaauaaagauuuauuuucaugcucacuu

SEQ ID NO: 15843 - RNA, 64 nt, Human
caaagucauuucuuucaaaagagacaucaugucugaaaauaauuacugguagucuaauaugagc

SEQ ID NO: 15844 - RNA, 64 nt, Human
uguuaccuuaucaaaugaaauauuacagcaccuagaaaauaauuuaguuuugcuugcuuccauu

SEQ ID NO: 15845 - RNA, 64 nt, Human
auaaugaugaaauuucaacuacauacaaggaggagaaaauaagaacccagucauaacagaggaa

SEQ ID NO: 15846 - RNA, 64 nt, Human
cuugcaauaaugaaauuccuuaugucaggacccugaaaauaagcacauuugaaaacucuuagaa

SEQ ID NO: 15847 - RNA, 64 nt, Human
caguagaaugaaaugagucagggagcuucaguuagaaaauaaaguugaggcaguuuuugugaag

SEQ ID NO: 15848 - RNA, 64 nt, Human
cuggcuauugcccuauaccugccaaucacccaaagaaaauaauagcuucugagaaagcucaauu

SEQ ID NO: 15849 - RNA, 64 nt, Human
caaaaauaauguucuuuuuaugcaaauccccugugaaaauaaaauuuucaauguuuuuuugguc

SEQ ID NO: 15850 - RNA, 64 nt, Human
gaaaggugcgacuggaaacuuuccuuucuguugugaaaauaaagauuauauuagaauccaaaua

SEQ ID NO: 15851 - RNA, 64 nt, Human
auaaaucuaucuucaaagacauauuagaaguugggaaaauaauucaugugaacuagacaagugu

SEQ ID NO: 15852 - RNA, 64 nt, Human
gcugauuccacagcaugcagccugguaggggaaggaaaauaaaagggugugaagaaggaauagu

SEQ ID NO: 15853 - RNA, 64 nt, Human
ccccuuguggaaaaaaaaauucugcugugaagaugaaaauaaaaauggagagaaaacacuggaa

SEQ ID NO: 15854 - RNA, 64 nt, Human
uauguugguccugaguauuuugcaaaugcacagagaaaauaaaacuaaacuccuuguuuauuug

SEQ ID NO: 15855 - RNA, 64 nt, Human
uagcucugagaaccguagaugauuucaguucuaggaaaauaaaacccguugauuacuauauugg

SEQ ID NO: 15856 - RNA, 64 nt, Human
uuuuaaacuuuggaauguguuuaaauuuaaauuugaaaauaaagauauuugauuuucuggggaa

SEQ ID NO: 15857 - RNA, 64 nt, Human
aagaguccaguacccaggccccauggaaaggucugaaaauaauauuccagauuacacuguaccu

SEQ ID NO: 15858 - RNA, 64 nt, Human
uuuucccaaacuucuucccaucauagcacauguagaaaauaauauuuuuauggcacacugggau

SEQ ID NO: 15859 - RNA, 64 nt, Human
gggggagugugacacuuucuuuccauguucaagugaaaauaaauaauguacccugcagcccuuu

SEQ ID NO: 15860 - RNA, 64 nt, Human
ggacacccuaugaaaguggguagaccucucagcggaaaauaagaagggcuuuuaccuacagggc

SEQ ID NO: 15861 - RNA, 64 nt, Human
agguaccuauuucuaccguuucaagugaugaagugaaaauaauuuacauucgauaguguuacug

SEQ ID NO: 15862 - RNA, 64 nt, Human
cagcaucugguaugcagccaccaggacaaggacugaaaauaaugucuacaguccacagcuucag

SEQ ID NO: 15863 - RNA, 64 nt, Human
gcaaguuguacuguaugcaguuuuguaaauaagugaaaauaauuuguuguacuuuuuauucaau

SEQ ID NO: 15864 - RNA, 64 nt, Human
auucauaugcuucccagagaagcucauuuaguuagaaaauaaggcaaguuuugaagccugcuaa

SEQ ID NO: 15865 - RNA, 64 nt, Human
aggucauuuuuuuuugugguaagaauaacuaauggaaaauaaugaaacacccugggguuugggg

SEQ ID NO: 15866 - RNA, 64 nt, Human
uuuuguuuuguuuuguaaaaaugauaaaacuucagaaaauaaaaugucaguguugaauaauuua

SEQ ID NO: 15867 - RNA, 64 nt, Human
agaugacuauucaguggcuaacuuggguuaggaagaaaauaauuagguauuuucuccaaauguu

SEQ ID NO: 15868 - RNA, 64 nt, Human
uuuuuuuuccaguaaugagcuuaagaaauuuguggaaaauaacucaccuggcaucuuacaucug

SEQ ID NO: 15869 - RNA, 64 nt, Human
gaauugucugaacacaguagaacgauacaauccugaaaauaauaccuggacuuuaauugcaccc

SEQ ID NO: 15870 - RNA, 64 nt, Human
auguugccuuuuuaaaauaauuauacuugcacaugaaaauaaaauauaaagucaauaauagucc

SEQ ID NO: 15871 - RNA, 64 nt, Human
agaggguacaagcuccagaacaguaaccaagugggaaaauaaagacuucuuggaugacugacuc

SEQ ID NO: 15872 - RNA, 64 nt, Human
uccuguuucuuaaaccuagcaccucuguguauuugaaaauaaugagacaucuuucauuggauuu

SEQ ID NO: 15873 - RNA, 64 nt, Human
uuucaucauugugguguuugucuaccugacuguggaaaauaagucgcuguuugguuaaguaauu

SEQ ID NO: 15874 - RNA, 64 nt, Human
aaggagguauugagaggaacccuacuguugacuugaaaauaaauagguuccauguguaaguguu

SEQ ID NO: 15875 - RNA, 64 nt, Human
uucugaaccucagagucuucaccuauaagacggggaaaauaauaccacccuuucaagauuguug

SEQ ID NO: 15876 - RNA, 64 nt, Human
uaaguaauggaagguaaagaaaaauuacagaauggaaaauaauauuuugggcaagcaaacaaau

SEQ ID NO: 15877 - RNA, 64 nt, Human
cccugggccuucccauccuucauguugaaaaagggaaaauaaacccaagagugaugucgaagaa

SEQ ID NO: 15878 - RNA, 64 nt, Human
uuauuuggcaaauuuuauaaugaaguuuuaaguugaaaauaaaauguagcaacauuuugaucac

SEQ ID NO: 15879 - RNA, 64 nt, Human
aagcaaacaacacaauuacaagguugaaucugaggaaaauaauccuugugccauagaaguauuu

SEQ ID NO: 15880 - RNA, 64 nt, Human
agugcccucuuaaaaauacaaaaaucaaaaagaggaaaauaaguuaaauuaagcccaaguaaca

SEQ ID NO: 15881 - RNA, 64 nt, Human
aauguugcacacuuacuaaaaaacuuuggaaauggaaaauaauguauuagugcaacaguugaug

SEQ ID NO: 15882 - RNA, 64 nt, Human
gcuggguccaaagugauuuacauaaauuuauaaugaaaauaaacauguauaaaauuuaaaaaaa

SEQ ID NO: 15883 - RNA, 64 nt, Human
uagccgaauauaauggaaauaggaaaaauuagucgaaaauaaagguugauuuagaaaugaagaa

SEQ ID NO: 15884 - RNA, 64 nt, Human
gaauaguguggauuauuaaauaucuaguuuggaagaaaauaauuuauauaaauuauuguaaauu

SEQ ID NO: 15885 - RNA, 64 nt, Human
uccuguaaauguaaauauuauggaaaaccuuauggaaaauaauuauaguacaauucucaagaaa

SEQ ID NO: 15886 - RNA, 64 nt, Human
uuguuuauuucugauaauuaaccuaagcccuuaugaaaauaaacaaaaugaagggauuaugaca

SEQ ID NO: 15887 - RNA, 64 nt, Human
gucuuaggaauucuucaaaaaauggcaucccaaugaaaauaaauuugaugacuauauuuucaug

SEQ ID NO: 15888 - RNA, 64 nt, Human
caucuuauagcacuuugaaauaccucauguuuaugaaaauaaauagcuuaaaauuaaaugaugc

SEQ ID NO: 15889 - RNA, 64 nt, Human
guauguacagauuaaaauuauugcuacauuugaggaaaauaaaauugcuugcuucuauguaauu

SEQ ID NO: 15890 - RNA, 64 nt, Human
auauaugagacaaucaacaccguuccaaaggccugaaaauaauuuucagauaaagagacuccaa

SEQ ID NO: 15891 - RNA, 64 nt, Human
guacacuuuuaguagucauagugaagcaggucuagaaaauaagccuuuggcagggaaaaagggc

SEQ ID NO: 15892 - RNA, 64 nt, Human
acugccuuccacaauuaaagaauacucauagaaagaaaauaaucauaaaucauauuugauuaac

SEQ ID NO: 15893 - RNA, 64 nt, Human
cagauugaaaaagagggaccguguaaagaaaauggaaaauaaauaucuuucaaagacucuuuua

SEQ ID NO: 15894 - RNA, 64 nt, Human
gcccagccucaaaaauauuuuuuaaaagaaaagagaaaauaauucuucugucaaaggagguuaa

SEQ ID NO: 15895 - RNA, 64 nt, Human
acucccaccccagccaaaaauauauaaaaaacaagaaaauaacaaauuaaccgcaaacuaucaa

SEQ ID NO: 15896 - RNA, 64 nt, Human
aaccagaacaguguuuguccauguugcauguaaugaaaauaaaucccugcucugagaaaagcuc

SEQ ID NO: 15897 - RNA, 64 nt, Human
uugggucuuuuuucuugagcuuauaauguaccuggaaaauaaaccucuugagaaaaagaaaagu

SEQ ID NO: 15898 - RNA, 64 nt, Human
ucuaaauuaacaugaaauacuucauuuugauugagaaaauaaaaucagauuuuuucaaagucaa

SEQ ID NO: 15899 - RNA, 64 nt, Human
uuccuuucuccuuuuuacaaaaacaaacauagaagaaaauaaaugcacuuuauccacuccccaa

SEQ ID NO: 15900 - RNA, 64 nt, Human
uaagucccuuuuuguauguguuuuuauacuuuuagaaaauaaaaacuuuagauuaacucauagu

SEQ ID NO: 15901 - RNA, 64 nt, Human
uugccauuguuuucuuuuguaccugaagcauuuugaaaauaaaguuuacuuaaguuaugcuugu

SEQ ID NO: 15902 - RNA, 64 nt, Human
aagauguguuguugguuuccaaaaaggaacacuggaaaauaaauuuugaauguuuauguucuca

SEQ ID NO: 15903 - RNA, 64 nt, Human
uuggcgcaauauuuaugggagugggagggauggggaaaauaaacuuaacucuacaaaagcaaac

SEQ ID NO: 15904 - RNA, 64 nt, Human
cgggauauuauagaaaauuauuuguaugaauaaugaaaauaaaacacaccucguggcauggcug

SEQ ID NO: 15905 - RNA, 64 nt, Human
caauuuaaacucccaguuguuuauuuucacaaaagaaaauaaaauugcaguugcaagaccuuuu

SEQ ID NO: 15906 - RNA, 64 nt, Human
auuccaaguaaaugucuuaauacaguuucaauuagaaaauaaaaugucucauacuugcacauug

SEQ ID NO: 15907 - RNA, 64 nt, Human
cuacuuuguaaaggugaccuuuaaaaaauaaaaggaaaauaaagaauguuaguuucauucugcc

SEQ ID NO: 15908 - RNA, 64 nt, Human
caguagaccugauuuucaaaaucugcccucagaugaaaauaaaauaaacgaaacauuuagacaa

SEQ ID NO: 15909 - RNA, 64 nt, Human
ugggagauuguaaaaucuguaaaguuuguuuugugaaaauaaaauguucacaguagaauuuuuc

SEQ ID NO: 15910 - RNA, 64 nt, Human
uuuuaaaauaucuggauuaugaagaaaaagugaugaaaauaaauuaaaacugaauuaccuuuuc

SEQ ID NO: 15911 - RNA, 64 nt, Human
uuuuuuucuaauaccguggauggugggaauucgggaaaauaaccaguuaaaccagcuacucaag

SEQ ID NO: 15912 - RNA, 64 nt, Human
gauguuuuuauauaguaaacccauuaaauacugugaaaauaacacugaacuuggaaacuauauu

SEQ ID NO: 15913 - RNA, 64 nt, Human
uaugucucuguaaagugaucagcaguugcagcgugaaaauaaauacuuuaacucaggggucacu

SEQ ID NO: 15914 - RNA, 64 nt, Human
caauaaacugaaaacauggaucaacccuucuuuugaaaauaaacugagucaauuuagccuuuua

SEQ ID NO: 15915 - RNA, 64 nt, Human
ugccaagauucuuaaauuugccagcguuaaaguagaaaauaacauuucagaagagcacaauaug

SEQ ID NO: 15916 - RNA, 64 nt, Human
aaauugcaaauauaaacaaaagaaaaauccaacugaaaauaacacuaaguauuuuugaguuccu

SEQ ID NO: 15917 - RNA, 64 nt, Human
augugugauuaaaugcuuuuuuaaauugcuaagggaaaauaacaaaguguuaguaaucauugcu

SEQ ID NO: 15918 - RNA, 64 nt, Human
ucuauguaaacucaacgauauguuugguuuuccugaaaauaaaugauuuuaaauaaauuaaauu

SEQ ID NO: 15919 - RNA, 64 nt, Human
ugccccucaggggaauucggagcuagaggacauggaaaauaaagccaggaaagucaaaaaaacg

SEQ ID NO: 15920 - RNA, 64 nt, Human
aaaagcgcaaagaggagaaugaagauccagaaaggaaaauaaagaagaagggcuucggcgccau

SEQ ID NO: 15921 - RNA, 64 nt, Human
caucuuuguggauggugucuccuuuacuaaauaagaaaauaacaaagcccuuauucucuuuuuu

SEQ ID NO: 15922 - RNA, 64 nt, Human
auucuccguuuugguuccauuuuguacacguuuggaaaauaaucugcagaaacgagcugugcuu

SEQ ID NO: 15923 - RNA, 64 nt, Human
uuuaggcucccucggaacuuuugccaguguggaggaaaauaaaaaagaacuuaaauaaaaucug

SEQ ID NO: 15924 - RNA, 64 nt, Human
acuccagccggggugacagagugagacuccgacugaaaauaaauaaauaaauaaauaaauaaau

SEQ ID NO: 15925 - RNA, 64 nt, Human
aaaaaguuuauuuuccuuuugucugggcaguagugaaaauaacuacucacaacauucacuaugu

SEQ ID NO: 15926 - RNA, 64 nt, Human
guuaaauaauaauaguuaaugaaggugugcuacagaaaauaaucugguguucuugcuaacuuug

SEQ ID NO: 15927 - RNA, 64 nt, Human
uaucaggcauaaauuauguagaauuagaggcuuugaaaauaauacugguagguugcucaaaggu

SEQ ID NO: 15928 - RNA, 64 nt, Human
caguucugcaagugacuguguuuuguauuacugugaaaauaagaaaauguaguuaauuacaauu

SEQ ID NO: 15929 - RNA, 64 nt, Human
uuuaguuuggguucauuucuauaacauuuuguaagaaaauaaaaguuugagcaccugauuauau

SEQ ID NO: 15930 - RNA, 64 nt, Human
cuuagauuuuauguaguauuaagugaaaaaauacgaaaauaauaaacauugaagaaaaaaauaa

SEQ ID NO: 15931 - RNA, 64 nt, Human
cuuuuucuuuuuuacggaauucaucaucagagaagaaaauaacaaaaauggaagcaaacaacau

SEQ ID NO: 15932 - RNA, 64 nt, Human
uacuaugacuuauauaacuuauacauauaauuuugaaaauaacaacuaaaagauguauaacaua

SEQ ID NO: 15933 - RNA, 64 nt, Human
aguuaaagaaaggaaaagaaaacaaaaaacgaaugaaaauaacugaauuuggaggcuggaguaa

SEQ ID NO: 15934 - RNA, 64 nt, Human
uugaaauucuauuuauaauacagaaucuuguuuugaaaauaaccuaauuaauauauuaaaauuc

SEQ ID NO: 15935 - RNA, 64 nt, Human
auaaagaccagaaauucccuuuucaccuuuucaggaaaauaacuuagacucuaguauuuauggg

SEQ ID NO: 15936 - RNA, 64 nt, Human
uuacuguguaaagacuugaagggacagaagugaagaaaauaagcugcaauuuuguacagauacc

SEQ ID NO: 15937 - RNA, 64 nt, Human
uuauacuauugagaaaucuauggggaggauaugagaaaauaaauuccuucuaaaccacauugga

SEQ ID NO: 15938 - RNA, 64 nt, Human
ggcugacaauaagguuugacagaggggaacagaagaaaauaauaugauuuauuagcacaacgug

SEQ ID NO: 15939 - RNA, 64 nt, Human
gggaucuuuagaaaacuucauacuguaugaauaagaaaauaaaauauuugaaacuugcuugaau

SEQ ID NO: 15940 - RNA, 64 nt, Human
uagauuuauuuuucuuacuccacuaaacuauaaagaaaauaauuacuuagaaacuccauuuuaa

SEQ ID NO: 15941 - RNA, 64 nt, Human
aaagaauucauuuucuucuuuuuuguguaucauugaaaauaagagaaguaaucccagauaauaa

SEQ ID NO: 15942 - RNA, 64 nt, Human
auuuuuuuuacuuuagcacauaauuuguauauuugaaaauaauguauauuauuuuaccuauuag

SEQ ID NO: 15943 - RNA, 64 nt, Human
aagguugaaucauuuuauuaaaaauacuuuuuaagaaaauaacuaugaacaucugaauauuaaa

SEQ ID NO: 15944 - RNA, 64 nt, Human
ugcaugaagccaauuuugaggguagacguguggggaaaauaaaucauuauacaguaagaccugg

SEQ ID NO: 15945 - RNA, 64 nt, Human
gccuuaucggggcgaaccuuuuaggauuccaugugaaaauaaaauaugaggaaaaguuuaaccu

SEQ ID NO: 15946 - RNA, 64 nt, Human
caaaaacagagucgcuuuugccuuuucaaaucaagaaaauaagugcucugucaaaagcacaaaa

SEQ ID NO: 15947 - RNA, 64 nt, Human
uggcucugccccgcagacggucugugugcuguuugaaaauaaaucuuaguguucaaaacaaaau

SEQ ID NO: 15948 - RNA, 64 nt, Human
uauccacucggaccaucuguuaucucucuacacugaaaauaaaaccucuuccacccaccccauu

SEQ ID NO: 15949 - RNA, 64 nt, Human
aagcucucccuagcuucacaucuuguguuuuccagaaaauaaaaacagcagacuguccuuucuc

SEQ ID NO: 15950 - RNA, 64 nt, Human
ggcgagugcuuucuguauuuaaauauuguaaaaagaaaauaaguuauaacuguuauaaagcaga

SEQ ID NO: 15951 - RNA, 64 nt, Human
aauucuaaaagauaaguguguuugcaaaaaaaaagaaaauaaauacauaaaaaagggacaagca

SEQ ID NO: 15952 - RNA, 64 nt, Human
aagaguuauguuggauaguuuuauuucuguggcugaaaauaaaaucuugucuagcacaguuaaa

SEQ ID NO: 15953 - RNA, 64 nt, Human
ccagauguaggggaagagauguuuacaguaugaugaaaauaauuuuccaaguaaagugauguuu

SEQ ID NO: 15954 - RNA, 64 nt, Human
aacgauuacucgaagaugacugcaaagguaaaaggaaaauaaaaguguauugcacaaugagauu

SEQ ID NO: 15955 - RNA, 64 nt, Human
guuaguuuugagguaacugcauucauuaggggcugaaaauaaauguuaaaaauguuuaauuugg

SEQ ID NO: 15956 - RNA, 64 nt, Human
uuugugcucuuguuuguauuuuauuaaggaaaaugaaaauaaucuggcaucaguuucauuuugc

SEQ ID NO: 15957 - RNA, 64 nt, Human
aauucuaugcaaaaucauagccaaaacuaguauagaaaauaauacgaaacuuuaaaaagcauug

SEQ ID NO: 15958 - RNA, 64 nt, Human
uacauaucucuaauuuacuuugaaauucaaaggugaaaauaaaaaaugauggccuaaguaaaau

SEQ ID NO: 15959 - RNA, 64 nt, Human
gcuuuuccagacacaaggcugcuaaaccaauuaagaaaauaauuaauuucuuucaagcaacuaa

SEQ ID NO: 15960 - RNA, 64 nt, Human
cuauauaguaguaugcaguauuuauauuauuccugaaaauaaaaugaggggagaauauucccua

SEQ ID NO: 15961 - RNA, 64 nt, Human
aaaaacaaacaacaacaacaaaauuauaaagguagaaaauaaaccuaaauugugucguaauuaa

SEQ ID NO: 15962 - RNA, 64 nt, Human
cucucuguuguuuguaauauucucuuaaaagcuugaaaauaaaacuucuuucccuaccauuagu

SEQ ID NO: 15963 - RNA, 64 nt, Human
aaaauagcaaacuaaaugcaaagaguuugcauuugaaaauaauaaaguaguugccguauacaac

SEQ ID NO: 15964 - RNA, 64 nt, Human
ugaauucauuuauuuuuuuuagaauugggauuaugaaaauaaccaaagaguauagaacuuaaua

SEQ ID NO: 15965 - RNA, 64 nt, Human
gcugcguuuuguuuucuuuacuguaugaaaacaggaaaauaaaagagaaauuuagaaaauacag

SEQ ID NO: 15966 - RNA, 64 nt, Human
uaauuuagacagaaaagcaaauagcaauugacuugaaaauaagaaguggagccgaagguggaua

SEQ ID NO: 15967 - RNA, 64 nt, Human
agaugagauacuacacucauuuaaauauuuuuaagaaaauaaaaagcuuaagaaauuuaaaaug

SEQ ID NO: 15968 - RNA, 64 nt, Human
aauuuuccuaauuuggacaagauuauuccaugaggaaaauaauuuuauauagcuacaaaugaaa

SEQ ID NO: 15969 - RNA, 64 nt, Human
ucuauaauaaauuaacaagauucaccuaaccuuugaaaauaaaguaguauugaagacuuacaug

SEQ ID NO: 15970 - RNA, 64 nt, Human
gucacauuuuucuacuauuugaccaaaaggaaaagaaaauaaagaagaacucuggaguggucua

SEQ ID NO: 15971 - RNA, 64 nt, Human
auguuaugccuguugcaggcaaauguaaagucuagaaaauaaugcaaaugucacggcuacucua

SEQ ID NO: 15972 - RNA, 64 nt, Human
uuuauuucaaaggaagaaaauauauugauucuuagaaaauaaacugucaauuuagaauucuuug

SEQ ID NO: 15973 - RNA, 64 nt, Human
auguacauuccacauuuuaauaaauuaaccacaagaaaauaaucccacauauacaaggucaggg

SEQ ID NO: 15974 - RNA, 64 nt, Human
aguaaacuguaacuaaacacuucaacaugaauuugaaaauaaauaauuguggauauaaaagaac

SEQ ID NO: 15975 - RNA, 64 nt, Human
uaggcucuuaagcagcauggaaaaaugguugauggaaaauaaacaucaguuucuaaaaguuguc

SEQ ID NO: 15976 - RNA, 64 nt, Human
aaaaucaccaagaaaaacagcuucucaguuaagugaaaauaaaccaguuaaaacagaaccuuua

SEQ ID NO: 15977 - RNA, 64 nt, Human
aauucuacuucuaagaaucauacucuacuucuaagaaaauaauuagaaguagacaaagauuaau

SEQ ID NO: 15978 - RNA, 64 nt, Human
uauuucuaaauucauguacuguauguccauaagugaaaauaaaaugucauauucuuuucuauua

SEQ ID NO: 15979 - RNA, 64 nt, Human
aaauguaaauacuguuuuuaacaacuaugauuuggaaaauaaaucaaugcuauaacuauguuga

SEQ ID NO: 15980 - RNA, 64 nt, Human
aaggcaaacuauaggauaacacagagcccuuuuugaaaauaaauuggcauuggaguguuuuacc

SEQ ID NO: 15981 - RNA, 64 nt, Human
ucacccuguuucuuucugugaagcgagaaugucugaaaauaaauaggaccaugccauggguucu

SEQ ID NO: 15982 - RNA, 64 nt, Human
augggcacagagaggggccugugggaggggcugggaaaauaaaguccaaggucgagaccagaca

SEQ ID NO: 15983 - RNA, 64 nt, Human
uggauuuuuuuuuuuuuaaggaaaaauacguuuggaaaauaaacuguuauggugauaauuuggg

SEQ ID NO: 15984 - RNA, 64 nt, Human
ccgccccagccaacuucaugggucacuuuuucuggaaaauaaugaucuguacagacaggacaga

SEQ ID NO: 15985 - RNA, 64 nt, Human
gaauucugugaauucugugaagaguaaugugauugaaaauaagucuaaacagcuguaaaaguga

SEQ ID NO: 15986 - RNA, 64 nt, Human
gugaucgucagaugugugaauggacgguuuaggugaaaauaaucaacugcauaguucccaugca

SEQ ID NO: 15987 - RNA, 64 nt, Human
agaccaaaagaugccugacauagagccaaauucugaaaauaauuguaguaguagugauauaguc

SEQ ID NO: 15988 - RNA, 64 nt, Human
aacuuaugaaaaccaagaaauguaaagauaacaggaaaauaaguuuugauugcauuguuuuuaa

SEQ ID NO: 15989 - RNA, 64 nt, Human
acaccaaaaaaaaaauuaacauuguaugaagauggaaaauaagaagaugcacuuucuguaacuu

SEQ ID NO: 15990 - RNA, 64 nt, Human
guuuggauuaaaauguugacaugauuucacauuugaaaauaaacucaucucuuauuuugaaguu

SEQ ID NO: 15991 - RNA, 64 nt, Human
acauaaggaguccuacccguugagguuggagagggaaaauaaagaagcugccaccuaacaggag

SEQ ID NO: 15992 - RNA, 64 nt, Human
uaaaauaacguccugugaccaaguuguuuaaauggaaaauaaagugcuuucuuuaaggaaaaua

SEQ ID NO: 15993 - RNA, 64 nt, Human
uaacuacuuccaucccugcuuauuuuuaauuugggaaaauaaauacauucgaaggaaccugugu

SEQ ID NO: 15994 - RNA, 64 nt, Human
auaugaggaugguauaacuauguaaauuguuuuugaaaauaauuuguuuccccacaacuuuuga

SEQ ID NO: 15995 - RNA, 64 nt, Human
uuuucuuucuuucuaaaauagauuggucugagaagaaaauaaguaauuugaggccauuuggaag

SEQ ID NO: 15996 - RNA, 64 nt, Human
guacaaaacaugaaaauuaaaaugaacaauauaggaaaauaauuguaacaggcauaagugaaua

SEQ ID NO: 15997 - RNA, 64 nt, Human
guggagaaguucuguaugugaggaaggaaaaaaagaaaauaaaaguguguuugaaaaauauuau

SEQ ID NO: 15998 - RNA, 64 nt, Human
uguguacucuugcucuuuuagcuagaguguaugugaaaauaaagaaauacaucauuguauucac

SEQ ID NO: 15999 - RNA, 64 nt, Human
uguaaaguuuggggacuuaccucuguagcauugugaaaauaaacuuugauuaagcugauuugaa

SEQ ID NO: 16000 - RNA, 64 nt, Human
aguauuugagugauguuuuaaauauccuaugucugaaaauaauuccuccuaauugugugguaau

SEQ ID NO: 16001 - RNA, 64 nt, Human
uuuucuccaaauacaaaguauauucucuuuauuggaaaauaaauuaauaaauauauucuguauu

SEQ ID NO: 16002 - RNA, 64 nt, Human
guagggcuaucuuuuuaaaaaaugucaacaaagggaaaauaaacuaucagcuuggauggucacu

SEQ ID NO: 16003 - RNA, 64 nt, Human
caauaacaggaacaugagacuucgcaaaucucuggaaaauaauauccaaaugaaauuaagucuc

SEQ ID NO: 16004 - RNA, 64 nt, Human
gucucacuggccaagaaaauugccuuuaaaacucgaaaauaaggccagguguggugacucacac

SEQ ID NO: 16005 - RNA, 64 nt, Human
gcuagguauuuaucaacugcagauguuauugaaagaaaauaaaauucagucucaagaguaaacc

SEQ ID NO: 16006 - RNA, 64 nt, Human
guacuaaggagaaaugacuuuuauaacauuuugagaaaauaauaaagcauuuaucuaaagauuu

SEQ ID NO: 16007 - RNA, 64 nt, Human
aauagaucaccuuagaaaauuaugcaauuaaugugaaaauaauugauguuugcaaugugucuuc

SEQ ID NO: 16008 - RNA, 64 nt, Human
ucucuguaaucugcuaugaaagaaaauaacaaaugaaaauaaauguguacuacacuuugaaaua

SEQ ID NO: 16009 - RNA, 64 nt, Human
agguuucuuucuuucucuguaaucugcuaugaaagaaaauaacaaaugaaaauaaauguguacu

SEQ ID NO: 16010 - RNA, 64 nt, Human
cuguauuauauuuuaauguauaugugaauauauugaaaauaauuuguuuuuuccugguuuuugu

SEQ ID NO: 16011 - RNA, 64 nt, Human
uagcuagcauuacuaaccaacuguuggaagcucugaaaauaaaagaucuugaacccaugcucuc

SEQ ID NO: 16012 - RNA, 64 nt, Human
guuaauuaucccuguccuuucacauuuauagggggaaaauaaauacuuuaauguuguuuauagc

SEQ ID NO: 16013 - RNA, 64 nt, Human
gaguacccaaauacacaaaaggugucccuuuaaggaaaauaaagaauuaaguuuuaaauaacau

SEQ ID NO: 16014 - RNA, 64 nt, Human
augucaaaaacguacccauuuucacaaaaaugaggaaaauaagaauuugauauuuuguuagaaa

SEQ ID NO: 16015 - RNA, 64 nt, Human
uauuuuuaccaaaguguagcuaauauuucaagcugaaaauaauaguucuacugcccgugucucc

SEQ ID NO: 16016 - RNA, 64 nt, Human
ucuccuaagaacugugccucggguuuuucaauaggaaaauaaggugagacucuuccauggagaa

SEQ ID NO: 16017 - RNA, 64 nt, Human
uuaccagcauuuguguuagccagcucacagagaagaaaauaacuugcaguaguuuuauaauaag

SEQ ID NO: 16018 - RNA, 64 nt, Human
cccaccuccucaagcuauccaauuuucugacuuugaaaauaaccaugagagaugccacauuucu

SEQ ID NO: 16019 - RNA, 64 nt, Human
guuuaaaaaaaaaaaggcagaaaacccaccaugggaaaauaagcauuuuuuaaaaucugaaguu

SEQ ID NO: 16020 - RNA, 64 nt, Human
gaaaaucuuagaguaaauuuuagucuuaaagccagaaaauaaguuuauagccaucuagauauuu

SEQ ID NO: 16021 - RNA, 64 nt, Human
uuacuuaaauugacacuuuuugaaaugccagucugaaaauaauuaagauaucucugcuuuguau

SEQ ID NO: 16022 - RNA, 64 nt, Human
uuuuccagagaauauuauaaagugcuuuagguaugaaaauaaaucaucuuugucugauuaacug

SEQ ID NO: 16023 - RNA, 64 nt, Human
cugcagauuuuuugaguucccaauacguuucauagaaaauaaguaagaacuauuuuuaaaauau

SEQ ID NO: 16024 - RNA, 64 nt, Human
ucucuuuagugucaguuaaauuaugaacuaacuugaaaauaaaaguuguuugacugaaagugau

SEQ ID NO: 16025 - RNA, 64 nt, Human
aauuuuauuauuuucaucuuuauugaucaaauuugaaaauaaaauucacaauguaauacuacua

SEQ ID NO: 16026 - RNA, 64 nt, Human
aaaugucuugcaaugugcuguaaucacaagaggagaaaauaacuuguuuccuugaucugucaga

SEQ ID NO: 16027 - RNA, 64 nt, Human
auauauuagugcuuuuuuuuuuucaaaagaaaaggaaaauaaaagaaauauaucccuugcuccc

SEQ ID NO: 16028 - RNA, 53 nt, Human
auuagcccuacugccaauaaagggaaaauaagagaugcucaucgacgaauuau

SEQ ID NO: 16029 - RNA, 64 nt, Human
auaccagagaaucuaauuguugcccggggggaaugaaaauaauggaauuuagagaacucuuuca

SEQ ID NO: 16030 - RNA, 64 nt, Human
cccauuuccuuccaguaaauccacccaaggagaggaaaauaaaaugacaacgcaagaccuagug

SEQ ID NO: 16031 - RNA, 64 nt, Human
uuccacuugcagguuuauggaaacagcaguauuugaaaauaaauaaaaagugggagaauuccuu

SEQ ID NO: 16032 - RNA, 64 nt, Human
uguacgugaauguuuaaugugcucucaaaacauggaaaauaaguuuagugcacauagcuaaauc

SEQ ID NO: 16033 - RNA, 57 nt, Human
gcaacgauaaauacucuuaggaagagagaaaauaagguuucauaaguuuguacuuga

SEQ ID NO: 16034 - RNA, 64 nt, Human
uuaacuguuuggcucacuuccaguuaguuugaaugaaaauaauaauuuucuacuuggaguugaa

SEQ ID NO: 16035 - RNA, 64 nt, Human
guguugcuuguacuguauguuucucuacuguauggaaaauaaaguuuacaagcacacgguucuc

SEQ ID NO: 16036 - RNA, 64 nt, Human
auuuccuaucacuauuucagugucagaacaaacugaaaauaauggcucguguuuauguugaaga

SEQ ID NO: 16037 - RNA, 64 nt, Human
ugcauuaaauuuaagauaugcaaauuuauguagagaaaauaaauguuauauacccuauaaucuu

SEQ ID NO: 16038 - RNA, 64 nt, Human
gucgagauuacaaugcucuagaaucagcauauaagaaaauaaaugauaucugcauguugaauug

SEQ ID NO: 16039 - RNA, 64 nt, Human
guugccucauagcuuuguacagauuaugaggacugaaaauaauugggcauuuacccaucuuggu

SEQ ID NO: 16040 - RNA, 64 nt, Human
agaaauauuuuguggcaaugaagaaaacacuacggaaaauaaaaaauaagauaaagccuuauga

SEQ ID NO: 16041 - RNA, 64 nt, Human
agaaauauucuguggcaaugaagaaaacacuagggaaaauaaaaaauaauauaaagccauauga

SEQ ID NO: 16042 - RNA, 64 nt, Human
uauacauguuauuaaacucuuuaaauaugucauagaaaauaauacaaucauguaaugagucuug

SEQ ID NO: 16043 - RNA, 64 nt, Human
acugcuuuaaugucaaguuugcagaauugucucugaaaauaaaaacccugacuuuaguuguaaa

SEQ ID NO: 16044 - RNA, 64 nt, Human
uugaaauauugaaaauauugaaaauauuauuauugaaaauaaaaucuugaucucaacuaucccc

SEQ ID NO: 16045 - RNA, 64 nt, Human
caucuaaaguccuggcccuggcccuuacuauuaggaaaauaaacagacaaaaacaaguaaauau

SEQ ID NO: 16046 - RNA, 64 nt, Human
uaauaaaguaugacccacauuacuuuuuaugggugaaaauaagacaaaaauaauaguuuuagug

SEQ ID NO: 16047 - RNA, 64 nt, Human
gaagauggacucuaaacuuugguuuaccuccauggaaaauaaagauuuagaaaccagguggaaa

SEQ ID NO: 16048 - RNA, 64 nt, Human
acuguaguuguagauccuugucauuuugcuguuugaaaauaaccaauguguuuucuaaaacugu

SEQ ID NO: 16049 - RNA, 64 nt, Human
acauugaaaaaucguacagucauuucaagaauaagaaaauaaaauuuucucuuugucugaaccu

SEQ ID NO: 16050 - RNA, 64 nt, Human
auguucuccucuaucuuagagggguauucuucuugaaaauaaaaaauauugaaaugcuguauuu

SEQ ID NO: 16051 - RNA, 64 nt, Human
caaaugccuucuauguuguuugcucuguagacaugaaaauaaacaauaucucucgaugauaauu

SEQ ID NO: 16052 - RNA, 64 nt, Human
aaaugguuggguguguccuuucuggugaccaugagaaaauaauaugucuugaugaagucuuuuc

SEQ ID NO: 16053 - RNA, 64 nt, Human
uucuauuuuuguaguguuacuggcuaagucuuuggaaaauaauuuuucauaauaugucaugcua

SEQ ID NO: 16054 - RNA, 64 nt, Human
aguauauuuuagaaauuuguuaaugagaguaaaagaaaauaaauguguauagcucaguuuggau

SEQ ID NO: 16055 - RNA, 64 nt, Human
cuuguuuaaauguccauuuuuauucuuuauguuugaaaauaaauuauggggauccuauuuagcu

SEQ ID NO: 16056 - RNA, 64 nt, Human
auguuugaauauaacaaaauaucaauacuuaacggaaaauaaggugacacgaagaaaguacaua

SEQ ID NO: 16057 - RNA, 64 nt, Human
uaaugacuuuagugacauuauaaaacugaaacuggaaaauaaaauggcuuaucugcugauguuu

SEQ ID NO: 16058 - RNA, 64 nt, Human
uaaagacaaaguaauucuauuaaaugaacuaacugaaaauaauaauuauaggaagugauuauuc

SEQ ID NO: 16059 - RNA, 64 nt, Human
ucuguagaauuuauuuuaacuaugaccuuuaauugaaaauaaauaauuaaaauaucagacaugu

SEQ ID NO: 16060 - RNA, 64 nt, Human
cugucuuuuauuauaggauuaguaagauauacaagaaaauaaccaccguguugugaaaaaguga

SEQ ID NO: 16061 - RNA, 60 nt, Human
cuuggcuugaagaacaguaaaaucacagcggaaaauaaaaagaaagucgcguuguuauau

SEQ ID NO: 16062 - RNA, 64 nt, Human
uaugacauugguggauauuuuggcacuuuuauaugaaaauaaauuuuuuaaugaaaucugggug

SEQ ID NO: 16063 - RNA, 64 nt, Human
uugguauuaucaaagcauugcugagagacggugggaaaauaaguugacuuucaaaucacguuag

SEQ ID NO: 16064 - RNA, 64 nt, Human
acccuauaguuuggaguuaguaugagccuuuugugaaaauaaauauauuaaauuauuuugccug

SEQ ID NO: 16065 - RNA, 64 nt, Human
acaaucauuacuucuguauuuuuaaugaaugcaggaaaauaauauuuuuauguauaaaagauga

SEQ ID NO: 16066 - RNA, 64 nt, Human
uauuuauuuuacauuuaaauucccacagcaaauagaaaauaauuuaucauacuuguacaauuaa

SEQ ID NO: 16067 - RNA, 64 nt, Human
ggauauaagacuuauuuucauguacuauaaauaugaaaauaacuuugauuuuuaauuguguagu

SEQ ID NO: 16068 - RNA, 64 nt, Human
cuucuuugaagaaaaguaugucucuggaucccuggaaaauaaugauguccaaagcaaauuguga

SEQ ID NO: 16069 - RNA, 64 nt, Human
uagugcaaugucauaucugaucccaggaagccuggaaaauaaaagacgaugcauuauaacuugc

SEQ ID NO: 16070 - RNA, 64 nt, Human
caaaaaauaaaaacauucuaguaacuggccacuggaaaauaaauaaaaauaaaaacuaggguuu

SEQ ID NO: 16071 - RNA, 64 nt, Human
cuaaauaagucaccauugacuucuuggugcuguugaaaauaauccauuuucacuaaaagugugu

SEQ ID NO: 16072 - RNA, 64 nt, Human
cagauagccuauuuauuauaaauuaugagaugaugaaaauaauaaagccaguggaaauuuucua

SEQ ID NO: 16073 - RNA, 64 nt, Human
auucuagaaacuaaaaucaagaauacagaaaaaugaaaauaacauuuuacuucugcgcuucuau

SEQ ID NO: 16074 - RNA, 64 nt, Human
uucuccuuaccacaaucuuaaauagauuucagcugaaaauaaucaguucuuaugaaaacaaaua

SEQ ID NO: 16075 - RNA, 64 nt, Human
cauucaucacuucagugauccaugcauagaauaugaaaauaaauucuuccaacucaugggauaa

SEQ ID NO: 16076 - RNA, 64 nt, Human
ggccaggcauggccuaguaaguacaccaugccucgaaaauaaguccagaagcacuggacuaaag

SEQ ID NO: 16077 - RNA, 64 nt, Human
caaacaaaacagauaugcuuacucuaguuaaaaagaaaauaaaucucaugucagacccagaaag

SEQ ID NO: 16078 - RNA, 64 nt, Human
auuuucguaccuuucuaccaaaaccaaguuucaggaaaauaacucuauguuguuuauuuucagu

SEQ ID NO: 16079 - RNA, 64 nt, Human
guaguuuuuguuuuacugagaugcuuuuguaaaggaaaauaauacugugacaguuuaguaauuc

SEQ ID NO: 16080 - RNA, 64 nt, Human
uguauuuuuuuucuaaauguacauaauuagaaaagaaaauaacaauaggaagcuauguguaucu

SEQ ID NO: 16081 - RNA, 64 nt, Human
gugucuaccucuuccaugaaaaauggaaagggaugaaaauaaugggaguauaauacccauuuaa

SEQ ID NO: 16082 - RNA, 64 nt, Human
agaauugaccuuaauuuguuuuccagaaucaaaagaaaauaaaauauaaauuuugaaacuauga

SEQ ID NO: 16083 - RNA, 64 nt, Human
cugucucaaaaaaaaaaaaaaaaaaaggagagaagaaaauaaagaaggcuaauauauaauuuuu

SEQ ID NO: 16084 - RNA, 64 nt, Human
ugugaacauggaaacaacuucuaguauuggaucugaaaauaaagugucauccaagccauaaaaa

SEQ ID NO: 16085 - RNA, 64 nt, Human
acaguuucuagcauuaaacaaauaaacaaggggagaaaauaaaacucaaggacugaaaaucagg

SEQ ID NO: 16086 - RNA, 64 nt, Human
auccuauaauucuacuuguaagauccuaucauaugaaaauaaccagagauacaaagacauucug

SEQ ID NO: 16087 - RNA, 64 nt, Human
gagaagguugguuaaaagauggcagaaagaagaugaaaauaaauaagccugguuucaacccucu

SEQ ID NO: 16088 - RNA, 64 nt, Human
uuucgauauuuauugauguuuucacaaagaacaggaaaauaaaauauuuaaaaauauaaaaugu

SEQ ID NO: 16089 - RNA, 64 nt, Human
ugaaacucagugguaacucaugauuuaugacauugaaaauaaagaggaacauugaccugcagac

SEQ ID NO: 16090 - RNA, 64 nt, Human
uuuucacuuuagccauauucugauuuuuaaaaaggaaaauaaaaacaaaucuuucuucaguauc

SEQ ID NO: 16091 - RNA, 64 nt, Human
ccaaucaucuccuuccuguuaaucacauguuaaugaaaauaagcucuuuuuaaugaugucacug

SEQ ID NO: 16092 - RNA, 64 nt, Human
ugaaguuguguauuuaaugcauuauagcaugguggaaaauaagguucagaugcagaagaauggc

SEQ ID NO: 16093 - RNA, 62 nt, Human
aaauuccugucaaugacugaggaugacaugaggaaaauaauguaauuguaauuuugaaaugu

SEQ ID NO: 16094 - RNA, 64 nt, Human
uauugaaagguuuuaaaauggcauacagauaauggaaaauaagcuuuauguuucaagaagggca

SEQ ID NO: 16095 - RNA, 64 nt, Human
uugauuguacucuccagaaaauuuuucugucagugaaaauaaaagaaaaauuaaaguaaagcua

SEQ ID NO: 16096 - RNA, 64 nt, Human
cauucacaaaauuucuuaugcauacauugcuauugaaaauaaaauuuaaauauuuuuucauccu

SEQ ID NO: 16097 - RNA, 64 nt, Human
ccuacucgaaagaaauguagaugcuaugcauuuugaaaauaaucugcaucaguuagaacugcag

SEQ ID NO: 16098 - RNA, 64 nt, Human
aauuaucauaucuuccauuccuguuauuggagaugaaaauaaaaagcaacuuaugaaaguagac

SEQ ID NO: 16099 - RNA, 64 nt, Human
uuggaauagaauugguaaguugcaaagacuuuuugaaaauaauuaaauuaucauaucuuccauu

SEQ ID NO: 16100 - RNA, 64 nt, Human
aacccaaugaacagcuuauguguuagccauagcugaaaauaagcacaaauagcuuauauucaga

SEQ ID NO: 16101 - RNA, 64 nt, Human
aaaacuauuuucuuauaguauaguuacaaaaugggaaaauaauuaguuacagugggaaauucac

SEQ ID NO: 16102 - RNA, 64 nt, Human
ucuucugacuucuuggcuaacuuccagacuaugggaaaauaaauuaugauuguaugugaccccc

SEQ ID NO: 16103 - RNA, 64 nt, Human
cauaguguucuguguaguuauugcuuagucugcagaaaauaaugacuuagaugagaugucugac

SEQ ID NO: 16104 - RNA, 64 nt, Human
uauuuugucuuuguaauuuacagaaguuauuggagaaaauaaacuuguuucauuuugcauuucu

SEQ ID NO: 16105 - RNA, 64 nt, Human
uaaguguuauaucccuaaccaagaagaaaaauaugaaaauaauuaagacuagaaucaagcagua

SEQ ID NO: 16106 - RNA, 64 nt, Human
aaaagaaaauggagaaaugaaauauuuuaugaaagaaaauaauaacaauuauucaauaaucuau

SEQ ID NO: 16107 - RNA, 64 nt, Human
gugagagccugcugagaugaagaaaucacuucaugaaaauaagcaaagaccacacauuuuuuac

SEQ ID NO: 16108 - RNA, 64 nt, Human
uagaugacuuuguggccaucuuguuauugaguaagaaaauaaagcauggacaucaugaaaauaa

SEQ ID NO: 16109 - RNA, 64 nt, Human
guuauugaguaagaaaauaaagcauggacaucaugaaaauaacagauguuacccaaacucaucu

SEQ ID NO: 16110 - RNA, 64 nt, Human
aaagauuccaaagaaagucaaaaaguguaaaauggaaaauaagagaucaaaaugaauauagcau

SEQ ID NO: 16111 - RNA, 64 nt, Human
ucuagcuaaucucgguagaugucauuacaaccuggaaaauaaaucacccuaagugacacaaauu

SEQ ID NO: 16112 - RNA, 64 nt, Human
gagaaaaagagagagcagggugggguaaggaggagaaaauaaaccaacaauuaggucugcauuu

SEQ ID NO: 16113 - RNA, 64 nt, Human
uauaaaaccacuaauuguuccguuaagcuucacagaaaauaaaaccucuauuacuagacauuua

SEQ ID NO: 16114 - RNA, 64 nt, Human
uauuaauguaacuagcauaagugguuuucuucaggaaaauaaauaucacaguauuaucuguguu

SEQ ID NO: 16115 - RNA, 64 nt, Human
uuaaaacacucuuuccccgcaccccagcaauuaugaaaauaaucucugauucccugauuuaaua

SEQ ID NO: 16116 - RNA, 64 nt, Human
uuuauguuuguaaucuguaaaugaacacauggcagaaaauaaccccugauugguaggaucauag

SEQ ID NO: 16117 - RNA, 64 nt, Human
aaugucuucgagauguagaaauaaggaauauucugaaaauaaaaauuauacaguaguaaagaua

SEQ ID NO: 16118 - RNA, 64 nt, Human
uguguugaugagagaauaaucuugggcagucugggaaaauaaggaaggcaucuccuucuuacuc

SEQ ID NO: 16119 - RNA, 64 nt, Human
uaucauuaauaaauauaccuuugcucuuuucagggaaaauaacaaccacccuuacugauaguug

SEQ ID NO: 16120 - RNA, 64 nt, Human
guagggauucacugacuagauuuuacugaacuaugaaaauaaauacacauaauuuuucacaaaa

SEQ ID NO: 16121 - RNA, 64 nt, Human
guaauucuaacuucaaugcaugugacugcuuuaugaaaauaauagugucuucuauggcauguaa

SEQ ID NO: 16122 - RNA, 64 nt, Human
cuuauacaguggagggaagucuuccuuccugaaggaaaauaaacugacacuuauuaacuaagau

SEQ ID NO: 16123 - RNA, 64 nt, Human
ugugacuguggguuuuauuuuguauucugguuaagaaaauaauguauugaguuacugucaagua

SEQ ID NO: 16124 - RNA, 64 nt, Human
aaauguaaaauacucuccagaucuaccauuaauagaaaauaaacuaaaccuuauauuuuauuuu

SEQ ID NO: 16125 - RNA, 64 nt, Human
ugguuagugugacccccucaaguagcaagugauggaaaauaagagucaaauaccuugauguuug

SEQ ID NO: 16126 - RNA, 64 nt, Human
gauuaucugaguguuccacaguuguaugucaaaagaaaauaaaauucaaauauuuaaaacggac

SEQ ID NO: 16127 - RNA, 64 nt, Human
gaacacgauccucuuucugggcauuccuaggggagaaaauaaaauuuguaauguucuagagauc

SEQ ID NO: 16128 - RNA, 64 nt, Human
auaugugguguauauccuuccaaaaaauuaaaacgaaaauaaaguagcugcgauuggguaugug

SEQ ID NO: 16129 - RNA, 64 nt, Human
cuuaagaugugcaaggagauuuaaugauuucaaagaaaauaaugguucuuuguuuuuaauguua

SEQ ID NO: 16130 - RNA, 64 nt, Human
cucgauauuuccaauccuggcuacuuuucuuagagaaaauaaguccuuuuuuucuggccuugcu

SEQ ID NO: 16131 - RNA, 64 nt, Human
auacacaaaaauagaaauuuaaaaaagaugagaugaaaauaaaucuaagucaaaguucuaauag

SEQ ID NO: 16132 - RNA, 64 nt, Human
cacacacacagaaaauauacuguaaagaaagagagaaaauaaaaaguuaaaaaguuaaaaaaaa

SEQ ID NO: 16133 - RNA, 64 nt, Human
augaaaaucuagucuuuuuaggacuggacacaaggaaaauaaucucuaaacuauugacuaaauu

SEQ ID NO: 16134 - RNA, 64 nt, Human
cauccaccaauaucauguguagauauuauguauagaaaauaaaauaaauuauggcucuaacuuc

SEQ ID NO: 16135 - RNA, 64 nt, Human
acuugaauauuguauguugcauuccacuucauuugaaaauaaugaaaccauguaccacuguuua

SEQ ID NO: 16136 - RNA, 64 nt, Human
cugccaauuagcuucuacuaaccacgguucaacagaaaauaaauguguauuugugaauaacaaa

SEQ ID NO: 16137 - RNA, 64 nt, Human
uaccaguuuucuuuaugaugauacaguguuaaaagaaaauaaauuacaauugaucugucaucca

SEQ ID NO: 16138 - RNA, 64 nt, Human
ggaggauuugguagcaauguguagagcagagcuggaaaauaaggguucuugaaacagcaacagu

SEQ ID NO: 16139 - RNA, 64 nt, Human
auuaucuuuacaaaguguuuaaaguuugaacauagaaaauaaucucucugcuuaauuguuaacu

SEQ ID NO: 16140 - RNA, 64 nt, Human
ccguaggcagagugcucacuuugaauugcuaauagaaaauaaugcacaguguccucaggauaug

SEQ ID NO: 16141 - RNA, 64 nt, Human
gguaagguacaaguguguuaaaauugaaaacucugaaaauaacucuuuaaaaagcccucuuaau

SEQ ID NO: 16142 - RNA, 64 nt, Human
uauugaaggucauaaucagugauuuuuguuauaugaaaauaauaguguuucacaguauuucuau

SEQ ID NO: 16143 - RNA, 64 nt, Human
cgaagugccuuuaauucagccuuauccaacuagggaaaauaauguuggacaagucuaggauuug

SEQ ID NO: 16144 - RNA, 64 nt, Human
gaaaagauucucaguuaccaaacgucuccaccuagaaaauaaaaauacauuaagaugugcuuuc

SEQ ID NO: 16145 - RNA, 64 nt, Human
uuccuuuuuuuuuuuuuuuugguaucuguucaaugaaaauaagguaugacccaaguuuuuaccu

SEQ ID NO: 16146 - RNA, 64 nt, Human
cuuguuuguucagucugaauuaaaauuagacuuugaaaauaaagcuuaaauaguuguuuccucu

SEQ ID NO: 16147 - RNA, 64 nt, Human
uuucuaaaaacuucaaguguuugauuaaaauagagaaaauaauuuuuaaaauaauagauaaaaa

SEQ ID NO: 16148 - RNA, 64 nt, Human
ugcugugacuuaggugaauuuucaauuuaagguagaaaauaaguuuuuaggagguuuguaaaag

SEQ ID NO: 16149 - RNA, 64 nt, Human
uccuucaaaaaaccaaacaccauaucugaugugugaaaauaauggaggaaaaccucuuguguau

SEQ ID NO: 16150 - RNA, 64 nt, Human
gaacaaaauaaguagacaaaauaacaaaagacaggaaaauaagucucuuuguauccuuauuaau

SEQ ID NO: 16151 - RNA, 64 nt, Human
uucagaugccuuugagaaaugaaugaaguagagagaaaauaaaagaaaaaccagccaggcacag

SEQ ID NO: 16152 - RNA, 64 nt, Human
aaugauuuaauuuuuccuauugcucuuccuuguggaaaauaaaguguuuuguuuuuuucuguuu

SEQ ID NO: 16153 - RNA, 64 nt, Human
ccugccauuuaaccccacaguuaauaaaguggcugaaaauaauaguagcucuggcuuggugcuu

SEQ ID NO: 16154 - RNA, 64 nt, Human
uguguuucuacacagcaaaccauuuuucuuucaugaaaauaauauauuauuaacaugaauauau

SEQ ID NO: 16155 - RNA, 64 nt, Human
uuuaaauaagcgcuuuaaugaaaaugguuagacugaaaauaauuuugguccuuaaaaggaguca

SEQ ID NO: 16156 - RNA, 64 nt, Human
auacauaauaaaauucgagcuacauaaguauauggaaaauaauguaccuugauuauuaugaaau

SEQ ID NO: 16157 - RNA, 64 nt, Human
ggaccccuuucauuuucaguuuugcucaucuagggaaaauaaggcuuugguuuccaguuuaauu

SEQ ID NO: 16158 - RNA, 64 nt, Human
ucagggauuuauaauuuuaaaacaaauaugcacagaaaauaaacauuucuuaaaauauauucug

SEQ ID NO: 16159 - RNA, 64 nt, Human
agucuguuuuauguguuuugauuacuagugagcagaaaauaacauacccuguauucaaaauuac

SEQ ID NO: 16160 - RNA, 64 nt, Human
acaaaucuuaaaguaucggaacuguuuagcuuaugaaaauaaucgacucugaauauuuguuaca

SEQ ID NO: 16161 - RNA, 64 nt, Human
ucuuuugauaaauggaucaguuuuaggacuuucagaaaauaaaagaucgcucuugaaaagcugu

SEQ ID NO: 16162 - RNA, 64 nt, Human
aucaagcuauuugggguguuuguuaguaaauagggaaaauaaucucaaaggaguuaaauguauu

SEQ ID NO: 16163 - RNA, 64 nt, Human
cagcauaccacgccacaggguuagaaccaacgaagaaaauaaaaugagggugcccagcuuauaa

SEQ ID NO: 16164 - RNA, 64 nt, Human
aguaaaaaagagaauuguagauaauacugucuaggaaaauaagaauuagguuucuuugaagaag

SEQ ID NO: 16165 - RNA, 64 nt, Human
cugacuuugaaauuauguuaagugaaauaucaaugaaaauaaaguuuacuauaaauaauauuuc

SEQ ID NO: 16166 - RNA, 64 nt, Human
agaaaagcaagaaaaugcagauagagaaaaagaagaaaauaaaacuggaguauuuccacaaccc

SEQ ID NO: 16167 - RNA, 64 nt, Human
aggaagaggucccaaauuuggaguaaagaugggagaaaauaaauaugugcuauuuccuuggcga

SEQ ID NO: 16168 - RNA, 64 nt, Human
uacaagugugcaaauuaugacugcgugagccuuagaaaauaaaauguauaaagggcaacacaug

SEQ ID NO: 16169 - RNA, 64 nt, Human
uugcaguauuuaaagcuuaagcuuucaggaaaaagaaaauaagaauucagugugugcaugacaa

SEQ ID NO: 16170 - RNA, 64 nt, Human
aagagcagaagcuccuugguuuaaccagcacagagaaaauaauauaaaucccauaagggcagac

SEQ ID NO: 16171 - RNA, 64 nt, Human
guugggaagaaauacauuuccuaauguauuuauagaaaauaaaaauauuuuuaugugccuuuuu

SEQ ID NO: 16172 - RNA, 64 nt, Human
cucagaauuacuaagcauguggcauaaauuuggagaaaauaauaugacuagaaaaauuaguguu

SEQ ID NO: 16173 - RNA, 64 nt, Human
cuuggugccucaguuuccugaccuaugaaacagagaaaauaaaagcacuuauuuauuguuguug

SEQ ID NO: 16174 - RNA, 64 nt, Human
cacuuucccucuguuuccugaccuaugaaacagagaaaauaacaucacuuauuuauuguuguug

SEQ ID NO: 16175 - RNA, 64 nt, Human
aaaagaugcaguuuuccuuuguauugggaaaugugaaaauaaaauugucaacucuuucaguuaa

SEQ ID NO: 16176 - RNA, 64 nt, Human
ccugugccccucagagaggcaugugaugugcaaggaaaauaauaggauauaaaacacaucaagu

SEQ ID NO: 16177 - RNA, 64 nt, Human
uccagccugggcaacagagcgagacuucaucucagaaaauaaaaaauaggggccaggcacagug

SEQ ID NO: 16178 - RNA, 64 nt, Human
aauaaaagaaaaccaugauuuccccuucccuuuggaaaauaaacauaagacuaaacaugagaaa

SEQ ID NO: 16179 - RNA, 64 nt, Human
cccuuuauauuuguucuaaaauaagucaaaaugugaaaauaauauuaaaucuaagauauuuuga

SEQ ID NO: 16180 - RNA, 64 nt, Human
ugaugguaaaguugguaaaaggcaacuuucagaagaaaauaaugugcuuuagaaaaaaaauuca

SEQ ID NO: 16181 - RNA, 64 nt, Human
uaucaguuuuauucucauguaccuaaguuguggagaaaauaauugcauccuauaaacugccugc

SEQ ID NO: 16182 - RNA, 64 nt, Human
cacacccaguuauggaauguccagaguucucgaagaaaauaaaugacuuuaggaagagguauac

SEQ ID NO: 16183 - RNA, 64 nt, Human
aaauuaauacaguaguaguaaucauuuucuaggggaaaauaaaagaauaaaucacuauacugau

SEQ ID NO: 16184 - RNA, 64 nt, Human
ggaaaguguaggugaaaaaacuuguaacuguauugaaaauaaauaccauuaaacugugaucagu

SEQ ID NO: 16185 - RNA, 64 nt, Human
acuuuguuuugguacauuugguugugcuuguggggaaaauaaaaacgcagagauccuuauauau

SEQ ID NO: 16186 - RNA, 64 nt, Human
guguacaaauuggucaaguugcaauuauuuaugagaaaauaaugauaaauguaaaauaucuaaa

SEQ ID NO: 16187 - RNA, 64 nt, Human
agguuuuaugcuauuccuguguucuccaaaacaagaaaauaaaaagacaugacuuauucucugu

SEQ ID NO: 16188 - RNA, 64 nt, Human
cuuccauuccagccuaacauccaaugcaggcaaggaaaauaaaagauuuccagugacagaaaaa

SEQ ID NO: 16189 - RNA, 64 nt, Human
ugcaauuaaaagaaaaauguuaaaauauuaaaaugaaaauaaaagcauuacuuuccaacaaaga

SEQ ID NO: 16190 - RNA, 64 nt, Human
agcagauacaguauaaacucacaaacacagauuugaaaauaaugcacauaugguguucaaauuu

SEQ ID NO: 16191 - RNA, 64 nt, Human
aaaccaacagguuuuacuggucaaaaugacugcugaaaauaauuuucaaguugaaagaucuagu

SEQ ID NO: 16192 - RNA, 64 nt, Human
cuauuuagacauguaauuuguguaaauuauugaugaaaauaauuuacugugacuuuauuagcag

SEQ ID NO: 16193 - RNA, 64 nt, Human
ccauucagucuggacuucaaaucacuugucuucagaaaauaaaagauuuguuccacccgggugu

SEQ ID NO: 16194 - RNA, 64 nt, Human
gagggaagggaaaaaagugugaaaggaugaugaagaaaauaauuuuacuauuucuuuuaaaagu

SEQ ID NO: 16195 - RNA, 64 nt, Human
uuuguuauauuaaaagugcacaaaaacugagagugaaaauaaaagguacauuuuauaagcuugc

SEQ ID NO: 16196 - RNA, 64 nt, Human
accgugcugacagauaucaaaguacucuagcagggaaaauaauuuguuugcuguguaaggaaga

SEQ ID NO: 16197 - RNA, 64 nt, Human
ugauaaguuuacacacugugcaaucucacaaucugaaaauaaaguugaguuggcuguguuuucu

SEQ ID NO: 16198 - RNA, 64 nt, Human
gcuggauaaauuaaaaucugagguuaaugaaauggaaaauaaucuaacucgaaggcgccugaaa

SEQ ID NO: 16199 - RNA, 64 nt, Human
uccacucucaaguuuucuacuuugucuuugaacugaaaauaaacauggaucuagaaaaccaacc

SEQ ID NO: 16200 - RNA, 64 nt, Human
auuuuuccaaaauaauuuuaagaaaucaaagagagaaaauaaagaccuugcuuaugauugcaga

SEQ ID NO: 16201 - RNA, 64 nt, Human
gccgacugugaggaaaagcagagggaaugugaaagaaaauaagagaauccacgggauuugaugc

SEQ ID NO: 16202 - RNA, 64 nt, Human
guauucucuucuuuugaaaauuuuauuuuuaucugaaaauaacaguugaucugaaauaaaaagg

SEQ ID NO: 16203 - RNA, 64 nt, Human
agcuaugucaccuuacuacagaauccagcagucagaaaauaacacaaaaaaugccgagguuugg

SEQ ID NO: 16204 - RNA, 64 nt, Human
ugugugaauauaauuuuugacuaaccugugacuggaaaauaagucuucauuuuucuccuuuaca

SEQ ID NO: 16205 - RNA, 64 nt, Human
aaacauaaauaucugccacauaaaagaaguccaggaaaauaacacguaauaagacuguucacuc

SEQ ID NO: 16206 - RNA, 64 nt, Human
aaaacauggcuacuuucuaagcuacaaaccauuagaaaauaacucaaaaagauggcagaggcaa

SEQ ID NO: 16207 - RNA, 64 nt, Human
aacacagauaguaguaaaaauucugaguaacugagaaaauaaucaguuggaaaugauuagauaa

SEQ ID NO: 16208 - RNA, 64 nt, Human
ccccaacucagaguuaagcauacauggcaaugcugaaaauaaacaaaauccacugaggcuuccc

SEQ ID NO: 16209 - RNA, 64 nt, Human
ggcucccugcucucccgaggaagaugcucugcaggaaaauaaaagucagccuuuuucuacauau

SEQ ID NO: 16210 - RNA, 64 nt, Human
cgugcacugagcugcaacuucuuacuucccuacugaaaauaagaaucugaauauaaauuuguuu

SEQ ID NO: 16211 - RNA, 64 nt, Human
aggagacuguuuggaaauugauuuugaaccugaugaaaauaaagaauggaaagcuucagugcug

SEQ ID NO: 16212 - RNA, 64 nt, Human
uuuuauuaauuaucuggauaacagcaaaaaaacugaaaauaaagagagagagagaucugggugu

SEQ ID NO: 16213 - RNA, 64 nt, Human
gaugcuaggaugaggcaggcccaguccuccuccagaaaauaagacaggccacaggagggcagag

SEQ ID NO: 16214 - RNA, 64 nt, Human
ccuggcucaagaauuacuccgaagucagucugcagaaaauaaauauuuaguaugacaugacacu

SEQ ID NO: 16215 - RNA, 64 nt, Human
aaucaaagugauuuugaaaaucucuaauggcucagaaaauaaaaacauccaguuuguggaugac

SEQ ID NO: 16216 - RNA, 64 nt, Human
guaccauuuuuaauuuaugucaguugaugcaucugaaaauaagugcuuggaguguucguacccu

SEQ ID NO: 16217 - RNA, 64 nt, Human
ggguucucugcuguccuaagaacuucaguguagagaaaauaagacuucuggugcugcuggggua

SEQ ID NO: 16218 - RNA, 64 nt, Human
gggauugggcccugagagggcuaguucuguggcugaaaauaaagcaugucccgcccccuacugg

SEQ ID NO: 16219 - RNA, 64 nt, Human
uuuauguguuuuuccagagcuuucugggaugugggaaaauaaauuacacugaagcaguugaaag

SEQ ID NO: 16220 - RNA, 64 nt, Human
uugucaguuuagcauuacauugucuugagcaccagaaaauaaaauccauauauuaauaaaaacc

SEQ ID NO: 16221 - RNA, 64 nt, Human
uuuuagaguauuccucaaaacuguaaaaaucauggaaaauaagggaauccugagaaacaaucac

SEQ ID NO: 16222 - RNA, 64 nt, Human
agaaucuuagaggcuugaugaugaugguguuggugaaaauaagaaagaauugcaguaaagucuu

SEQ ID NO: 16223 - RNA, 64 nt, Human
gagagaaucaauugcugaaaguguuaaaauuucugaaaauaaaugcuuaauuacauauacagga

SEQ ID NO: 16224 - RNA, 64 nt, Human
uuucuuuacagcugcaauauuugugacugaauaggaaaauaaaugaguuuggagacuucaaaua

SEQ ID NO: 16225 - RNA, 64 nt, Human
gauaagacugauaaacuucguauuguauagcuuugaaaauaauuaugccuaguauggagaaaca

SEQ ID NO: 16226 - RNA, 64 nt, Human
ugugacuuuauuuguguccuaaacauucuucagugaaaauaauuuuauuucagucaaacauuua

SEQ ID NO: 16227 - RNA, 64 nt, Human
acagcauacaaucucagaaacuuagaagcaaguagaaaauaauugguugauguaaacgaaagug

SEQ ID NO: 16228 - RNA, 64 nt, Human
cugcuaaagguaaaagaaaagaaaaaaauaguuggaaaauaagacaugcaacuugaugugcuuu

SEQ ID NO: 16229 - RNA, 64 nt, Human
ucugaauauuuuacaaauuauagcuaugucuugugaaaauaaccucaaaaagaaaaauacgacu

SEQ ID NO: 16230 - RNA, 64 nt, Human
acuuguuuguauuucaucuugauuuuuuucuuuggaaaauaaagcauucuauuugguucagauu

SEQ ID NO: 16231 - RNA, 64 nt, Human
auucacuucauuguaccccaugaccugagguaaagaaaauaauuuucaaauugcagacuuccuu

SEQ ID NO: 16232 - RNA, 64 nt, Human
cuucaugcucaccuauuggagauuugggaagguugaaaauaaacuuccuaauuuuuauuuguau

SEQ ID NO: 16233 - RNA, 64 nt, Human
gcaaugauggcuggaucauuuaaaguucuuuuuagaaaauaacauaagccaaagacucaagugu

SEQ ID NO: 16234 - RNA, 64 nt, Human
acuuacuguauaaaauuaguuggaagccauguaagaaaauaacaucugaaaauucuugaacuua

SEQ ID NO: 16235 - RNA, 64 nt, Human
ugaccaaaaguuacauguuugcaccuuucuaguugaaaauaaaguguauauuuuuucuauaaag

SEQ ID NO: 16236 - RNA, 64 nt, Human
uuaacugacauuugcuuuuuuucaagaccuaauagaaaauaagaaagcccauaauguauuuaga

SEQ ID NO: 16237 - RNA, 64 nt, Human
aucuuugccuuaccugaucacaaauuauguuggggaaaauaaagauuuaauauuucuuuaaaua

SEQ ID NO: 16238 - RNA, 64 nt, Human
uaaaaugugaaaaaacauuauuuuuucaaagcaagaaaauaauuuacugcccucuuacauaaug

SEQ ID NO: 16239 - RNA, 64 nt, Human
gauuucuccaaaucugggagaauuuucaaaauaagaaaauaaccuuuauaugauauacuaugac

SEQ ID NO: 16240 - RNA, 64 nt, Human
gcucuuuuuuccccucauaaccuuguuuuugguagaaaauaagcuagagaaauuaagccaucgu

SEQ ID NO: 16241 - RNA, 64 nt, Human
cuggguaaaaagucuucucagaaaaacaaugucagaaaauaacagcgugcugcuuagaaauacg

SEQ ID NO: 16242 - RNA, 64 nt, Human
gacuuauuuuccuuuuacuauacagcuuggcagagaaaauaaauaucaucaaauaagauacagu

SEQ ID NO: 16243 - RNA, 64 nt, Human
uggaagaaaaaagagagaauuucuuuugggcagugaaaauaaagcaguuaacaguccuaacugg

SEQ ID NO: 16244 - RNA, 64 nt, Human
gccggguuucaucuggaauuaacuggauggaagggaaaauaaagcuaucuagcggugguuuuuu

SEQ ID NO: 16245 - RNA, 64 nt, Human
uucauucuuuugacauuaugugaauauuuuacuggaaaauaagacuaauaaauuguuaaaaguu

SEQ ID NO: 16246 - RNA, 64 nt, Human
ggcagauaagaauuacaauuauagaaaaugaggggaaaauaacaaaccuguuuuaugaaaauuc

SEQ ID NO: 16247 - RNA, 64 nt, Human
uaaagggcacucuaugaauugauuuauugucuaagaaaauaacaccacaaguagggaaauuguu

SEQ ID NO: 16248 - RNA, 64 nt, Human
uuauuuuuuucccuuuagcauugcaugugaauaagaaaauaauguuuaaagaaaaaaaaaaaaa

SEQ ID NO: 16249 - RNA, 64 nt, Human
gucucuuuggaguuggaauuucauuauauguuaagaaaauaaaggaaaaugacuuguaaggucc

SEQ ID NO: 16250 - RNA, 64 nt, Human
ccaaauuuaaaaugugugccauauucugguucuugaaaauaagauuccagagcucuuugaucgc

SEQ ID NO: 16251 - RNA, 64 nt, Human
guuauugugaaagguguacuuugugcucauuucagaaaauaaaacacaaccuuucucuugaugc

SEQ ID NO: 16252 - RNA, 64 nt, Human
ccuaugugcaugucuaaauagucacaaugaagaugaaaauaaggaugauggggacgggguccag

SEQ ID NO: 16253 - RNA, 64 nt, Human
cauuguuaagaaaguauuugauuuuugucucaaugaaaauaaaacuauauucauuuccacucua

SEQ ID NO: 16254 - RNA, 64 nt, Human
cagaagggguccacguugaauucugaaucaucuugaaaauaagauuccaaccacaaaaaaaauu

SEQ ID NO: 16255 - RNA, 64 nt, Human
cauugcugaguauagaaucagaaugcugaguauagaaaauaauuuaaaacuaaaguugguaggu

SEQ ID NO: 16256 - RNA, 64 nt, Human
aacauuguaugcauuuugauuuuuccuacuuuaagaaaauaaaauaauuuaauuuuacauuaga

SEQ ID NO: 16257 - RNA, 64 nt, Human
uaugggcaaaaacauucuauuauagugaacuaaugaaaauaacagcguauuuucaauauuuucu

SEQ ID NO: 16258 - RNA, 64 nt, Human
aaaaaaaaaaaucaaguaauuguuuuccuaugaggaaaauaaccaugagcuguaucaugcuacu

SEQ ID NO: 16259 - RNA, 64 nt, Human
uugcuaucaguagcuguuuuuaaagccguccaaggaaaauaauuauuuacaguuuuugaaguca

SEQ ID NO: 16260 - RNA, 64 nt, Human
aaguuuuguacaaaauuauauggauuuugugccugaaaauaauagagcuugagcugucugaacu

SEQ ID NO: 16261 - RNA, 64 nt, Human
ugagugcuuguuagagagaaagagaacuacuaaggaaaauaauauuauuuaaacucgcuccuag

SEQ ID NO: 16262 - RNA, 64 nt, Human
auaauguccuguauaaauguuuuuacugcuuuuagaaaauaaagaaaaaaaacuugguucaugu

SEQ ID NO: 16263 - RNA, 64 nt, Human
acuuuuaaacuuugacacauccuucagauuuccugaaaauaauugaaauaucuuacuuuaaaaa

SEQ ID NO: 16264 - RNA, 64 nt, Human
gcacuuacuaagaacaugaaaaaaaaugaaguaggaaaauaagaugaagacuuuguauuuuggc

SEQ ID NO: 16265 - RNA, 64 nt, Human
ugaaauugagucuuagauuuaaugaauuucacucgaaaauaaaugaucagaagaauuuucaucu

SEQ ID NO: 16266 - RNA, 64 nt, Human
acagcaacaauuuaugaauugaauuaucuugguugaaaauaaaaagaucacuuucucaguuuuc

SEQ ID NO: 16267 - RNA, 64 nt, Human
auccccauccccaugcccucaucccgaccucuuagaaaauaaauacaaguuugaacaggcuucg

SEQ ID NO: 16268 - RNA, 64 nt, Human
ccauuuguauaguguguuucauuuuuuaaugugugaaaauaaagaaaauuaaaggauuucugua

SEQ ID NO: 16269 - RNA, 64 nt, Human
ccauuggaugaaccucugguuuagccacaguugugaaaauaaauggaaguugguugauugucua

SEQ ID NO: 16270 - RNA, 64 nt, Human
gguagauaugcaacucuggccuccagucuuccaugaaaauaaaugcugccuggacccccaccca

SEQ ID NO: 16271 - RNA, 64 nt, Human
acagauuccuaauucuaugacaguguacauauaugaaaauaaaugaugaaaaaagaacuauaau

SEQ ID NO: 16272 - RNA, 64 nt, Human
ucagacgaggcuguaguuuaaauaccaaaagagggaaaauaaaaaagaaccuuuguaaaauaua

SEQ ID NO: 16273 - RNA, 64 nt, Human
caaaugcauuuuucaucuauaaaaugucaugaaagaaaauaaagguagugaaauauggacaaag

SEQ ID NO: 16274 - RNA, 64 nt, Human
uggugagcacaagguaagucauaaagaauaaugagaaaauaaaucuaugcuggugcagcugaga

SEQ ID NO: 16275 - RNA, 64 nt, Human
auguggacucuguuccuuuauguaaacauguaaagaaaauaagucagcgaaaaaaaugaaaccc

SEQ ID NO: 16276 - RNA, 60 nt, Human
augcaguuuuucauaauuaaugaggaaaaugaaaauaaacaguggucauucaccuccccu

SEQ ID NO: 16277 - RNA, 64 nt, Human
ggaaaaagaagaaaagagcuucuucuuugcagaugaaaauaaagguguuuuugguuaacuguca

SEQ ID NO: 16278 - RNA, 64 nt, Human
gccauucuccaaggaucucgauuuccuuuuaauggaaaauaacauuaaacaccaaauauaagcc

SEQ ID NO: 16279 - RNA, 64 nt, Human
uuuuuuuaauuauuuuaaucccaaacaucuuccugaaaauaacauucccuuaaacaugcugugg

SEQ ID NO: 16280 - RNA, 64 nt, Human
agaguaaccugugugcauacucuagaagaguagggaaaauaaugcuuguuacaauucgaccuaa

SEQ ID NO: 16281 - RNA, 64 nt, Human
aacagucuucauuuuuaaguaacugauuuaaaaggaaaauaauaaaauauguucguuuaucauu

SEQ ID NO: 16282 - RNA, 64 nt, Human
uggacauaaagaaaauccuacuuauagaaaaggagaaaauaauuaaacagucuucauuuuuaag

SEQ ID NO: 16283 - RNA, 64 nt, Human
uucaagugaccuguacugcuuggggacuauuggagaaaauaagguggaguccuacuuguuuaaa

SEQ ID NO: 16284 - RNA, 64 nt, Human
auuggggagggcauggaagauccagcggaaaguugaaaauaaacuggaaugaucaucuuggcuu

SEQ ID NO: 16285 - RNA, 64 nt, Human
aacauuuuacauaaaaugcuaaaauuuauuauaggaaaauaaaucaaacccaaagaaaguuuau

SEQ ID NO: 16286 - RNA, 64 nt, Human
uuuacaugaagcucaaguguuaggauugacuuaugaaaauaaauuuuauuucuauccaaauuug

SEQ ID NO: 16287 - RNA, 64 nt, Human
uuagucacuuccucacauggaaggcagcuuuucagaaaauaacagacauugcucguuucucaug

SEQ ID NO: 16288 - RNA, 64 nt, Human
uaccauucaacugaacaacuaguugucaacuaaugaaaauaaaacauuuucucuaagcaucuuu

SEQ ID NO: 16289 - RNA, 64 nt, Human
uaggauuuucaaagaauggagguugcugcacucagaaaauaauucagaucauguuuaugcauua

SEQ ID NO: 16290 - RNA, 64 nt, Human
agccgguucuggguagcagaucaauuuccaacuggaaaauaacuauauaauguaugcuuauugg

SEQ ID NO: 16291 - RNA, 64 nt, Human
cauuucucaauaauuuccuccacaaauuauuaaugaaaauaagaauuauuuugauggcucuaac

SEQ ID NO: 16292 - RNA, 64 nt, Human
gucccuaaaauuaaaaaaaaaaaaaaaaaaaaaggaaaauaaaggagacuugaaauuuuugaac

SEQ ID NO: 16293 - RNA, 64 nt, Human
gaaguugcuauuuugaguuuagcauugauauugugaaaauaagugcaauuuggauuucauguuu

SEQ ID NO: 16294 - RNA, 64 nt, Human
cuuguagaauauguauuaaucauucuacauuaaagaaaauaaugguucuuacuggaaugucuag

SEQ ID NO: 16295 - RNA, 64 nt, Human
auuuuuaugagcacagacuuucaagaaaauacuugaaaauaaauuacauugccuuuuguccauu

SEQ ID NO: 16296 - RNA, 64 nt, Human
ugaaaacugcaaugcugggaaaagaaggaaacaugaaaauaaaaauaagacaguuuauuagaaa

SEQ ID NO: 16297 - RNA, 64 nt, Human
guacuucuguaaagagaauaucaauauaaauaaggaaaauaaaucaaugaaauguuucaaugau

SEQ ID NO: 16298 - RNA, 64 nt, Human
ccaucaauaucacaauagauuucucaagguaagagaaaauaagcucaugagaugacauucaccc

SEQ ID NO: 16299 - RNA, 64 nt, Human
ggcaauauucuguaacuauugggugaauaugguggaaaauaauuuaguggauggaauaucagaa

SEQ ID NO: 16300 - RNA, 64 nt, Human
uugugaaauaaauguugcaguuuuuuaaaauaaugaaaauaaauacucuugguuuugcuuugug

SEQ ID NO: 16301 - RNA, 64 nt, Human
auuauuucagaaauuucccaugaaacuaaaaauagaaaauaagauauacaaguuaauucgguac

SEQ ID NO: 16302 - RNA, 64 nt, Human
aguccacuuuugucacaauucauuuuuauuaauagaaaauaaacacuuauuccaguuucaaagu

SEQ ID NO: 16303 - RNA, 64 nt, Human
caauacaagccauaggcucacagaaaaagaaaaagaaaauaaaaauuaaauuaaaaaaaaagaa

SEQ ID NO: 16304 - RNA, 64 nt, Human
uuguaaacccuauaauuaugaagcgauugcuugagaaaauaacauauaaacauagaauagaaua

SEQ ID NO: 16305 - RNA, 64 nt, Human
aaauuauuuuuccaucugaggaaaaaaauacuaggaaaauaaaucaaggugaugcugaaaaaaa

SEQ ID NO: 16306 - RNA, 64 nt, Human
ugucuucuugcaauauuuuaaauauuguauuugagaaaauaaacaucugagucauucacuuuuu

SEQ ID NO: 16307 - RNA, 64 nt, Human
cugacaaaaagggaaaauacgaaacacagaaagggaaaauaaacugacuuuuauaaugaaucuc

SEQ ID NO: 16308 - RNA, 64 nt, Human
aauuguaccuuuguguuuuguugcucuguuuccugaaaauaacucggggaugcuccugguuugu

SEQ ID NO: 16309 - RNA, 64 nt, Human
ugagugagagaguucaggagaguagcaacaaaaggaaaauaaaugaacauauguuugcuuauau

SEQ ID NO: 16310 - RNA, 64 nt, Human
cacaccaguccaaauggcuauuauaaaaaugucagaaaauaacagaugcuggugagguugugga

SEQ ID NO: 16311 - RNA, 64 nt, Human
auucuuuucaguuggagagaauugggcuaagauagaaaauaacaugauuuguuccuuauuaaag

SEQ ID NO: 16312 - RNA, 64 nt, Human
uggcaacaggugaaugaaccuagagcggugacaugaaaauaaagcucacuguuacucgcuguuu

SEQ ID NO: 16313 - RNA, 64 nt, Human
aauuuauuauuucaaaagaauaugucuuaaaagggaaaauaaaaacuuucuguugaaucacaac

SEQ ID NO: 16314 - RNA, 64 nt, Human
uuacuuauaucaauuuaaaauuugcuagugguuugaaaauaauaauguacugacuacauguaug

SEQ ID NO: 16315 - RNA, 64 nt, Human
gccucacuuaauuccagccuuuuguuuucugcuggaaaauaaguguggacauugaagcuugagc

SEQ ID NO: 16316 - RNA, 64 nt, Human
uuaauguagaaaaugugacaucuggauauaaaaugaaaauaaauguuaaauuaaauggaccuua

SEQ ID NO: 16317 - RNA, 64 nt, Human
uuuauuuuucucaagcugcuuucaggagcuagcagaaaauaacucaaaguugaagacucuggaa

SEQ ID NO: 16318 - RNA, 64 nt, Human
uuggcuguaaucacuccucgccgugucuggcacugaaaauaaggaaaaaaaaccuacuacugaa

SEQ ID NO: 16319 - RNA, 64 nt, Human
acaucaacauuuguaaaauugauguguuauaguggaaaauaacauauagauuaaacaaaauuuu

SEQ ID NO: 16320 - RNA, 64 nt, Human
agguuuaaaggaauugauuccucugaaagggccugaaaauaaaaagucuuuaacauacaaagaa

SEQ ID NO: 16321 - RNA, 64 nt, Human
aguuuaauaacacuuagaaguguuuacuuaccuggaaaauaauugcuaugccguacauucagag

SEQ ID NO: 16322 - RNA, 64 nt, Human
acaaaaaacccuaaaaaaacuuuaaugaaagguggaaaauaauuuaacuuacaaugugaaaaua

SEQ ID NO: 16323 - RNA, 64 nt, Human
aucuguauuaauugauuugauggcauaagguuaugaaaauaauguacugccccauguauuacug

SEQ ID NO: 16324 - RNA, 64 nt, Human
gaauauucauucagacaaaucagaaagggcacuugaaaauaaauuuugauucugagccaggaga

SEQ ID NO: 16325 - RNA, 64 nt, Human
uuagcagaaaggcauggcuaauaauguugguggugaaaauaaauaaauaaguaaacaaaaugaa

SEQ ID NO: 16326 - RNA, 64 nt, Human
agaaaauuauaaauguuaaaaggaaguuauugaagaaaauaaaagaaauuauguuauauuaucu

SEQ ID NO: 16327 - RNA, 64 nt, Human
cagaaguaauaauuggagguaaaguuuccuuagagaaaauaauuuuauucugcuuuguccaauu

SEQ ID NO: 16328 - RNA, 64 nt, Human
auuauuucuggauugaaaaucuuauaaaacccuugaaaauaaacagucucuuuuuuacaaagcc

SEQ ID NO: 16329 - RNA, 64 nt, Human
uaaaucuuauccuuguaucuuuuuauacauauuugaaaauaagcuuauauguauuugaacuuuu

SEQ ID NO: 16330 - RNA, 64 nt, Human
gagcaacguggaacuuccaugaggccccguuugggaaaauaaaaggauccucuucacuucuuuc

SEQ ID NO: 16331 - RNA, 64 nt, Human
uaaauacacuuuacgugaauacagucuaagugaagaaaauaaauaaaaggaagagguuuauaac

SEQ ID NO: 16332 - RNA, 64 nt, Human
auauuaaagcgcaaaugaauucaaccucagcccugaaaauaacagaauucugaaguuuccuaug

SEQ ID NO: 16333 - RNA, 64 nt, Human
uuucuauguguuuuuugcaacauaugaguguuuugaaaauaaaguacccaugucuuuauuagau

SEQ ID NO: 16334 - RNA, 64 nt, Human
uucauuuugcuauggggggcaggcaggggggauggaaaauaaguagaaacaaaaaagcaguggc

SEQ ID NO: 16335 - RNA, 64 nt, Human
aauugagugugccaguccuaggaccuuucuacgagaaaauaaaccuuguauaaaguaaguguua

SEQ ID NO: 16336 - RNA, 64 nt, Human
uuaaagcuguggucuuuccauguggagacugauagaaaauaauuuugucccaagucuuauuugc

SEQ ID NO: 16337 - RNA, 64 nt, Human
aaguaaaguaaaacaaaccuaucuugguuaacaugaaaauaacaauugagaauauauuauauuc

SEQ ID NO: 16338 - RNA, 64 nt, Human
guuaucuggacuagaauuuucaaucaauguguuugaaaauaauguugcuaucaccuauuugguu

SEQ ID NO: 16339 - RNA, 64 nt, Human
gauguuuaauauaacuuuacaacuauaucucauugaaaauaaagucauuggggauuuuuaccuc

SEQ ID NO: 16340 - RNA, 64 nt, Human
aacugacugauaguucuauauuuucaaaauauuugaaaauaaaaaguauucccaagugauuuua

SEQ ID NO: 16341 - RNA, 64 nt, Human
gguuuauuuugggcucagaaauaauugcucuguugaaaauaauccuuugucagaaaagaaggua

SEQ ID NO: 16342 - RNA, 64 nt, Human
uacaaagugaaaucuuagagaagcuaaaaggaaagaaaauaaaucuaucaaaauuacccuaaac

SEQ ID NO: 16343 - RNA, 64 nt, Human
aaaaaaauaaugguaguaaagaaacugacaaacugaaaauaagaaaacaaaaaucaaaugccua

SEQ ID NO: 16344 - RNA, 64 nt, Human
gaacagcuguugacucuaguacugugaauccagugaaaauaagccaugagaauguuuuagcaca

SEQ ID NO: 16345 - RNA, 64 nt, Human
aauaauuucgguacaucuuaugguuuaaagaguagaaaauaagaugaaauauccuaaaauauag

SEQ ID NO: 16346 - RNA, 64 nt, Human
uuggcagagagguacaguauguuaucccuauggugaaaauaaauuaauuuguuguauauaguuc

SEQ ID NO: 16347 - RNA, 64 nt, Human
aagauaugcacagucuauuuuuuguauaguauuggaaaauaaaaaugcuauaauuuggguaugg

SEQ ID NO: 16348 - RNA, 64 nt, Human
uggaugaagguggguauuggggguggcugugaaagaaaauaauggagaaucacuuuucuagaca

SEQ ID NO: 16349 - RNA, 64 nt, Human
uagauucuaaauaaauaggggcuuauacaaaaaagaaaauaaaaagccauauauacugcaaagu

SEQ ID NO: 16350 - RNA, 64 nt, Human
agacugaauuuaacuacuaagaauaaauaaagaagaaaauaaccuuaaucucuuguauuuguuu

SEQ ID NO: 16351 - RNA, 64 nt, Human
gaagaauaauuuggaaauuguugcuguguucugugaaaauaaccuccccaaaauaauuaguaac

SEQ ID NO: 16352 - RNA, 64 nt, Human
gauccacuaugccuuaaugguuuccuccauuugagaaaauaaagcuauucacauuguuaagaaa

SEQ ID NO: 16353 - RNA, 64 nt, Human
gaagauuaucggcuauaagagaauaagaauugcagaaaauaacagugaagugauugaaacuuuc

SEQ ID NO: 16354 - RNA, 56 nt, Human
auaucugcaagucugugugaggccuugaaaauaacacuagggcauaacaauuacuu

SEQ ID NO: 16355 - RNA, 64 nt, Human
uaagugaacuaccaugcuuuguuuacguguaaaggaaaauaauguuugauaguaaauguccacu

SEQ ID NO: 16356 - RNA, 64 nt, Human
uucuagucagucauacaacuauaacuacuauagagaaaauaaaauuuuuuccuuuuuuuuuuua

SEQ ID NO: 16357 - RNA, 64 nt, Human
uguugcccuaucgugauuucaguugaauucaugugaaaauaauagccauccuuggccuggcgcg

SEQ ID NO: 16358 - RNA, 64 nt, Human
guugaauaaagaaacagaaaaaauagaacauacugaaaauaaucuaaguuccaaccauagaaga

SEQ ID NO: 16359 - RNA, 64 nt, Human
aguaacaauacaugagaaagaugucuauguagcugaaaauaaaaugacgucacaagacaauugg

SEQ ID NO: 16360 - RNA, 64 nt, Human
uuucauaacuuccuguacuugaagucuaaaagcagaaaauaaaggaagcaaguuuucuuccaug

SEQ ID NO: 16361 - RNA, 64 nt, Human
gcuuuaaaucauuuuugcuuuagucuuuuuaaaggaaaauaacaaaacuaugcuguuuauauug

SEQ ID NO: 16362 - RNA, 64 nt, Human
uuuacauucauugauuauuagucauucuaacuuggaaaauaaugcaauugggucacaguguuaa

SEQ ID NO: 16363 - RNA, 64 nt, Human
guaaacuuuuccuaaaacacuuuauauuauaaaugaaaauaaauugcuaguuuauauuuuagau

SEQ ID NO: 16364 - RNA, 64 nt, Human
gugggaggggagaaagggaaccuuuucuuaaaaugaaaauaauuacugcuauuuuaaaauuucu

SEQ ID NO: 16365 - RNA, 64 nt, Human
uaagcauuuacaucacguacucauaaccuauuaugaaaauaaaugaaacuggcuggguauggug

SEQ ID NO: 16366 - RNA, 64 nt, Human
gcccaacuaaacccagaacucaaacuuaacauuagaaaauaagguccagggccggacacagugg

SEQ ID NO: 16367 - RNA, 64 nt, Human
ucccauccuggccaaugcuuaaauacuauuuguugaaaauaauucuuugagacagauuucagcu

SEQ ID NO: 16368 - RNA, 64 nt, Human
guuuuguguuuuuuucuggaacuacuucaagugagaaaauaaaaaaaaauggugacaaagcugu

SEQ ID NO: 16369 - RNA, 64 nt, Human
uuuuugaauuuugcuuaaaaucuauuuuucauaugaaaauaaaagauaacaaucaacuuggguc

SEQ ID NO: 16370 - RNA, 64 nt, Human
guucagugaugcccucuucuuguuugaaacaaaagaaaauaaugcauuguguuuuuuaaaaaga

SEQ ID NO: 16371 - RNA, 64 nt, Human
auguucuggguccauguacucagauaaacaugaagaaaauaagcaaagaaaaauggagacuggg

SEQ ID NO: 16372 - RNA, 64 nt, Human
cuguuguagauuuauguaaaaauacauucuuuuugaaaauaaaaauuuucaugucuucuaauuu

SEQ ID NO: 16373 - RNA, 64 nt, Human
augaguuauuuuuauuuauuuaaauuuuauuuuggaaaauaaauuauuuuuggugcaaaaguca

SEQ ID NO: 16374 - RNA, 64 nt, Human
acuguaaauacacauucuuauucuugaaccuucugaaaauaaguugcagacaucaugaaaaugu

SEQ ID NO: 16375 - RNA, 64 nt, Human
auugagcugugaagucuucuuggaccuguugucugaaaauaaaguuaauuuguuugaggcaucu

SEQ ID NO: 16376 - RNA, 64 nt, Human
cuucuggugccacaacuguuuauccuuuuuugaagaaaauaagggaacagaaaugccuuuuugu

SEQ ID NO: 16377 - RNA, 64 nt, Human
cucacugcagaaaucaugugacugucacgugcuggaaaauaaagugauacaucuugaaaaugaa

SEQ ID NO: 16378 - RNA, 64 nt, Human
uaauauugauuguaugucuacugugcugcauuaagaaaauaaaauuucuauauaccaaaaaugu

SEQ ID NO: 16379 - RNA, 64 nt, Human
gaccagucaacucuaagaagacuagauauuccuagaaaauaaagaagcaaaucucuuuaccggg

SEQ ID NO: 16380 - RNA, 64 nt, Human
uuucagcuccccaugcuccagaauacccacccaagaaaauaauaggcuuuaaaacaauaucggc

SEQ ID NO: 16381 - RNA, 64 nt, Human
cucacucuuuuuuuuuaguuacuaaucauuuuaugaaaauaauguauuuauaaguauuuucuua

SEQ ID NO: 16382 - RNA, 64 nt, Human
cuuauuaacaacugugaauaugagaaauacagaagaaaauaauaagcccucuauacauaaaugc

SEQ ID NO: 16383 - RNA, 64 nt, Human
uuugugacaggauuguagcaaauuauuauuuaaggaaaauaaauuguguaaacauuuaaugugg

SEQ ID NO: 16384 - RNA, 64 nt, Human
uauauauguaaaaaauguuaacaggaaaaugagagaaaauaaagcagcugaggauacaaaugug

SEQ ID NO: 16385 - RNA, 64 nt, Human
uaacaauacauucuguguauauuauuuuaaugaagaaaauaaauugauuacuggcauuggaaca

SEQ ID NO: 16386 - RNA, 64 nt, Human
auaaaaacuuuaaugaauuaggauaacaagaagagaaaauaaagguaaaaacacuauuaccugu

SEQ ID NO: 16387 - RNA, 64 nt, Human
aaaccaguucugugaaaacgguaccucauuucuggaaaauaacuuauaccagcccuucuguucu

SEQ ID NO: 16388 - RNA, 64 nt, Human
uugaaaguuuaauguuuuuauuaggagauuuaaagaaaauaaaggucuacaauaucuuuagguu

SEQ ID NO: 16389 - RNA, 64 nt, Human
gagccaaggaauucuguggcugugcugcguuucagaaaauaacccccagaggccuugggcugug

SEQ ID NO: 16390 - RNA, 64 nt, Human
cagggugguuuauaaagccuguaaacacaccuaagaaaauaaacauuuuacaaaugagcuuuua

SEQ ID NO: 16391 - RNA, 64 nt, Human
cuuucacuggccacaguuguuugaugcauuaaaagaaaauaaaaaaaagaaaaaagagaaaaga

SEQ ID NO: 16392 - RNA, 64 nt, Human
cuuuaccuuuuguuuuuccuuggaccuaaacagagaaaauaaugcuuauguaucugaagaaaag

SEQ ID NO: 16393 - RNA, 64 nt, Human
aaauguuuacacagcuuguggaauuauuucgugggaaaauaaauuuuuauaacuucucccacuu

SEQ ID NO: 16394 - RNA, 64 nt, Human
aacuuggagagggaaaauuaagcuauacuuuuaagaaaauaaauauuuccauuuaaaugucuuc

SEQ ID NO: 16395 - RNA, 64 nt, Human
aaagacaaaugaagccuaaucguuuuucuagaaggaaaauaaauucuaauugauaaugaauuuc

SEQ ID NO: 16396 - RNA, 64 nt, Human
uagaaaugauaccaagucucuaccaucucuuucagaaaauaaaagcagagauaacacuucccaa

SEQ ID NO: 16397 - RNA, 64 nt, Human
aucgguuucugcuguauuaaugacaauuauucaugaaaauaaaaaaugaaauauuuuguauacu

SEQ ID NO: 16398 - RNA, 64 nt, Human
aaaauguugaccuuuuacuuccuuuuacaaaaaugaaaauaauaaacauguuuucguauaaaau

SEQ ID NO: 16399 - RNA, 64 nt, Human
gcaguuugaagcaguucuucaugccacuuaguuugaaaauaaaauucuagauaugcaaaugauu

SEQ ID NO: 16400 - RNA, 64 nt, Human
uuuaggcuuuuguccuucugcaauacaugcacuugaaaauaaacagaaaagagauguuuaauaa

SEQ ID NO: 16401 - RNA, 64 nt, Human
agcaacaagagcgaaacugucucaaaaaaaagaagaaaauaaauaaauaaaaaucagagcacaa

SEQ ID NO: 16402 - RNA, 64 nt, Human
auaugaugccauaagggagaagaguuuauuuggggaaaauaaaagaaauuuccacaccuuuguu

SEQ ID NO: 16403 - RNA, 64 nt, Human
gaagccaacuucuguauaccuucacccauuucaugaaaauaaaaucaaaagggaaaucaaaaau

SEQ ID NO: 16404 - RNA, 64 nt, Human
uucuggaacauggauuuguguucaccuuaaaugugaaaauaaauccuauuuucuauggaagacu

SEQ ID NO: 16405 - RNA, 64 nt, Human
acagcuugcaugcaaucaaccucuuuuguaaauggaaaauaaagucuguuacccaaaggccaug

SEQ ID NO: 16406 - RNA, 64 nt, Human
ccucccagggcuguguggaucugacaggguauaggaaaauaaaaagcggagaaggugucuucag

SEQ ID NO: 16407 - RNA, 64 nt, Human
cgccgggauuccucugcugccauuugaauuagaagaaaauaauuuauaugcaugcacaggaaga

SEQ ID NO: 16408 - RNA, 64 nt, Human
gacaccuucacugaagcaagucggaaaguacaaugaaaauaaauauuuuugguauuuauuuaug

SEQ ID NO: 16409 - RNA, 64 nt, Human
gaauuuuuuuuuaucaagagggauaaaacaccaugaaaauaaacuugaauaaacugaaaaugga

SEQ ID NO: 16410 - RNA, 64 nt, Human
aucaaugcuuagagaaauauccuuuccuuaaaaagaaaauaacuuuuauauuuagaguacauag

SEQ ID NO: 16411 - RNA, 64 nt, Human
guggcgguugaaauagucccacauguggucaucagaaaauaagccauuccucauaccaauauag

SEQ ID NO: 16412 - RNA, 64 nt, Human
aagugaacacccaugaaccuacuacccagguuaagaaaauaaaugucaccagguacuugagaaa

SEQ ID NO: 16413 - RNA, 64 nt, Human
cgacucgaaauaacagaaacaaagucaauaaagugaaaauaaauaaaaauccuugaacaaaucc

SEQ ID NO: 16414 - RNA, 64 nt, Human
acuguaaaaaaaagacagugguuuugaaauuguugaaaauaaauguauuuuuguacaucaaagc

SEQ ID NO: 16415 - RNA, 64 nt, Human
auuuuauguuuagauagggcugggcaaggaaaaagaaaauaaagacaaccauauuuagcagugc

SEQ ID NO: 16416 - RNA, 64 nt, Human
ucacucugauuacccacucacuacaugaaguccugaaaauaacagagaaacuguuauaucuuuu

SEQ ID NO: 16417 - RNA, 64 nt, Human
uguuggaugacuuuaaugcuacauuuuaaaaaaagaaaauaaaguaauaauauaacucaaaaug

SEQ ID NO: 16418 - RNA, 64 nt, Human
cuaugggauuuuccccccacuggucugcauaaaagaaaauaaaaugacauaaaagggagcacuc

SEQ ID NO: 16419 - RNA, 64 nt, Human
cuaaaaauucugguuuuaaauaugagaaucaguggaaaauaaggguauaauuuuguaggucaua

SEQ ID NO: 16420 - RNA, 64 nt, Human
agggaaaauauuaauuuuaauauuauaacaaccugaaaauaauggaaaagagguuuuugaauuu

SEQ ID NO: 16421 - RNA, 64 nt, Human
cuguuggacuggguagaaaucuuucaagaagcuugaaaauaaggccauaaaggaggggcuuuca

SEQ ID NO: 16422 - RNA, 64 nt, Human
acuggccguaaguucucucagcuuuuguuugucugaaaauaaauuuaguucgccuuuauucugc

SEQ ID NO: 16423 - RNA, 64 nt, Human
ucaaacugauuccuuucuuugcauaugaguauuugaaaauaaauauuuucccagaauauaaaua

SEQ ID NO: 16424 - RNA, 64 nt, Human
cacaaccucagcccacucucagucaaggagggcagaaaauaaaagaugacaucacugccagagg

SEQ ID NO: 16425 - RNA, 64 nt, Human
aucuguacauccacaaaaauaugcaauggauguagaaaauaaaauucaagaaaagaacguugaa

SEQ ID NO: 16426 - RNA, 64 nt, Human
auaagacauuuccuaauuuauggggauuuuaauugaaaauaaacuugagucccaauagagcugu

SEQ ID NO: 16427 - RNA, 64 nt, Human
gacaacauagcaagauuccaucucuaaaaaaaaugaaaauaaacauaagccacaaggaaugggu

SEQ ID NO: 16428 - RNA, 64 nt, Human; identical to SEQ ID NO: 16394

SEQ ID NO: 16429 - RNA, 64 nt, Human
aauauguauaauuuuuaaaauguuuuauuauuuugaaaauaauguuguaauucaugccagggac

SEQ ID NO: 16430 - RNA, 64 nt, Human
cuuuacaaaguaaguuuuucuguuacuuagagcugaaaauaaaagcaauguagaguuacgcuuu

SEQ ID NO: 16431 - RNA, 64 nt, Human
uagaaaugauaccaagucuguacugucucuuucagaaaauaaaagcagggauaacacuucccaa

SEQ ID NO: 16432 - RNA, 64 nt, Human
agucuuuagucaaaucucugcauuguuucaugcagaaaauaaagauacaauuaaggcugacauu

SEQ ID NO: 16433 - RNA, 64 nt, Human
aucacauugugcuacuacgacuuuauuuuuucuugaaaauaaagccuugaggaugugaacauaa

SEQ ID NO: 16434 - RNA, 64 nt, Human
acuuuguguuucagccauguauuugcagcugagagaaaauaaucauucuuauuucaugaaaauu

SEQ ID NO: 16435 - RNA, 64 nt, Human
uaaugcuuucgauaguguuaacuugcugcaguaugaaaauaagacggauuuauuuuuccauuua

SEQ ID NO: 16436 - RNA, 64 nt, Human
uucucauugugcuuucccuucccuucuuuauaaugaaaauaaaucuugagucguugacuuuugu

SEQ ID NO: 16437 - RNA, 64 nt, Human
caccuguguuugcauauuuauauaugcuguggaugaaaauaacuuacuagagaauguauauuuu

SEQ ID NO: 16438 - RNA, 64 nt, Human
auggccagaaaauauuguauugcuuggcagaaaagaaaauaaggucuaaaggaaaguagcacau

SEQ ID NO: 16439 - RNA, 64 nt, Human
cauuaauggaucuugugaauggguugauugcugugaaaauaaugcccccuuuccccuuuucugg

SEQ ID NO: 16440 - RNA, 62 nt, Human
ucucccaguauauugacugauguuuggacggugaaaauaaaagaguuuuacuucucuggacu

SEQ ID NO: 16441 - RNA, 64 nt, Human
auaaaggaaaucaaauguuauuuuuaagaaaauggaaaauaaaaacuuuauaaacaccaucugc

SEQ ID NO: 16442 - RNA, 64 nt, Human
gagguggaugucagaucugguagguugcagcagagaaaauaaaugugccuugagagaccacuca

SEQ ID NO: 16443 - RNA, 64 nt, Human
ggaaccccaggaauugacccugaguuuuaaauucgaaaauaaaguggggcugggacacacgacc

SEQ ID NO: 16444 - RNA, 64 nt, Human
cugguggaaacguuaggauaagcaagaauugccagaaaauaaaguagacagaucuuucucuuug

SEQ ID NO: 16445 - RNA, 64 nt, Human
gcucgggucacuuagaguaaggauaacccuucaugaaaauaagccuuuaguugcucucuauuuu

SEQ ID NO: 16446 - RNA, 64 nt, Human
uagggaauuuugaacaccucuuuaaauacagcuagaaaauaaaaccaauuuguaaagccacauu

SEQ ID NO: 16447 - RNA, 56 nt, Human
ucaaccuagagacuaugugaagaaaagaaaauaaucagauuucaguuuucccuaug

SEQ ID NO: 16448 - RNA, 64 nt, Human
aucucucucucucuuucccuuuccucagugaugugaaaauaauuguguuuugcugaacuuguua

SEQ ID NO: 16449 - RNA, 64 nt, Human
ucuucuggguuuuuguuuugcuuuuugaaauaaggaaaauaagcuuaucuuaaguuuauuuuuc

SEQ ID NO: 16450 - RNA, 64 nt, Human
gggccuuauccuauagaggcauuuguaauauggagaaaauaauuuuucauuuuugcucauuuaa

SEQ ID NO: 16451 - RNA, 64 nt, Human
augguccaaaauuguaauggagucuguauuagaagaaaauaaggguaaaaucaggcugaacugc

SEQ ID NO: 16452 - RNA, 64 nt, Human
uggcguugaauagauguguauuuccuccccugcagaaaauaagcacagaaaauuauaauguagg

SEQ ID NO: 16453 - RNA, 64 nt, Human
gaaacacauuugccuaucuucuuacccugaaacagaaaauaaauauugugcuuuaugugguagu

SEQ ID NO: 16454 - RNA, 64 nt, Human
auuacuuggguauucucugauuucuagcuaauaugaaaauaauuuucuuucuagaaacacauuu

SEQ ID NO: 16455 - RNA, 64 nt, Human
ucacuagcaaagcaaauauuauaaaguuauaucugaaaauaauugugggaaguaugugauugcc

SEQ ID NO: 16456 - RNA, 64 nt, Human
cacauguugaauagaguauacuggauuggugaaagaaaauaauaauaaugagcaucuaaguggu

SEQ ID NO: 16457 - RNA, 64 nt, Human
aagacggauuucacauccacaggacggucuugaagaaaauaacacuguguauauuauuuuaaaa

SEQ ID NO: 16458 - RNA, 64 nt, Human
guuauuaaguucuuuaaaauguaaagccaugcuggaaaauaauacugcugagauacauacagaa

SEQ ID NO: 16459 - RNA, 64 nt, Human
aggacaguccuauuuuugauguccuuuccuuucugaaaauaaaguuuugugcuuuggagaauga

SEQ ID NO: 16460 - RNA, 64 nt, Human
ucaagugagccacuggaaagaaagcaaaacaagagaaaauaaaugaguuguuugacauaauuua

SEQ ID NO: 16461 - RNA, 64 nt, Human
acccuaaauuuugguuguacauuuuauuugaaaggaaaauaaauuuuuuuuuugggccaacagu

SEQ ID NO: 16462 - RNA, 64 nt, Human
cacaugacuaccuuugagcuaaugacugucuccagaaaauaacugugccccaagaagugcucca

SEQ ID NO: 16463 - RNA, 64 nt, Human
ggaaccagcuuaggcaaaagaguccccacaagaugaaaauaaagauccuaguuaccauucaaag

SEQ ID NO: 16464 - RNA, 64 nt, Human
uuguaaaacaugucaagauuuuuccaccaagcuagaaaauaaaaaacuuaguucuaccacaucc

SEQ ID NO: 16465 - RNA, 64 nt, Human
uuucaacaaugugcacucuuacucaugaacuaaugaaaauaaugcaugaauauaaaucuauauu

SEQ ID NO: 16466 - RNA, 64 nt, Human
gcauauaugcacagauacacacacacacacacacgaaaauaaauaaauguucauauucuucugu

SEQ ID NO: 16467 - RNA, 64 nt, Human
aacagacauuuauuuucuccucucccuugaauaagaaaauaaguuuuccauuccuaugaacugu

SEQ ID NO: 16468 - RNA, 64 nt, Human
agaauaaaauuuucuacaucaaaguaagacuugagaaaauaaacuuauguguauauauguuuaa

SEQ ID NO: 16469 - RNA, 64 nt, Human
gaaauacuuuuaaauuuuuccuucaugcucuagagaaaauaauuuuauuuuuaaauaaacgcca

SEQ ID NO: 16470 - RNA, 64 nt, Human
aguccuauauaaaacuaaauuugcuaucuguguagaaaauaauuucaugacauuuacaaucagg

SEQ ID NO: 16471 - RNA, 64 nt, Human
ggaauuguucuuuaucaaggguagcuaaugacaugaaaauaauugugaaauauggaauuauuuc

SEQ ID NO: 16472 - RNA, 64 nt, Human
aaacuucaagacacuggugguggugggagaucaggaaaauaacuuggccuagcucaaacaauau

SEQ ID NO: 16473 - RNA, 64 nt, Human
acaacuacuuugucgguugcucugaggguuaaaugaaaauaaaaagaaaaugugaaacagcacc

SEQ ID NO: 16474 - RNA, 64 nt, Human
agguagcccaaaauagagaaagauuagauaaagagaaaauaaguauccaucagagacaguaucu

SEQ ID NO: 16475 - RNA, 64 nt, Human
uuuguuuacuaugagucguuauuuaauuucucuugaaaauaauuuccucaaagcccaagucaau

SEQ ID NO: 16476 - RNA, 64 nt, Human
aaucaggacuauuccuagacacuagcaaaaucuagaaaauaaauaacaaggcugggugcggugg

SEQ ID NO: 16477 - RNA, 64 nt, Human
uaaaauuuccuuaggagugcagagggcucauugggaaaauaaaaauaauaaaaauaaauaaaac

SEQ ID NO: 16478 - RNA, 64 nt, Human
acuuuguuuuuuguuauuuaugaccuuguuuaaagaaaauaaauaucucccaaccuuuauuggu

SEQ ID NO: 16479 - RNA, 64 nt, Human
caguuuauggggcuagaagagcgagaaaauucaagaaaauaaauguagcuggugggagacuuug

SEQ ID NO: 16480 - RNA, 64 nt, Human
ucauugcaccaugucagacuuuuguauaugccuugaaaauaaaugaaagugagaauccucuaug

SEQ ID NO: 16481 - RNA, 64 nt, Human
uugaaauugcacauucacauuggacugagacuuugaaaauaacuuuuacauacuuuuguuuaag

SEQ ID NO: 16482 - RNA, 64 nt, Human
uggauuuuuuaaaucauauuaaaauuacagaugugaaaauaaagcagaagcaaccuuuuucccu

SEQ ID NO: 16483 - RNA, 64 nt, Human
uuguagagcauuuuguagagugguuuaaauaguugaaaauaaaguucagaacaucauguguuua

SEQ ID NO: 16484 - RNA, 64 nt, Human
gcaaccuaagcuaagucacucugcgauauuucuugaaaauaacgaccuugucuuguaucagugg

SEQ ID NO: 16485 - RNA, 64 nt, Human
auguuuguccucccuuaauuuugccucaacacaagaaaauaaguuuuauguccauuuuuguucc

SEQ ID NO: 16486 - RNA, 64 nt, Human
uuuaucaucgaugggaaggguagaaaacuucaaggaaaauaagugaaauuuuaaaagucagcau

SEQ ID NO: 16487 - RNA, 64 nt, Human
caaugggaaucucuaaugugaaaauguauucuaugaaaauaauuuuuuuaaauaaaauguuaua

SEQ ID NO: 16488 - RNA, 64 nt, Human
aaaaacuuucuguuuucuggggucugggaaaauagaaaauaagauuucaaauauuaaauaagcu

SEQ ID NO: 16489 - RNA, 64 nt, Human
aaaggcuguggccucagggcgccucccagugccagaaaauaaaguccuuuuggauucugcuggg

SEQ ID NO: 16490 - RNA, 64 nt, Human
aguuugcaugucucaugauaaccaaauguaagaugaaaauaaaagaugauuuacuucaucucug

SEQ ID NO: 16491 - RNA, 64 nt, Human
accauagcaaggccuaauguuagcuuuagcuuuagaaaauaacaguuugugaacuuacuucccu

SEQ ID NO: 16492 - RNA, 64 nt, Human
gaaugagcauucucuuguuuuaauguuggugucagaaaauaaauaugaaacauuaaguccaaau

SEQ ID NO: 16493 - RNA, 64 nt, Human
cuggggaaaaaaaacuuuuuuuuaaauuaaaaaggaaaauaaaagauauugaggucuuccuagu

SEQ ID NO: 16494 - RNA, 64 nt, Human
uaacauuuauaggaggaaaaaaaucacuuugggagaaaauaaaauucaacucaagcauaaagcu

SEQ ID NO: 16495 - RNA, 64 nt, Human
agggucagcaacaacaaagaaaaagacaauuacagaaaauaagcaagauuuggaaaggaaguau

SEQ ID NO: 16496 - RNA, 64 nt, Human
aaaguucacuggagucucaacaucuaugacucaugaaaauaaaauuuucaucuucucaacacaa

SEQ ID NO: 16497 - RNA, 64 nt, Human
ggcgcagaggcuuuuccaguguguauaaauccaugaaaauaaacgccaccugcaccccacccac

SEQ ID NO: 16498 - RNA, 64 nt, Human
aaacccauuaggcaugccuaauauuuaggcaagagaaaauaaaccaagauagauccauuuggac

SEQ ID NO: 16499 - RNA, 64 nt, Human
cucaagaacaccuuuguuuugcacugacaagauggaaaauaaauuauauuaauuuuugaaaccc

SEQ ID NO: 16500 - RNA, 64 nt, Human
agagcagaaauaaaaaggaagaaaauguagauuagaaaauaagacuucugagaaaaaguucaag

SEQ ID NO: 16501 - RNA, 64 nt, Human
auugcaugacuauuauuuaucuucuuuuaguguagaaaauaauuuuuuacaaaaagucacuuuu

SEQ ID NO: 16502 - RNA, 64 nt, Human
cucaaagaauuuauucaucucuaacaugauauuggaaaauaauggaugaaaauaggaaaaauga

SEQ ID NO: 16503 - RNA, 64 nt, Human
acauagacuuauuuuuaaauuguaccaaucacaagaaaauaauggcaauaauuaucaaaacuuu

SEQ ID NO: 16504 - RNA, 64 nt, Human
uguaaaauagccuucccaaguuucuuuuucccuggaaaauaaaaaagguaauagaacuuguagu

SEQ ID NO: 16505 - RNA, 64 nt, Human
cugggugacagagugagacuccaucucaaaaacugaaaauaaaaauaaaaauauguauucuccu

SEQ ID NO: 16506 - RNA, 64 nt, Human
gaccccaaccaugcugcauguguaaagaaggauugaaaauaaaauugcacuuuuuagguacaaa

SEQ ID NO: 16507 - RNA, 64 nt, Human
aagacaacuggagaacgacuaagaccaaauuauggaaaauaagaaaaagcuguugcuggcaaga

SEQ ID NO: 16508 - RNA, 64 nt, Human
agagcucaacucucucccaaccucaccauggaaagaaaauaauuaugaaugccacugaggcacu

SEQ ID NO: 16509 - RNA, 64 nt, Human
gcugucugcccagagaaauaaguaauuuauauaagaaaauaaauuucauaaauaaauugccuuu

SEQ ID NO: 16510 - RNA, 64 nt, Human
aggcaaaggaaacuaaggaaggagguucagugaggaaaauaagguuguccaugagauuugaaua

SEQ ID NO: 16511 - RNA, 64 nt, Human
uuuucuugguuuauggaaauaucuauauuaaugugaaaauaauuaauuuagaauugugauuaaa

SEQ ID NO: 16512 - RNA, 64 nt, Human
cauuguauucguguuugcauuauuaauuugaauagaaaauaaucacauuuucaacccauuuaua

SEQ ID NO: 16513 - RNA, 64 nt, Human
uaaauaagauuuaauucacaucaaauaaaauuuagaaaauaaaauuuaacucacacugcccagg

SEQ ID NO: 16514 - RNA, 64 nt, Human
cuauuacaggauauguugcaguccccaucuuucugaaaauaacccuuaacguauccaacagcca

SEQ ID NO: 16515 - RNA, 64 nt, Human
gaaucuuuuaugcaccaaaguuggucuugaaaaggaaaauaaaaucacuuucuugcuugguaag

SEQ ID NO: 16516 - RNA, 64 nt, Human
aaaucuuuaaauguauugaagcauugugcugucugaaaauaaggaauugcuuauaaaccagcca

SEQ ID NO: 16517 - RNA, 64 nt, Human
uauguagcugauuuaauaagcuaguuagugaauggaaaauaaguguggaguauuaaaaauguuc

SEQ ID NO: 16518 - RNA, 64 nt, Human
uuuuuaaacaauuuuuaagacuuguaauuacccugaaaauaagguuuauaaugcaaagaccagc

SEQ ID NO: 16519 - RNA, 64 nt, Human
acacacagaugacaaauuauauuugaaaucguuggaaaauaaauucagaucaaaaugccuuuca

SEQ ID NO: 16520 - RNA, 64 nt, Human
auuaguguuagugcucagaaaucaccauaaucacgaaaauaauaauaauaaaucuuuaacauac

SEQ ID NO: 16521 - RNA, 64 nt, Human
aaaaaagugaaugacguuuguuuagccaguaggagaaaauaaauaaauaaauaaaucccuucgu

SEQ ID NO: 16522 - RNA, 64 nt, Human
agucauaaauggauaaugaauauaaaugcgcauugaaaauaaacauaaaauguuacccacauuu

SEQ ID NO: 16523 - RNA, 64 nt, Human
aauagaaguuuaagaaaaguuuccguuugcacaagaaaauaacgcuugggcauuaaaugaaugc

SEQ ID NO: 16524 - RNA, 64 nt, Human
caguucucaugagaacuugguaguaagcuaaacugaaaauaaggugggcuucacuggagaaaug

SEQ ID NO: 16525 - RNA, 64 nt, Human
aagaaauauauucuaacaguacgcacugaauagugaaaauaauuagacauuuuaagaaccagag

SEQ ID NO: 16526 - RNA, 64 nt, Human
gggaucuacugugauguugucuucaaaggcaggagaaaauaauguucacaauaaaaugugcuaa

SEQ ID NO: 16527 - RNA, 64 nt, Human
guaguuuugauccaaaaucuaaaacuuaaagucagaaaauaauuaaaauuuuucuuguagaaau

SEQ ID NO: 16528 - RNA, 64 nt, Human
uuuucaguuccaugugccucccaaauaaaaaacagaaaauaaguaguuuuugugaauugacuug

SEQ ID NO: 16529 - RNA, 64 nt, Human
uugccuuugagaauaaacucauaaggucuaccaagaaaauaaauguuaugauguuucaguuggc

SEQ ID NO: 16530 - RNA, 64 nt, Human
uuuugguggugaggaggaagaacaaauaauagaagaaaauaaaaaugagauagaagaaaaguaa

SEQ ID NO: 16531 - RNA, 64 nt, Human
auuaguaguuaccuguaaauggcagaucuuuuaggaaaauaagagaaagguaagggcucuuuug

SEQ ID NO: 16532 - RNA, 64 nt, Human
uaaaauuuuaacauuggcaucuaaaguguuauuugaaaauaaaauuauuuuccuguucauugau

SEQ ID NO: 16533 - RNA, 64 nt, Human
ggguaucuauuucuuucuaagacuacauuaguaggaaaauaagucuuuucaugcuuaugauuua

SEQ ID NO: 16534 - RNA, 64 nt, Human
gauuccuggagggaagaccauuccuguuacaaaugaaaauaagcaacagaauuagcuacaucca

SEQ ID NO: 16535 - RNA, 64 nt, Human
caucuccaggugaugcccaaggcacagggcugcagaaaauaaaccuccagauuccaccaacacg

SEQ ID NO: 16536 - RNA, 64 nt, Human
aaccacggagcuccauggcucuucauucaaaagggaaaauaaugauuccacguugcuuuuuaga

SEQ ID NO: 16537 - RNA, 64 nt, Human
uaugguuuguacaauguacaauuguuucauuucagaaaauaaaaauuucaaaucaugaauaccu

SEQ ID NO: 16538 - RNA, 64 nt, Human
aauguaguuugagauagugauuaagugcuaugaagaaaauaaacuagggugaugauuuuagugg

SEQ ID NO: 16539 - RNA, 64 nt, Human
aaacgaugugcaauacauuuuuuucucuuuccuugaaaauaaaaagagaaacaaguauuuugcu

SEQ ID NO: 16540 - RNA, 64 nt, Human
uuugcuacuguuuuuccuuuuuuuacuaugacaggaaaauaaaugcaauuuuaguggaauugau

SEQ ID NO: 16541 - RNA, 64 nt, Human
agcuuucagaaauaaguuacaaaucuuuguagaugaaaauaauggaaggaauguggagcaauaa

SEQ ID NO: 16542 - RNA, 64 nt, Human
uuaagaaaugauacaguuaaugcaacaaaagauggaaaauaauauuucagucaauaugucauug

SEQ ID NO: 16543 - RNA, 64 nt, Human
auaaaaaaccacagcaaauuucuugaugaaaauugaaaauaaaaguuuccuuguauuuuagugc

SEQ ID NO: 16544 - RNA, 64 nt, Human
gacacaaauaaaauacaacuguucaauggaaauagaaaauaaacaccauaaaagagagaagaga

SEQ ID NO: 16545 - RNA, 64 nt, Human
uacuauuggagugauuuuuuucuuucuaaacagggaaaauaauguuacaaaagcaucuuuuuug

SEQ ID NO: 16546 - RNA, 64 nt, Human
cacuaaguuaaugucuaagauaauggggaaaauagaaaauaacauuauuaaguguaaaaccagc

SEQ ID NO: 16547 - RNA, 64 nt, Human
aauauuaauauuaaaaugcagaccguuaugauuggaaaauaaaucaaugaacaauauaaugagu

SEQ ID NO: 16548 - RNA, 64 nt, Human
ucuauuauaggccuucauucaaucucagauuuaugaaaauaauuacuggauuggauuaucauau

SEQ ID NO: 16549 - RNA, 64 nt, Human
ugugaagcaaacaaaaaaaauuuguauguaaacugaaaauaagaaaauacauuagcaagcuuaa

SEQ ID NO: 16550 - RNA, 64 nt, Human
agcaaccacucugguaaucuagaauucaguggcagaaaauaaauaagaagauaacuuccuucag

SEQ ID NO: 16551 - RNA, 64 nt, Human
cugaauucuuggguuggggccaaaauauuaagcugaaaauaaugcugguguggauuuguuuuaa

SEQ ID NO: 16552 - RNA, 64 nt, Human
uugcugaacauauuuuauucucuuuucagagaaggaaaauaaaaaggauucuaaaaguuugaug

SEQ ID NO: 16553 - RNA, 64 nt, Human
agaagucauacuuugguggcuaaguuuuacuaaggaaaauaacugaaaagauuaaaagugagag

SEQ ID NO: 16554 - RNA, 64 nt, Human
uuuacuaggguauugaauaaaucuagucuuacuagaaaauaaaaggagcuguuuuguggcuuug

SEQ ID NO: 16555 - RNA, 64 nt, Human
uucuucaacuccuuuuggcaagaaaacuguaacagaaaauaaauuuugaauguguacuuaaguc

SEQ ID NO: 16556 - RNA, 64 nt, Human
ggcuauaauagcaauaaaaguuagacgaaguguagaaaauaaaauaaauuucauaauguuaguc

SEQ ID NO: 16557 - RNA, 64 nt, Human
gcauuaaggaaguauaugaucugacuuuucagaagaaaauaaacaaaugcauuauguaagguca

SEQ ID NO: 16558 - RNA, 64 nt, Human
ugucaacccuuccauuucaaucccaguuagaaaugaaaauaauuacuuugaaacuuggcuuuaa

SEQ ID NO: 16559 - RNA, 64 nt, Human
ucuucaauauuuacaauaauaggaugaucuacaagaaaauaaguuucuuuuugcaaauuuuuau

SEQ ID NO: 16560 - RNA, 64 nt, Human
uuucaaugugaauccaaagcuugucugguucucugaaaauaauuuuuuccccuuuagguucuuu

SEQ ID NO: 16561 - RNA, 64 nt, Human
aguucuccugggucugcagaagguugggaauuuagaaaauaaggcuguucuuucauauuuuaau

SEQ ID NO: 16562 - RNA, 64 nt, Human
auuauguaaugaauauguguugcuuuuguaauaggaaaauaauaaaguuaaaauuucaacugca

SEQ ID NO: 16563 - RNA, 64 nt, Human
aaagucaucacgaaauggaaguuuucccaggguggaaaauaagaggaagugcugcuguaauugg

SEQ ID NO: 16564 - RNA, 64 nt, Human
guaaaaauaauaaugcagugguuguuucugucaggaaaauaaaucuuacagaacaacuggugga

SEQ ID NO: 16565 - RNA, 64 nt, Human
auccccauuuuacugcaaaguugacaagcucagggaaaauaaauaguuggccagaauuaagcaa

SEQ ID NO: 16566 - RNA, 64 nt, Human
uuccuauuuaaugaauugugauuuaaaacaaaaugaaaauaagccagguauucuaaaagauccu

SEQ ID NO: 16567 - RNA, 64 nt, Human
aucaaacaggaggauaacgaccugaagaaaaugagaaaauaaaauauuucuuaauuguaaucau

SEQ ID NO: 16568 - RNA, 64 nt, Human
guuaggagggccugugguagacagcgugaaucaugaaaauaagccuggagaguucuguuauuaa

SEQ ID NO: 16569 - RNA, 64 nt, Human
acuuugauacgccucaucuuauccuacauuauuggaaaauaaaugagauguccacacaaaugga

SEQ ID NO: 16570 - RNA, 64 nt, Human
acuccgccccaguacuugcuuugcuucauuuggggaaaauaauaccuuuucuuuaaaaaaaaaa

SEQ ID NO: 16571 - RNA, 64 nt, Human
uggaguaccacucugagcucuucaagguauggcugaaaauaacagcuacacaucuacagcuuag

SEQ ID NO: 16572 - RNA, 64 nt, Human
auacugacugacugcaauauuuguaguaaauagggaaaauaaguauuuaguuggagggauaauu

SEQ ID NO: 16573 - RNA, 64 nt, Human
cugauaccuguugguccacaucaucuuuucagaagaaaauaaaagcauuuaauugccaauggga

SEQ ID NO: 16574 - RNA, 64 nt, Human
acauaauccucuccaacuggauuauaaauaaauugaaaauaacucauuauaccaauucacuauu

SEQ ID NO: 16575 - RNA, 64 nt, Human
aaaauaagaaagcugagacugaggaggugaaacugaaaauaaaaagagaaaguucauccucuaa

SEQ ID NO: 16576 - RNA, 64 nt, Human
uugggaaacauuaaaggauguuugagggcagcaggaaaauaauacaaaacuuaaguuugggucu

SEQ ID NO: 16577 - RNA, 64 nt, Human
uacauauaauaauauaaauaaaaauaucuuuuuugaaaauaauuuaauauaccauguaauuuac

SEQ ID NO: 16578 - RNA, 64 nt, Human
ggcaacaagagcaaaacuccgucucaaaaaagaugaaaauaaaauaaaauauauauuuacaggc

SEQ ID NO: 16579 - RNA, 64 nt, Human
aaaugaaaaagauccuuuucaaaaaggugauccugaaaauaaaacuaacacuccaguauuuugu

SEQ ID NO: 16580 - RNA, 64 nt, Human
ggaaaugggaaauggauggaaaugggaaaggagggaaaauaauagcccagugagagcugaauga

SEQ ID NO: 16581 - RNA, 64 nt, Human
acuuggaagccaauuugguccuuuaauaaguaaagaaaauaauauguuuaaaaauguaaauguu

SEQ ID NO: 16582 - RNA, 64 nt, Human
ucccuuugauuaguauguguuacauauaaagacagaaaauaaaguauaaaucaagagcuuaaau

SEQ ID NO: 16583 - RNA, 64 nt, Human
aaaugguaucuaauuaauaacuagucugacaucagaaaauaaaauugaggcugauuuuuaaaaa

SEQ ID NO: 16584 - RNA, 64 nt, Human
gugugaaaacaagugucaaaauuccucauauagagaaaauaauuuugaguuuagaguauuaucu

SEQ ID NO: 16585 - RNA, 64 nt, Human
aaacuauguagcaaaaguaucuguaaaauccauggaaaauaaaaguuguaucauucuuuuugag

SEQ ID NO: 16586 - RNA, 64 nt, Human
cauugcacuucuaaaauucagccuuguucauucagaaaauaaggauggauuuugugaauaauug

SEQ ID NO: 16587 - RNA, 64 nt, Human
uccuugaaagcccauuaaguggaauagacuuucugaaaauaagaguucuuuaccucaguccucc

SEQ ID NO: 16588 - RNA, 64 nt, Human
aaaaacugagacuauggacauucaaaucaugggagaaaauaauuuuguagauuauguuccauug

SEQ ID NO: 16589 - RNA, 64 nt, Human
uaggauucuuuuggggaagagucauaauucuuuugaaaauaaccaugaauacacuuacaguuag

SEQ ID NO: 16590 - RNA, 64 nt, Human
agauguuuauauauuaacgacaauuuuuuuuuuggaaaauaaaaagugccuaaaagauguaugu

SEQ ID NO: 16591 - RNA, 64 nt, Human
uuuuuuuucucauuuaaaauaaaaaaggaagaaagaaaauaauuuuccuuguaaaaucgggcca

SEQ ID NO: 16592 - RNA, 64 nt, Human
cuccauuucauagaugaaaauagugaagcccacagaaaauaaguagcuccuccacagguuguaa

SEQ ID NO: 16593 - RNA, 64 nt, Human
uaucaaaggcaagauaucauuuauuggacuucuugaaaauaaaaguuacaaaauccaacaacaa

SEQ ID NO: 16594 - RNA, 64 nt, Human
ggaaagugugacacaguuuuuaaauuuagauguagaaaauaaugaauuaaugagauuggugaaa

SEQ ID NO: 16595 - RNA, 64 nt, Human
uuugcugaagaaauuguauuucaaccacauccaugaaaauaaaacaccuccuguuguggauggu

SEQ ID NO: 16596 - RNA, 64 nt, Human
cggggaggccggcgcagcgcagagcgggcucgaagaaaauaauucucuauuauuuuuauuacca

SEQ ID NO: 16597 - RNA, 64 nt, Human
gcuuuuggagaacuugucaaauuacagccaaugagaaaauaaggaccuagcauacuguggagaa

SEQ ID NO: 16598 - RNA, 64 nt, Human
acugaauuuuaaacuuuuugcaugcuucuauguagaaaauaaucaaaugauaauagauacuuau

SEQ ID NO: 16599 - RNA, 64 nt, Human
uuagauaugcaaauugauaaggaucuaacacuaggaaaauaaaggcgaguuuugguuugguugg

SEQ ID NO: 16600 - RNA, 64 nt, Human
cccugaugccuaaccaaagaugaguuaaccaaaggaaaauaacauuaaaggagacuuauguguu

SEQ ID NO: 16601 - RNA, 64 nt, Human
guuuccuguaaaguacaauccaacucaucaaguagaaaauaagcaugcaucauugaaaagagaa

SEQ ID NO: 16602 - RNA, 64 nt, Human
uuaaugugaaacauuuagugaauacaguaaaggagaaaauaaaauuguuagcauucuacccaga

SEQ ID NO: 16603 - RNA, 64 nt, Human
ccaccaccuucuucuauaaaugcaaacuuaagaggaaaauaaugacauguauaguauacucuug

SEQ ID NO: 16604 - RNA, 64 nt, Human
uauauggacauggaaauauuuauauaauuuuauagaaaauaaccuuuuagauggucaaagugua

SEQ ID NO: 16605 - RNA, 64 nt, Human
uaaauagcaguucacauuuuuccacaguauaauggaaaauaauggguaggggugcauugcuuau

SEQ ID NO: 16606 - RNA, 64 nt, Human
uuuuaagacuuuaauuuaguaauuuuauauuugggaaaauaaagguuuuuaauuuuauuuaacu

SEQ ID NO: 16607 - RNA, 64 nt, Human
gauauacgguagcagggguuuacggcugccaggggaaaauaacucaucaaguguuggacuuuca

SEQ ID NO: 16608 - RNA, 64 nt, Human
uauuaaauaaaccagagaucugaucuucaagcaagaaaauaagcaguguuguacuugugaauuu

SEQ ID NO: 16609 - RNA, 64 nt, Human
agacuacuaaugacuuuguuugaauuauccacaugaaaauaaagagccauaguuucagccuugc

SEQ ID NO: 16610 - RNA, 64 nt, Human
cacuuucccucaaccagcccuuaacuagaacacagaaaauaaaaccaagacuggaagguccccu

SEQ ID NO: 16611 - RNA, 64 nt, Human
uuagagauaauugucuaguuagggggcagcuggagaaaauaagcuaaguuugcaauaacagagu

SEQ ID NO: 16612 - RNA, 64 nt, Human
uccauuaaaguaacuuuuuuaacuaugagaauuagaaaauaagggacaacagggguuaaaaaua

SEQ ID NO: 16613 - RNA, 64 nt, Human
ugacauuuuagaaguggagagugcaucauauguagaaaauaaauauucagacguggcucauuaa

SEQ ID NO: 16614 - RNA, 64 nt, Human
cuccauacgcucauagucacauauggaauuuugagaaaauaaagcaugcugucuuuaggaauuu

SEQ ID NO: 16615 - RNA, 64 nt, Human
acagauguuggcuuauuguaaaaauaaaguuaaagaaaauaauguauguauugguaaugauguc

SEQ ID NO: 16616 - RNA, 64 nt, Human
acauaaaucuuguuccuuucucauuggaagcuuugaaaauaaugauaacacuauuaguagcuag

SEQ ID NO: 16617 - RNA, 64 nt, Human
aucuuugaaaaaauuacccucuagcucuaacacugaaaauaauaauaaauuguagaucucugca

SEQ ID NO: 16618 - RNA, 64 nt, Human
ggagauuuuuuuuuucacaguugaguuaguuugugaaaauaaagaacucuguagcucaccaagg

SEQ ID NO: 16619 - RNA, 64 nt, Human
uugcccucaugaagaaucccuagaggaagauaaggaaaauaaguauuuuccaguuuugcuugac

SEQ ID NO: 16620 - RNA, 64 nt, Human
uugaccucaucauuaauaagugaagaauacaucagaaaauaaaauauucacucuccauuagaaa

SEQ ID NO: 16621 - RNA, 64 nt, Human
guggaaauauuuucaagauaauguuccuuaggaagaaaauaacauucuuggguugagggaagga

SEQ ID NO: 16622 - RNA, 64 nt, Human
cuauaacagauccuuucaaaagaagaguuuuagagaaaauaaauuuaacuuuaaccacagugaa

SEQ ID NO: 16623 - RNA, 64 nt, Human
uguaaagaguuccguuugccuuucaauuuuuagagaaaauaaagacugcauucaucucauuguc

SEQ ID NO: 16624 - RNA, 64 nt, Human
uguucacuuauggcugguuuugcuauagaaauuggaaaauaaaggccacuuuuuugaaaucccc

SEQ ID NO: 16625 - RNA, 64 nt, Human
auucuaccccuuuuccuggaaaaacuggaagaaugaaaauaauuuuuuucuguggaagagagaa

SEQ ID NO: 16626 - RNA, 64 nt, Human
ugacgugcccaggccaacgucgcaggacaguugugaaaauaacaugacgcucguccaaggccac

SEQ ID NO: 16627 - RNA, 64 nt, Human
ggggugaaauauaccaaauucugcaucuccagaggaaaauaagaaauaaagaugaauuguugca

SEQ ID NO: 16628 - RNA, 64 nt, Human
uucuguaccaaacugauuucaaaaguacuacauugaaaauaaaccggugacuguuuuucuucau

SEQ ID NO: 16629 - RNA, 64 nt, Human
ucuaaacucaaaagugauaggacaagcuacagaggaaaauaaguacauagauuugauuucucca

SEQ ID NO: 16630 - RNA, 64 nt, Human
aaagccaucuauguacugaacccgggacuagaaggaaaauaaaugaucuauauguuguguggau

SEQ ID NO: 16631 - RNA, 64 nt, Human
aauguggugacaucagauguuauuuuuccuagaugaaaauaaaagucaagcagugauuaguuuc

SEQ ID NO: 16632 - RNA, 64 nt, Human
gcuuagggcacagugaaguaggaaacaauauuuugaaaauaaguuuuaaauuuaaaaugaucaa

SEQ ID NO: 16633 - RNA, 64 nt, Human
caaccuggauuuucugccucagccccauuuugcugaaaauaaugacuuucugaauaaagauggc

SEQ ID NO: 16634 - RNA, 64 nt, Human
agcaggaagcucuuauugcuuauuuggucguaaugaaaauaauuuguaaaauguccuuuaaaag

SEQ ID NO: 16635 - RNA, 64 nt, Human
uuuuccuaagaggucuagaaaugcuuaaacuauugaaaauaaaucaaauuauucaaagacugga

SEQ ID NO: 16636 - RNA, 64 nt, Human
acuaaacgcaguaguuuuuuuaaaaggggagauagaaaauaaaugguuuuguuggagugcauuu

SEQ ID NO: 16637 - RNA, 64 nt, Human
uaggcccuuuuaccuuuggcuguuacccuuccuugaaaauaacccgaacucagaauuauuuaaa

SEQ ID NO: 16638 - RNA, 64 nt, Human
gaaaauggugaagccauagaaaaguuacccgagggaaaauaaauacagugauauucuuacgcaa

SEQ ID NO: 16639 - RNA, 64 nt, Human
ugauuuuaaaaaaggaaucaauagaugcuuugaagaaaauaaaacuuauacaguugauugaaaa

SEQ ID NO: 16640 - RNA, 64 nt, Human
auuaguuuuucuaaauagacccuuaugggaguuugaaaauaaauacucacauauuucacuacuu

SEQ ID NO: 16641 - RNA, 64 nt, Human
uugcucucuagucucugaaaagcaaaaaaagugagaaaauaauuucuucagagauaacuucaag

SEQ ID NO: 16642 - RNA, 64 nt, Human
acaacuaauuauuguugauacuuuucauuacaaggaaaauaaguuauaaauaccaugucaaauu

SEQ ID NO: 16643 - RNA, 64 nt, Human
uuauguuuggaugcagcagcugaauauauccagagaaaauaaacuuaagauuacuggccuuugg

SEQ ID NO: 16644 - RNA, 64 nt, Human
auuggauaaauaugaauaaauauuuucucucagggaaaauaauuuuugaaaguagggugauuga

SEQ ID NO: 16645 - RNA, 64 nt, Human
uugcaccgaaaugucuuguuuuguugcgacauaggaaaauaaccaagcacaaaguuauauucca

SEQ ID NO: 16646 - RNA, 64 nt, Human
gugcgaggcaaugcucuagguccuguaggggcuggaaaauaaaccgcaugcuggccuagccuuc

SEQ ID NO: 16647 - RNA, 64 nt, Human
auauacuaaguuacagaggaugcauccaaguagagaaaauaauauguggguuaagauacauccu

SEQ ID NO: 16648 - RNA, 64 nt, Human
cauuuguuccacccgaccucugacugaugguuuggaaaauaacuuuaauuaggaucauaugacc

SEQ ID NO: 16649 - RNA, 64 nt, Human
uugagaaacaggcugacacuauucucuuugauuagaaaauaaacucauaaaacucauaauguug

SEQ ID NO: 16650 - RNA, 64 nt, Human
uuucauuuuucuaaaggggcagaggccucuuuuagaaaauaauaaaaugcaaugugugugauuu

SEQ ID NO: 16651 - RNA, 64 nt, Human
acauacuggcauauuuaagcugaaugucaaucuggaaaauaaauugacuguauuaacagaaaua

SEQ ID NO: 16652 - RNA, 64 nt, Human
uaauucagguuugaucaaggugugaauaacugaagaaaauaacuugcuggcuauauaggaaaau

SEQ ID NO: 16653 - RNA, 64 nt, Human
uuguauuucaguuuugaagauuuaaaaaaaaugugaaaauaaauauauauuaguauccuuuauu

SEQ ID NO: 16654 - RNA, 64 nt, Human
acauucucucucaauuucagcuucggaacgcuaugaaaauaauacaugauuaaaguuucacaga

SEQ ID NO: 16655 - RNA, 64 nt, Human
uucuccuauuuuuaaauuuauuaugcaaauuuuagaaaauaaaauuugcucuaguuacacaccu

SEQ ID NO: 16656 - RNA, 64 nt, Human
gaaacuuguuuuuuuaacgucagccagauauuuagaaaauaaccucaaaaguguuuauaugguc

SEQ ID NO: 16657 - RNA, 64 nt, Human
uagagagaucccaucucuaaaaaauaaaauauaagaaaauaaaacuuaggggauauacagauuu

SEQ ID NO: 16658 - RNA, 64 nt, Human
ugaguugccuaguagcaauaaaacaagugaauaggaaaauaauuaauauauuauucuauuuagc

SEQ ID NO: 16659 - RNA, 64 nt, Human
ugggauuguaggcaaacccaccuguggcaucacugaaaauaaauuugaucauaccuaagagguu

SEQ ID NO: 16660 - RNA, 64 nt, Human
uugaagggguuccuuuuccauugcucaguuuuuagaaaauaauucucaucuuuuuucuaaagaa

SEQ ID NO: 16661 - RNA, 64 nt, Human
uaagaaaguaauccaaauaagaaacacgauaguugaaaauaauuuuuauaguaaauaauuguuu

SEQ ID NO: 16662 - RNA, 64 nt, Human
gccgaagugucuuccaccugcccugcggaccguggaaaauaaaaggcucugcccccagugugag

SEQ ID NO: 16663 - RNA, 64 nt, Human
ugcugccauaaaagggaggcgggggggaggaagggaaaauaaaggcaucuuuccaaguacucau

SEQ ID NO: 16664 - RNA, 64 nt, Human
ggcagccguggccuaggcccaaacucugcucugagaaaauaaauaucuguaccaccugucauaa

SEQ ID NO: 16665 - RNA, 64 nt, Human
uuagaguuguacuuuuaaaaaaauuaacgggaaagaaaauaacuuugugaagccaguguauucu

SEQ ID NO: 16666 - RNA, 64 nt, Human
acauacuggcauauuuaagcugaaugucaaucuggaaaauaaauugacuguauuaacggaaaua

SEQ ID NO: 16667 - RNA, 64 nt, Human
gaaggaacacauaaguaaguugcuuuggugccaagaaaauaaaaaagcuauuaucaggucuccu

SEQ ID NO: 16668 - RNA, 64 nt, Human
cuuauaguuguagccuuacaacuuacaggcaucagaaaauaaguaaucaaauuagguaccugga

SEQ ID NO: 16669 - RNA, 64 nt, Human
cucucuuacguucauggcuggcuugagaugaguugaaaauaacuucgccaggccaguguguaga

SEQ ID NO: 16670 - RNA, 64 nt, Human
cugguuugcuucuauuacuuuucuuugacauaaagaaaauaacuucugcuagguauuacucucu

SEQ ID NO: 16671 - RNA, 64 nt, Human
aguucuguugagggcaaaauauuauaaaucuauagaaaauaaacuguuugacuugaaucauuuc

SEQ ID NO: 16672 - RNA, 64 nt, Human
cuuguauguggggaagacauuguugucuuuuugugaaaauaaaaauccacaccuggaaguguau

SEQ ID NO: 16673 - RNA, 64 nt, Human
guuauaacaguguuuaauuuagauaaguuugagggaaaauaaucaguaggcaagaggaacauuu

SEQ ID NO: 16674 - RNA, 64 nt, Human
ccucaaucuuagacucuggccucaaaaauuguaagaaaauaaacuucugucuuuuaagccaccc

SEQ ID NO: 16675 - RNA, 64 nt, Human
uguagauuuuacaauaauguuacucuacaaaugggaaaauaaauucuuuaaaauugaauauuga

SEQ ID NO: 16676 - RNA, 64 nt, Human
acauuuugauaccugccauguaacaucuacuccugaaaauaaauguggugccaugcaggggucu

SEQ ID NO: 16677 - RNA, 64 nt, Human
ucucuuuuuggcuugugcugggauuuaagaauuagaaaauaaaaauaagcagaaauuaaaaaaa

SEQ ID NO: 16678 - RNA, 64 nt, Human
uuucuuccaaauguaauuuuaugucugcuuuaaggaaaauaaaauaaaauauuaauaggaguug

SEQ ID NO: 16679 - RNA, 64 nt, Human
aaaaccacacacaccagaaaaacaaaagacagcagaaaauaaccagguauucuuagagcuauag

SEQ ID NO: 16680 - RNA, 64 nt, Human
uuguauuuaauaucaauggacugagucugauucagaaaauaauuguaauguucauauucaauau

SEQ ID NO: 16681 - RNA, 64 nt, Human
uacaucagaaaaugggauaaacauacauuucacagaaaauaaucaagacuugcucugcagccac

SEQ ID NO: 16682 - RNA, 64 nt, Human
ccaguaaccucacugagaauguuuuacagugauggaaaauaaacucuguuccaaguucaacucu

SEQ ID NO: 16683 - RNA, 64 nt, Human
uuguauaucauauuguaaaguaucauacugccaagaaaauaacuccuagaaaggcauuaucuca

SEQ ID NO: 16684 - RNA, 64 nt, Human
cuugaucuugggcuuucagcccccaaaggugugagaaaauaaacuucgguugauaaacugcugu

SEQ ID NO: 16685 - RNA, 64 nt, Human
agggacccugccaaguggcaccugauuuacucuagaaaauaaaaguagaaaauacugaguccag

SEQ ID NO: 16686 - RNA, 64 nt, Human
aaggcgaccgacugcgcugagcugcuuauuuauugaaaauaaacgacggaaaagucuggccuug

SEQ ID NO: 16687 - RNA, 64 nt, Human
cagccuggaugacaagcaagacccucccuccaaagaaaauaaagcucaaaauaaaauaugauuu

SEQ ID NO: 16688 - RNA, 64 nt, Human
aaaacaagcaacaccuuaaaagaguuuuauuucugaaaauaaauuaauuuuuuguaaauaaaau

SEQ ID NO: 16689 - RNA, 64 nt, Human
acuuccuuacaauuucuccugaguuaacuuuugugaaaauaauaccuaagguuuucuggcuuau

SEQ ID NO: 16690 - RNA, 64 nt, Human
auuuuuccaucaccgagagagagagacagagagagaaaauaaacuaccccuccuauucagaagu

SEQ ID NO: 16691 - RNA, 64 nt, Human
ccuccuguccuguccuugccccucaggacugcuggaaaauaaauccuuuaaaauagugucugcu

SEQ ID NO: 16692 - RNA, 64 nt, Human
ccuugguuuuguauuuuauuuacagaguuuuacagaaaauaaaaaagcaaaaugucuuuccuac

SEQ ID NO: 16693 - RNA, 64 nt, Human
ucaaggcuggaccacucaguuauuauugcuauuagaaaauaauauaucauguuuacuuuuguuc

SEQ ID NO: 16694 - RNA, 64 nt, Human
auugacuccacuuuguuguguuguuuucauuguugaaaauaaauauaacuuuguauucgagucu

SEQ ID NO: 16695 - RNA, 64 nt, Human
uuugugugaauugacuaccguuguuugcaaacccgaaaauaaaagacguucauuauguaugaaa

SEQ ID NO: 16696 - RNA, 64 nt, Human
ugccacugucuugugucagaacuuuuacaguacagaaaauaacagaauagccuucuguaaugag

SEQ ID NO: 16697 - RNA, 64 nt, Human
cucaaggacacauugaauacguugugaccauccagaaaauaaaugcugaggggacacagucaca

SEQ ID NO: 16698 - RNA, 62 nt, Human
cccauuuauauaaugguuauaaaauuuacaguuugaaaauaauacauuuguguuucuuuaaa

SEQ ID NO: 16699 - RNA, 64 nt, Human
auaaacaaauuuauaaacauuacuaauuucugaugaaaauaaaguuguuucucccuccacuucc

SEQ ID NO: 16700 - RNA, 64 nt, Human
aaugggaacuaauagggaaauuuauuuauagcaugaaaauaaaccugguggcuggagucugcuu

SEQ ID NO: 16701 - RNA, 64 nt, Human
uguaaagcaguugaaagaauuuauucagcaaccagaaaauaagcugguaaguauaguauguuug

SEQ ID NO: 16702 - RNA, 64 nt, Human
gacuuguauuuaaauuguauguguuuuacucuuugaaaauaaaucuauaaaaccaacauuuucc

SEQ ID NO: 16703 - RNA, 64 nt, Human; identical to SEQ ID NO: 16701

SEQ ID NO: 16704 - RNA, 64 nt, Human
uuuucuggccaguguuuaaaacuucaguuucacagaaaauaaggcacccaucugucugccaacc

SEQ ID NO: 16705 - RNA, 64 nt, Human
gaucacacccuggugaaccccgggugcuaagaaugaaaauaaccuuggugaguuguacaaauua

SEQ ID NO: 16706 - RNA, 64 nt, Human
uacuggugcugaaaggaaggauggauaacgaggagaaaauaaaacugugaggcucaaggcuggu

SEQ ID NO: 16707 - RNA, 64 nt, Human
cagcauaaacgggggugggggggauccugauuuugaaaauaaucuauuuguagcuucucuucua

SEQ ID NO: 16708 - RNA, 64 nt, Human
gugaacaaaguuuaccagaaagcaguugagacaagaaaauaagagcucaggaugagggaaaaga

SEQ ID NO: 16709 - RNA, 64 nt, Human
uuuagaauguuuuuaugaguaaauuuaauguacugaaaauaaaaauuuuaaaaaaggcuguuuu

SEQ ID NO: 16710 - RNA, 64 nt, Human
aacuguccggccccgagucacucagcguuugcgggaaaauaaaccacuggucccagagcagagg

SEQ ID NO: 16711 - RNA, 64 nt, Human
agccacaucacucacagcugaucacugguugguggaaaauaaacuaugagcagcagauuacguu

SEQ ID NO: 16712 - RNA, 64 nt, Human
gcaaaauggggcaguggacugacaggcugacauagaaaauaaacuuugcccaaucacaacuugu

SEQ ID NO: 16713 - RNA, 64 nt, Human
acaaggccguuucuuuguuucugagcauaaagaagaaaauaaaucuuuuacuaagcaugagugu

SEQ ID NO: 16714 - RNA, 64 nt, Human
cuucuccagauuuagcauccugcagagccaccgagaaaauaaaaaagcugggcuuggaggcugc

SEQ ID NO: 16715 - RNA, 64 nt, Human
gcgggagcccugaaaaauuaggggggaaaugggagaaaauaaugugacauuucaaaaacagcac

SEQ ID NO: 16716 - RNA, 64 nt, Human
gagcuggaggacaauauccagggacauggcucuggaaaauaacuuuuuuuuuuuuaagagacag

SEQ ID NO: 16717 - RNA, 64 nt, Human
cacacagacccuacccuuuccccuagcccaguuagaaaauaagucugggccggcggcgguggcu

SEQ ID NO: 16718 - RNA, 64 nt, Human
gaaguaauggaauuauguugguuauuuucuuuaugaaaauaaaccaguucuuccaaggaaguua

SEQ ID NO: 16719 - RNA, 64 nt, Human
gacaggaugcccaguuaaguuugaauuucagauagaaaauaauuuuagaauaaauauguucuau

SEQ ID NO: 16720 - RNA, 64 nt, Human
uuuagccaaagccauaaaaaaccugcaacguagagaaaauaaugcagauacccugacuagccag

SEQ ID NO: 16721 - RNA, 64 nt, Human
ucuggauauauuccuuuugucuucaucacuuucugaaaauaaacauaaaacuguugaaugugcc

SEQ ID NO: 16722 - RNA, 64 nt, Human
uggaguguaaugguggcguagagaaucacaaauggaaaauaauuccauaauuauuuuuuugacc

SEQ ID NO: 16723 - RNA, 64 nt, Human
gaaauauuuucuugcaucaguauuggcuagaaaagaaaauaaauaaaaccaaguuaauuuagua

SEQ ID NO: 16724 - RNA, 64 nt, Human
ugauugaacuuguucauuuuguuuugcuugggaggaaaauaaacaauuuuacuuuuuuccuuua

SEQ ID NO: 16725 - RNA, 64 nt, Human
gcuucagcugcugcuauuaugauguuuugcaaaggaaaauaaucaaaccaaagaguauucagug

SEQ ID NO: 16726 - RNA, 64 nt, Human
uccuguggggaaacaauuucauucucuccaucgugaaaauaagugaauaagagugaagcaaaau

SEQ ID NO: 16727 - RNA, 64 nt, Human
guaggcuggacacaagcacaggcuguagcauggugaaaauaagccaagcagugcagaaugccuc

SEQ ID NO: 16728 - RNA, 64 nt, Human
uuuaagaauuaaaaaaauacaaaaaagaaaaaaugaaaauaaaggaauaagaaguuaccuacuc

SEQ ID NO: 16729 - RNA, 64 nt, Human
agccaacagaguaaaguggaaggaaguuuauucagaaaauaaaggaguaucacagcucuuuuag

SEQ ID NO: 16730 - RNA, 64 nt, Human
uuucugguugaaaucaagguuaggaugcaacugagaaaauaaaagacugcacuuuggagaggca

SEQ ID NO: 16731 - RNA, 64 nt, Human
aaucuuagaaguuauaaggaaacucucacuagaggaaaauaaugaacaaaugaaaguguucauc

SEQ ID NO: 16732 - RNA, 64 nt, Human
aaccuggcuuucucacagcuggacauaauucuaggaaaauaaaauacuaugucgccacuugguc

SEQ ID NO: 16733 - RNA, 64 nt, Human
auauuuuauuacuagagcaagauggguuuuuaaggaaaauaaugugaaauucuggaaauuuucu

SEQ ID NO: 16734 - RNA, 64 nt, Human
guauuuuauguauguuuacacugucaaacaucuggaaaauaaaaggucuaugcucauaacugug

SEQ ID NO: 16735 - RNA, 64 nt, Human
ucugaagcaugcacaccucugaagaccccugcaugaaaauaaccuccaaggacccucugacccc

SEQ ID NO: 16736 - RNA, 64 nt, Human
acuucugucuugauggucuauggaaauagaccuugaaaauaaggugucuacaagguguuuugug

SEQ ID NO: 16737 - RNA, 64 nt, Human
ugguuauugguuuuuuuguauagaccaaagcaaagaaaauaaaaauaacacagaugcguuggag

SEQ ID NO: 16738 - RNA, 62 nt, Human
uucagaugaugaagaaagaggaacgggcuuggaagaaaauaaucaagaagagcaaagcaugg

SEQ ID NO: 16739 - RNA, 64 nt, Human
uacagaugcaaacagcuauaauuuugcaaaaaaggaaaauaacucuccugaacaucuaaaagau

SEQ ID NO: 16740 - RNA, 64 nt, Human
cagccuaccugaccaucucuuuagcugucaccaagaaaauaaaccccacugucucucuagcuug

SEQ ID NO: 16741 - RNA, 63 nt, Human
aaaagaaaaagaacaaaaaauauauaucacucuagaaaauaaaucucuccugugucuuauucu

SEQ ID NO: 16742 - RNA, 64 nt, Human
gaaacaaaagucucauucauaagaggucuuagaagaaaauaaccaguuaaccugauuucaauuu

SEQ ID NO: 16743 - RNA, 64 nt, Human
aauuaaggauucucaggucccuguguagagcagugaaaauaagaugugcguauguguguguaug

SEQ ID NO: 16744 - RNA, 64 nt, Human
acacaggagcuacaccuugauccucuccuggcaugaaaauaaaacaaagguuuucguuguuguu

SEQ ID NO: 16745 - RNA, 64 nt, Human
gaauuucuucacccaacuuaaauguucuugagaugaaaauaaaaccuauucccauguucuaugg

SEQ ID NO: 16746 - RNA, 64 nt, Human
uguauuauucucuguaguaagauuaguaauaagugaaaauaaaugauuuaaauucauuuugucu

SEQ ID NO: 16747 - RNA, 64 nt, Human
guaguaaccccugcccagguauuuuuucacuugugaaaauaauuugagaaagaccuuuguuccu

SEQ ID NO: 16748 - RNA, 64 nt, Human
acuaugauuuauuggguuucuuaaaaaucuugaagaaaauaauaaaauuuaucucacaauaagu

SEQ ID NO: 16749 - RNA, 64 nt, Human
aguaaucuucauuuuaguauuuaugcuuagaugugaaaauaaauguuauuuguugaucauuucu

SEQ ID NO: 16750 - RNA, 64 nt, Human
ucacccauuccuagugcucuugguauacacuugggaaaauaauguccuccaggagaaaguguua

SEQ ID NO: 16751 - RNA, 64 nt, Human
gggagauuauaaucaguuuguuuucaagauaauagaaaauaagguccaugagaauagaaguuau

SEQ ID NO: 16752 - RNA, 64 nt, Human
gagcuucuaagggcaucuuaacaggaugcuacaugaaaauaaggaaagaaauuaauacauauca

SEQ ID NO: 16753 - RNA, 64 nt, Human
augugcuuaauuccuacagugaguuuauauuuuugaaaauaaaagcuaguaaauauucuuucug

SEQ ID NO: 16754 - RNA, 64 nt, Human
caucaagcacuccuaccuuaauuauugcacuagagaaaauaaauuccaaauuaggaaguguuuc

SEQ ID NO: 16755 - RNA, 64 nt, Human
aauaaaaguaauucagucauuuuaguuuuugauugaaaauaaagguagggcuucuaaaaacuuc

SEQ ID NO: 16756 - RNA, 64 nt, Human
gagucaacaacauacugccacuaugaaguaauaagaaaauaaaaaguuaaaaaauguaacagau

SEQ ID NO: 16757 - RNA, 64 nt, Human
uccccccuuuuuuuaauuaaaagaagucacuuaggaaaauaacaucacagagaaaagaauuucu

SEQ ID NO: 16758 - RNA, 64 nt, Human
uuuguuuauuuuaaagcaagaauggaagacccuugaaaauaaagaaguaauuauugacacauuu

SEQ ID NO: 16759 - RNA, 64 nt, Human
ccuguugggcguuacuagaaacuauggaaaacuggaaaauaacuuugaaaaaauuggauaaagu

SEQ ID NO: 16760 - RNA, 64 nt, Human
acauauaugcagugcuuguuguccaaauagaaaugaaaauaaguggaagagagaggaagaaguc

SEQ ID NO: 16761 - RNA, 64 nt, Human
uuuguuuuguuuuguuuuguuuuguuuuugucuugaaaauaauagacauuuguagaauauggag

SEQ ID NO: 16762 - RNA, 64 nt, Human
gaacauuuacguuguuaccaagauuuuugcuauugaaaauaaaguuuuuaugaauauuuauaua

SEQ ID NO: 16763 - RNA, 64 nt, Human
caagggcuggcaccuagacauuaaacuguaauuugaaaauaagcaacauguugcauaacuuguu

SEQ ID NO: 16764 - RNA, 64 nt, Human
gcuuucuccucccuauuauuuucuggcuugaggggaaaauaaugucaggucuuucacucauaua

SEQ ID NO: 16765 - RNA, 64 nt, Human
uaaaaaguggaaugggauauggcuuuugguaccugaaaauaaaugcuuuaauaauuguaagcca

SEQ ID NO: 16766 - RNA, 64 nt, Human
cauccucucuauaauuuggagucaucuuacuaaugaaaauaauguuuucccauauauuauuaaa

SEQ ID NO: 16767 - RNA, 64 nt, Human
uauuuccuuuuaccuaauuugaauaugcauuugagaaaauaagaggauaaaggauggcuaagag

SEQ ID NO: 16768 - RNA, 64 nt, Human
uggcugaccuugcacuugucaaaaauguaaagcugaaaauaaaaccaggguuucuauuuaucug

SEQ ID NO: 16769 - RNA, 64 nt, Human
aacauuucuucuuguuugcaucuuaguagaaauggaaaauaaccacuccuggucgucuuuucau

SEQ ID NO: 16770 - RNA, 64 nt, Human
ugucuucauuccaauggggucaggucaauauuaugaaaauaauuuuuauauuuauauuuguaac

SEQ ID NO: 16771 - RNA, 64 nt, Human
ggacucaggcuggcagaggggcuggugcccuggagaaaauaaagagaaggcuggagagaagccg

SEQ ID NO: 16772 - RNA, 64 nt, Human
cucugucucgcgggccgggaaacugcucugaugggaaaauaaacagcccaaaaccaagugggug

SEQ ID NO: 16773 - RNA, 64 nt, Human
gcucaggcuggugugggaugcagccggccgaugagaaaauaaagccauauugaaugaucgccac

SEQ ID NO: 16774 - RNA, 64 nt, Human
ccagaaucguaucccaaagcccucccauggccuagaaaauaaauaaguuauuguuugucuuagu

SEQ ID NO: 16775 - RNA, 64 nt, Human
guuagugcccccaaacgucacuguugcugagguugaaaauaaucaugcagucauuccucaauua

SEQ ID NO: 16776 - RNA, 64 nt, Human
uugguuuguaaauuauucuacggaggcaaaaagggaaaauaaaaacuugcccuucccuggcuga

SEQ ID NO: 16777 - RNA, 64 nt, Human
cuuaugcuggguguuggagcagagugagggagaggaaaauaaagaccugcacaucugaccccaa

SEQ ID NO: 16778 - RNA, 64 nt, Human
ccugaccgugcugaacagacccccccacacgagagaaaauaaaggagcaauaaagucacgagaa

SEQ ID NO: 16779 - RNA, 64 nt, Human
gucuaccuggcguuuuguuagaaaugucagauaggaaaauaaaaaccauuugaguaaaaaagcc

SEQ ID NO: 16780 - RNA, 64 nt, Human
aucagucuuaaauuuuuaaaaauauguaauuuuagaaaauaauuuaaaagguuuuguuucaguu

SEQ ID NO: 16781 - RNA, 64 nt, Human
cgcugccuguguucuccgagggccuucauuuaaagaaaauaaggguguuuuggguuuuucucuu

SEQ ID NO: 16782 - RNA, 64 nt, Human
ucgaauauucuacuaaaugagaguucugaguauagaaaauaaaacuaaaguugguagaaaaauu

SEQ ID NO: 16783 - RNA, 64 nt, Human
uuagacauuacacuaaaucagagugcugaguauagaaaauaauacaaacagauuugucuaaaca

SEQ ID NO: 16784 - RNA, 64 nt, Human
aaauuuccuuggcuuuaguuuuauaucauauuuagaaaauaauaaugaaaagcauccccaaaau

SEQ ID NO: 16785 - RNA, 64 nt, Human
cuugauaguggucaccugugaagaguggagaagggaaaauaaugagugugggaggugggauggg

SEQ ID NO: 16786 - RNA, 64 nt, Human
aaauugcugggaauauuugacucuccguauuggagaaaauaaaauuacaacauuacgacauacu

SEQ ID NO: 16787 - RNA, 64 nt, Human
uuaguucucauuaaauuuaggaaaauucacacuagaaaauaaagcuguuaauguaacaguugug

SEQ ID NO: 16788 - RNA, 64 nt, Human
agcuucaugaaacuguccaccaagaucaagcagagaaaauaauuaauuucaugggacuaaauga

SEQ ID NO: 16789 - RNA, 64 nt, Human
agccugggcgacagagugagacucccucucaaaagaaaauaaaaauaaaaauaaacuggccagg

SEQ ID NO: 16790 - RNA, 64 nt, Human
ugagaaaauuaaaaauucauuguuccagcaguuugaaaauaaauuguugucgaugauagucacc

SEQ ID NO: 16791 - RNA, 64 nt, Human
aaugggaaugcaaagcuugagcugcucugcaagagaaaauaagcaggacagaggauuugcucug

SEQ ID NO: 16792 - RNA, 64 nt, Human
agcuuaaaaaaaaaguauacaugacuuuaaugaggaaaauaaaaaugaauauugaaauguugug

SEQ ID NO: 16793 - RNA, 64 nt, Human
ucacuuuuucuacuauccuugcuaaguuuucauagaaaauaaggaacaaagagaaacuuguaau

SEQ ID NO: 16794 - RNA, 64 nt, Human
uccuaugcccagcugcacagcuuacccucaaacagaaaauaaugaagccuucuuccucccagga

SEQ ID NO: 16795 - RNA, 64 nt, Human
agcuaaaguaaguuaaaagauuaugauaaacucagaaaauaaacacagagaaggaaucucauuu

SEQ ID NO: 16796 - RNA, 64 nt, Human
gccucaagaugguuuucaaaaaaauuuuuuuaaagaaaauaauuguauacgugucaacacagcu

SEQ ID NO: 16797 - RNA, 64 nt, Human
gcaaauugugccuaagcgaaauauuuuuuuuaaggaaaauaaaaacauuaguuacaagauuuuu

SEQ ID NO: 16798 - RNA, 64 nt, Human
ccgaaugucagcaccuucccccuacccgaguugugaaaauaaaaaauguuuccagacauugcca

SEQ ID NO: 16799 - RNA, 64 nt, Human
auuuuguugauaaguaacccuguaauuuuccaaggaaaauaaagaacagacuaacuagugucuu

SEQ ID NO: 16800 - RNA, 64 nt, Human
uggaauuguuuaauuauuuguacuuuucaugccagaaaauaaaaguucagaaucuuaaggccuu

SEQ ID NO: 16801 - RNA, 64 nt, Human
ucagguauuuuacuaaaucagagugcugaguauagaaaauaaucuaaaacuaaaauugguaaaa

SEQ ID NO: 16802 - RNA, 64 nt, Human
accuugcuuauuaaaugagcgacuuaaaaugauugaaaauaaugcuguucuuuaguagcaacua

SEQ ID NO: 16803 - RNA, 64 nt, Human
auguacucuuggcacauuucaauaaaauuguuuggaaaauaaacacagcacuugcugggauucc

SEQ ID NO: 16804 - RNA, 64 nt, Human
ucccaucacaagcccggggagggaucccgccuuugaaaauaaagcuguuaugggugucauucag

SEQ ID NO: 16805 - RNA, 64 nt, Human
cucucaagauuuuuuuugucagaggcuccaaauagaaaauaagaaaagguuuucuucauucaug

SEQ ID NO: 16806 - RNA, 64 nt, Human
aaguagagaugcccauagagggaaaaauuauguggaaaauaaaaacuguaguauaccuguuaug

SEQ ID NO: 16807 - RNA, 64 nt, Human
aauguuaaacuugauucuuaugacauauuccuaugaaaauaauaaauacuggcacuuuuccuug

SEQ ID NO: 16808 - RNA, 64 nt, Human
ggccagauaaauuaagucaaacauuugguuuccagaaaauaaagacaaauagagaagguuagau

SEQ ID NO: 16809 - RNA, 64 nt, Human
uuucuugguuggaagcugcagcuggcccaagaaagaaaauaaaaaacaacacuuuugcaugagu

SEQ ID NO: 16810 - RNA, 63 nt, Human
gccggacuggccgggccugagacccaugcccaggaaaauaacagagcuggaugcugagagacc

SEQ ID NO: 16811 - RNA, 64 nt, Human
augcucuugaaauguuaaaaucacaucagcacuggaaaauaacuccuaaauguccaaaaagaac

SEQ ID NO: 16812 - RNA, 64 nt, Human
aauaugaccucagugagugucaaaguuuacacuggaaaauaacuuuaaggugacaguauugaug

SEQ ID NO: 16813 - RNA, 64 nt, Human
ucaaagcauuauggcugucacaagcuugugaaaggaaaauaaaaauuacuaagccaaagagaaa

SEQ ID NO: 16814 - RNA, 64 nt, Human
ccuagauccagaguucagaagaccuugagacaaugaaaauaaacuugguaauaaucuuuuuuca

SEQ ID NO: 16815 - RNA, 64 nt, Human
cacucgcuucccccauagccaccccagaaauggugaaaauaaaauaaagcagguuuuucuccuc

SEQ ID NO: 16816 - RNA, 64 nt, Human
guauuaaacacuucagaauaucaauguaaaauuggaaaauaaggaacugggggcauuuguuuag

SEQ ID NO: 16817 - RNA, 64 nt, Human
agacaguuauuuauagucauuuauuuuaaaaaaugaaaauaagugaauaauaauuagguuaaca

SEQ ID NO: 16818 - RNA, 64 nt, Human
uugcuuguagaaacaauuuugaaagccccuugaggaaaauaaaaaucaagaagaacacuuuucu

SEQ ID NO: 16819 - RNA, 64 nt, Human
uaauacauuguaauacuguaugauaaucaugugugaaaauaauuuuugaaauauccuuuggcug

SEQ ID NO: 16820 - RNA, 64 nt, Human
acacagcuuagcuugguuuugcuuauucaaaagagaaaauaacuacacauggaaaugaaacuag

SEQ ID NO: 16821 - RNA, 64 nt, Human
acccucuccccacuuuuuuuaaaaauuuuaaccagaaaauaaagauaguuaaauccuaagauag

SEQ ID NO: 16822 - RNA, 64 nt, Human
uuuauuuuguucggagucucuucauaaaacauuugaaaauaaaagaucauucuucacccauaug

SEQ ID NO: 16823 - RNA, 64 nt, Human
gaucaaugaaccaucucuucugggcaguuuuguugaaaauaaagguuucucuuugauuucaaga

SEQ ID NO: 16824 - RNA, 64 nt, Human
ucagagcuccaugcacacagugucuucagaaggugaaaauaaauauuucccugugcuccuuuua

SEQ ID NO: 16825 - RNA, 64 nt, Human
cuugaauacaaaugcacucccaaagugguuuuaagaaaauaaaaagauuauccuuccucuuugu

SEQ ID NO: 16826 - RNA, 64 nt, Human
ggacuaaggaauucugcagcuugcagauguuuaagaaaauaauggccagauuuuuuggguccuu

SEQ ID NO: 16827 - RNA, 64 nt, Human
augaagaaggaucuuaggcauucuuaaaauucaagaaaauaaaacuaagcucuuugagaacugc

SEQ ID NO: 16828 - RNA, 64 nt, Human
ugaagucuguuaaagccauugucagcaaagcuuugaaaauaaaggacuucacaaaaacgguaau

SEQ ID NO: 16829 - RNA, 64 nt, Human
auagccuuuggcucacccagagucagggagagaugaaaauaauaggucagaaugcaagugacuu

SEQ ID NO: 16830 - RNA, 64 nt, Human
gcuacuucguaauguuguuacuaaauuuuaucuugaaaauaaauaacaguguuugaggacagaa

SEQ ID NO: 16831 - RNA, 64 nt, Human
uguccaguuauauuguuuuuuagaacaacacuuggaaaauaauuugcagugauuauauuucuga

SEQ ID NO: 16832 - RNA, 64 nt, Human
uugauguugaacuucccagccuccagaacucugggaaaauaaaguccucuuuauacauuuccua

SEQ ID NO: 16833 - RNA, 64 nt, Human
cucugacaggccacugcaucucagauucaggggagaaaauaaguugucaccuccccuucaaagu

SEQ ID NO: 16834 - RNA, 64 nt, Human
cccucacugaguuuuaaauuuuaguggagagauggaaaauaauuaaacaaauaaacaauguuau

SEQ ID NO: 16835 - RNA, 64 nt, Human
aucuucucuaagccaagcaauuauuuuauggagggaaaauaaggccagaaacuucugagcagau

SEQ ID NO: 16836 - RNA, 64 nt, Human
guuuuuguucuuuugaagaauagagugguauuuagaaaauaaauugcauugcaaagcucuuauc

SEQ ID NO: 16837 - RNA, 64 nt, Human
uggggguacaagagcaggaguggggcaagaguuugaaaauaaagccgcuuccuugugaacuaac

SEQ ID NO: 16838 - RNA, 64 nt, Human
cuguuggaaugaguaugugauucuuuuuaaguaugaaaauaaagauauauguacagacuuguau

SEQ ID NO: 16839 - RNA, 64 nt, Human
aacugaguaggaaaugaaauacuagauuagacuagaaaauaaggaauaaaucgauuuuacuuug

SEQ ID NO: 16840 - RNA, 64 nt, Human
aguuccagguagugguuuugccuuucccaaaaaugaaaauaaacuguuaccgaaggaauuaguu

SEQ ID NO: 16841 - RNA, 64 nt, Human
uuaauuauuugaugggccugccaugugaaaaccagaaaauaaccucguacucacaagccagugg

SEQ ID NO: 16842 - RNA, 64 nt, Human
uuuuuuucuucuauuaaaauauaacauugugaaagaaaauaaaauuuaugcuauucuuugcuuu

SEQ ID NO: 16843 - RNA, 64 nt, Human
aaaaaagaaaauagagcuuuauaagcagagagaagaaaauaaucaucuaagaccaucucuccau

SEQ ID NO: 16844 - RNA, 64 nt, Human
ugcuuacugcuuauauuugcucagggaagaguaggaaaauaaaauauaugcaaaucaagaggaa

SEQ ID NO: 16845 - RNA, 64 nt, Human
uucauuacugcauccccaguaaugaaaguacuuagaaaauaauuauugaaugaaugaaaucuaa

SEQ ID NO: 16846 - RNA, 64 nt, Human
gcaagugaaugucauuuuaaucaauaucaaugaugaaaauaaagccaaauuugaaguaaagugu

SEQ ID NO: 16847 - RNA, 64 nt, Human
ccucugaugcaggagaggaaaaauuguaauugaugaaaauaaugaaugaaaaucaacagaugaa

SEQ ID NO: 16848 - RNA, 64 nt, Human
ucugauucugcauuucuuccucaauuuauguaaugaaaauaaaauuaauauaucaucuaacagu

SEQ ID NO: 16849 - RNA, 64 nt, Human
uguauaaauuccuguccugaaauauuuuauucaugaaaauaagguaagcaaaaaccaacuccau

SEQ ID NO: 16850 - RNA, 64 nt, Human
uaaaauugccaaguggacuuggaaguccagaaaggaaaauaauuuaaauuaaugcuggugaucu

SEQ ID NO: 16851 - RNA, 64 nt, Human
agcaggacuggccgccccugcugugggggguucagaaaauaaaaugccgcgcagcccuugccag

SEQ ID NO: 16852 - RNA, 64 nt, Human
aaauaucuguggaacauguaaauacugucaaauggaaaauaaaauaaguuauaauuuuugugaa

SEQ ID NO: 16853 - RNA, 64 nt, Human
cauagacuuuuaaacuucaaccaauguguuuacugaaaauaacaaauguuguaaauucccugag

SEQ ID NO: 16854 - RNA, 64 nt, Human
uuucuuggaaaaaauuuuaagaaucaaaaauaaagaaaauaaaaaaugcauacaguuaaacauu

SEQ ID NO: 16855 - RNA, 64 nt, Human
acuuaagaaauuugagcagaauuuaaaaaagaaagaaaauaaauuguuuuucccaaaguauguc

SEQ ID NO: 16856 - RNA, 64 nt, Human
uguauuuaugcccuuauaucccaaaaaugucuuagaaaauaaaaauucugggccuuacuuguuu

SEQ ID NO: 16857 - RNA, 64 nt, Human
auuaaucaauggauauccuucaguagugaaugcagaaaauaaaaauacacagguaauuuaguau

SEQ ID NO: 16858 - RNA, 64 nt, Human
uuaccuguuagcagguucuuguuucauaaagguagaaaauaaauacagacaacaucuacugagc

SEQ ID NO: 16859 - RNA, 64 nt, Human
cucaaguuaugaaauaaaacugagagauaauggagaaaauaauuuuuauggguuuuuuugguua

SEQ ID NO: 16860 - RNA, 64 nt, Human
uaguccaaauauaagaaacugucauguuuugugggaaaauaauuuuauaauccauuuaaaguga

SEQ ID NO: 16861 - RNA, 64 nt, Human
acuuccuauucuuucuuaaauuugauggagaagggaaaauaaauugcaguuauugauucuugcc

SEQ ID NO: 16862 - RNA, 64 nt, Human
cauuaagaaauaauuuuagauuugugcucuagcagaaaauaacucuguacccaucaaucuuauu

SEQ ID NO: 16863 - RNA, 64 nt, Human
aaccuguagcugacuuuagccacccacaaguacagaaaauaauccagucccucauagcacuggu

SEQ ID NO: 16864 - RNA, 64 nt, Human
uaauggugggguuuucugcuuuguuuuuauuuaagaaaauaaacacgacauauuuaaagaaggu

SEQ ID NO: 16865 - RNA, 64 nt, Human
ggauuggaugaaagucaaagguugucuacuuuaagaaaauaaaauacccugaauggagcccagc

SEQ ID NO: 16866 - RNA, 64 nt, Human
gguuuuuuguucuguuuuguuuuguuuucuuugagaaaauaaggacuuuguguucauuugaagu

SEQ ID NO: 16867 - RNA, 64 nt, Human
acuccagucugagcaacagaucgagacccugccugaaaauaaaucaauaaauaaacucaaccga

SEQ ID NO: 16868 - RNA, 64 nt, Human
cggaauacaauguccuuccauagcaugggaagaagaaaauaaacaucuccuuuccaacagcugu

SEQ ID NO: 16869 - RNA, 64 nt, Human
ugaaagaaacuugcuucccuuagccuuuguucuagaaaauaaacuugugcacuuugaccucugu

SEQ ID NO: 16870 - RNA, 64 nt, Human
cccaccuagccuuucccugcugcccaacuggauggaaaauaaaagguucuuguauucucacugc

SEQ ID NO: 16871 - RNA, 64 nt, Human; identical to SEQ ID NO: 16870

SEQ ID NO: 16872 - RNA, 64 nt, Human
uucucuuuuuaaaaauaaaaccagacucuguucugaaaauaaaaaacuugagacuugugacaag

SEQ ID NO: 16873 - RNA, 64 nt, Human
aagaaagcccuaagugaggacuguuggcugauuggaaaauaauaaaagaaucauuugcaacauc

SEQ ID NO: 16874 - RNA, 64 nt, Human
uuauucuugauggcaucugucagauauuagaauugaaaauaagaaucuucccaaaauccuuuaa

SEQ ID NO: 16875 - RNA, 64 nt, Human
ugcuaauaugaacagaaaugcauuuguaauucaugaaaauaaauguacaucuucuaucuucaca

SEQ ID NO: 16876 - RNA, 64 nt, Human
uaaucccuguguagacuguuguaaagaaacuguugaaaauaaagagaagcaaugugaagcaccu

SEQ ID NO: 16877 - RNA, 64 nt, Human
cuuuaugccacaccuaccacgggauaauaaaagggaaaauaauuugagugcgccugggauuucu

SEQ ID NO: 16878 - RNA, 64 nt, Human
gcaaauagaaaacccaacucaaccugcuuaagcagaaaauaaauuuauugauucaaguuuggag

SEQ ID NO: 16879 - RNA, 64 nt, Human
ucccuuuauaaacuugguguaggccguauauuuugaaaauaaacaucugguugagguuauuuca

SEQ ID NO: 16880 - RNA, 64 nt, Human
acugcggacaauuaguauucaaaguuuauuuucagaaaauaaaauaauaaaagcccaggguauu

SEQ ID NO: 16881 - RNA, 64 nt, Human
gagauaucugcacauaaaauuauuauuaccugaagaaaauaaggcugcauuuugaaauguuaag

SEQ ID NO: 16882 - RNA, 64 nt, Human
augcagcacguggaggggaacacauacaugucuugaaaauaaacugcuagaauaaagaaaugcu

SEQ ID NO: 16883 - RNA, 64 nt, Human
gcagguaaagguuuauacaacaagaaagcacauugaaaauaauuugauacucuaacaauccauu

SEQ ID NO: 16884 - RNA, 64 nt, Human
ggaaauaaggagaaaagagaaugggagagugagagaaaauaaaaaaggcaaaagggagagagag

SEQ ID NO: 16885 - RNA, 64 nt, Human
auuucgccagcuuguacguagcuugccacucagugaaaauaauaacauuauuaugagaaagugg

SEQ ID NO: 16886 - RNA, 64 nt, Human
ugaaauuuaauucuauuuugauaaaacuaagacugaaaauaaccacuuguaaacauuccuauga

SEQ ID NO: 16887 - RNA, 64 nt, Human
gcagaaaccaacaagaaccacuccuucauguuuggaaaauaauuucucuuguauuaucuccuuu

SEQ ID NO: 16888 - RNA, 64 nt, Human
uagauuggcaaugcaguuacauuguuucuucuuugaaaauaaaguucuagacauauaaaacagg

SEQ ID NO: 16889 - RNA, 64 nt, Human
uaacauuuuacuuuuaauuauguaaauuugguuagaaaauaauaauaaaugguuagugcuauug

SEQ ID NO: 16890 - RNA, 64 nt, Human
ugaauacccagagccacuaaaucuuuuuuuacuagaaaauaauugggguccauaugaaagucuc

SEQ ID NO: 16891 - RNA, 64 nt, Human
acuuaucuuacaaaguguauuuuauaaaauuaaagaaaauaaaauuaagaauguucucaaucaa

SEQ ID NO: 16892 - RNA, 64 nt, Human
uucugcuucuaaaaucugaggacagugcuagugggaaaauaauuuucaaacuaccugguuaacc

SEQ ID NO: 16893 - RNA, 64 nt, Human
guauuuaugugugugaauaacaucuuggcaugcagaaaauaauuuuggcugcuuugaacaggau

SEQ ID NO: 16894 - RNA, 64 nt, Human
auaguuccucauucauuuuuauauugaccacuaagaaaauaauucaucagcauuaucucauaga

SEQ ID NO: 16895 - RNA, 64 nt, Human
ucugccuuuuuaacuugcuuugcaagccuacucugaaaauaaguuauuuagucaaguuauucuc

SEQ ID NO: 16896 - RNA, 64 nt, Human
cugaauagaauuugaagcagucugaauguucuuugaaaauaacuggaguuauuagcauacccua

SEQ ID NO: 16897 - RNA, 64 nt, Human
ccacuuuuaaaaaugacacauauuuaaacacuuagaaaauaaaguuaacacuuacugaagugcu

SEQ ID NO: 16898 - RNA, 64 nt, Human
aaaaaaaggguagcaguuuauucaucugugaaaggaaaauaauacuuaucuuacaagguugcaa

SEQ ID NO: 16899 - RNA, 64 nt, Human
gacgagaaaacaauaacgauaaaagacagugaaagaaaauaacgauaaaagacagugaaagaaa

SEQ ID NO: 16900 - RNA, 64 nt, Human
cagugaaagaaaauaacgauaaaagacagugaaagaaaauaacaauaaaagacaaggaaaaaau

SEQ ID NO: 16901 - RNA, 64 nt, Human
aaggauauuuaagugagcauuuucuaguucauaugaaaauaaccauaguacaggaugauuucug

SEQ ID NO: 16902 - RNA, 64 nt, Human
uaggugaagcauacuccaguguuuuagggguuuugaaaauaaauauuuaaauuucacaguccuc

SEQ ID NO: 16903 - RNA, 64 nt, Human
uagcaagaagcuacaucccucaaacuucggcaaugaaaauaaaguuugagaagcugauggcugu

SEQ ID NO: 16904 - RNA, 64 nt, Human
uagcaagaagcuacaucucucaaccuugggcaaugaaaauaaaguuugagaagcugauggcugu

SEQ ID NO: 16905 - RNA, 64 nt, Human
uguuguagcaacaucauaaaaucaagaguaucaagaaaauaaaugagcauagcaaugcuacucu

SEQ ID NO: 16906 - RNA, 64 nt, Human
auuuuacaccccaaagagugugccccauggugaugaaaauaaagugaacauguugcaaaaugau

SEQ ID NO: 16907 - RNA, 64 nt, Human
agugucuaaagguagaugcaaauuaaaaugcagggaaaauaacuuuucugauguugaugcaugu

SEQ ID NO: 16908 - RNA, 64 nt, Human
cacuguccugguuccaucucugcuauaugggaaugaaaauaaagaaacauauuucuuggcuugu

SEQ ID NO: 16909 - RNA, 64 nt, Human
uuuaaacauuuguaauaguucuauaaagacuauggaaaauaaccuugcuuuugggggguuuuug

SEQ ID NO: 16910 - RNA, 64 nt, Human
accaucugauguuucauauuuaaguguauuuaaagaaaauaaacaccauuauucaagccauaua

SEQ ID NO: 16911 - RNA, 64 nt, Human
auguaaagaaaucagauacaaacuacugcaauuagaaaauaaaauaugaacaacuuucaacaau

SEQ ID NO: 16912 - RNA, 64 nt, Human
gauuccuauaauacagugcuauaagcuaugcacagaaaauaaaauguuugaaauccaagaauaa

SEQ ID NO: 16913 - RNA, 64 nt, Human
ggacuugcaucagcugccuccagaacaauuuuaagaaaauaacaaagauguuuagaagaaaucu

SEQ ID NO: 16914 - RNA, 64 nt, Human
accuugacuuggauuuugacaggagggagccugggaaaauaauuuuuuccuccaagauucucag

SEQ ID NO: 16915 - RNA, 64 nt, Human
aacaagcaauccucugucaaaaucugagguauuugaaaauaauuauccucuuaaccuucucuuc

SEQ ID NO: 16916 - RNA, 64 nt, Human
uauaucacaaaaauggcaacaucuuuuacauaaagaaaauaaguuuguaagugauauuucuuaa

SEQ ID NO: 16917 - RNA, 64 nt, Human
uauguuugcuuguauuuuuuaaugcuaaucuugugaaaauaauugacaggcgaaagaaaacucu

SEQ ID NO: 16918 - RNA, 64 nt, Human
agaaaaaccaguacccuugagccuuaaucagcaagaaaauaacucuggcucauacaguguagaa

SEQ ID NO: 16919 - RNA, 64 nt, Human
auguuucaguuuguuuuccguucuguuuuaaacagaaaauaaaaggaguguaagcuccuuuucu

SEQ ID NO: 16920 - RNA, 64 nt, Human
uuucuuuuagaauaugggaguaagaugagcuagagaaaauaaccuggucucacugugguugccc

SEQ ID NO: 16921 - RNA, 64 nt, Human
gcugcaucaagacccauuuggcaagagguuguccgaaaauaauuccuugaucauaucugaagug

SEQ ID NO: 16922 - RNA, 64 nt, Human
aauaacaacugauggugaaucuuaccgagcuguagaaaauaaaaaauuccucuccaaacauggg

SEQ ID NO: 16923 - RNA, 64 nt, Human
uuuacugaagaaauuguacuucauccacauccaugaaaauaaaaugcucuccuuuugugcacag

SEQ ID NO: 16924 - RNA, 64 nt, Human
uagucucauuuuuuacucuuugucaagagaaauggaaaauaagaguacuugggcccucuuaagg

SEQ ID NO: 16925 - RNA, 64 nt, Human
uuuccaaucacuuaguagccccucaaaguaguuagaaaauaaacagauuuuuccaguguugauu

SEQ ID NO: 16926 - RNA, 64 nt, Human
aaaccccacuuauggguguaagccuacuagacuugaaaauaaaguauaaaacauuuccaaucac

SEQ ID NO: 16927 - RNA, 64 nt, Human; identical to SEQ ID NO: 16904

SEQ ID NO: 16928 - RNA, 64 nt, Human
uguuuuaucugguucuuaaauguuuguuacuacagaaaauaaaacugcgcuacuauuccaaguc

SEQ ID NO: 16929 - RNA, 64 nt, Human
cuggaggaggacggcuuacauguuuguuucuguagaaaauaaaacugagcuacgauuccguguc

SEQ ID NO: 16930 - RNA, 64 nt, Human
cuggaggaggacggcuuacauguuuguuucuguagaaaauaaagcugagcuacgauuccguguc

SEQ ID NO: 16931 - RNA, 64 nt, Human
ucaguuuacucucucccucuacuaauuuccugcugaaaauaacacaacaaaaauguaacagggg

SEQ ID NO: 16932 - RNA, 64 nt, Human
ucaguaccauugucacugcaauaaguggguuuuagaaaauaagugugaaaagaaucagguguua

SEQ ID NO: 16933 - RNA, 64 nt, Human
gucaacugaaucuuuuauucauagaaaugaaaaggaaaauaaaaacuguggcugaccaaaaggu

SEQ ID NO: 16934 - RNA, 64 nt, Human; identical to SEQ ID NO: 16889

SEQ ID NO: 16935 - RNA, 60 nt, Human
gagacucgagcagauauuaaagcaagcauugaaaauaauaguuauugcauaccaauccuu

SEQ ID NO: 16936 - RNA, 64 nt, Human
uggcuugagaaauauggacacuuaauacuaccuugaaaauaagaauagaaauaaaggaugugau

SEQ ID NO: 16937 - RNA, 64 nt, Human
gguacucggggaccuccaaagacuaaacugacaagccuucaaggagcccagggguaaguuaacu

SEQ ID NO: 16938 - RNA, 64 nt, Human
cuuagggcagaguuagcucuuuuguucuauucaggccuucaacugauucagcaaggcccgccca

SEQ ID NO: 16939 - RNA, 64 nt, Human
agcaccuagaguagugcuuggugcaugauaguaggccuucaauaaauuuuuucuaaaugaauga

SEQ ID NO: 16940 - RNA, 64 nt, Human
ugagauuucccugaauaauauauuuaucuuaagagccuucaaguuucaaauuaauauuggaaca

SEQ ID NO: 16941 - RNA, 64 nt, Human
ugcacagcucuagauggcuccuagauuauugagagccuucaaaacaaaucaaccuaguucuaua

SEQ ID NO: 16942 - RNA, 64 nt, Human
gauauuuuacuucuuccagacaccagaagaaauggccuucaauuauuugaaaagagacacagag

SEQ ID NO: 16943 - RNA, 64 nt, Human
guuccggucccgguagccuuguuaacccucagaggccuucaaguccuuuccaccucucacccau

SEQ ID NO: 16944 - RNA, 64 nt, Human
aggccacuuuggaaaggguuuggaugagcugguggccuucaaccucugccugcaucugccacuu

SEQ ID NO: 16945 - RNA, 64 nt, Human
gaauuuuaucugguuauugcaucuggugauagaggccuucaaagccuauuauuucuaaccuaag

SEQ ID NO: 16946 - RNA, 64 nt, Human
ugucagaauugguuuggugcaggcaauagauuuugccuucaaggguuccuguggaucucaggaa

SEQ ID NO: 16947 - RNA, 64 nt, Human
uggacuccagaaaugugcaugcagaucagcuguugccuucaagauccagauaaacuuuccuguc

SEQ ID NO: 16948 - RNA, 64 nt, Human
ucccagaagcggaccugaggaccccuuggcccuggccuucaaacccacccccuuuccuuccagc

SEQ ID NO: 16949 - RNA, 64 nt, Human
guagaauguuuguaaagcucuuaacaguauguaagccuucaauaaauuucaguuuuccccuugu

SEQ ID NO: 16950 - RNA, 64 nt, Human
uguuccauguuuauuuguuaaagcagugugaauagccuucaagcaugugaauaaucuuccaucu

SEQ ID NO: 16951 - RNA, 64 nt, Human
acuucaauagaucaaaguccagcaggcaaggacggccuucaacugaaaagacucaguguucccu

SEQ ID NO: 16952 - RNA, 64 nt, Human
gcucuaacaguuugauaucagcagacguguuuaagccuucaacuugauuuccaauuauuccauc

SEQ ID NO: 16953 - RNA, 64 nt, Human
aauggauucaacacugugcacggaaaagacaagagccuucaacgacccuggacagugacgagga

SEQ ID NO: 16954 - RNA, 64 nt, Human
cugaaauacacgcuaguaacuccucugcccuucagccuucaaaguaagagucagcuuuuucucc

SEQ ID NO: 16955 - RNA, 64 nt, Human
uuuccccagacuuguuggcguaggcuacagagaagccuucaagcucugagggaaagggcccucc

SEQ ID NO: 16956 - RNA, 64 nt, Human
augccacagucugagguugauaucuaaaaucuaugccuucaaaagagucucuguuuuuuuuuuu

SEQ ID NO: 16957 - RNA, 64 nt, Human
gcucacaaucuuccaaugacuucucccuccgguggccuucaagguccuuuaugaguguuacccc

SEQ ID NO: 16958 - RNA, 64 nt, Human
uugcccauugcacuuacauaccaccaccaagaaagccuucaagaugucaaauaaagcaaaguga

SEQ ID NO: 16959 - RNA, 64 nt, Human
acugaggaccgugagcuccaggccccgugucagugccuucaaaccuccuccccuauucucaggg

SEQ ID NO: 16960 - RNA, 64 nt, Human
acuggaauaguuuuuuuuuuuuuuuuuuuuuuuugccuucaacuaaaaacaaaggagauaaauc

SEQ ID NO: 16961 - RNA, 64 nt, Human
cucaggaucagagcugauaacgggauucccuugggccuucaaggugccaggccugccccaguac

SEQ ID NO: 16962 - RNA, 64 nt, Human
cuuggccuguaaucaccugugcagccuuuugugggccuucaaaacucugucaagaacuccgucu

SEQ ID NO: 16963 - RNA, 64 nt, Human
aucaaaguagaagagcccccaaccuuuucucucugccuucaagaaggcagacauuugguaugau

SEQ ID NO: 16964 - RNA, 64 nt, Human
aucuuugacggcagaguaguaaaugcuuccacgugccuucaacuggauauuuauagucuuacug

SEQ ID NO: 16965 - RNA, 50 nt, Human
augcaguggauucugacugagccuucaaagcagcuccuggaguccaaugg

SEQ ID NO: 16966 - RNA, 64 nt, Human
gaugaacucaagcccuguggccacaguucugggagccuucaacccuggcucaugcugccauagu

SEQ ID NO: 16967 - RNA, 64 nt, Human
agacucaggacuuaaacauagccacgccaccuuggccuucaaugacagggaucuagcaaugcug

SEQ ID NO: 16968 - RNA, 64 nt, Human
cuagacaucugaauuugaucucaaugguaacauugccuucaauuaacaguagcuuuugaguagg

SEQ ID NO: 16969 - RNA, 64 nt, Human
aucagaaaguuauaugugcagauuauuuuccuuggccuucaagcuuccaaaaaacuuguaauaa

SEQ ID NO: 16970 - RNA, 64 nt, Human
cacagaguccuucacaaaccaagaacacacguaggccuucaacacaauuccccucuccucuucc

SEQ ID NO: 16971 - RNA, 64 nt, Human
uggaaaguuggggaguagaacgugugagaaguuggccuucaaggggcucagguuaauaauagag

SEQ ID NO: 16972 - RNA, 64 nt, Human
gaaugaaauccugugccguucuucagucuggagugccuucaaagaucagaaacaugauuuguuc

SEQ ID NO: 16973 - RNA, 64 nt, Human
uucagggcccccagcaccccugugucugcagagugccuucaaaacucagcuguuccagccggug

SEQ ID NO: 16974 - RNA, 64 nt, Human
cugaccuggcaucuaauucugauucuggcuuuaagccuucaaaacuauagcuugcagaacugua

SEQ ID NO: 16975 - RNA, 64 nt, Human
ggcuccagcccuugucagauucacccagggugaagccuucaaagcuuuuugcuaccaaagccca

SEQ ID NO: 16976 - RNA, 64 nt, Human
caauuuaaacuugccaguaccaacugggaugugugccuucaauuugaaaauuguauguuuuauu

SEQ ID NO: 16977 - RNA, 64 nt, Human
cugcagccagcagagcuuagcuucaaggacaccugccuucaaagccacugaggggaggaagggc

SEQ ID NO: 16978 - RNA, 64 nt, Human
augccccuuguaauguuugcauacacuagaaaaugccuucaauuuguguuuuaccagaauuuug

SEQ ID NO: 16979 - RNA, 64 nt, Human
cauggaggccagugaaagcugacaucuguaaaaggccuucaaggaagagaaaccaggcccugcg

SEQ ID NO: 16980 - RNA, 64 nt, Human
ucuucuggaagauuugcguuagaguuuuuguugggccuucaaaaagcuguguucagaguuagga

SEQ ID NO: 16981 - RNA, 64 nt, Human
guugaauuaacauaauauauguaaaguagaauaagccuucaaauuauaaaccaagggucaauug

SEQ ID NO: 16982 - RNA, 64 nt, Human
gagauuauucucaccaacccgcugccuucaugcugccuucaaagcuagaucauguuugccuugc

SEQ ID NO: 16983 - RNA, 64 nt, Human
agagaaacccuacacauguaaagaauguggcaaagccuucaauagguucucaacccuuacugug

SEQ ID NO: 16984 - RNA, 64 nt, Human
ugagaagccacaaaaauaugaaaaauguggcaaagccuucaaaugcuugucacaucuuacugua

SEQ ID NO: 16985 - RNA, 64 nt, Human
gugacucuccucucucaggaugacgaggaccugugccuucaacaagcaaaaugcugcucacggu

SEQ ID NO: 16986 - RNA, 64 nt, Human
aaauacuucaugaaaggcaguguauucugaaaaagccuucaaauaaagguauugcaacacgauu

SEQ ID NO: 16987 - RNA, 64 nt, Human
uccucucaugguuugaaacugcaucugaaugccugccuucaauccuggccaaguuggaguagac

SEQ ID NO: 16988 - RNA, 64 nt, Human
gccuuguguguguuuuacuaaccuuuuauaucuugccuucaagugagaaggaacaaacaacucu

SEQ ID NO: 16989 - RNA, 64 nt, Human
cagaccagggguuaccagccucacagcugcagcugccuucaagccuguaggauccacuggcguc

SEQ ID NO: 16990 - RNA, 64 nt, Human
guguuugauuaaugaaaaaauucuucaugagucagccuucaaaaguuaagcuugccuuuuacuu

SEQ ID NO: 16991 - RNA, 64 nt, Human
uaacuuacacagaaugagaggaguaaauguucuugccuucaaauaguguuuuacguuuuuuauc

SEQ ID NO: 16992 - RNA, 64 nt, Human
aggacauuuucagcauauuuauacaugagaaacagccuucaacaaguauuugugaagugacuga

SEQ ID NO: 16993 - RNA, 64 nt, Human
cugcuccuggcucuauuuuguuaaggugucaucagccuucaaccuccauuuauauauuuuuaua

SEQ ID NO: 16994 - RNA, 64 nt, Human
uuguuuucauugauuucaaaaguuuauuuucugugccuucaagggacaacuuuuuuaacuuugg

SEQ ID NO: 16995 - RNA, 62 nt, Human
ggccccaaaccaaacucuagcugauccauguugccuucaaguuuguuuuucucgggggcauc

SEQ ID NO: 16996 - RNA, 64 nt, Human
cccugaugagucuaucuaaacauaugcauuuuaagccuucaaauuacauuaucaacaugagaga

SEQ ID NO: 16997 - RNA, 64 nt, Human
uuauugauuucaagucuucuauuaaggacauuuagccuucaauggaaauuaaaacucauuuagg

SEQ ID NO: 16998 - RNA, 64 nt, Human
ccuuuucauuuauggacaauuuuuuggacuaguagccuucaauauacauucugcuuugaauuaa

SEQ ID NO: 16999 - RNA, 64 nt, Human
cucuucugucaucuugaaguaaauagaagaucaagccuucaaaucucuuaauuuuuucgguauu

SEQ ID NO: 17000 - RNA, 64 nt, Human
uccucuuuuauaaacuuauagaaugucaaacuuugccuucaacuguuuuuauuucuagucucuu

SEQ ID NO: 17001 - RNA, 64 nt, Human
aguauuguagaaagcuaauacaaaacuauccuaugccuucaaauaguauagaaaauggaaaaua

SEQ ID NO: 17002 - RNA, 64 nt, Human
aauaaauaaauaaauaaauaaauaguauuuuugagccuucaagauacaguuccugaauauucua

SEQ ID NO: 17003 - RNA, 64 nt, Human
uucugccuacaguucagacagaagucacaaaaaggccuucaacucaccaaagguaaauaucugu

SEQ ID NO: 17004 - RNA, 64 nt, Human
gcaaagaaaaguuucaccuguauugaaucagaaugccuucaacugaaaaaaacauauccaaaau

SEQ ID NO: 17005 - RNA, 64 nt, Human
aaaauuguauuuacagcugauggacucaauuugagccuucaaacuuguaguuauccuauuauau

SEQ ID NO: 17006 - RNA, 64 nt, Human
gauccaauuguggauuuauuuacaaacaucaaaugccuucaagccaauccuuuuugcuguaugu

SEQ ID NO: 17007 - RNA, 64 nt, Human
uguaguuuuuguuuuaugcaagaaacagaccugugccuucaaagcccacguaaagccucaaaac

SEQ ID NO: 17008 - RNA, 64 nt, Human
gggccucccauaauugcuuugccaaaauaccagagccuucaagugccaaacagaguauguccga

SEQ ID NO: 17009 - RNA, 64 nt, Human
ccuugccugaaucuggagugggguugagcccucugccuucaaccuuaagauuuaggaaguucuu

SEQ ID NO: 17010 - RNA, 64 nt, Human
guaucugcucuaaaaugacuuguuccuggggaaugccuucaaccaaaacacagcuaguauuucu

SEQ ID NO: 17011 - RNA, 64 nt, Human
ccugguacugauaguaguggcucgauuuuuaagagccuucaauuguagaugaacaucucuguua

SEQ ID NO: 17012 - RNA, 64 nt, Human
uuaucccucauucauccauccguucauucauucagccuucaaucaacaucucuugagugucuau

SEQ ID NO: 17013 - RNA, 64 nt, Human
gaguuuugcaguggugcaaucauagcucauugcagccuucaauuccugggcucaggcaauccuc

SEQ ID NO: 17014 - RNA, 64 nt, Human
uguagccugggagaaugguuacuuuggcauuagggccuucaagggcuggcagucuuacagaggc

SEQ ID NO: 17015 - RNA, 64 nt, Human
acagugugggugccacagguaaccccaauuucuggccuucaacuucuccccuugaccgggucca

SEQ ID NO: 17016 - RNA, 64 nt, Human
aaauacccaaaauuccaaguucucgauuucacaugccuucaagacugaacaccgacuaagguuu

SEQ ID NO: 17017 - RNA, 64 nt, Human
uucauuuggauuucaaauuguccagaguggaaaagccuucaagaugacaugaugaauuacucag

SEQ ID NO: 17018 - RNA, 64 nt, Human
ccaaauauagcucuguguauaacaucguacugcggccuucaaaacuacguuauguuggagcauu

SEQ ID NO: 17019 - RNA, 64 nt, Human
cuugaaauuauguuguuacacaacaaauuguggggccuucaaauuguuuuucucuuuucauauu

SEQ ID NO: 17020 - RNA, 64 nt, Human
uguggcuucagccgugguccuccugggaccgguagccuucaagcuuguccagcagaaccagcuc

SEQ ID NO: 17021 - RNA, 64 nt, Human
guggguaguggugaaggaccgauaucagaaaaaugccuucaaguguacuaauuuauuaauaaac

SEQ ID NO: 17022 - RNA, 64 nt, Human
agguucuacaggaaauacagagaugaacaacuuugccuucaaaaaugugcugccuagaaacaga

SEQ ID NO: 17023 - RNA, 64 nt, Human
ccuguuucugagaguggaucucaagcaaguucaugccuucaaucagauguuacuuagggugggu

SEQ ID NO: 17024 - RNA, 64 nt, Human
uuuucuguuuuaauucagcacugauugauccaaggccuucaauguaggagugcuaccauggaaa

SEQ ID NO: 17025 - RNA, 64 nt, Human
agaaguucuaguuuucaaauauagauuguaaggagccuucaauuuucuuuagcgacuacuaccu

SEQ ID NO: 17026 - RNA, 64 nt, Human
gcccucagcucuuagcuggucuaagaaugacgaugccuucaaaaugcugcuuccacucagggcu

SEQ ID NO: 17027 - RNA, 64 nt, Human
cuagcaaggcucaucuuucugcccggcuacaucagccuucaagaaucagaagaaaggccaaggu

SEQ ID NO: 17028 - RNA, 64 nt, Human
gcucccuuucauugucuauauuccagucaagcuggccuucaaaauuucagcacauugggucuuu

SEQ ID NO: 17029 - RNA, 64 nt, Human
ugcgaacaagcagcccccagcgagggucuccuucgccuucaaccuccuagugucuguuagcauc

SEQ ID NO: 17030 - RNA, 64 nt, Human
cacccucaucccgcagcugcagagacuggaaacugccuucaaggccacggcuggucaucugcug

SEQ ID NO: 17031 - RNA, 50 nt, Human
caccuuacgugucugccuaagccuucaagugggcggagcugagggcagca

SEQ ID NO: 17032 - RNA, 64 nt, Human
aaaaguuaaaagucaguagaaaacaggugccucagccuucaaaugguugcuuuuuuuccauuuu

SEQ ID NO: 17033 - RNA, 64 nt, Human
ggacauccaguuccccagcuguaguuauguaucugccuucaagucucugacaaaugugcugugu

SEQ ID NO: 17034 - RNA, 64 nt, Human
ugaaaaaaauauuuuagcuuagacuaagcuaccugccuucaaaauaguuuagggaccaccacca

SEQ ID NO: 17035 - RNA, 64 nt, Human
agagauuuaauuaaucaugaauguguaacacagugccuucaauaaaugguauagcaaauguuuu

SEQ ID NO: 17036 - RNA, 64 nt, Human
aaccucaccaauaaaggguggauguucaacaugugccuucaaaugugacccacugagaaggaaa

SEQ ID NO: 17037 - RNA, 64 nt, Human
aaauaaauuuauuucaauauuagcaagacagcaugccuucaaaucaaucuguaaaacuaagaaa

SEQ ID NO: 17038 - RNA, 64 nt, Human
cgaaagcuguuaaauucucagguugucagguucugccuucaaggguuguuggaaaauagucccc

SEQ ID NO: 17039 - RNA, 64 nt, Human
gccuaguuaaauauuucaguguuguuugguguaagccuucaaagaaaaaacauaaaaaguggga

SEQ ID NO: 17040 - RNA, 64 nt, Human
gguuuuuaagaauuucuugauacucuuauagccugccuucaauuuugauccuuuauucuuucua

SEQ ID NO: 17041 - RNA, 64 nt, Human
cgugacacuaaacauuagcccaaaggacuucuuagccuucaauugggagauaccuuuggucugc

SEQ ID NO: 17042 - RNA, 64 nt, Human
ucagaugcuguucgaccuggagucagccuacaacgccuucaaccgcuuccugcaugccugagcc

SEQ ID NO: 17043 - RNA, 64 nt, Human
aagaagcaauaacuauuuuuccucauuaauagcugccuucaaggacuguuucagugugagucag

SEQ ID NO: 17044 - RNA, 64 nt, Human
auuauuguucuuucacuuauucagaacauuacaugccuucaaaaugggauuguacuauaccagu

SEQ ID NO: 17045 - RNA, 64 nt, Human
cuuuuuccaguaggagagaaguuugcugaggaaugccuucaagcacaaagugaugaaugacugc

SEQ ID NO: 17046 - RNA, 64 nt, Human
aggaaugccuucaagcacaaagugaugaaugacugccuucaagucucaagaaaacacuuuuccc

SEQ ID NO: 17047 - RNA, 64 nt, Human
cagagccucagacccacacagcccagaggacgaggccuucaagccugccccucuucugcuuuuu

SEQ ID NO: 17048 - RNA, 64 nt, Human
ugaagacccugguccaggauucgcccucucccaugccuucaagucagcaucaggcuuagggcaa

SEQ ID NO: 17049 - RNA, 64 nt, Human
gaaaugggaguuccugagauacaacaaaaugugugccuucaaagaaacugacagcuuuguauuu

SEQ ID NO: 17050 - RNA, 64 nt, Human
uacacagacccaaacaaaaaaauaauaaucaaaugccuucaauuucugagaaaaugaggcagag

SEQ ID NO: 17051 - RNA, 64 nt, Human
uauauauuuauuucacgacagaguugaauguauggccuucaacaugaugcacaugcuuuugugu

SEQ ID NO: 17052 - RNA, 64 nt, Human
auuuuugaguuuuuuuguggggguacaggagggggccuucaagcuguacugugagcagacgcau

SEQ ID NO: 17053 - RNA, 64 nt, Human
cuuaauuaaaaaccuacaauuuacacaccucccugccuucaagacugugagcuuuggauagccc

SEQ ID NO: 17054 - RNA, 64 nt, Human
aguuucugcuuuugaaaauugcuuguaauuccuagccuucaaauuauuaaacacuccuugagug

SEQ ID NO: 17055 - RNA, 64 nt, Human
uagcuauuauuuaaguauuuauugaaguagaggggccuucaaacuacuuuauacuagugauagu

SEQ ID NO: 17056 - RNA, 64 nt, Human
cuucccugagaaaggugaggcccaaaggagagaggccuucaaacugucccagguccugcgcagc

SEQ ID NO: 17057 - RNA, 64 nt, Human
uggaaaaugacguuuguggcucuuucccaaguuggccuucaaagagccugccugcuguugagcc

SEQ ID NO: 17058 - RNA, 64 nt, Human
gugucagccugcaucgcaagcacacacccugcgggccuucaagucucacuguuccguaugagga

SEQ ID NO: 17059 - RNA, 64 nt, Human
accagccaguggaaauuacucaaacacguauugugccuucaaugagaagccuucucacugaaag

SEQ ID NO: 17060 - RNA, 64 nt, Human
cuuuuccccucuucuacccuccccaagaaaaagggccuucaaggcaggaaugagaaagcaaagc

SEQ ID NO: 17061 - RNA, 64 nt, Human
cugcacagagccgugucccagacacgcugucagugccuucaacacggagccgguuuguucauuc

SEQ ID NO: 17062 - RNA, 64 nt, Human
uccuuccugguuuugagugacaccacagcugucagccuucaagaugucaagucuucgagucagc

SEQ ID NO: 17063 - RNA, 64 nt, Human
agccuuuuuuuuuuuucuucuguacucuucuuuugccuucaauaugaguuucauuuccucugug

SEQ ID NO: 17064 - RNA, 64 nt, Human
ucuucggggaacuguagaugacaggcuuaauugggccuucaaccuguaugaccuuaacaaggac

SEQ ID NO: 17065 - RNA, 64 nt, Human
ccaggcagggcagcaugggacccagugucucagugccuucaaaacccacccccaccccuacccu

SEQ ID NO: 17066 - RNA, 64 nt, Human
guuagaaauuguaacuuugauauugaauucucuugccuucaacaagcacacugacagagaaaaa

SEQ ID NO: 17067 - RNA, 64 nt, Human
ucugccuucaugcaccuguccuuucuaacacgucgccuucaacuguaaucacaacauccugacu

SEQ ID NO: 17068 - RNA, 64 nt, Human
aaaagggacaugcuaaaagacucauuacuacucagccuucaauguaccuguguguccaucuuau

SEQ ID NO: 17069 - RNA, 64 nt, Human
gauuaugagugaacccccaaauaggguguuuucugccuucaaauaaaagucaccccugcauggu

SEQ ID NO: 17070 - RNA, 64 nt, Human
ugcccgggcagugccauccuggugggggagggcagccuucaaacguguggggucuacaguccuc

SEQ ID NO: 17071 - RNA, 64 nt, Human
uaccuaugucaagagaagggaugaggccaaggcugccuucaauuagaagcagccgcccacagag

SEQ ID NO: 17072 - RNA, 64 nt, Human
auccagccccguuuuugcugcuuccagggccucugccuucaaggcccccauggggcuguccauc

SEQ ID NO: 17073 - RNA, 64 nt, Human
ggcugggguggaggcugggaucagaccguggugggccuucaagcuaaggagcuuccuaggugaa

SEQ ID NO: 17074 - RNA, 64 nt, Human
uggccucaggagugggacacccagacuuggcagggccuucaagaggccugugugggggccccag

SEQ ID NO: 17075 - RNA, 64 nt, Human
guaaugaacacauuaacgacuagauuaaaauauugccuucaagauuguucuuacuuacaagacu

SEQ ID NO: 17076 - RNA, 64 nt, Human
ugggcccugccuccccauaggccauuuggacucugccuucaaacaaaggcaguucaguccacag

SEQ ID NO: 17077 - RNA, 64 nt, Human
gaagggcuaauauugaccgucuugacuggcuggagccuucaaagccacugggauguccuccagg

SEQ ID NO: 17078 - RNA, 64 nt, Human
agaagccuaaaauuccugguucucucagggcuucgccuucaaggguucuggaggagggaagggu

SEQ ID NO: 17079 - RNA, 64 nt, Human
ucuugccccagaccggcagccuggccauccccaagccuucaacagaagcugugcugccacggca

SEQ ID NO: 17080 - RNA, 64 nt, Human
uccaguaccuaaucacgcucuguuccuugcuuuugccuucaagggaauuccgaguguccagcac

SEQ ID NO: 17081 - RNA, 64 nt, Human
ucccauccaccuccucucuacucugccagucucagccuucaaagcacuugacaucagggacccu

SEQ ID NO: 17082 - RNA, 64 nt, Human
uaaagcagaauguaggagagggauucuuccaaaggccuucaaaucaaauuagaauucacugaga

SEQ ID NO: 17083 - RNA, 64 nt, Human
gucaacaauuuagggguacgaaaguaggaugagagccuucaaagucuaccagcacaaagacccc

SEQ ID NO: 17084 - RNA, 64 nt, Human
ucagaaucuuuuucugcaucaauucagucaauuugccuucaacaaagagaagucagcaaguucu

SEQ ID NO: 17085 - RNA, 64 nt, Human
cccccuccgcccccaugcucucuguggccuccaugccuucaagacuucugucuguaucuaucuc

SEQ ID NO: 17086 - RNA, 64 nt, Human
uuuggucuggggacaauccccuuggcugcucuuugccuucaaugaguuuccugcaugacagagg

SEQ ID NO: 17087 - RNA, 64 nt, Human
caagcugaaagucagacuaagaaauaaagagagggccuucaagaagcuuccugaaugauuucug

SEQ ID NO: 17088 - RNA, 64 nt, Human
auucucacggaauuccuggaaaugauugugaauugccuucaaauaauagaaaaguguauuuauu

SEQ ID NO: 17089 - RNA, 64 nt, Human
aaaugccuaagaaaauacuccucugaugcauuuagccuucaacccuaccugucuugcugaaggg

SEQ ID NO: 17090 - RNA, 64 nt, Human
gacagagcuccucaaaccauuguggauaucuucugccuucaaccacagaucaaauacuucaaga

SEQ ID NO: 17091 - RNA, 64 nt, Human
guggguauuauggaggagguugugauggugguaagccuucaaagaaagaaaggccuuucaagaa

SEQ ID NO: 17092 - RNA, 64 nt, Human
ggaugauaauaccaagaugaagccacugguuccugccuucaaguucuuucaaguuuuuauuuua

SEQ ID NO: 17093 - RNA, 64 nt, Human
ucagaaaaggcaaacuauuuuguacuguuuauaagccuucaaacaguaguuuuacaaucaugcu

SEQ ID NO: 17094 - RNA, 64 nt, Human
ccaugcuggggcaacgucauucagugucuucucggccuucaaaaggcuuggacagacuguucuc

SEQ ID NO: 17095 - RNA, 64 nt, Human
ucguuccugcuuccaagcagcaugcuacaggccagccuucaaagaaagaccagaagccaagugu

SEQ ID NO: 17096 - RNA, 64 nt, Human
cuuauagaaauacaaguaagacuuaggauaauuugccuucaaaacaguuuuccuaaucucagca

SEQ ID NO: 17097 - RNA, 64 nt, Human
ugagaaauauaaaaauaauuaaaacaaaauccuugccuucaaacgaaauggcucggccaggcac

SEQ ID NO: 17098 - RNA, 64 nt, Human
guugugccagguuccacucaaguaaauuaucucugccuucaaggagcuugcaguauagugagaa

SEQ ID NO: 17099 - RNA, 64 nt, Human
caaagcugcaacugaauaaaucuggugaggugaggccuucaaaauguauuaauacgccuuuguu

SEQ ID NO: 17100 - RNA, 64 nt, Human
uggcaucauccugguuuccaucuuugccuaugaugccuucaagaucuaccggacugagauggca

SEQ ID NO: 17101 - RNA, 64 nt, Human
ucuucaucuuuaaccuggcagaaacugcucacaugccuucaaaagugaaagcucaacucuacgc

SEQ ID NO: 17102 - RNA, 64 nt, Human
uuucuuugagcuugugaaagcucuguguucuuuugccuucaaucuguugucuucaaaacaaaca

SEQ ID NO: 17103 - RNA, 64 nt, Human
gugacccauccuccauccuauuuauaguggaagggccuucaauuguaucaguacuuuuuuuuaa

SEQ ID NO: 17104 - RNA, 64 nt, Human
caccaucuuuuauaaauugccauggaaaccaagugccuucaaugaaacaagccugaauaauuuu

SEQ ID NO: 17105 - RNA, 64 nt, Human
guaggggcuggaaaauaaaccgcaugcuggccuagccuucaaguugcuuuucagccaugaaauu

SEQ ID NO: 17106 - RNA, 64 nt, Human
gggcagggaaggacaggacccucaggaauucagugccuucaacaacgugagagaaagagagaag

SEQ ID NO: 17107 - RNA, 64 nt, Human
ggaaggcgaagaaucaaguaaucucuaggcaaaugccuucaaguuuuccaguucugagguaacu

SEQ ID NO: 17108 - RNA, 64 nt, Human
auagggguauguuggaauccgaagccacuuccccgccuucaagccccagaugggcugcucuccu

SEQ ID NO: 17109 - RNA, 64 nt, Human
gaaggggaguccucucuucccacaaguccauucugccuucaaaguguaaguucucaugucauua

SEQ ID NO: 17110 - RNA, 64 nt, Human
gggaggcccuggaaaauuuugugcuuccaacguggccuucaauucuugcuuuuuugccccucgg

SEQ ID NO: 17111 - RNA, 64 nt, Human
agugccaugcuuucaggucuucuguggccuacuggccuucaagacagaggccugccccagugug

SEQ ID NO: 17112 - RNA, 64 nt, Human
uucugccauaaagacugauuuuuguucguucugagccuucaaggaauuuguuuuuuacaacugg

SEQ ID NO: 17113 - RNA, 64 nt, Human
aggggagcaccacgcgcugcaguucaccgaccuggccuucaagcaggcccgggacggcugcccg

SEQ ID NO: 17114 - RNA, 64 nt, Human
guauggcggccaccagaaggcuguugucugccuggccuucaaugacagugugcugggcuagccu

SEQ ID NO: 17115 - RNA, 64 nt, Human
aaacuuggugcacucugaaagcagcacuuggacagccuucaaaguccuuccaucuggcugcacu

SEQ ID NO: 17116 - RNA, 64 nt, Human
ugcuucuagccucccaguaggaggccccagccaugccuucaaccuggcaggagguguagccacu

SEQ ID NO: 17117 - RNA, 64 nt, Human
uugauaaagauguuguuaaacugugucagccugagccuucaaaggguaaauuuaaucaugauuc

SEQ ID NO: 17118 - RNA, 64 nt, Human
gguugaggucccgagcgccacuccuagccuugccgccuucaauagagaagaaaucccuuugcua

SEQ ID NO: 17119 - RNA, 64 nt, Human
cuuaggagauagaugcuggauuauauaggugaaugccuucaagaaauguguaauuuaauuccaa

SEQ ID NO: 17120 - RNA, 64 nt, Human
gcagggccucugucaauuguacgcgccaccgagugccuucaacacagcuugucucuugccugcc

SEQ ID NO: 17121 - RNA, 64 nt, Human
uucuucccugcccagagccagccugggauugucagccuucaauccccuuuccuuccucuuuuug

SEQ ID NO: 17122 - RNA, 64 nt, Human
cacucacuuccaccccaaacuccucaaaucaaaagccuucaaaacacgaggcacucuuggaucu

SEQ ID NO: 17123 - RNA, 64 nt, Human
gacugacacccugguucagaacaccaucaaagaugccuucaagggcugcacugugcugaccauc

SEQ ID NO: 17124 - RNA, 64 nt, Human
uagagaagaaaauuugguuuuagcaaaugacagagccuucaaaaauauuuuuggaauaauguga

SEQ ID NO: 17125 - RNA, 64 nt, Human
aaguugugugaggauugcauuaacaaaccuaugagccuucaauggggaagaccagaagggugag

SEQ ID NO: 17126 - RNA, 64 nt, Human
agugcuucagucuuugguuuauuucaugcacugugccuucaaaaugaaauuuuuaaaagggacu

SEQ ID NO: 17127 - RNA, 64 nt, Human
guugugccuggaccaucgcugccugccagcuucugccuucaacuucagcaccugccccggcagu

SEQ ID NO: 17128 - RNA, 64 nt, Human
ucaagggagauuauaccaguaggacugaaucagggccuucaaagcuggacugaguugguccugu

SEQ ID NO: 17129 - RNA, 64 nt, Human
ggaggcagggaacauggggaggaggagggucggugccuucaagaaaacaggcacugcccuggug

SEQ ID NO: 17130 - RNA, 64 nt, Human
caacuguuuaccucuugguuguccccgugaagaagccuucaaacccugcaccauaaauacaugu

SEQ ID NO: 17131 - RNA, 64 nt, Human
ugggagggugguuacuguggguggaauaguggaggccuucaacugauuagacaaggcccgccca

SEQ ID NO: 17132 - RNA, 64 nt, Human
cauuagaaacuaucccuaaauguaaagaucuuuugccuucaaauuuggcuuauuuuuucugauu

SEQ ID NO: 17133 - RNA, 64 nt, Human
uggcauaugucaguuaugaaauuauuauaauucagccuucaaacuacuacugaucaacuaaagg

SEQ ID NO: 17134 - RNA, 64 nt, Human
ggagcgcauccacggcugccccgugugcaggaaggccuucaagcgcgccacgcaccucaaggua

SEQ ID NO: 17135 - RNA, 64 nt, Human
ggagcggccguuccauugcacgcuuugugagaaagccuucaaccagaagagugcgcugcaggug

SEQ ID NO: 17136 - RNA, 64 nt, Human
uguaauuaaaacuauuuaguguuaguuauaaauagccuucaaaaagagagauucuccauuacac

SEQ ID NO: 17137 - RNA, 64 nt, Human
auuuguacagucagagggcaacaggaagaugcaggccuucaagggcaaggagaggccacaagga

SEQ ID NO: 17138 - RNA, 64 nt, Human
aggcggggcugguccacauucccaggccccaacagccuucaaagauggguaaaggagcuugccc

SEQ ID NO: 17139 - RNA, 64 nt, Human
agagaaacccuauaaaugcaugccaugugguaaagccuucaaucuuuccaguuccuuucaguau

SEQ ID NO: 17140 - RNA, 64 nt, Human
gacuuuaauuuaauuuuuuuuuuguagggccaccgccuucaaacacaacugcuacaacauucua

SEQ ID NO: 17141 - RNA, 64 nt, Human
agaggaacccuaugagugugaagaauauggcaaagccuucaacaaguccucaauucuuaccaga

SEQ ID NO: 17142 - RNA, 64 nt, Human
aguggggucuggccugggaggaggucugauaagugccuucaaggagcuuacguucuaguuaggg

SEQ ID NO: 17143 - RNA, 64 nt, Human
ccuucacauccaauaagcaauaugcaggagugaagccuucaaaaugauaaguaaggucagaauu

SEQ ID NO: 17144 - RNA, 64 nt, Human
auucccuuguucuagauucacuuuaacgcuuaaugccuucaaaguuuugguuuuuuuaagaaaa

SEQ ID NO: 17145 - RNA, 64 nt, Human
aguugauguuuccacguggcuauuuccaagcuuugccuucaaauaaauucuguacuuaaucaua

SEQ ID NO: 17146 - RNA, 64 nt, Human
uaaauuuuuuaaauaauuucaauguaguuuucccgccuucaaauaaacaugucugcccucaugg

SEQ ID NO: 17147 - RNA, 64 nt, Human
auagaggccucaugaaugcagcaaauguggaagcgccuucaacucaagaucuaucaucauuuag

SEQ ID NO: 17148 - RNA, 64 nt, Human
agaaaagcccuacgaaugcauugauugugggaaagccuucaaugaucgcucaacccuuaguaaa

SEQ ID NO: 17149 - RNA, 64 nt, Human
ggccgccccagcgaccucccuggcaccggccgccgccuucaaauacuuggcacauuccuccuuu

SEQ ID NO: 17150 - RNA, 64 nt, Human
gcuuggcugugcccucagauuccgcaccaauaaagccuucaaacucccuaaucugugguuugau

SEQ ID NO: 17151 - RNA, 64 nt, Human
gcuguuaguaauuucuuguggauuucauuguuuugccuucaaauaaagccuuuuuuuaaagacc

SEQ ID NO: 17152 - RNA, 64 nt, Human
ccugcaggguuuccuugggcgcggccccaaaauugccuucaaaacaaacccgggacgguugaaa

SEQ ID NO: 17153 - RNA, 60 nt, Human
accaggaacucuacuauuagagggacgacugccuucaagcaucccugcaacugccacagc

SEQ ID NO: 17154 - RNA, 59 nt, Human
agauucauaauggaauuuaauagaagaaagccuucaaauguauaugauguuacagaaca

SEQ ID NO: 17155 - RNA, 64 nt, Human
gaugacaaguuccaauagcuuauaugcccagaaggccuucaaaauaagaauuuugaaagaauac

SEQ ID NO: 17156 - RNA, 64 nt, Human
ggccaagcccuccucuucccagaauuggcccggggccuucaauuuacguucuuuacacuacggg

SEQ ID NO: 17157 - RNA, 64 nt, Human
guuggucucacaugacucuugauagaguuugccagccuucaaaucaccaacugugggaaccaac

SEQ ID NO: 17158 - RNA, 64 nt, Human
ugccuacccucuguccugccuuguuauuguaagugccuucaauacuuugcauuuugggauaaua

SEQ ID NO: 17159 - RNA, 64 nt, Human
acuuggguggguacuugggugaggaucccugaaggccuucaacccgagaaaacaaacccagguu

SEQ ID NO: 17160 - RNA, 64 nt, Human
uuccagagaaauuugagguccucgcuuguucucugccuucaagaaacaaugaccugauucuguc

SEQ ID NO: 17161 - RNA, 64 nt, Human
ugcuuccuugaauuaggcuuuccuaaccugaagcgccuucaaacuuccaauaaagagaucauuu

SEQ ID NO: 17162 - RNA, 64 nt, Human
aaccagacacugcauggcaaccuccuuggggccagccuucaaggcuucauggccauaucaugaa

SEQ ID NO: 17163 - RNA, 64 nt, Human
cggccaucccucggaccuugaccccccuguccgcgccuucaaggcucccaacucaggcaccagg

SEQ ID NO: 17164 - RNA, 64 nt, Human
cguccccgugagcccgaggcuggaaguggugucugccuucaaggguuaaucccucuuuguucca

SEQ ID NO: 17165 - RNA, 64 nt, Human
aggcuggguugucacugagacuagauucucaccugccuucaaagaagggccaauucccuuuaaa

SEQ ID NO: 17166 - RNA, 64 nt, Human
gaguacuucguauuuuuuuuuaauugccuuguuugccuucaacuuccuugauuuucauaguuua

SEQ ID NO: 17167 - RNA, 64 nt, Human
uguagguugagagaggaagcgagaaguuaaggaugccuucaaaauuuuuguuuagaucaucagg

SEQ ID NO: 17168 - RNA, 64 nt, Human
aucagaggguguaaagaaggacauuuuaacaaucgccuucaauuuuacuccacuuaauuaccga

SEQ ID NO: 17169 - RNA, 64 nt, Human
ugcccccuccagccggcuuuuccccuugacugaagccuucaacaucaucuugggagagaggcac

SEQ ID NO: 17170 - RNA, 64 nt, Human
ccucaguuucccucugugaaguggggggaggcaggccuucaaggagggauagagguacaaggcu

SEQ ID NO: 17171 - RNA, 64 nt, Human
uacucccucccuaccuuuuccauccuccuccucugccuucaaaaaaggaaacuuucccuugguu

SEQ ID NO: 17172 - RNA, 64 nt, Human
gguaguuuuuucaacaucuaaaauuuuuguuuuagccuucaaaaccaacuuaccaaccucaguc

SEQ ID NO: 17173 - RNA, 64 nt, Human
uguaggggaagugccacucgcuguuuggggcccggccuucaaauucaaaauugagccaugcuuu

SEQ ID NO: 17174 - RNA, 64 nt, Human
cccuugaaggugguagcccagcuccuguuccugugccuucaaaaggcuggggcacuaugaguaa

SEQ ID NO: 17175 - RNA, 64 nt, Human
guauaugugauuaaaaugaagauuauuuucuaaagccuucaaauuagaaguggauuucuguuuc

SEQ ID NO: 17176 - RNA, 64 nt, Human
ucaauuucuccccaggguggaugggggaaauggugccuucaagaccuucaccaaacauacuaga

SEQ ID NO: 17177 - RNA, 64 nt, Human
acagucuuccugaaggacauuuugaggugggggggccuucaaagcucagagacugguuugaaug

SEQ ID NO: 17178 - RNA, 64 nt, Human
guaaagaaaccuguuaugaauuagauuacaagcagccuucaaaagaauuggcacugggauaaga

SEQ ID NO: 17179 - RNA, 64 nt, Human
cuucaucuagacugagggcaagaucccaguggaggccuucaagcaaauccccuaaaaggagccc

SEQ ID NO: 17180 - RNA, 64 nt, Human
ucaaccccagggugguuuucaggaguccgagguagccuucaaucacuggacuccauggccuucc

SEQ ID NO: 17181 - RNA, 64 nt, Human
ugcccagcuuaagcaucccuggcaucagacuauggccuucaagagcacuagggcauaugcuuuu

SEQ ID NO: 17182 - RNA, 64 nt, Human
ugccauacaucuauuuaagugcauaaggucuuuggccuucaagauccaucgaccuuaaacagga

SEQ ID NO: 17183 - RNA, 64 nt, Human
ccggaagaacuuugcucggacacacuggaagcgagccuucaaugccaccucguuccugcgccac

SEQ ID NO: 17184 - RNA, 64 nt, Human
auggaccccaucccucuaaagccugcccuccuuugccuucaacuguauaugcuggguauuucau

SEQ ID NO: 17185 - RNA, 64 nt, Human
cagcuaagcaauagauaacauccaucguggcucugccuucaaagggaaauuuuacauaugucac

SEQ ID NO: 17186 - RNA, 64 nt, Human
cccagggggccacguagcagcggcucaguggguggccaucgaucuggaccguccccugcccacu

SEQ ID NO: 17187 - RNA, 64 nt, Human
gcuuucucucccucagccugcaaggguccgauuugccaucgaaaaagacaaccucuacuuuuuu

SEQ ID NO: 17188 - RNA, 62 nt, Human
caaggaggcuccagccauaggcgccuaguguagccaucgagggacuugacuuguguguguuu

SEQ ID NO: 17189 - RNA, 64 nt, Human
ugguucauguggacacacaaaggcaaacagaucugccaucgaucgcagauuucuguagaaacac

SEQ ID NO: 17190 - RNA, 64 nt, Human
gacggguucccugaauccccgggguccuuggagagccaucgaggagaaugugcaauuggacuga

SEQ ID NO: 17191 - RNA, 64 nt, Human
cuccggccguacacgacagugccuugacccaacagccaucgaguacuguauguauuuccaccug

SEQ ID NO: 17192 - RNA, 64 nt, Human
ucagagcaggagggaggcaagccgccucuucucggccaucgacugcagaugaugaaagagcggg

SEQ ID NO: 17193 - RNA, 64 nt, Human
caguggagcuuaggaaacgcucccacucccacgggccaucgagggcccagcacggcugagcggc

SEQ ID NO: 17194 - RNA, 64 nt, Human
auucauaauuucugcucagauaauugaauaguuugccaucgagauuauuuucauuuauacuaua

SEQ ID NO: 17195 - RNA, 64 nt, Human
cugcauguacaaacuucuacccuagaagcucucugccaucgauguauucuaauagauuuguaag

SEQ ID NO: 17196 - RNA, 64 nt, Human
aaacccaggguguuccuuggaucucaggaucugagccaucgagggaagaguggggcugcuaggc

SEQ ID NO: 17197 - RNA, 64 nt, Human
accaggaacacaccuguagcccagcaaaguugaggccaucgacuggcucaucacaacaaggaag

SEQ ID NO: 17198 - RNA, 64 nt, Human
acaggaccuaauguuuauguggaaucuccaggcugccaucgagggcuccugagcucauccugag

SEQ ID NO: 17199 - RNA, 64 nt, Human
uccaaugguuuuuucacugccugaccuuuaaaaggccaucgauauucuuugcucuugccaaaau

SEQ ID NO: 17200 - RNA, 64 nt, Human
aguauuucuacauuacagccauauguaacaucaagccaucgauuguguacuuuuccuuugcuag

SEQ ID NO: 17201 - RNA, 64 nt, Human
gucacauugucagaacagguggcugcuguguggugccaucgagucccugcugguuccccuuguc

SEQ ID NO: 17202 - RNA, 64 nt, Human
uccaggauggacucagugcagagcaggacaugaugccaucgaaauuggaagguucccuggugcu

SEQ ID NO: 17203 - RNA, 64 nt, Human
ccuggaaaagaagaaacuuugccucaagacuauagccaucgacuccugccugaguuuccagccu

SEQ ID NO: 17204 - RNA, 64 nt, Human
ucuaaaauuaugccucccucuguuuuuauaaguugccaucgaaaagugauuuaaauaagcaggu

SEQ ID NO: 17205 - RNA, 64 nt, Human
gcccugcccuucaccguggauguuuucagaaguggccaucgagaggucuggaugguuuuauagc

SEQ ID NO: 17206 - RNA, 64 nt, Human
aaguuucagugccagcuagaaaauacugcuuucugccaucgauugggggugguuuuugucaaau

SEQ ID NO: 17207 - RNA, 64 nt, Human
ugcuccuagugacauguacaagaucaugaagaaagccaucgagagaggcucccucaugggcugc

SEQ ID NO: 17208 - RNA, 64 nt, Human
cucccacuguauggccgugccuagaccgauggcagccaucgaauauuccucugggcucacgggg

SEQ ID NO: 17209 - RNA, 64 nt, Human
accacaugaaggcccaggagugggagggggaauagccaucgacaaacuaagggggccucagagg

SEQ ID NO: 17210 - RNA, 64 nt, Human
gaguggugcgggagcaggcugccgaguggagggugccaucgagggcuccggaucccuuauccua

SEQ ID NO: 17211 - RNA, 64 nt, Human
gagccgcauccugguuuuagacgaggccacagcugccaucgaccuggagacugacaaccucauc

SEQ ID NO: 17212 - RNA, 64 nt, Human
guugaggccaggguggucagggugcagaauaaaugccaucgagccuguggcuggcccucugcug

SEQ ID NO: 17213 - RNA, 64 nt, Human
uugcacugcugcgguuguacccugauacggccuggccaucgaggacaccugcccauccggccuc

SEQ ID NO: 17214 - RNA, 64 nt, Human
ugggagggcuaggggagcaaaagacagggacacugccaucgauaaugucagccugcagcacuga

SEQ ID NO: 17215 - RNA, 64 nt, Human
ggggcagaccggugauccuuaccaguggaagcgagccaucgagccauuggcagaaauccugcug

SEQ ID NO: 17216 - RNA, 64 nt, Human
agaaggggggcccugcacaaggaaacagggaagagccaucgaaguuucagucggugagccuugg

SEQ ID NO: 17217 - RNA, 64 nt, Human
cuuuagcucuggaaagaauaaggcugccuuggaggccaucgagcgugccgcuuucuucguggcc

SEQ ID NO: 17218 - RNA, 64 nt, Human
caauguaagccaucccggccagccccugacaucugccaucgaucuugcaccaagacugaacuug

SEQ ID NO: 17219 - RNA, 61 nt, Human
agucacccacucacucagaaagccgggagucaucggacaccuugcuggucagagguccugg

SEQ ID NO: 17220 - RNA, 61 nt, Human
uuggugcugcuaagaccgagaaauuuaaagaaucggacagauggacgcagagaaccagagg

SEQ ID NO: 17221 - RNA, 61 nt, Human
gggccugagcagcuggaucugguacaaagcaaucggacauagaguuggagggggaggcccc

SEQ ID NO: 17222 - RNA, 61 nt, Human
agcagggaaccugagacagggccacugcgggaucggacaaagccccgcuuuggagaggcug

SEQ ID NO: 17223 - RNA, 61 nt, Human
agaaagcaaacaagaagacuccggcucugcuaucggacacagauccugaucccucuugcuu

SEQ ID NO: 17224 - RNA, 61 nt, Human
uggguaagaaaaugcaaaccuguuauaaguuaucggacagaaagcuaggugcucugucacc

SEQ ID NO: 17225 - RNA, 61 nt, Human
aggaaacaaagauaaugacucaguucagaggaucggacaaaugugucuaguccggguggac

SEQ ID NO: 17226 - RNA, 55 nt, Human
ucacagacaacagcuacuaagcagcaucggacaagacccccagcacuuggggguu

SEQ ID NO: 17227 - RNA, 61 nt, Human
caugggacucaaugguggugaagaaaucucaaucggacaccagaggugggggcaacucugc

SEQ ID NO: 17228 - RNA, 61 nt, Human
acugcaguauacauuuaucuacacauuauauaucggacauauaauauguaaauaaaugacu

SEQ ID NO: 17229 - RNA, 61 nt, Human
cuuccaaaucaugccauaauuguaauguugaaucggacagagccuuacgugcccgagggcg

SEQ ID NO: 17230 - RNA, 61 nt, Human
gaaagaauauaagcaaucucacaggccugcaaucggacacugucucugugugguucauagg

SEQ ID NO: 17231 - RNA, 61 nt, Human
gcuuuugaaaguguuuuaaaagauuuccuuuaucggacaggaccaucuuuaugaccugcuu

SEQ ID NO: 17232 - RNA, 61 nt, Human
aagcaaagccuucagcaagaucauacgacucaucggacacuaauuuauauaggagugaagu

SEQ ID NO: 17233 - RNA, 61 nt, Human
uccuccaucgauggacacugcauugcuucucaucggacacuuguggagcgcaggggccugg

SEQ ID NO: 17234 - RNA, 61 nt, Human
uucauuuccaaucccagaacacauggagggaaucggacaggugaugccagcaguuccugcu

SEQ ID NO: 17235 - RNA, 61 nt, Human
ucaaaagcaaagcauucucuucccagugccuaucggacagugcggcggucgaggugggugu

SEQ ID NO: 17236 - RNA, 61 nt, Human
aaauacuacauucacccacguugugauucauaucggacaguuucuuacucaaagauaacac

SEQ ID NO: 17237 - RNA, 61 nt, Human
gcuccucuguguguacuucauagaagguggaaucggacagaggcagguuagugacaguuau

SEQ ID NO: 17238 - RNA, 61 nt, Human
ccccugcgaccgcccugccccccgucaccgaaucggacacucauccuuucucacacuuccc

SEQ ID NO: 17239 - RNA, 61 nt, Human
auccucuuaaagaauaaaagcacauccguggaucggacauggcugcaugugccugcuuaac

SEQ ID NO: 17240 - RNA, 61 nt, Human
aaccuuaauuuuacagcccuuggcuuguguuaucggacauucuaaugcauauuuauaagag

SEQ ID NO: 17241 - RNA, 61 nt, Human
gguagcuaugcuuugauguccuguugaggccaucggacagagacuggagcccaggugacag

SEQ ID NO: 17242 - RNA, 61 nt, Human
ccuccaugcaccaucacuguggcuggcaggcaucggacagccucauccagacccccugccc

SEQ ID NO: 17243 - RNA, 61 nt, Human
gcuugcggagcccaggugaacaagcucagcaaucggacaucucuggggaaaggaagguggc

SEQ ID NO: 17244 - RNA, 61 nt, Human
ucugacccucugcggccacugcgccacugccaucggacaggaggauuccuuguguuuuguc

SEQ ID NO: 17245 - RNA, 61 nt, Human
ccucccaagcauauaacccccuaaggaauccaucggacaagaccccgucuaacacugcauc

SEQ ID NO: 17246 - RNA, 61 nt, Human
caucccgcgcgcugcagccucaugugacccgaucggacagugccauccaugggccccaccu

SEQ ID NO: 17247 - RNA, 61 nt, Human
cugcugucguacagcacauuagcaaauugucaucggacaaugaccgcuucuucauguagau

SEQ ID NO: 17248 - RNA, 64 nt, Human
gcagccgggggccgguggccagagcgagggcaccagccacgaaggacggaggcgggcggggccc

SEQ ID NO: 17249 - RNA, 64 nt, Human
aggccacgggccacgggaagaaccaagcggugccagccacgagacgucaccaagaaaacaugca

SEQ ID NO: 17250 - RNA, 64 nt, Human
uuuugaggugcaauguuuaauuguuaaaaauaguagccacgacuuuaucaggcagccccaaacu

SEQ ID NO: 17251 - RNA, 64 nt, Human
ugccaagggugcuggugcggauggacacuaaugcagccacgauuggagaauacuuugcuucaua

SEQ ID NO: 17252 - RNA, 64 nt, Human
uggacccacagccuaagcugagugugaccccagaagccacgaugugcucuguauccagaacaca

SEQ ID NO: 17253 - RNA, 64 nt, Human
agugagcuuggugcgguaggugcuggccucaaacagccacgaggugguagcucugagcccuccu

SEQ ID NO: 17254 - RNA, 64 nt, Human
uuguuuuuuggugcuaauaugacauaugacaauaagccacgaggugcaguaaguacccgacuaa

SEQ ID NO: 17255 - RNA, 64 nt, Human
ugucugcugggcuacaaaccaggagcaaccgugcagccacgaacacgcaugccucagccagccc

SEQ ID NO: 17256 - RNA, 64 nt, Human
ggccuguggugccaucuccccaugguucauguggagccacgaacauccuuucccugcaguccau

SEQ ID NO: 17257 - RNA, 64 nt, Human
agcccucgguaaguauguuuagaaauagaacauuagccacgagccauaggcauuucaggccaaa

SEQ ID NO: 17258 - RNA, 64 nt, Human
cuuaauccuuaacaagacagcacuccagauaggcagccacgaccccaaaggugaggauaauguu

SEQ ID NO: 17259 - RNA, 64 nt, Human
aggaugccagccccugccuggguugggggcacucagccacgaccagccccuuccuggguauuua

SEQ ID NO: 17260 - RNA, 64 nt, Human
aguuauucuaugagaacacugcaucugcauucauagccacgaguuuguuauugcuacaggcuac

SEQ ID NO: 17261 - RNA, 64 nt, Human
guucucagugauguauaugcaacauuuuguugaaagccacgauggacuuacaagcuuuaaugga

SEQ ID NO: 17262 - RNA, 64 nt, Human
ccaugagcuuccuuuauuucuggcucacagaggcagccacgaggcacuacaccaaguauuauau

SEQ ID NO: 17263 - RNA, 64 nt, Human
caauuaaauaacugagaccuaagucugggaacagagccacgaaucugccuuugagaugcuggca

SEQ ID NO: 17264 - RNA, 64 nt, Human
aaagauuccagcacugagccgugggccggucaugagccacgauaaaaaaugccaguuuggcaaa

SEQ ID NO: 17265 - RNA, 64 nt, Human
cugugccaccagggagugccuauacauccuguccagccacgacauugagcagcacgcccccuau

SEQ ID NO: 17266 - RNA, 64 nt, Human
gcaauaccuccuccuguguuguauuacacauauuagccacgaguuuuugcagugaccagauaaa

SEQ ID NO: 17267 - RNA, 64 nt, Human
guccaggguggagcgcgccagccucagccagagcagccacgacagccacagugugugcacucga

SEQ ID NO: 17268 - RNA, 64 nt, Human
gaugagacaagagguagaggggagagguagagguagccacgagcugauaauuacagacaagaga

SEQ ID NO: 17269 - RNA, 64 nt, Human
gcaggguggaccccaguuuggaagcugagcccccagccacgaacauggaucugaggaggggccc

SEQ ID NO: 17270 - RNA, 64 nt, Human
agcagugguggcuggcgcgcuuucgcacuguggcagccacgagagucugugcacgucugugcug

SEQ ID NO: 17271 - RNA, 64 nt, Human
ccagcccugcaggugggacuggcucucccuccccagccacgaguaugccacagggggcuuucaa

SEQ ID NO: 17272 - RNA, 64 nt, Human
gauugcuugagcgagggaggucgaggcugcagugagccacgaucacaccacugcacuccagccu

SEQ ID NO: 17273 - RNA, 64 nt, Human
caaggccuggagggcccaaugucgcugcaaacacagccacgaagaacaugcagccacugggccc

SEQ ID NO: 17274 - RNA, 63 nt, Human
ccucugugauggcagugugagcuggacugugucagccacgacucgagcacucauucugcuccc

SEQ ID NO: 17275 - RNA, 64 nt, Human
ccagcuaggaggaaauggagcaagaugaacaggcagccacgaggugggugggagcuggcagucu

SEQ ID NO: 17276 - RNA, 64 nt, Human
ucauccuuggagagacugagcacucagcaccuucagccacgauuucaggaucgcuuccuuguga

SEQ ID NO: 17277 - RNA, 64 nt, Human
gugaagccagcauguucaccacuggucguucagcagccacgacagcaccaugugagauggcgag

SEQ ID NO: 17278 - RNA, 64 nt, Human
uuauacaccagugugugccugcagcagccuccacagccacgauggguuuguuucuguuuucuug

SEQ ID NO: 17279 - RNA, 64 nt, Human
cacuuugcaccuccuauccccaggguccgccgagagccacgauuuuuuacagaaaaugagcaau

SEQ ID NO: 17280 - RNA, 64 nt, Human
uguguaaauaauuugcacugaaacguggauacagagccacgaguuuggauguuguaaauaaaac

SEQ ID NO: 17281 - RNA, 64 nt, Human
agccaaugauccccccucaggacaaaucuacuccagccacgaugagaagugggugagccagggu

SEQ ID NO: 17282 - RNA, 64 nt, Human
cccagaguucuucgcuccacucacucaaaaucagagccacgaugacccaaaggauaagaaagaa

SEQ ID NO: 17283 - RNA, 64 nt, Human
agaagaagcagcagaaggagcaggagcaagugagagccacgagccaaggugggcacuugauguc

SEQ ID NO: 17284 - RNA, 64 nt, Human
cggagggggcugugcacauaccaguuacuuaagcagccacgagugucccccaugccuuggugcg

SEQ ID NO: 17285 - RNA, 64 nt, Human
agugcugggaucacaggcaugagccacugugcccagccacgagcugcuuuuuauccaccuuccg

SEQ ID NO: 17286 - RNA, 64 nt, Human
gaaugaaagagcggagacgguaguuuaguauuugagccacgaguuuaugugcacaaguguuuug

SEQ ID NO: 17287 - RNA, 64 nt, Human
gggaacauuaaaacaguaacugacauccaguuaaagccacgaucgucagcaauucuccuuuuuu

SEQ ID NO: 17288 - RNA, 64 nt, Human
agccacuguccgucuuuaaacagaaagucaaaggagccacgaagcaagcggccguccgggcguc

SEQ ID NO: 17289 - RNA, 64 nt, Human
ugccagcuggaggugaaacugugcuuguauccccagccacgaagagcuggaccagcuucaagua

SEQ ID NO: 17290 - RNA, 64 nt, Human
cugggguaugggaugagcauggagaagaggcaccagccacgauuccuuccuaagcaucuccugu

SEQ ID NO: 17291 - RNA, 64 nt, Human
cagugcaauacgggagugacccagcuacugaaccagccacgaacagcccgccagaggccugaag

SEQ ID NO: 17292 - RNA, 64 nt, Human
ggcagagacgcaguugucucugggcgcuugccagagccacgaaccccagaccuguuuguaucau

SEQ ID NO: 17293 - RNA, 64 nt, Human
ggaaaccacagcauuaucacagcauuauugugacagccacgaacccauugcccacaaccccucc

SEQ ID NO: 17294 - RNA, 64 nt, Human
ggcccccgcgcgcucuagugcccccgcacgcgggagccacgaaccucggggugggggugggcag

SEQ ID NO: 17295 - RNA, 64 nt, Human
cuccagguaggcccguuuucacguggagcaugggagccacgacccuucuuaagacauguaucac

SEQ ID NO: 17296 - RNA, 64 nt, Human
ggcagcaggccccgauaccgggaagagccgacacagccacgaaccagacaagcagacaaucagc

SEQ ID NO: 17297 - RNA, 64 nt, Human
auuacacaucaagcgaugaaacuggaaaacuacaagccacgaaugaaugaauuaggaaagaaaa

SEQ ID NO: 17298 - RNA, 64 nt, Human
aaaacacaagacccuccgcccgaguaaauucuucagccacgaagggauggaugugcaucugccc

SEQ ID NO: 17299 - RNA, 64 nt, Human
ucaggggaggccagaggagagcugcugggccccgagccacgaacuugcugggugguucucuggg

SEQ ID NO: 17300 - RNA, 64 nt, Human
gucucgguuauccaccccuaccucccagugucuaagccacgaauaaugguaugcuguugcugau

SEQ ID NO: 17301 - RNA, 64 nt, Human
cuggcaggaugaaucgcaggauggcgcguacugaagccacgauguucauccaggccaaagcagg

SEQ ID NO: 17302 - RNA, 64 nt, Human
uuaacguuuucauuaaaauuuuuuuuguaacuggagccacgacguaacaaauauggggaaaaaa

SEQ ID NO: 17303 - RNA, 64 nt, Human
agguaaaugccugcacccauaauuuucuaguaauagccacgaccaauuuauuaacagucagggc

SEQ ID NO: 17304 - RNA, 64 nt, Human
ggucagggccuacagcuguguuguccaguacaggagccacgagccaaauguggcauuugaauuu

SEQ ID NO: 17305 - RNA, 64 nt, Human
gaaugauuggucauggggaagucucugcgccauaagccacgaucccagcgcaaaacccuuacuc

SEQ ID NO: 17306 - RNA, 64 nt, Human
cacaucaauaaacaugacacucugaagugaaaguagccacgagaauugugcuacuuauacuggu

SEQ ID NO: 17307 - RNA, 64 nt, Human
ggugcccacaggccgcccugcgggugaacaaagcagccacgaggugcaacaagguccucuguca

SEQ ID NO: 17308 - RNA, 64 nt, Human
uguauuuucacuggagacgggguuucacuguguuagccacgauggucuccaucuccugaccucg

SEQ ID NO: 17309 - RNA, 64 nt, Human
ggcagcaagggaccugcucaucauauuccaacccagccacgacugccauguaagguugugcagg

SEQ ID NO: 17310 - RNA, 64 nt, Human
aaacugcgucucggaugucugucuuuugccucgaagccacgauggaucgcugguuuccucugca

SEQ ID NO: 17311 - RNA, 64 nt, Human
gaaucagaguagaggacauggcugucuucuaaaaagccacgacaugaaaaugacaaucccuuuc

SEQ ID NO: 17312 - RNA, 64 nt, Human
uccguccaccccugcaaagccaagacccuucugcagccacgaauguccacggagcccgccggca

SEQ ID NO: 17313 - RNA, 64 nt, Human
cccccuuauuauuuugacgguuuuuuuuuucggggcaggggaccuuaccuguaagacuuuuaaa

SEQ ID NO: 17314 - RNA, 64 nt, Human
agggggaagacaagaugucauccuuggaaacccugcaggggacaguuuuuccaggguggccuau

SEQ ID NO: 17315 - RNA, 64 nt, Human
ugucagccugaagaucagagcugcagccagucaggcaggggagagauuuuucuuuuaagcccug

SEQ ID NO: 17316 - RNA, 64 nt, Human
ucuccugaagugucucaaguauaccagugggagugcaggggaggagcacaggccuucagauggg

SEQ ID NO: 17317 - RNA, 64 nt, Human
ugcuuuccaaaguagcccagguccugggccagaugcaggggaggugccuauccaugagugaagg

SEQ ID NO: 17318 - RNA, 64 nt, Human
gcugacugaguacaccggugaggcuggggucucugcaggggaggucacuggaacagcgagcaag

SEQ ID NO: 17319 - RNA, 64 nt, Human
ucuuuggugagacuucccuggauggagagcagcagcaggggaagaggugcucucagagacagca

SEQ ID NO: 17320 - RNA, 64 nt, Human
uaauccuuucuccaucaagaguuacuuaccaagggcaggggaagggggauauagaggucacaag

SEQ ID NO: 17321 - RNA, 64 nt, Human
cugccucaagaagcugaugguggcacuucaauuugcaggggacucaaagcaggauuucagguaa

SEQ ID NO: 17322 - RNA, 64 nt, Human
uguuguuaaugcagagaacaaacucuguuuaguugcaggggaaguuugggauauaccccaaagu

SEQ ID NO: 17323 - RNA, 64 nt, Human
aggggaacaugaaaagagacuaggugaagagagggcaggggagcccacaucuggggcuggccca

SEQ ID NO: 17324 - RNA, 64 nt, Human
ggugauucaaagguuaauagaggcugaggagauugcaggggaaacacccuugcugcauccccaa

SEQ ID NO: 17325 - RNA, 50 nt, Human
uuggagaaguagaucggugagcaggggagcagcguuugauccccccugcc

SEQ ID NO: 17326 - RNA, 64 nt, Human
cucugggcuauaugccuauauuuauaaaccagcagcaggggaaagauuauauuuuauaagaggg

SEQ ID NO: 17327 - RNA, 64 nt, Human
cgaagaaacaaaaucuuaaaggcuaugguuuauugcaggggauugggaggggggcgggaaaaca

SEQ ID NO: 17328 - RNA, 64 nt, Human
uccugugcaaugaaggugauaacaguaaaagaaggcaggggaaacuuacguuggaugacauuua

SEQ ID NO: 17329 - RNA, 64 nt, Human
ggaaaggggcguauuaacgguccuuugcuuccccgcaggggagaaaaagcuugacgaacuucac

SEQ ID NO: 17330 - RNA, 64 nt, Human
ggcugggagaaggugcuugggcuucugcggugaggcaggggagucugcuugucuuagauguugg

SEQ ID NO: 17331 - RNA, 64 nt, Human
cacacccguaaucccagcacuuugcggggccgaggcaggggaacacaaggucaggagaucaaga

SEQ ID NO: 17332 - RNA, 64 nt, Human
ucguuccucauugccucgggcugcgucaggggaagcaggggacagguguccaguugcugggccg

SEQ ID NO: 17333 - RNA, 64 nt, Human
agacagugucauggugcagagguaggcauucugagcaggggaacaaaauaagggccuagaaacu

SEQ ID NO: 17334 - RNA, 64 nt, Human
cgugggugugcagugcccagcacgggacccggcugcaggggaccuucaauaaacacuuguccag

SEQ ID NO: 17335 - RNA, 64 nt, Human
acuuggagccuccagugugcgucagggucugugggcaggggacagggcgugggugggggccgag

SEQ ID NO: 17336 - RNA, 64 nt, Human
ggugcugggcccuggcaggaaugggccaagccaagcaggggagacuagagagcaccaauggcca

SEQ ID NO: 17337 - RNA, 64 nt, Human
ccaggauugugcaauagucagagugucccuuuuugcaggggacugggccauggguccucggccc

SEQ ID NO: 17338 - RNA, 64 nt, Human
ccccugcccaacccucauccccaucuucucaggggcaggggacuaccuuccagugucucccucc

SEQ ID NO: 17339 - RNA, 64 nt, Human
gugucuuugggccacugcucaacuucccccuccugcaggggauccggguccaugggauggaggc

SEQ ID NO: 17340 - RNA, 64 nt, Human
agagagguuguauuuaccuucccaagguuggaaagcaggggaauuucccaguguccuaguuuuc

SEQ ID NO: 17341 - RNA, 64 nt, Human
agggugggagcaggaaaugauugcugagcccggggcaggggaauugcaucugcaggaaagagau

SEQ ID NO: 17342 - RNA, 64 nt, Human
caccugugaccaaggcuuauguggucaggacugagcaggggacuggcccuccccuccccacagc

SEQ ID NO: 17343 - RNA, 62 nt, Human
gaaaggaaccgagcuuguagguacccggcggggcaggggauggggugggguaccggauuucg

SEQ ID NO: 17344 - RNA, 64 nt, Human
uuacucaaaccugcaggaaucagccuauuaacaggcaggggaaacgguacuuuccaaugaaugg

SEQ ID NO: 17345 - RNA, 64 nt, Human
cagaggaguaagagaggaagaugcuuaccagugggcaggggacccccaaagaggagccagcccu

SEQ ID NO: 17346 - RNA, 64 nt, Human
uccagugaagcccuguucugagaacgagcagacugcaggggaggccaugggauuccccaggcca

SEQ ID NO: 17347 - RNA, 64 nt, Human
caugcucccuaccuguccccucacagggaggggagcaggggagggaaagaaaccaggcaucugg

SEQ ID NO: 17348 - RNA, 64 nt, Human
uccugggucccauccagggaccuaagagaaaguagcaggggaagguuugguguguggggguggg

SEQ ID NO: 17349 - RNA, 64 nt, Human
ccaggcuccuccuagacucugucccugggcuagggcaggggaggagggagagcaggguuggggg

SEQ ID NO: 17350 - RNA, 64 nt, Human
ucuucauccaaaucuagggggcuucaagagaggggcaggggagauugaugaucaggugccccug

SEQ ID NO: 17351 - RNA, 64 nt, Human
cugaaccugagggagacaacggcagagggagugagcaggggagaaauagcagaggggcuuggag

SEQ ID NO: 17352 - RNA, 64 nt, Human
cacuaaccucugcuuggacaaguuucucuuaacugcaggggaaugaagauuucuaguccucgac

SEQ ID NO: 17353 - RNA, 64 nt, Human
uccuucauacuuuguugggggacuuuggaggcgggcaggggacagggcuauugauaaggucccc

SEQ ID NO: 17354 - RNA, 64 nt, Human
ccagggagcugcaggggcaugggaaggugggcgggcaggggagggucagccagggccugcgagg

SEQ ID NO: 17355 - RNA, 64 nt, Human
uuacauucaaguuaaaaaggcugauaugaacagggcaggggaaaaucuuaggaugguuguacaa

SEQ ID NO: 17356 - RNA, 64 nt, Human
agaggagagggcauccccuuuccagggagguaaagcaggggaccagagcgcccccucguguaug

SEQ ID NO: 17357 - RNA, 64 nt, Human
ucauggugggugccuccaggugauguggacuggagcaggggaguuuugucuggaaucuggggac

SEQ ID NO: 17358 - RNA, 64 nt, Human
aaaauuuuaacaacgcacaaaaaaauacagaacugcaggggauuuuaucuuggaucauuaucca

SEQ ID NO: 17359 - RNA, 64 nt, Human
gcauuccugcucauucccucugcuuagcuggugggcaggggagagagggaaaugccaaaaacuu

SEQ ID NO: 17360 - RNA, 64 nt, Human
aacauucaugaauucacaaaaauauguuacuauggcaggggaacauuuuguacacauuuaagua

SEQ ID NO: 17361 - RNA, 64 nt, Human
aagccucaaagaagcauuugcugaggauggagaggcaggggagggaggcgggaggccgucacug

SEQ ID NO: 17362 - RNA, 64 nt, Human
cucaggaagaguagaaauuggguggugcuccucagcaggggaagguggauguuuaggcuugggc

SEQ ID NO: 17363 - RNA, 64 nt, Human
cuggaugucaccaagaaggggcucgagugccccugcaggggaggguccaaucuccggugugagc

SEQ ID NO: 17364 - RNA, 64 nt, Human
ugaaaugacuggauugcucuuuauccagcccacagcaggggaaagaaaggcaacucgcaaagau

SEQ ID NO: 17365 - RNA, 64 nt, Human
aaguucaaggcaaaauaguauuuucuauuacugugcaggggaaagggauggaucgauacaugca

SEQ ID NO: 17366 - RNA, 64 nt, Human
ccccuggaagcagcauugugugauauucucagaggcaggggaaaauagagggaaaaauagagac

SEQ ID NO: 17367 - RNA, 64 nt, Human
cagggccacaggguugcuuucugucuuugguggggcaggggaguugacagggaugaggguccaa

SEQ ID NO: 17368 - RNA, 64 nt, Human
cccucacacgugagaaccaugaacaagcgcaagggcaggggaauguacugaaaggagccugcuc

SEQ ID NO: 17369 - RNA, 64 nt, Human
cucuuuugucuuggucgcugcuucuagaaucuaugcaggggauagcagugaggucagaagucuu

SEQ ID NO: 17370 - RNA, 64 nt, Human
gaacaaggacacagacauucccucaguguggggggcaggggacacagggagaggaugguugucc

SEQ ID NO: 17371 - RNA, 64 nt, Human
ggaccaagcaucuuggggggguggccgcugaguggcaggggacaggaguccacuuuguuucgug

SEQ ID NO: 17372 - RNA, 64 nt, Human
ugagaacagaaagugcaauauuuccuuucaccuggcaggggaggggggauuuauuucugaaaga

SEQ ID NO: 17373 - RNA, 64 nt, Human
uuguugucucuagccugaucagauaggagcacaagcaggggacggaaagagagagacacucagg

SEQ ID NO: 17374 - RNA, 64 nt, Human
aagucucagugccagaacauaagcccugaagugggcaggggaaauguacgcugggacaaggacc

SEQ ID NO: 17375 - RNA, 64 nt, Human
agaggaaggcgauacucucgcucacgcagcaggagcaggggacgaaggugagaucuuguuuaac

SEQ ID NO: 17376 - RNA, 64 nt, Human
uggcacaccagcucagacaggggccugcgcagcugcaggggacagacgccaaucacugucacag

SEQ ID NO: 17377 - RNA, 64 nt, Human
ccucucaguguguccaggauggcauucccagaaugcaggggagagcaggaugccggguggagga

SEQ ID NO: 17378 - RNA, 64 nt, Human
gcccuuuucuccuaugcacaccaggauagacaaggcaggggauacuggcagccugcaucauccu

SEQ ID NO: 17379 - RNA, 64 nt, Human
aagcaggcugcagggcauuccagccaagggcacagcaggggacagugcagggagguguggggua

SEQ ID NO: 17380 - RNA, 64 nt, Human
uuucuuuucaggugacauccugaggggccuguaagcaggggagcuccuuuuucuaguuugccug

SEQ ID NO: 17381 - RNA, 64 nt, Human
ugggccaagcucugggggcagguggagagggcgggcaggggagagacccagcggcacugaucgc

SEQ ID NO: 17382 - RNA, 55 nt, Human
cacauuccccuaagaccuaaauuaugcaggggagaacccuacauggaaucauauu

SEQ ID NO: 17383 - RNA, 64 nt, Human
cuccuuuuggauugaggcuauguacuuggugggggcaggggagggaauauauuauaauacuauu

SEQ ID NO: 17384 - RNA, 64 nt, Human
cuguccaaagauuaggguuggugguggcagugcagcaggggagggacaaacaaccaagcuaugg

SEQ ID NO: 17385 - RNA, 64 nt, Human
ggugccuguaaucccagcuacucagggggcugaggcaggggaauggcuugaacccaggaggcag

SEQ ID NO: 17386 - RNA, 64 nt, Human
gcugaccagacuaaacucccaaccccagaccagggcaggggacaggucucaaguccuucccagc

SEQ ID NO: 17387 - RNA, 64 nt, Human
gaagucucuuccuuucugggcuuuguuagucagagcaggggaucagaggagacugaagcagaaa

SEQ ID NO: 17388 - RNA, 64 nt, Human
ucauguagugauaauugcuguggagaaaaauaaagcaggggagggaguaagaaauccuggagau

SEQ ID NO: 17389 - RNA, 64 nt, Human
ccacuucuagccagagccacuugcagacaucacggcaggggaugaggagccgggguugcugcug

SEQ ID NO: 17390 - RNA, 64 nt, Human
gagccccaguggugagaagacuuccccaagccuggcaggggauccagcucaagggaguaaguag

SEQ ID NO: 17391 - RNA, 64 nt, Human
agcuucucuugccccuuccauucaggguucccuggcaggggaagcugagagccauggcugaacu

SEQ ID NO: 17392 - RNA, 64 nt, Human
ccccugauccagacaagugggagagcccgugggggcaggggaccuggagcugccagcaccaagc

SEQ ID NO: 17393 - RNA, 64 nt, Human
caggcccacccaacugaaggcauggcggcggggugcaggggaaaguuaaaggugaugacgauca

SEQ ID NO: 17394 - RNA, 64 nt, Human
ugcacccuuuuguauuaaacacugcaagggugaugcaggggagcaggaaagccauccuaaacuc

SEQ ID NO: 17395 - RNA, 64 nt, Human
uaucacacguggccuugucuagacccaguccugagcaggggagaggcucuugagaccugaugcc

SEQ ID NO: 17396 - RNA, 51 nt, Human
cucuggacaggacaugcugaggcaggggacaguguccccugcuaccgcccg

SEQ ID NO: 17397 - RNA, 64 nt, Human
gcagucucuaaaaacuacccacagcagcauuggugcaggggaacuuggccauuagguuauuauu

SEQ ID NO: 17398 - RNA, 64 nt, Human
ggcaaauacaaaccgccccguggccugcaggccugcaggggaggcagcaaagggaccuggcagu

SEQ ID NO: 17399 - RNA, 64 nt, Human
gugggaccgguggagcagccccugggcucccugggcaggggaguucugaggcuccugcucuccc

SEQ ID NO: 17400 - RNA, 64 nt, Human
aagccccucagggcccagaccuuccugcucuccagcaggggauccccacaaccucacacuuguc

SEQ ID NO: 17401 - RNA, 64 nt, Human
gggaguguauauaaaacuugcuuuauugcauggggcaggggaaguccaggccuaauacuccuaa

SEQ ID NO: 17402 - RNA, 64 nt, Human
gcuguccucccuucccugcagcuccagucagugugcaggggacucaggggcuuggcccuaagaa

SEQ ID NO: 17403 - RNA, 64 nt, Human
gaggccagcugaguaggcagccuggugagggggggcaggggaugggcaggagggugggagagug

SEQ ID NO: 17404 - RNA, 64 nt, Human
cagucugaagagcucuauacagguacuaagacuagcaggggacaccaagacucugcacaaccag

SEQ ID NO: 17405 - RNA, 64 nt, Human
ggccggugcccggcucauggucugggggaugcaggcaggggaagggcagagauggcuucucaga

SEQ ID NO: 17406 - RNA, 64 nt, Human
aagagugggaacagguggggucaggggccagagugcaggggagggggcaaugguggagguggcg

SEQ ID NO: 17407 - RNA, 64 nt, Human
ggaggcuaccuguggaauggcugagccugguucugcaggggaggaaggcugccaggagcugagg

SEQ ID NO: 17408 - RNA, 64 nt, Human
guucacucugcacccugaugugggaggcuuuggcgcaggggacacuuucaggaaagggaggagc

SEQ ID NO: 17409 - RNA, 64 nt, Human
gucagcaaaaagcaaaaucauuuuauaugucaaagcaggggaguaugcaaaaguucugacuuga

SEQ ID NO: 17410 - RNA, 55 nt, Human
ccgugugcuucccaagcugaggcgggcaggggagccggaccagggaggacggugg

SEQ ID NO: 17411 - RNA, 64 nt, Human
acugggaggauggaggacggagcugcagacgaaggcaggggacccauggcgaggaggaauggcc

SEQ ID NO: 17412 - RNA, 64 nt, Human
ugaccgcgggugucacgggcauuucucaaaggaagcaggggauucagugagugugaaggugaac

SEQ ID NO: 17413 - RNA, 64 nt, Human
cccagagacccggggauggauuggccuccagggcgcaggggagggugcggcagggcaggagcuu

SEQ ID NO: 17414 - RNA, 64 nt, Human
cucauuuuuaaacagggauaauaaaacuaauauugcaggggaguuacaggguuaaauaagaucc

SEQ ID NO: 17415 - RNA, 64 nt, Human
auccaagcaaauggccaaugagaucauugugaaggcaggggaauguaugugcacaucuguuuug

SEQ ID NO: 17416 - RNA, 64 nt, Human
gcugcaggggccaacaagaggucagcuuugcccagcaggggacccggaggagccugguggcugc

SEQ ID NO: 17417 - RNA, 64 nt, Human
cagccaccuccuaucaaucaaucagggaagaaaugcaggggagacuggggcccucagugagggg

SEQ ID NO: 17418 - RNA, 64 nt, Human
ccuccaccugugagauccgugaauucucggaauggcaggggaagccuugcacuagguugcagag

SEQ ID NO: 17419 - RNA, 64 nt, Human
ugacauauauagaguuuaauuuuacggucccuccgcaggggagcggccuccagccuuauucucc

SEQ ID NO: 17420 - RNA, 64 nt, Human
cauaucuguaauccuaacacuuugacaggccaaggcaggggaauugcuugaguucagaaguuug

SEQ ID NO: 17421 - RNA, 64 nt, Human
cccucugcagacugccccgcggccucggccaccggcaggggaaccgagaccagcaccccgcacg

SEQ ID NO: 17422 - RNA, 64 nt, Human
acuuuuguaaguuuuuauuguguaaguuuauaaugcaggggaaguacuacuccucaaauguuga

SEQ ID NO: 17423 - RNA, 64 nt, Human
uugauuauucugcaaaagugauuagaacuaagaugcaggggaaauugcuuaacauuuucagaua

SEQ ID NO: 17424 - RNA, 64 nt, Human
acuaacagagggggagccagggaugauggggugggcaggggauuugcaugaugaggaguaucau

SEQ ID NO: 17425 - RNA, 64 nt, Human
ggcaccuggauacccugggccagguaaccugagggcaggggagaggugggguggcagacacgca

SEQ ID NO: 17426 - RNA, 64 nt, Human
acagccuggaauggggaaggccugggguggaaaggcaggggagggaggguguguguagguaugu

SEQ ID NO: 17427 - RNA, 64 nt, Human
gagcuuggucaaacugcuuuuguuucaacugcaggcaggggagcaaaaggacgccaugugagca

SEQ ID NO: 17428 - RNA, 64 nt, Human
agugcuagucucagauaggugcuuccccugaggugcaggggaagaccaaaguuugcaacucgaa

SEQ ID NO: 17429 - RNA, 64 nt, Human
aaagucauugcucuggagaauuaggagggauggggcaggggacuguuaggaugcauuauaaacu

SEQ ID NO: 17430 - RNA, 64 nt, Human
ugacuacaacaugcaucaugcucauggggagggagcaggggaagguuguaugugucauuuauaa

SEQ ID NO: 17431 - RNA, 64 nt, Human
uagcaaauugcucaugcugaaauuucuggcauaagcaggggaagucuugugucuggagaauagu

SEQ ID NO: 17432 - RNA, 64 nt, Human
uucagcugccuggaggccagaaggaaagggcagugcaggggaggccugagcccgacuuagccag

SEQ ID NO: 17433 - RNA, 64 nt, Human
uguuggggaaggcggggcaggcagccuguugcaggcaggggaaggagaagagacugaggggcug

SEQ ID NO: 17434 - RNA, 64 nt, Human
aaaaaagagucuauuuuaguguuaggaagccccagcaggggagucggaagagcuuggaagagcu

SEQ ID NO: 17435 - RNA, 64 nt, Human
uguucugcccagucccgucauucugggcuagaaggcaggggaccuuggcauguggcuggccaca

SEQ ID NO: 17436 - RNA, 64 nt, Human
ccacagggcaccagggaugauccugauguggcaggcaggggagacucacagaaaaaucugccca

SEQ ID NO: 17437 - RNA, 64 nt, Human
ucggugccugucaacugcuuuucagcaguggacugcaggggaaagagcagugauuuggggugag

SEQ ID NO: 17438 - RNA, 64 nt, Human
gcguggcauccuccuaggggcugagaggugagcagcaggggagcgggcacaguccccucugccc

SEQ ID NO: 17439 - RNA, 64 nt, Human
cagacaaccuuugaauugugccuacuaaauuauagcaggggacuuuggcacccaaggaguucug

SEQ ID NO: 17440 - RNA, 64 nt, Human
aacugguuaggaaagcccagggggaagggagggggcaggggaggaggcaauucugaaugaauga

SEQ ID NO: 17441 - RNA, 64 nt, Human
accccgaggcaggagagugacuguggccaaccgagcaggggaacaggggcuuuggacuccugag

SEQ ID NO: 17442 - RNA, 64 nt, Human
uacauggauggcagcaggcaaagagagaacuugugcaggggaacucuuuauaaaaccguccgau

SEQ ID NO: 17443 - RNA, 64 nt, Human
gguugcauucuucccucuggacuagaguagaaaugcaggggaaacugcuguggauuugagaggc

SEQ ID NO: 17444 - RNA, 64 nt, Human
caaguguauaagcaucccuugaagagggauuggggcaggggaggcagaaggggcucuccagacc

SEQ ID NO: 17445 - RNA, 64 nt, Human
gcauguuucaucccaacaaucagacugugccaaagcaggggacuuuguccuuuguggauugcau

SEQ ID NO: 17446 - RNA, 64 nt, Human
agggacaaggcccagggaagaguguauuuggggagcaggggaggggaggguguugagaaagcug

SEQ ID NO: 17447 - RNA, 64 nt, Human
guuaccggcuggagagccggaggugggaccgggagcaggggaccguagaaccgggccgcgcucc

SEQ ID NO: 17448 - RNA, 64 nt, Human
gccgugaggagggagcccgcucaggauggccugggcaggggaggacaucucuagagggaagcuc

SEQ ID NO: 17449 - RNA, 64 nt, Human
caaggcuggggcauggcaaaucaggggccagagagcaggggagcuugggacucaggucuguaac

SEQ ID NO: 17450 - RNA, 64 nt, Human
gaucuuggagaugggugggcaggugauucugugggcaggggaugugcuccccugcaccucuggg

SEQ ID NO: 17451 - RNA, 64 nt, Human
guuuauuuccacauagauguuaaugauguucaaagcaggggagaagaauuauucaauuucauga

SEQ ID NO: 17452 - RNA, 64 nt, Human
gagcaagcucgcuuuuuaaaaaugaaauuugggggcaggggaaggggaggcgggagggagggga

SEQ ID NO: 17453 - RNA, 64 nt, Human
guaaaauauauaauugaaucagaguaaucauaaugcaggggagacauucaaauuagagacaagg

SEQ ID NO: 17454 - RNA, 64 nt, Human
ugaaaacagauaaauguaacaaccagucaaagaagcaggggaaaaguaagcuccuccaaaguug

SEQ ID NO: 17455 - RNA, 63 nt, Human
aggaccucuuacacaucugacuccgcagugccugcaggggagcacggagccgcgggacagcca

SEQ ID NO: 17456 - RNA, 64 nt, Human
caagccugauacgcaucugggcccgccgggcucagcaggggaggcugcuacggcugcccacuuc

SEQ ID NO: 17457 - RNA, 64 nt, Human
uguuggagcagguagcuagucagacaugagcagggcaggggagggcccccucaccaggaauguc

SEQ ID NO: 17458 - RNA, 64 nt, Human
cacagauugagaaccucggggacuugagccuucugcaggggauguccacagagagggaagggcc

SEQ ID NO: 17459 - RNA, 64 nt, Human
ggccaguagggggagggaaagggagaggggaagggcaggggacucaggaagcagggggucccca

SEQ ID NO: 17460 - RNA, 64 nt, Human
uggggggacgggaugccuggccuaagcaccuggagcaggggaccccauauccacugguagccac

SEQ ID NO: 17461 - RNA, 64 nt, Human
acuaaggaaggaauugggaacacaaagggugggggcaggggaguuuggggcaacugguuggagg

SEQ ID NO: 17462 - RNA, 64 nt, Human
ugcgguguugggagagucuuuguguuggggaguggcaggggaugauuuguuucaggggaaaaug

SEQ ID NO: 17463 - RNA, 64 nt, Human
cucggagcugcagaccccagggcucuugguggaggcaggggaacccugagagugcuguuuacag

SEQ ID NO: 17464 - RNA, 64 nt, Human
ggauucuuuaaucauggagcaagagaauuucaaggcaggggauuuuaucccccaccaaaaacac

SEQ ID NO: 17465 - RNA, 64 nt, Human
agguguuuucucaguaucacagaccagcucugcagcaggggauuggggagcccaggaggcagcc

SEQ ID NO: 17466 - RNA, 64 nt, Human
uuuuauggaaacucugagaagcugaaugauacaugcaggggauauuuuuugagaugauuuaaau

SEQ ID NO: 17467 - RNA, 64 nt, Human
cccaccguuggagcccagcugccuguuuucuuuugcaggggaucugggcaccugugccuugagg

SEQ ID NO: 17468 - RNA, 64 nt, Human
gugcaaaauuuuaguaucagaaaauacgagauuugcaggggaaacaucaguaaacuaccauuaa

SEQ ID NO: 17469 - RNA, 64 nt, Human
uuguucugugaucauagaaaggguauuuuaggcugcaggggagggcagggcuggggaccgaagg

SEQ ID NO: 17470 - RNA, 64 nt, Human
agccccaaguacgacucacugagccaugcucauugcaggggaggcugggucugggggugcguga

SEQ ID NO: 17471 - RNA, 64 nt, Human
gguacaguauauggggauuguuucguuuuuccuagcaggggaaccuuaguuaauaauaaaauac

SEQ ID NO: 17472 - RNA, 64 nt, Human
gcccccagguucaagguguuggcgggggcggagggcaggggaacgggauccuucucccgcugcc

SEQ ID NO: 17473 - RNA, 64 nt, Human
cagcacacuaacucuggguggcuguccccaccgugcaggggagggaguccgcagccucccuuca

SEQ ID NO: 17474 - RNA, 64 nt, Human
cuuuuagcccacugaugcuuacuuaggccggagagcaggggacacggugcuagguucccucgug

SEQ ID NO: 17475 - RNA, 64 nt, Human
gguaggguggcugcugagaugcaggucggaagaggcaggggaaggcuccaggccuaacuuggag

SEQ ID NO: 17476 - RNA, 64 nt, Human
uccugcucacaauaaagccggggccgagcagcuggcaggggaggccaaucccucccuccccucc

SEQ ID NO: 17477 - RNA, 64 nt, Human
auuacaaguccucuuuggguguaggagggggugggcaggggacaaguccaggaggggucccagg

SEQ ID NO: 17478 - RNA, 64 nt, Human
cgcuguuggcgacagcagcgcugugauucgcguagcaggggaguuguuugaaacaccuuccuga

SEQ ID NO: 17479 - RNA, 64 nt, Human
aaacagcccuagacaggugcuggccucaacccuggcaggggagggggagcccagagugauguuu

SEQ ID NO: 17480 - RNA, 64 nt, Human
uggacaggcagggagaugcaugcgagugcaugcagcaggggauggggccguguccgugugcccc

SEQ ID NO: 17481 - RNA, 64 nt, Human
ggcccaggucuucagggugaggcugcuggcgagggcaggggagagggggcauucugguuaaaag

SEQ ID NO: 17482 - RNA, 64 nt, Human
aucuggucucagaaauggaccagcuggaugcagggcaggggacugagggugcuugaguaggaug

SEQ ID NO: 17483 - RNA, 64 nt, Human
acccggccugcggagggaggggacagcuggacccgcaggggaggucccuuucuuccugaccacc

SEQ ID NO: 17484 - RNA, 64 nt, Human
aggggccggcuguuuccugacagaugccuggugagcaggggaagcaggacccaguggucagcag

SEQ ID NO: 17485 - RNA, 64 nt, Human
aggugagcugcccuggggguucacuggaguugaggcaggggacaguagucuccccugccagccu

SEQ ID NO: 17486 - RNA, 64 nt, Human
aguggaccuggcaaccacaagacccuccccauaagcaggggaccagcauacccgggagcugucc

SEQ ID NO: 17487 - RNA, 64 nt, Human
agccaggucugguccguggugucccccgcacccagcaggggacaggcacucaggagggcccggu

SEQ ID NO: 17488 - RNA, 64 nt, Human
caggcagccugagagcuggcccagggguccccuggcaggggaaacucuggugccggggagggca

SEQ ID NO: 17489 - RNA, 64 nt, Human
gguagaccaggugcucagcccaggcacaacuucagcaggggauggcgcuaggggacuuggggau

SEQ ID NO: 17490 - RNA, 64 nt, Human
guuuccucaggaggaaaugggcaaggcagaguaagcaggggagacagguuuaaggguagcuggc

SEQ ID NO: 17491 - RNA, 64 nt, Human
uccgaguuugcagggugcugagcuguaugguccagcaggggaguaauaagggcucuucuggaag

SEQ ID NO: 17492 - RNA, 64 nt, Human
caaaccuguagucguagcuacuugggaggcugaggcaggggaaucacuugaaccccggaggcgg

SEQ ID NO: 17493 - RNA, 64 nt, Human
uuuugaucagagaauuuuggaaaguaccaaagaagcaggggaaucauuggccaguguuacguuu

SEQ ID NO: 17494 - RNA, 64 nt, Human
uggcccggaaccaaggugggccaagguccgccuugcaggggaggccuggcugcagagaggcgga

SEQ ID NO: 17495 - RNA, 64 nt, Human
uuuguaaaauuuuaaaugcauaaaggggguuggggcaggggaaccacgaaguaguuaauuuuag

SEQ ID NO: 17496 - RNA, 64 nt, Human
gcccaccaggacuuuugagcuggggcugacuccugcaggggaagcccugguccagcugggugcc

SEQ ID NO: 17497 - RNA, 64 nt, Human
ucucccuugucaugcugggcagcacaccggcuaagcaggggagcagagcaccaggccgggcgcc

SEQ ID NO: 17498 - RNA, 64 nt, Human
augugcuuucuaaucuccugccagcucuucucaagcaggggauccugggagauguaguuuucag

SEQ ID NO: 17499 - RNA, 64 nt, Human
ccugccugggagucucccugccucacuccucuaggcaggggagugaugcuucaggacgugacag

SEQ ID NO: 17500 - RNA, 64 nt, Human
cuaccccagccuccucagaacaggggugaccacugcaggggagacugccccuaaccugugucuu

SEQ ID NO: 17501 - RNA, 64 nt, Human
gcuaagacuggcagcuggguugguguguuagcgggcaggggagccauugugggguccccaggaa

SEQ ID NO: 17502 - RNA, 64 nt, Human
gaacuggauguguucuauugaugaccugugcucugcaggggaaaccagaaggcaaaaugcuggc

SEQ ID NO: 17503 - RNA, 64 nt, Human
ucacugccgacaucccucccccagcagaauggaggcaggggacaagggaggcaguggcuagugg

SEQ ID NO: 17504 - RNA, 64 nt, Human
uuguugcuauuccccacagcuggaugccaccucugcaggggagaaggcucccuccccauggggc

SEQ ID NO: 17505 - RNA, 52 nt, Human
gcucuccagggagcgauuaggggcaggggacaccuuggcuccucagcagccc

SEQ ID NO: 17506 - RNA, 64 nt, Human
aaaccagccucagaucagggcccugccacccagggcaggggaucuucugccggcugccccagag

SEQ ID NO: 17507 - RNA, 64 nt, Human
ggccuaugccauuucuguuguaguuuggggcagugcaggggaccuguguggggugugaaccaag

SEQ ID NO: 17508 - RNA, 64 nt, Human
uguguauccgcagucacagcagaaagccaugagagcaggggaaacaaggggcuucgagcacgcu

SEQ ID NO: 17509 - RNA, 64 nt, Human
uaggggaacaaggggauucaggagaaaccaggcagcaggggaugaaauacaugaauaaagagag

SEQ ID NO: 17510 - RNA, 64 nt, Human
gcggccuccacaccugaacuugccuaacuaacuggcaggggagacaggagccuagcggagccca

SEQ ID NO: 17511 - RNA, 64 nt, Human
aaaggcuugggaaaugaggggagguggaggcagggcaggggaagcgaagagucagccuuggaga

SEQ ID NO: 17512 - RNA, 53 nt, Human
agcuugagccagagcgaugacgggcaggggagccacacauacucacagccccc

SEQ ID NO: 17513 - RNA, 64 nt, Human
uccuauucaucuggaaggagggaggcuuggaugagcaggggaugagagcugcagggaaauaaau

SEQ ID NO: 17514 - RNA, 64 nt, Human
uguuuuugcccuguuuugauuuuggucccacagagcaggggauguaguuuguacccaccauggc

SEQ ID NO: 17515 - RNA, 64 nt, Human
caacccagcuccaucaucacagacacagagagcugcaggggaggccugcccacuguuuugucga

SEQ ID NO: 17516 - RNA, 64 nt, Human
guuauauggaugggaacccuaacuuagggcuugggcaggggaaagagaaagaagaugagagauu

SEQ ID NO: 17517 - RNA, 64 nt, Human
guuauauggaugggaacccuaacuuagggccugggcaggggaaagagaaagaaggugagagauu

SEQ ID NO: 17518 - RNA, 64 nt, Human
cacugccacuggggcuuugauuuggaggaauggggcaggggacuaucugaagcgcuuccauccu

SEQ ID NO: 17519 - RNA, 64 nt, Human
uuuugcuuuuuaaaaggagagaggaggggugauggcaggggaguggaggguggccgggcagguc

SEQ ID NO: 17520 - RNA, 64 nt, Human
ugcuuaacauuuguaggauuauuucgagggcagggcaggggaaagaaacgcguuaaagggccau

SEQ ID NO: 17521 - RNA, 64 nt, Human
gccuucccccaucguguacugcagaguugagcuggcaggggaggggcugagagggugggggcug

SEQ ID NO: 17522 - RNA, 64 nt, Human
uauauuuuuuaagaaauauaauaaagcacuuagggcaggggaaaucaucucgguaaucauggaa

SEQ ID NO: 17523 - RNA, 64 nt, Human
ggcuggcagaggagaacauguugagacaagggaggcaggggacuuaugcaucccucagugccau

SEQ ID NO: 17524 - RNA, 64 nt, Human
cuaaauagagaggaguuuagaggaaaguuuagaagcaggggaaauacaauuuugguugccagag

SEQ ID NO: 17525 - RNA, 64 nt, Human
ccccuuggcuucugaagacacgagccgugaguaggcaggggauuguaguagcagcugaccugag

SEQ ID NO: 17526 - RNA, 64 nt, Human
cugaguuuucaguguuaaacuaggaagugugacagcaggggagcuuucgugaggcagucaguca

SEQ ID NO: 17527 - RNA, 64 nt, Human
guccucuguggaauugugauugaaggauuuuaaagcaggggaggagaguagggggcaucucugu

SEQ ID NO: 17528 - RNA, 64 nt, Human
aucugggugaagaccucagggucucagaaaguaggcaggggaggagaggguaagggaaaggugg

SEQ ID NO: 17529 - RNA, 64 nt, Human
caggggugggacaugaaccagcggauggaguccagcaggggagugggaaagugggcuugugcug

SEQ ID NO: 17530 - RNA, 64 nt, Human
aucuaccggcugaacuuucugaccacagcccccagcaggggaggcccacaccugccccagcacc

SEQ ID NO: 17531 - RNA, 64 nt, Human
uuugcuggaagcugucuuaggcugugagacaggagcaggggaaccacagccuauggggaacugc

SEQ ID NO: 17532 - RNA, 64 nt, Human
ggaaaggccaagcugcuggguggggacagaagcugcaggggagagggaagcagccgugcuguca

SEQ ID NO: 17533 - RNA, 64 nt, Human
cucgugguggugcaggggacaagaggcugugggugcaggggacaccuguggagggcauuucccg

SEQ ID NO: 17534 - RNA, 64 nt, Human
ccggacacauuucacaccucaggcucgugguggugcaggggacaagaggcugugggugcagggg

SEQ ID NO: 17535 - RNA, 64 nt, Human
aacgacacacacuucaccugcaagggccgacaacgcaggggacaccgugccggcuucagacacu

SEQ ID NO: 17536 - RNA, 64 nt, Human
gcuucaagugccuuuugcugcgcaccaaugcccagcaggggaggugaggggggcuggcggggcg

SEQ ID NO: 17537 - RNA, 64 nt, Human
gcauaguauuugaugcagguuuuuuuugauugaugcaggggaucaaauuuaggaaguucugauc

SEQ ID NO: 17538 - RNA, 64 nt, Human
gccaggaacuggcuccuuugccucugcuacugaggcaggggaguaguggagagcgggugggugg

SEQ ID NO: 17539 - RNA, 64 nt, Human
ucugaaagcucaguaacucagaacaggaguaacugcaggggaccagagaugagcaaagaucugu

SEQ ID NO: 17540 - RNA, 64 nt, Human
caugcucuugaggagcuuacaauccuggcuggaggcaggggaggguauauucuuuaaauaugcu

SEQ ID NO: 17541 - RNA, 64 nt, Human
ggaccgcggcgagcagcacggagcggaagggagagcaggggagagaaggccucaucucucuaua

SEQ ID NO: 17542 - RNA, 64 nt, Human
cacacauuggcggguggggugcagggagggagaggcaggggagagagaauggcaucucgcgugg

SEQ ID NO: 17543 - RNA, 64 nt, Human
ucugccucugccccguuggaugcccugacugggggcaggggaagagacagggcacagcuggcca

SEQ ID NO: 17544 - RNA, 64 nt, Human
accggcuccccagcccuccccaccaagggguacugcaggggaagggcuggcugggguccccgag

SEQ ID NO: 17545 - RNA, 64 nt, Human
ucucccugugucagaugauauguccuugaagcuggcaggggauucccaguccagggaauauccc

SEQ ID NO: 17546 - RNA, 64 nt, Human
cugcucauuuagucccgucuuccucaccgccccagcaggggaacgcucaagccugguugaaaug

SEQ ID NO: 17547 - RNA, 64 nt, Human
caccccaccccuacccgccacagccucagggugugcaggggagccugcugcacagauaugauac

SEQ ID NO: 17548 - RNA, 64 nt, Human
uccaggaugaggauggggguggcaaugacacccugcaggggaaaggacugccccccaugcacca

SEQ ID NO: 17549 - RNA, 64 nt, Human
ccccaucaccucuacugucuccucccugggcuaagcaggggagaagcgggcuggggguagccug

SEQ ID NO: 17550 - RNA, 64 nt, Human
gcagagacuuccuugucaucauggagaagugccagcaggggacugggaaaagcacucuacccag

SEQ ID NO: 17551 - RNA, 64 nt, Human
acugcuguuccuccagggccagcacucgggcgaggcaggggagcugccuucgguacauaauuug

SEQ ID NO: 17552 - RNA, 64 nt, Human
gcuucagugaacacagacacugcagagccugggagcaggggaggggaauaguugagugugcugu

SEQ ID NO: 17553 - RNA, 64 nt, Human
ccuucaagaggcgccauagacccuagcggggagggcaggggagggacggaaggcuggcaccucu

SEQ ID NO: 17554 - RNA, 64 nt, Human
ccgagggccaguuucaggucuggaaggggaggaagcaggggaaggugaccugaggaggcucggc

SEQ ID NO: 17555 - RNA, 64 nt, Human
gucugucucaguugguuccaaaugaaaccagggagcaggggaguuaggaaucgaacaccaguca

SEQ ID NO: 17556 - RNA, 64 nt, Human
cagcacugcccaaagugcuuccaaggcagaagcagcaggggauggcguggucaagcacucggga

SEQ ID NO: 17557 - RNA, 64 nt, Human
cucauccuggugcuuagguggcagagggugggcagcaggggacagggaugggauggcaaaacca

SEQ ID NO: 17558 - RNA, 64 nt, Human
cacacuagugcucuccagaaucucugcccaggaggcaggggaaaaaucuccuuucugcuuccca

SEQ ID NO: 17559 - RNA, 64 nt, Human
aguucuuccuuccccaucugggccuucauaaaaugcaggggaagccagacuggucucaggagcg

SEQ ID NO: 17560 - RNA, 64 nt, Human
gacaggcacaggcugggcagaggcacagggcagugcaggggacucugcaguggggucgggaagu

SEQ ID NO: 17561 - RNA, 64 nt, Human
gugucuugggaguugugcagggacucuggcccaggcaggggaaggaagaccaggcgguagggga

SEQ ID NO: 17562 - RNA, 64 nt, Human
auaugcuuuacacucauuuucaauuucuaaauuugcaggggauacugaaaaauacggcaggugg

SEQ ID NO: 17563 - RNA, 64 nt, Human
cugcccguccucuuuugccggucagggcuggcacgcaggggaacaaaggaaggagcaucagcag

SEQ ID NO: 17564 - RNA, 64 nt, Human
cuggcauuuugugaaacucucaagggaaggugaugcaggggagaaaaugugaauuaaauuacau

SEQ ID NO: 17565 - RNA, 64 nt, Human
agcaguccuuagguuuugcugugcugggacaguggcaggggacccacaggggugaggacccacg

SEQ ID NO: 17566 - RNA, 64 nt, Human
gauggggaacacugugccucccugaacagaaauggcaggggaggaggcugaugcuuuaaaugaa

SEQ ID NO: 17567 - RNA, 64 nt, Human
agcuaagagccugccucaccccuuaccaaugagggcaggggaagaccaccuggcaugagggaga

SEQ ID NO: 17568 - RNA, 64 nt, Human
caacgcgggcuaaaaccgaccggacaucuagcgggcaggggaagacuccacuaaagacuuccac

SEQ ID NO: 17569 - RNA, 64 nt, Human
uuccccaccucucggugggacagagcagaggaaggcaggggauuuaggaucgcccucccauccu

SEQ ID NO: 17570 - RNA, 64 nt, Human
ucuuaaaacuauuuuuaaugauccacuaaacaaagcaggggauccugaagcugauauaaauaag

SEQ ID NO: 17571 - RNA, 64 nt, Human
agugccuugugggguauccaggaacacccucccagcaggggaugggaacccugucccaugaagc

SEQ ID NO: 17572 - RNA, 64 nt, Human
uuuuuaaauuuuuuagaugaccaaaacuugcagggcaggggaugcccagaagaguggugagaua

SEQ ID NO: 17573 - RNA, 64 nt, Human
gcugcuugguuagaucauauagcuaaugaauuaggcaggggagcuauuuuuugaagaugaugaa

SEQ ID NO: 17574 - RNA, 64 nt, Human
gggaguaaagcucccagcauauuuagauaauagggcaggggaagcacccucuuucuuucuagac

SEQ ID NO: 17575 - RNA, 51 nt, Human
cacugggcugcggcaagugaggcaggggagcucacugacccaaagauuugc

SEQ ID NO: 17576 - RNA, 64 nt, Human
uuaaaauccuucguagggaaggacagcugucuuugcaggggaaauaggaugggucguccuuguc

SEQ ID NO: 17577 - RNA, 64 nt, Human
cucagguuugggggaaaagacccgaauccagagugcaggggagaggggcuuggauaugccaugu

SEQ ID NO: 17578 - RNA, 64 nt, Human
gaggcacggcggcucuguucaagcacuuuaugcggcaggggaggccgccuggcugcagucacua

SEQ ID NO: 17579 - RNA, 64 nt, Human
cgcugcugccagccucagaaaggcacccaggugugcaggggagcacacagggcccggcagcccc

SEQ ID NO: 17580 - RNA, 64 nt, Human
agacaacucugaaaagugggcugugacucccgaugcaggggaugguguggucaagcccucgucu

SEQ ID NO: 17581 - RNA, 64 nt, Human
cuguucccaugagaugaugccaugggcccucucagcaggggaggguagagcggagaaaggaagg

SEQ ID NO: 17582 - RNA, 64 nt, Human
agaauuaucuuggaauugaagauauaucccuagagcaggggaccccaacccccaggccaugggc

SEQ ID NO: 17583 - RNA, 64 nt, Human
ggcuguucccucuccaaucuuccagccuuugggagcaggggaggggucaguagcagaagcagag

SEQ ID NO: 17584 - RNA, 64 nt, Human
agcuacgguuuuuuuuuuuuuuuuuuuuuuuuuggcaggggacaaggagcaugguggucuuggc

SEQ ID NO: 17585 - RNA, 64 nt, Human
ugaaacaccaggagaggcgucagaaguaggaagggcaggggaacaggaaugcaagauuaaggaa

SEQ ID NO: 17586 - RNA, 64 nt, Human
uguccucacaagaaggcuaauugguggugagacagcaggggaggaggaagagcugugguuugua

SEQ ID NO: 17587 - RNA, 64 nt, Human
uuucaaaauuacaaugcauuuauggugucugggggcaggggaacaucagaaagguuaaauuggg

SEQ ID NO: 17588 - RNA, 64 nt, Human
guauuucaaagaaucuuucucugcaguaaaucucgcaggggaauuugcacuauuacacuugaaa

SEQ ID NO: 17589 - RNA, 64 nt, Human
ucccccagagcagcccaggguccugccagagucugcaggggacagcccucguuuuuuaagucuu

SEQ ID NO: 17590 - RNA, 64 nt, Human
aggggaucaccuucgaggacuuccugaagaucuggcaggggaucgacauugagaccaagaugca

SEQ ID NO: 17591 - RNA, 51 nt, Human
ucaccaauggguaccacugaagcaggggacgguggcaggaggugaggaugu

SEQ ID NO: 17592 - RNA, 64 nt, Human
ugaguuggcugcauuuucuuaucugaucacaauggcaggggacagaaugugcauggaguggagc

SEQ ID NO: 17593 - RNA, 64 nt, Human
gccucggaauccacuaagaaggccugucuacacugcaggggaaccucaagaacuuuucauugca

SEQ ID NO: 17594 - RNA, 64 nt, Human
accauucucuuugauguaugcagagaguuacguagcaggggauguucucugauuuauuccacug

SEQ ID NO: 17595 - RNA, 64 nt, Human
gagaggcagaggcagacaggcgcuggacagaggggcaggggagugccaagguuguccuggaggc

SEQ ID NO: 17596 - RNA, 64 nt, Human
acacaguaccauuuaauggggaggacaaaauggggcaggggagggagaaguuucugucguuaaa

SEQ ID NO: 17597 - RNA, 64 nt, Human
aucaucaaugauacucauuuuuuaauaaccaaaggcaggggaaaaucauuuuacuuauuaauaa

SEQ ID NO: 17598 - RNA, 64 nt, Human
ccugcggcuguccuauagcugagaugcgugggucgcaggggaggugauuucuaggcauauugcu

SEQ ID NO: 17599 - RNA, 64 nt, Human
gugggcgcacccaugccucccgcaguccaggugagcaggggagcaacugagcaggaagaggaug

SEQ ID NO: 17600 - RNA, 64 nt, Human
uagacuugguuuuuagaauucauaaaacugacaggcaggggaaucuuccugagugacagcuugg

SEQ ID NO: 17601 - RNA, 64 nt, Human
agggccuuuaaaaaaguagauauuuaauaucuaagcaggggaggggacaggacagaaagccugc

SEQ ID NO: 17602 - RNA, 58 nt, Human
auggcgcacgcuuauuuuagggccagcggcaggggacuccagccugcuggacacuuca

SEQ ID NO: 17603 - RNA, 64 nt, Human
agggcugcucaucuguuccaagcaggaggauguggcaggggagggcugggagugaguagcucug

SEQ ID NO: 17604 - RNA, 64 nt, Human
acucuggcccuuggacuauggaaacgugggaggggcaggggagauguggggaaguccaggacuc

SEQ ID NO: 17605 - RNA, 64 nt, Human
ccuauccugcugcaguuucccagcugcagccuaggcaggggaugcacagcccaggcgaggaagc

SEQ ID NO: 17606 - RNA, 64 nt, Human
ggaccaguucauggaggccaucaccgucagugcagcaggggaugaggaugaggaugaauccggg

SEQ ID NO: 17607 - RNA, 64 nt, Human
cuggcggcaggcccgaagguguggaccccucagggcaggggaccuugcaacuuaucgcaaaggg

SEQ ID NO: 17608 - RNA, 64 nt, Human
gggaggagccugugcgucccagcugaaggcaguggcaggggagcagguuccccaagggcccugg

SEQ ID NO: 17609 - RNA, 64 nt, Human
acagcgccucuugggcugcucccucgugcacagcgcaggggaggaugggugccagaggguggga

SEQ ID NO: 17610 - RNA, 64 nt, Human
guaucaaacacacacaggauaccagcaauggauggcaggggagaguguuccuuuuguucuuaac

SEQ ID NO: 17611 - RNA, 64 nt, Human
aucuugcaaauuucuauucucuuuuacugaaaaagcaggggaugaguuccaucagaaggugccc

SEQ ID NO: 17612 - RNA, 64 nt, Human
aaaaagagauucaagagccaaguacucagcccuggcaggggauggggacaugaugcccagagcc

SEQ ID NO: 17613 - RNA, 64 nt, Human
cagugagaggaagggagggaugaggagguggagugcaggggauguuagggcagugaaagguucu

SEQ ID NO: 17614 - RNA, 64 nt, Human
cccucaagcccagugaggagguggguggaggcaugcaggggagacgacucagggaucgcggggg

SEQ ID NO: 17615 - RNA, 64 nt, Human
augaacagugcaaugugaaggaaggcaggagccugcaggggagcagacuuggugcccagcugcc

SEQ ID NO: 17616 - RNA, 64 nt, Human
ccccaggacucaaaaauagggaaguaacaguaacgcaggggaaacguuuucuguuuggaggagc

SEQ ID NO: 17617 - RNA, 64 nt, Human
ucuauccaccaagccagcaccccaccaucccuuugcaggggagucaaagggccagaacuccuug

SEQ ID NO: 17618 - RNA, 64 nt, Human
aucuugcauccugagucagaaguggaaauguccagcaggggaaggacaggcagguggauggugu

SEQ ID NO: 17619 - RNA, 64 nt, Human
ugggauagcgcaggaaggugggucccggcaacacgcaggggaugaguggaccuggaacugacaa

SEQ ID NO: 17620 - RNA, 64 nt, Human
gggcgauucuguguggggaaacccaccggaccuugcaggggaccauggggaagcugcaggugag

SEQ ID NO: 17621 - RNA, 64 nt, Human
cacgccuauaaucccugcgcuuuggcaguccgaggcaggggaauugcuugaacucaggaguugg

SEQ ID NO: 17622 - RNA, 64 nt, Human
ccaucgucuccucuuccaaucaggcccugcugaggcaggggaccucugcccgagaccugcucag

SEQ ID NO: 17623 - RNA, 64 nt, Human
ccggggcggggggcagggacccccgggcggccgggcaggggaaggggccuggccgccaccugcu

SEQ ID NO: 17624 - RNA, 64 nt, Human
ggccuucucuccugaccagcagcagguccucagcgcaggggacgccgucuuccucugggauguc

SEQ ID NO: 17625 - RNA, 64 nt, Human
cucaguggagaccccaaggagcugcagcugaacugcaggggagggaaggaggagcagccugggc

SEQ ID NO: 17626 - RNA, 64 nt, Human
aucaggugcaggggcugcccaggacaaagcgggggcaggggaaagacaccacccucgccccaag

SEQ ID NO: 17627 - RNA, 64 nt, Human
uggcaucuuaauaaaaccugcuuauacuucccuggcaggggagauaccaugaucgcggaggugg

SEQ ID NO: 17628 - RNA, 64 nt, Human
gaagaccaugucuccucguuggagaaacccaauagcaggggaagcuggggggucaagcaccauc

SEQ ID NO: 17629 - RNA, 64 nt, Human
cagcccuuaauuagggcuucagugacuuagaaaagcaggggaaacccaaggcuuugccugcaga

SEQ ID NO: 17630 - RNA, 64 nt, Human
gcucccgucacacacuacagguccccuccccagggcaggggauuugggcuccaugagcuccuug

SEQ ID NO: 17631 - RNA, 64 nt, Human
cacaccuguagucccagcuacucuggaggcugaggcaggggaaucgcuuaaacccaggaggcgg

SEQ ID NO: 17632 - RNA, 64 nt, Human
auucuggcucgaagcagccacugagccauaaugcgcaggggaggccagaagcucugugccuggu

SEQ ID NO: 17633 - RNA, 64 nt, Human
uauucuucuguccaucuuuggccugcuggugccagcaggggacacagacugcaaagagaagcac

SEQ ID NO: 17634 - RNA, 64 nt, Human
acagccucauccuguauaguuuaaugaugaaugugcaggggaccugucucaggcuccuauaugg

SEQ ID NO: 17635 - RNA, 64 nt, Human
cccgcuccugugcuggcacuucugugcucgcagagcaggggaacaggacucagcccccaucacc

SEQ ID NO: 17636 - RNA, 64 nt, Human
gaggaggcaacacugaucccccagaugcagggcugcaggggauucuguguuuucagacugccug

SEQ ID NO: 17637 - RNA, 64 nt, Human
uugauccuguugaacccgccugagacggugcugugcaggggaaagcccccgcacccacacagga

SEQ ID NO: 17638 - RNA, 64 nt, Human
cagagggcggcacaggcugggcuccagcaggugggcaggggaggucugggcaaggcgcugccgu

SEQ ID NO: 17639 - RNA, 64 nt, Human
ugcccguuuccucccauggcccaguaugaggccagcaggggacauuugggaugcccaggccgca

SEQ ID NO: 17640 - RNA, 64 nt, Human
ucgcgaaagcuuguuuccccacggucuggcuucugcaggggaaauuucaaggccacuggcgugg

SEQ ID NO: 17641 - RNA, 64 nt, Human
gugcccuggccuugggucugccgagccuccugcagcaggggacgggugcuuuggccagagucac

SEQ ID NO: 17642 - RNA, 64 nt, Human
uuaccauggcuggggaauugucuggugguggggggcaggggacagaggccaugaaggagcaagu

SEQ ID NO: 17643 - RNA, 64 nt, Human
cucuagccaggggcgacguguccccagguuucuggcaggggagaugugcagggugggucuuggg

SEQ ID NO: 17644 - RNA, 64 nt, Human
uuucugauauggcacaugcuaucaguuuuuuggggcaggggagaugaacuuuaaaaaaaaaaaa

SEQ ID NO: 17645 - RNA, 64 nt, Human
guccccugggagagagcccagcacccaagauccagcaggggacaggacagaguagaagccccuc

SEQ ID NO: 17646 - RNA, 64 nt, Human
gcagccgccugaggguggugaccccaggagggaggcaggggaggggugcggcggucccagcucc

SEQ ID NO: 17647 - RNA, 64 nt, Human
gagaacuggaaaggcugucuggggucuucugacugcaggggaaggauguacuuuccaaacaaau

SEQ ID NO: 17648 - RNA, 64 nt, Human
uugauacuuggggcagcccgaugcuguguguggggcaggggaggcauccuuacuggagaggcag

SEQ ID NO: 17649 - RNA, 64 nt, Human
gcugugcuggaauuccacagggaccagggccaccgcaggggacugucucagaagacuugauuuu

SEQ ID NO: 17650 - RNA, 64 nt, Human
gccgugcagagccugggcuccggcagggagaggugcaggggagucaccgcccagaccuccccag

SEQ ID NO: 17651 - RNA, 64 nt, Human
gcagacaucugccaugucccugagacugcgggaggcaggggaugcauggguguccccaucuguc

SEQ ID NO: 17652 - RNA, 64 nt, Human
acaccgacucugccuacauucuuuucuaugagcagcaggggauagacuacgcacaauuucugcc

SEQ ID NO: 17653 - RNA, 64 nt, Human
aaaaugugccaagaauuucccagucccaggcagggcaggggaaacuaagggcaagcaggauaca

SEQ ID NO: 17654 - RNA, 64 nt, Human
guggcuacagaaaagccccuuucuuccucuguuugcaggggaguguggcccuguggccugggug

SEQ ID NO: 17655 - RNA, 64 nt, Human
uggauuuaaaaaaaaaaaaaaaaacucuguuucugcaggggaugauauuggugaguugccaaag

SEQ ID NO: 17656 - RNA, 64 nt, Human
augccaacagccggguggcuguccaagcaggauugcaggggacacagggaagcacugcccagcc

SEQ ID NO: 17657 - RNA, 64 nt, Human
ugguuauuuauuuccuuagugccaggagggcacagcaggggagcccugauuuuuaauaaauccg

SEQ ID NO: 17658 - RNA, 64 nt, Human
agcuugagacucuggaaagaaauggggagggggggcaggggaaauguugcccuaagaaugcuuc

SEQ ID NO: 17659 - RNA, 64 nt, Human
gucaccuucuaccaccagggcaaggagcuggacugcaggggaggccacgugcagcuggcggacg

SEQ ID NO: 17660 - RNA, 64 nt, Human
ggccccaccucccugcaccccuccccucuauagagcaggggagugaagggguaugucaggcggg

SEQ ID NO: 17661 - RNA, 64 nt, Human
auucuugauuuaggguggcugguggcaaggaggggcaggggauauggggacgugacugggacag

SEQ ID NO: 17662 - RNA, 64 nt, Human
acuccccagccccagccccuuccaugguacuguagcaggggaauucccucccccuccuugugcc

SEQ ID NO: 17663 - RNA, 64 nt, Human
auacaauggauuuuggggacuuaggggaaaggaugcaggggaugagggauaaaaaaccauacau

SEQ ID NO: 17664 - RNA, 64 nt, Human
aguagccugagaggggcuuuuucuaggcuucagagcaggggagagcuggaaggggcuagaaagc

SEQ ID NO: 17665 - RNA, 64 nt, Human
cugagagaaaagcagcccacucuuguguucucaggcaggggaucuccaaaugcaaaaggaagcu

SEQ ID NO: 17666 - RNA, 64 nt, Human
uuuucuucucaaaggugguuuuuuggggggagaagcaggggacuccgcagcgggccccugccuu

SEQ ID NO: 17667 - RNA, 64 nt, Human
cuccucugggcagccccuuuccuccauguacacugcaggggacagaaggggggccccaucccua

SEQ ID NO: 17668 - RNA, 64 nt, Human
gaccaagcugcuuaaaguagaaggaucaggacuggcaggggauaugagggccaguguagagauu

SEQ ID NO: 17669 - RNA, 64 nt, Human
gggcugaccuuucuccugcuucucuccaggcucugcaggggacagggcaggugcugcaggagcc

SEQ ID NO: 17670 - RNA, 64 nt, Human
acugagagugcagccccuuccccugcccaggguggcaggggagggguaggguaaaaggcaugug

SEQ ID NO: 17671 - RNA, 64 nt, Human
guggagcaaagggaaccaaugccgaagaccgagggcaggggagggaggcggggguggacaggga

SEQ ID NO: 17672 - RNA, 64 nt, Human
cccccucagcccgccagcugaggggucccacggggcaggggagggaauugagagucacagacac

SEQ ID NO: 17673 - RNA, 64 nt, Human
uuuccuaccuucucugggggauuugaggguagaggcaggggaagaucuguuguugcagcugcuu

SEQ ID NO: 17674 - RNA, 64 nt, Human
gucagggggugucugcuagccucaaccuccuggggcaggggacgccgagacuccgugggagaag

SEQ ID NO: 17675 - RNA, 64 nt, Human
gccacgaaccucggggugggggugggcagugagugcaggggaugggguggggggacaggagggg

SEQ ID NO: 17676 - RNA, 64 nt, Human
cuuggcuucguuagugcauuacaugaaaugauuugcaggggauggggccuuuuccagggaaguc

SEQ ID NO: 17677 - RNA, 64 nt, Human
cagggugugaagggacuuaccucccaaagguucugcaggggaaucuggagcuacacacaggagg

SEQ ID NO: 17678 - RNA, 64 nt, Human
accuggagaguggaggcaccggccaggcaggggggcaggggagcucaggccuggggucuggggg

SEQ ID NO: 17679 - RNA, 64 nt, Human
gcccccagcaucuccuggggcccccauggcuggggcaggggaaagagagcccucaaaggccucu

SEQ ID NO: 17680 - RNA, 64 nt, Human
gucuccuacucuguguaaauauuuuucccuccgggcaggggagccaggguagagcaaaggagac

SEQ ID NO: 17681 - RNA, 64 nt, Human
cccugcccgccucucagaaaagcugcuguggugggcaggggauugggccaucugucuccuggcc

SEQ ID NO: 17682 - RNA, 64 nt, Human
agaugaaugcuggguggguguguccaggaggagagcaggggagagagugagcgugagcuuggca

SEQ ID NO: 17683 - RNA, 64 nt, Human
cagccccuccaccaccaggggcacugccgucauggcaggggacacaguuguccuugugucugaa

SEQ ID NO: 17684 - RNA, 64 nt, Human
aggcuccgucugacugugggcugggaggagggaggcaggggagagccggucacgguggcugguc

SEQ ID NO: 17685 - RNA, 64 nt, Human
uuauuuggggacagggguugggaugggggugugggcaggggaaaacagagaacgggaugcuuug

SEQ ID NO: 17686 - RNA, 64 nt, Human
caugccuguagucccagcuacucgggaggcugaggcaggggaauugcuugaacccgggaggcgg

SEQ ID NO: 17687 - RNA, 64 nt, Human
ccugucaccagguaguuuuucccugccagagauggcaggggaaagccagugguuccugggaacg

SEQ ID NO: 17688 - RNA, 64 nt, Human
ggcuuggagacccccagauaaccauaacagggaagcaggggaggcggaaaaauagaguuugaga

SEQ ID NO: 17689 - RNA, 64 nt, Human
cuuuguguccucauuauagcaaaggguuacuggugcaggggacuaggaaaaacccguccagugu

SEQ ID NO: 17690 - RNA, 64 nt, Human
ugaggggacaaccaccccucuuuccuccagguuggcaggggacccucuucucccgucugcccug

SEQ ID NO: 17691 - RNA, 64 nt, Human
cccaggcugcacagcaggcagggagggaggcaaggcaggggaguggggccugagcugagcacug

SEQ ID NO: 17692 - RNA, 64 nt, Human
cugagggagccaggaggccggggggccgggggcugcaggggaggcuguggggguccuggcagcc

SEQ ID NO: 17693 - RNA, 64 nt, Human
aaggcagggucguaucuguggggaccugacaagggcaggggaagcggagaccagggugcaggcu

SEQ ID NO: 17694 - RNA, 64 nt, Human
acugggaugaaguuggagggaggggcagggccuugcaggggauugguacugaucccagggagga

SEQ ID NO: 17695 - RNA, 64 nt, Human
guggggggguggggagaagggucgggcagggggugcaggggaggaaacuccucaccaggagagc

SEQ ID NO: 17696 - RNA, 64 nt, Human
ccaggcagagggcagggcuggaccaugggugagggcaggggagcccggagcuuccucuggucac

SEQ ID NO: 17697 - RNA, 64 nt, Human
gucccuucccugagcccuggccaagauucaggcugcaggggaagaaagaacaugaccgggaggu

SEQ ID NO: 17698 - RNA, 64 nt, Human
caugccuguaguacgagcuacucaggagguugaggcaggggaaucacuagaacccaggaggcac

SEQ ID NO: 17699 - RNA, 64 nt, Human
cugagagcuaggaaacugggagguugagccaggagcaggggaacuugggcuuugaggcgagacc

SEQ ID NO: 17700 - RNA, 64 nt, Human
cagagcuuuuccacugauuguacucagcggggaggcaggggaggcagaggggcagccucucuaa

SEQ ID NO: 17701 - RNA, 64 nt, Human
gccugugcaaugcauuagggaugccuccuuucccgcaggggauggacgaucucccaccuuucgg

SEQ ID NO: 17702 - RNA, 64 nt, Human
ugcugccuucaccacauauuagugcuugacccuggcaggggaccccauggaaaagauggggaag

SEQ ID NO: 17703 - RNA, 64 nt, Human
cggcucaggacccaguuuuggcugcugguucccagcaggggacucgggggauauacaguggcug

SEQ ID NO: 17704 - RNA, 64 nt, Human
ugcuaggggaagcauccccaggccugacugagcggcaggggagcacggcccguggguuugauug

SEQ ID NO: 17705 - RNA, 64 nt, Human
aagacaguguccccuccacagcugggugccaggggcaggggauccucaguauagccggugaacc

SEQ ID NO: 17706 - RNA, 64 nt, Human
aguagcugagggggcagacuagggaguagggcuggcaggggagggggcagacagccucgccucg

SEQ ID NO: 17707 - RNA, 64 nt, Human
caaagaccugugaagcuacagacugacagccagggcaggggaggagggaggggcgccagcaccu

SEQ ID NO: 17708 - RNA, 64 nt, Human
gucgcugaucacugggaccugguuccagccguuugcaggggaggcggcuccgagaggcgugugc

SEQ ID NO: 17709 - RNA, 64 nt, Human
gcaguucaguuccugacugugcaaggccaacagggcaggggaggggaagaccuggggaaggaag

SEQ ID NO: 17710 - RNA, 64 nt, Human
cacaccuuccccugcugcaugugggggccgaugggcaggggaccucgguggaaauaaaauguau

SEQ ID NO: 17711 - RNA, 64 nt, Human
aaaagcgagaagggggguucaggaggaagccaucgcaggggaccugggagacgccccgaggugu

SEQ ID NO: 17712 - RNA, 64 nt, Human
caauugcacaacuccguucucgggguggcggcaggcaggggaggcuuggacgccgguggggaau

SEQ ID NO: 17713 - RNA, 64 nt, Human
aggaaaugcagccaaaggugcagucggaaaagaugcaggggaaauguauuuaugcagcgacacc

SEQ ID NO: 17714 - RNA, 64 nt, Human
guuucuuuugaauaugguuauccccuaaccauaugcaggggauugguuccagacccccuaagca

SEQ ID NO: 17715 - RNA, 64 nt, Human
aguuuauuucaaauacaguuuuccccugacauaugcaggggauuaauuccagcagucccugauc

SEQ ID NO: 17716 - RNA, 64 nt, Human
cgcaccuguagucccagcuacucuggaggcugaggcaggggaauggcucgaacacaggagacgg

SEQ ID NO: 17717 - RNA, 64 nt, Human
acaaacccgggacgguugaaagccuucgaaccgugcaggggaugccucgggcccuggcccuucg

SEQ ID NO: 17718 - RNA, 64 nt, Human
ggcagcugagcugaucgccaacucacuggccacugcaggggacggccagagcgagcugugcaag

SEQ ID NO: 17719 - RNA, 64 nt, Human
agugccuagguuucucauaccccacaaggucacagcaggggagggagggacaauuuuauaauga

SEQ ID NO: 17720 - RNA, 59 nt, Human
uggagcaccgagacuccugagggcugugggcaggggaccugugugccccgcacccccca

SEQ ID NO: 17721 - RNA, 64 nt, Human
cucuguuuuccaggggagaaaccugagucucagagcaggggaguggcuucccaaggucucacag

SEQ ID NO: 17722 - RNA, 64 nt, Human
acagaaauccagaguggggagacagagaccaagagcaggggauagaagccgggcgaaguggccc

SEQ ID NO: 17723 - RNA, 64 nt, Human
gguaauuagacacugauugugugguagaaauacugcaggggaaaaggucgcccucuuaugcauc

SEQ ID NO: 17724 - RNA, 64 nt, Human
ugggcucuggcugguuccgucugcucugcugccagcaggggagaggggccaucugaugcuuccc

SEQ ID NO: 17725 - RNA, 64 nt, Human
gggggaccacaaacaaacaggguccuuagcuggggcaggggagcccaaaucuagggagagacuc

SEQ ID NO: 17726 - RNA, 64 nt, Human
gacccggggagggggacgggguggggaaacggaggcaggggacagaagaggggagauuggggga

SEQ ID NO: 17727 - RNA, 64 nt, Human
gcauuccugcuucucucucaggccaccacagagggcaggggaugguuagucaccugccccagca

SEQ ID NO: 17728 - RNA, 64 nt, Human
aggguaggcagugccugcuucugcuccaucaggugcaggggauuuggcugaaggcgugcauauu

SEQ ID NO: 17729 - RNA, 64 nt, Human
ucagagucucauuaccacugccaaugugguuuuagcaggggaggggaccugcuaagcugagacc

SEQ ID NO: 17730 - RNA, 64 nt, Human
aaggccacugugaggagagggguugccccagaaggcaggggaaggaccugaugagaacagaaua

SEQ ID NO: 17731 - RNA, 64 nt, Human
agcccagcccugugaaagauggagcugacuugcugcaggggaccugauuuauagggcaagagaa

SEQ ID NO: 17732 - RNA, 64 nt, Human
uggagauguuaucccaccauguaaagucgccugcgcaggggagggcugcccaucuccccaaccc

SEQ ID NO: 17733 - RNA, 64 nt, Human
uggccaggcaggaggggccggguucaggagcugagcaggggaugccugugcguggugccugggu

SEQ ID NO: 17734 - RNA, 64 nt, Human
ugguucagauuguuuuuaauagaaaacuaaaggggcaggggaagugaaaggaaagauggagguu

SEQ ID NO: 17735 - RNA, 64 nt, Human
cuuccugcuccauggaguccugaguugcucuggggcaggggauuacguuaugaaaacuaaccau

SEQ ID NO: 17736 - RNA, 64 nt, Human
gacagagaaggcugcaggaggccuuuguugcucagcaggggacucugcccucccuccuuccuuu

SEQ ID NO: 17737 - RNA, 64 nt, Human
accucccugcuaggcaugcaggggcuggcgguuggcaggggaaggaggcccagugagccggguc

SEQ ID NO: 17738 - RNA, 64 nt, Human
gcgggccgcgggcgacgggcgggugcgcgggcgggcaggggaccuuggcuaaggcgagaguagc

SEQ ID NO: 17739 - RNA, 64 nt, Human
aaaccaagauucccagugaagcaccugaggccaagcaggggagaggaaugaggggagcagcugg

SEQ ID NO: 17740 - RNA, 64 nt, Human
accccucccuguggaucgccugccugggcccagagcaggggaacuggaguuugugagugagcag

SEQ ID NO: 17741 - RNA, 64 nt, Human
uauuugugaauuuaaaaggaacaccgauuugcgggcaggggaaaacuucagucacguuugcaca

SEQ ID NO: 17742 - RNA, 64 nt, Human
uggguugcuggagcucaccagucuugagggaggugcaggggaaacuguguuuuuuaucuucaua

SEQ ID NO: 17743 - RNA, 64 nt, Human
gccucugugcugcuggggucacgcgaggcuguuugcaggggacacggucacaggagcucuucug

SEQ ID NO: 17744 - RNA, 64 nt, Human
gccagguggcagcuugagcauggacucccagacugcaggggagcacuuggggcagcccccagaa

SEQ ID NO: 17745 - RNA, 64 nt, Human
ugaaucgugcacacagccaugcuucaaggccggggcaggggagccugugcugaugccauccagg

SEQ ID NO: 17746 - RNA, 64 nt, Human
ugagggaagggcuucagggccaucugcucccagggcaggggacaggccaccaaggaccuuuggc

SEQ ID NO: 17747 - RNA, 64 nt, Human
cuccugccaccacccccuccccagggagcccaaggcaggggaggcucagcauggaaugaaacag

SEQ ID NO: 17748 - RNA, 64 nt, Human
cuggaucgcggccggccccggggggccccaggaggcaggggagcccagcugucgguccccagcc

SEQ ID NO: 17749 - RNA, 64 nt, Human
guuagggacuuuggcauuuccauagcugagcacagcaggggagggguuaaugcagauggcagug

SEQ ID NO: 17750 - RNA, 64 nt, Human
aggcccaggggagccccuggagggaaauuccuuggcaggggaacaggaaauguggccgccucug

SEQ ID NO: 17751 - RNA, 64 nt, Human
uguagaagcaguccuguauggagaccuuggaccagcaggggaagaucuaugggcaugggaggug

SEQ ID NO: 17752 - RNA, 64 nt, Human
ugggcccugaacacacggggccaugucuggacgagcaggggagagaggcugaacuggccagaag

SEQ ID NO: 17753 - RNA, 64 nt, Human
agcccagcagugcccacacaggacugggcccuccgcaggggacuucagagcagcaaggccccag

SEQ ID NO: 17754 - RNA, 64 nt, Human
gggaccaacuacucuggcaggaucuggaccccuggcaggggaguccagcugagaguggaagagg

SEQ ID NO: 17755 - RNA, 64 nt, Human
ccaggcgaguggagaaacgcccuccagucugagagcaggggagggaaggaggcagcagaguugg

SEQ ID NO: 17756 - RNA, 64 nt, Human
guuagugacuuuggcauuucuguagcugagcacagcaggggagggguuaaugcagauggcaagu

SEQ ID NO: 17757 - RNA, 64 nt, Human
ugccauacccacugaccccagaccagugcagccagcaggggaggugagccauacacaggccacg

SEQ ID NO: 17758 - RNA, 64 nt, Human
guguuaggaacuuuggcaucuguagcugagcacagcaggggagggguuacucaagauggcaagu

SEQ ID NO: 17759 - RNA, 64 nt, Human
agaaagccggggguaggggccacccuggaauggggcaggggaagggcacacccccugcccaugc

SEQ ID NO: 17760 - RNA, 64 nt, Human
gcaucuggacgcugcucuuaaaggaccuccuggggcaggggagcgguagggucuggacugggca

SEQ ID NO: 17761 - RNA, 50 nt, Human
aauucaaaaucaagcuuugagcaggggagugaggcagccagaaguggggg

SEQ ID NO: 17762 - RNA, 64 nt, Human
ugccucgcgggcucagugaguuaggaagucagcagcaggggaggcagcuugcaugccugucccc

SEQ ID NO: 17763 - RNA, 64 nt, Human
ccuggcucagaccagcccaaggccuugcccaguggcaggggaaaggggcaccucacuccaccuc

SEQ ID NO: 17764 - RNA, 64 nt, Human
ggcugaggcaggcuuaggggaaagaaccagaggggcaggggaggacuggggagggcuggcuagc

SEQ ID NO: 17765 - RNA, 64 nt, Human
aaaaguucuaacuuguuuuugagaagucaguacagcaggggaaaacauaugugaugcaauuaac

SEQ ID NO: 17766 - RNA, 64 nt, Human
guucaaugaguaagauguagauuuggagucaucagcaggggaaacuuguuagauguccuuugua

SEQ ID NO: 17767 - RNA, 64 nt, Human
caaacuugaggaagcccugguucuauuucaccuggcaggggagccuauaaggagagcgaugccc

SEQ ID NO: 17768 - RNA, 64 nt, Human
gugaggaagagcuggggggcagagguaaagcccugcaggggaggccacaggguccaucccgucu

SEQ ID NO: 17769 - RNA, 64 nt, Human
agagacgggagggaggagagagaggagaagggaggcaggggaggggcagcagaaccaaggcaaa

SEQ ID NO: 17770 - RNA, 64 nt, Human
cucaagggaaccuguccccaaauuggccucgguggcaggggagccccgcagagcuggacagcga

SEQ ID NO: 17771 - RNA, 64 nt, Human
uuggaaugagauuugccucaaucuccuauugccugcaggggagcaguuggcauaagcaacauuu

SEQ ID NO: 17772 - RNA, 64 nt, Human
ggccuggagccuaaggagcuguagggucugaggggcaggggaggcccauaucuuguuucaggua

SEQ ID NO: 17773 - RNA, 64 nt, Human
ugcccguuccccuaggagcuuugagcauuucucugcaggggacaguaguaauauaauucucucu

SEQ ID NO: 17774 - RNA, 64 nt, Human
aggcaaccucucucuucuccucuguuucgugaaggcaggggacacagaugggagagauugagcc

SEQ ID NO: 17775 - RNA, 64 nt, Human
aaggaaauguuucuuuauggccauuuuggagggagcaggggaugaggcuuggcauaguccaaaa

SEQ ID NO: 17776 - RNA, 64 nt, Human
accgggaugggagccgggcaaacuggccgcgggggcaggggaggccaucuggagagcccagagu

SEQ ID NO: 17777 - RNA, 64 nt, Human
gauacccagacuuaauugguauuuguucuugcauuggccaaagugaaaauuuuuuuuuuucuuu

SEQ ID NO: 17778 - RNA, 64 nt, Human
accacugagggagagacccuuucugaaagaaguauggccaaaagcacuuuaaugcugcugacau

SEQ ID NO: 17779 - RNA, 64 nt, Human
cagccagacuccaugacucaucugaucccuuuuauggccaaaucauccuucagaguagggaaca

SEQ ID NO: 17780 - RNA, 64 nt, Human
aagugcugggauuacaggcaugagccaccacgccuggccaaaaaaauauguuuuaaauguccca

SEQ ID NO: 17781 - RNA, 64 nt, Human
uggaucacccaaggucaggaguuugagaccagccuggccaaauggugaaaccccaucucuacga

SEQ ID NO: 17782 - RNA, 64 nt, Human
uuucucaucaucacucuauaccaauacuuauuucuggccaaaugaaucugcuucucugccccuc

SEQ ID NO: 17783 - RNA, 64 nt, Human
agccggaagcccugggacaaccaacagcagacaguggccaaaauuugcaagugccuugugagug

SEQ ID NO: 17784 - RNA, 64 nt, Human
ccagaugcagaccaugggcaaccaaccauugcacuggccaaaucauuauuuauggagaaauccu

SEQ ID NO: 17785 - RNA, 64 nt, Human
gugguggggguagcagguaaauugcuuaaucauuuggccaaauaauuagacaacuauaagauuu

SEQ ID NO: 17786 - RNA, 64 nt, Human
ggguaccuguagagagcuucuuuuuguuucuaccuggccaaaguuagaugggacaaagaugaau

SEQ ID NO: 17787 - RNA, 64 nt, Human
auuuaacaaacuaggaagaugaaaagggaaauuguggccaaaacuuugggaaaaggagguucuu

SEQ ID NO: 17788 - RNA, 64 nt, Human
gcuaaaguggauccugagccuagaagaacacaaauggccaaauauuucccuuccgucuuccuuc

SEQ ID NO: 17789 - RNA, 64 nt, Human
ugggacccaaagaguauccacuggggauguuuuuuggccaaaacucuuccuuuuggaaccacau

SEQ ID NO: 17790 - RNA, 64 nt, Human
gucuucaaccuggccuguccagcccuuccagauauggccaaacccauggccuggaugggcuugu

SEQ ID NO: 17791 - RNA, 64 nt, Human
agcaaauuauuauucucaguuuccauuaccuguuuggccaaacagauuaauaaaauauuugaaa

SEQ ID NO: 17792 - RNA, 64 nt, Human
caccccggacgggcguccaggacccugagggccauggccaaaaggcuccugagugugccuggug

SEQ ID NO: 17793 - RNA, 64 nt, Human
ggcccaguguccagucacuuagaaguuccccccuuggccaaaaacccaauucacauugagagcu

SEQ ID NO: 17794 - RNA, 64 nt, Human
cuuuagacccucgggccccauccucaucccugacuggccaaacccuugcuuuccugggccuuug

SEQ ID NO: 17795 - RNA, 64 nt, Human
cugccuuuggaugaaagacuccguugggaauaaauggccaaagcuuauaggacucugugacagg

SEQ ID NO: 17796 - RNA, 64 nt, Human
cuuuuuuucucccacuguuguaaauaacuuuuaauggccaaaccccagauuuguacuuuuuuuu

SEQ ID NO: 17797 - RNA, 57 nt, Human
acuuuacaggggcuguuuagaaauauauggccaaaucuguaacccggaaacagcaaa

SEQ ID NO: 17798 - RNA, 64 nt, Human
gaugaaacuaauuuuuggcuuaagucagaacaacuggccaaaauugaagucauauuugaggggg

SEQ ID NO: 17799 - RNA, 64 nt, Human
ugcuaaacaacuacggaauacuaaauaaaaaguuuggccaaaaccaaccaugaagcugcaaagg

SEQ ID NO: 17800 - RNA, 64 nt, Human
aaauuuguauaggcaaaccauuucuuaaaguugauggccaaauuuuaaaauguuauuuuucaua

SEQ ID NO: 17801 - RNA, 64 nt, Human
acaaaguccuucauaauuuaaccauuagcaucuuuggccaaaccaaaauaaagaaaagcaucuu

SEQ ID NO: 17802 - RNA, 64 nt, Human
agucaucagucuuauuucaguaaaaccaucuuucuggccaaaucucuaacacguuuuuuacuuc

SEQ ID NO: 17803 - RNA, 64 nt, Human
ggcuuagccggaggggacguggccaagggugagguggccaaaaccagaaccagcagucuccugc

SEQ ID NO: 17804 - RNA, 64 nt, Human
cuuuaccuaauggucucuaccuaauggaccuccguggccaaaaaguaccauuaaaaccagaaag

SEQ ID NO: 17805 - RNA, 64 nt, Human
uuucugucacucacauggacccaagauaaaagaauggccaaacccucacaaccccugauguuug

SEQ ID NO: 17806 - RNA, 64 nt, Human
uuaauucagacguaaagauucuaugaauauggacuggccaaaaguuauccuuacuccaucugug

SEQ ID NO: 17807 - RNA, 64 nt, Human
acaaggugauguaaucagcuuguuguagugaugcuggccaaauggugcucagcaggugagaaca

SEQ ID NO: 17808 - RNA, 64 nt, Human
uuugaaaaauauauuuucaaauucacuuucuaauuggccaaaagagaugaguuccagucugaau

SEQ ID NO: 17809 - RNA, 64 nt, Human
uaauaugugaccaagaacacaaggagcauccauauggccaaauaaauacacugaauuuuagaaa

SEQ ID NO: 17810 - RNA, 64 nt, Human
uggaaauacaguaaaauuugacuguuuaaaauguuggccaaaaaaaucaagauuuaauuuuuuu

SEQ ID NO: 17811 - RNA, 64 nt, Human
caaagccaaggcccgccccuuccuugugcucaaauggccaaagcuguucacgucugugcucaac

SEQ ID NO: 17812 - RNA, 64 nt, Human
uacugcaaggggacacacggcaucaugucaccacuggccaaaaagaagcuccuggcccagguga

SEQ ID NO: 17813 - RNA, 64 nt, Human
ggugagaauuagaaaugaaauauuuuuuauucauuggccaaaaaguucacagacagcaguguuu

SEQ ID NO: 17814 - RNA, 64 nt, Human
ucacggcugacauucggcuaacgagggauuacuuuggccaaaaccuuucaaaggauaugcagaa

SEQ ID NO: 17815 - RNA, 64 nt, Human
aauaucaagggagcaagaggaagccaagaaaacuuggccaaaucaaaguacuugauggggaaga

SEQ ID NO: 17816 - RNA, 64 nt, Human
agaaccacagggccucuuacaaguauaaggauuuuggccaaaugggacuuagacuggaggcuga

SEQ ID NO: 17817 - RNA, 64 nt, Human
uaucgagagguuuuucaaguaucuuugaguuucauggccaaaguguuaacuaguuuuacuacaa

SEQ ID NO: 17818 - RNA, 64 nt, Human
ucccugcugcuccccuaggacgcggcuaaacucuuggccaaaaggcgguacucacguggcggaa

SEQ ID NO: 17819 - RNA, 64 nt, Human
uuucauauuucuuuugacuuagaguauuaauacauggccaaaauaauuuaguuacuaccucaua

SEQ ID NO: 17820 - RNA, 64 nt, Human
augcgggaacuguuuaacaaauacuuuaaaaauuuggccaaaauuuaaacuguauaauggagcu

SEQ ID NO: 17821 - RNA, 64 nt, Human
uugauuaaagacggcuguuccaaaugggagaaauuggccaaaauaaagggguuacagggcccau

SEQ ID NO: 17822 - RNA, 64 nt, Human
caauucuccugauauugucauccagggcuuuucuuggccaaacccccuagaauuuccaugucuc

SEQ ID NO: 17823 - RNA, 64 nt, Human
acaucuucagcauuuuguaccaucugcuccccaauggccaaaaucacaucaccaggccgcagac

SEQ ID NO: 17824 - RNA, 64 nt, Human
uuuccuuccaccucuuugaccuucccuccagcguuggccaaauugugcugaggaagaugcauca

SEQ ID NO: 17825 - RNA, 64 nt, Human
caguaaugcuccauugcucuaaccuccugcuguguggccaaacggauauccuaauagaaauuga

SEQ ID NO: 17826 - RNA, 64 nt, Human
auuaagaagaacauaaauuuugagcuaguaacucuggccaaauaaauacacucaaguuuuuauc

SEQ ID NO: 17827 - RNA, 64 nt, Human
aagagcugagauuacaggcgugagccaccaugccuggccaaaacaccugauuuuuaaaugguag

SEQ ID NO: 17828 - RNA, 64 nt, Human
aacagacacagggagaguugguugucucuucacuuggccaaauguaagugaagaacagagucuu

SEQ ID NO: 17829 - RNA, 64 nt, Human
ugaaauuaacacaaaggaaguccaaccugagaaauggccaaauauauuuccugauaacauuaug

SEQ ID NO: 17830 - RNA, 64 nt, Human
ggcaaauaaacucuuuaacaggcaauuauauugcuggccaaaauaugcuauauuuguauacaaa

SEQ ID NO: 17831 - RNA, 64 nt, Human
ccauauguguuuucugcaguuauuucucuuguucuggccaaacaacccuaaaaauccuuaccau

SEQ ID NO: 17832 - RNA, 64 nt, Human
cuguuaauuuugagucaauucuaccccugacauuuggccaaaagcuuacuuaaaauuaaggauu

SEQ ID NO: 17833 - RNA, 64 nt, Human
agauccugguugguguugcagaagguuuacucuguggccaaaggagggucaggaaggaugagca

SEQ ID NO: 17834 - RNA, 64 nt, Human
auucaagugguauagcucugagcagggucacauuuggccaaaccugacacugucuugcugcauu

SEQ ID NO: 17835 - RNA, 64 nt, Human
ggccauggcauuuaacuaagugcaccugugaucuuggccaaaaaaccauugcaacucacaguaa

SEQ ID NO: 17836 - RNA, 64 nt, Human
aggagggaaaaggaagaggacaaaggagggugguuggccaaaguggcagagcucuguugcuguu

SEQ ID NO: 17837 - RNA, 64 nt, Human
aagggcugagauuacaggugugagcuaccucaccuggccaaaacaguuuuuuuagaaaugaagu

SEQ ID NO: 17838 - RNA, 64 nt, Human
gaaagagagaguugagaccaaucuuuauuuguacuggccaaauacugaauaaacaguugaagga

SEQ ID NO: 17839 - RNA, 64 nt, Human
agaauuaauuacuuuuaucuuuugucuucauuuguggccaaaauuauguuuacuagaggaaauu

SEQ ID NO: 17840 - RNA, 64 nt, Human
uucccacccugagguggguuacauaccugcccaauggccaaaggaaccgccuugugagaccaaa

SEQ ID NO: 17841 - RNA, 64 nt, Human
agugaggaggaggagcuggaaaccugggguggguuggccaaaggagaaccucaagcuccuggcc

SEQ ID NO: 17842 - RNA, 64 nt, Human
cccaaccugagaccuguuccccaucgcuaccauuuggccaaacaaccggcuacaaugcucuucc

SEQ ID NO: 17843 - RNA, 64 nt, Human
ggaggggaguagagaaguuacacagaaaugcugcuggccaaauagcaaagacaaccugggaagg

SEQ ID NO: 17844 - RNA, 64 nt, Human
aaccucaagccccugacccccaagggcacaacgguggccaaacucagggcucacaggccagcag

SEQ ID NO: 17845 - RNA, 64 nt, Human
gugagccugggaagugggugucuccaguuccauguggccaaauccuagggccucaaccucgcau

SEQ ID NO: 17846 - RNA, 64 nt, Human
ugagcuuagaggaagaaagaaaacaauuuuuauuuggccaaaacagaacaaaugcugaaaagga

SEQ ID NO: 17847 - RNA, 64 nt, Human
cuuaaauagaaacaagguccuucaaauguuccuuuggccaaaagcugaagggaguuacugagaa

SEQ ID NO: 17848 - RNA, 64 nt, Human
gcaguguuuugcagacuuuggggaguggucuauguggccaaauauuguguguauagacagaauu

SEQ ID NO: 17849 - RNA, 64 nt, Human
cgauaacggguguggguugguuuuguuugcaaaauggccaaaaaaaaaaaccggcuuccccgag

SEQ ID NO: 17850 - RNA, 64 nt, Human
caaacaugagaccucccuguuacagguggucaguuggccaaauguacuaacgggcacaugaaag

SEQ ID NO: 17851 - RNA, 64 nt, Human
augaaaucuuguuacuagaacaagaaaugucagauggccaaaaacaagaugaccagauuugauc

SEQ ID NO: 17852 - RNA, 64 nt, Human
uaaucccuuugaaaaucaaguaguagagccaaguuggccaaaaaacuuggauauuuaaaaagac

SEQ ID NO: 17853 - RNA, 64 nt, Human
ucuguugccaccuucuuucaugcacauuccucuuuggccaaacuggcugcucuuuguuuguaag

SEQ ID NO: 17854 - RNA, 64 nt, Human
gaugguuguauuauuuucucugaauccucuucacuggccaaagguuggcagauagaggcaacuc

SEQ ID NO: 17855 - RNA, 64 nt, Human
cugaagagaacucucucuucccacuaagugagucuggccaaaauguaaaccccacccucccugc

SEQ ID NO: 17856 - RNA, 64 nt, Human
uuagguugaacugaaaggguuuuuguaaauuuuuuggccaaaauuuuuuaaaacauacuuacuu

SEQ ID NO: 17857 - RNA, 64 nt, Human
cagaaaagaaaaccauuuuaguuccuuuauuuaauggccaaaugguuuuugcaagauuuaacac

SEQ ID NO: 17858 - RNA, 55 nt, Human
gaagagcagagaaaucuuaagacgguggccaaauuaaagugcuggccuucagaug

SEQ ID NO: 17859 - RNA, 64 nt, Human
uguacacaaauauuuauagcagaauuauucauaauggccaaaagcugaauacaacccaaauguc

SEQ ID NO: 17860 - RNA, 64 nt, Human
aaggcuuugcuuacuaaguuucugaguggcggaguggccaaacccuagagcuagcaguucccau

SEQ ID NO: 17861 - RNA, 64 nt, Human
aauaaguucacauuacagaaaagguuccauaauuuggccaaacugcaugcauguaaugcuuauu

SEQ ID NO: 17862 - RNA, 64 nt, Human
gucagacuuuaaagaauaauaugcugccaaauuuuggccaaaguguuaaucuuaggggagagcu

SEQ ID NO: 17863 - RNA, 64 nt, Human
uagacucucuuagaaacaagugacuccuucccaguggccaaaacuuaaucaucagagcgcuucc

SEQ ID NO: 17864 - RNA, 64 nt, Human
cuaaucuagcuugccauuauuguguguguaauuauggccaaaaggacauaggagauggacuaag

SEQ ID NO: 17865 - RNA, 64 nt, Human
gggggccggcacugcugcuuagaguggaggaggcuggccaaagagacugugggcuguuuucagu

SEQ ID NO: 17866 - RNA, 64 nt, Human
uuucauguuugaccuuuaaggugaaaaaagaaaauggccaaacccaacaaacuaacauuccuac

SEQ ID NO: 17867 - RNA, 64 nt, Human
ggagaucaaaaggaaugauguauuuuuuacguguuggccaaagucacuggauaaaaugagaauu

SEQ ID NO: 17868 - RNA, 64 nt, Human
uuccaacagucugcuccucagccugagauguucuuggccaaacuugaauuuucacaugaguaug

SEQ ID NO: 17869 - RNA, 64 nt, Human
acuaaaacaacaaugcaaaccuuucagcauuguuuggccaaacuuguuaaaacuguaaugcaag

SEQ ID NO: 17870 - RNA, 64 nt, Human
uuccaagucuuggggagaaaacauccuccucugauggccaaagcccuggaaucaaggguuucca

SEQ ID NO: 17871 - RNA, 64 nt, Human
accuuuacauaugaagguuuaaaaauacaucauguggccaaagaaugagaaaggacagaauuaa

SEQ ID NO: 17872 - RNA, 64 nt, Human
auuuuauugccuuuuaauagauauuuugucauuuuggccaaacaaaagacacugaguaguuaca

SEQ ID NO: 17873 - RNA, 64 nt, Human
uucacuuuaugacugacaauuaaaaaauauuguuuggccaaauaguaaacacccuuuugaaacc

SEQ ID NO: 17874 - RNA, 64 nt, Human
aauuuuaagugauaugaaauacuugucaugucuuuggccaaaucagaagauauucauccugcuu

SEQ ID NO: 17875 - RNA, 64 nt, Human
uauguaauauacacaaacucaauuagcauuguaauggccaaaugcauucccccaugcuuuucug

SEQ ID NO: 17876 - RNA, 64 nt, Human
ggauuguugucccaacccuguacuguacucccaguggccaaacuuauuuaugcugcuaaaugaa

SEQ ID NO: 17877 - RNA, 64 nt, Human
ugugaagcuucagaaauguuuuuucuuuuccuuguggccaaaccaguuuguuaaucugauuaua

SEQ ID NO: 17878 - RNA, 64 nt, Human
agacaccuuuuaaagugccucuaaauucaucagauggccaaacuguauuuauaauccacuuagg

SEQ ID NO: 17879 - RNA, 64 nt, Human
accaacuaacuggucguuugauuaggaaacaguuuggccaaaguaccaccuuugagaccuaagu

SEQ ID NO: 17880 - RNA, 64 nt, Human
aguccucccccagcucugucaaugacuaugaccuuggccaaagcacuucacugcucugggcugc

SEQ ID NO: 17881 - RNA, 64 nt, Human
aauaguccuccaaaacacaagggaggauuuuggguggccaaaguguacaauuuucaucccacaa

SEQ ID NO: 17882 - RNA, 64 nt, Human
ggacuaugcuguagauaucaguaugaucuggguguggccaaaaacaauuuucuuuauucugucu

SEQ ID NO: 17883 - RNA, 64 nt, Human
uggauaacuugaggucaugaguucgaaaccagccuggccaaaacagugaaaccccgucucuacu

SEQ ID NO: 17884 - RNA, 64 nt, Human
gaaauggaauaaaauguuuguggguaaaagcuaauggccaaaaugguugcaaucauucauacua

SEQ ID NO: 17885 - RNA, 64 nt, Human
acucaggggauuaaguuugaaacauagugucuuuuggccaaauugaaccuacuuguaaugugga

SEQ ID NO: 17886 - RNA, 64 nt, Human
uauugaucuuuaaagaugugcuaaaugacuuuuuuggccaaaggcuuaguugugaaaaauauaa

SEQ ID NO: 17887 - RNA, 64 nt, Human
aaaauauaauuuuuaaauuauacauucaagguaguggccaaauguaacacaucaaucauggaau

SEQ ID NO: 17888 - RNA, 64 nt, Human
aagugcugggauuacaggcacgagccaccacaccuggccaaaaaaauuuauauuuuuugagaca

SEQ ID NO: 17889 - RNA, 64 nt, Human
gcaauuaauauuucaauauuuuaugugcuuauauuggccaaaauauggacacaaauauagacua

SEQ ID NO: 17890 - RNA, 64 nt, Human
aauguaaucuguguuuucugguuuuucauuuauuuggccaaaauguuauauuaauggaguuauu

SEQ ID NO: 17891 - RNA, 64 nt, Human
aguacugucaaagacuuugggggucuaacuaaaauggccaaaguuccaacuuccuuaaauuuca

SEQ ID NO: 17892 - RNA, 64 nt, Human
aauuugagauacccaggacccuuucaagcaagaauggccaaaaagccuugugcugucuuugcuc

SEQ ID NO: 17893 - RNA, 64 nt, Human
ggcugcgugaaguccagugacccugaggggauuuuggccaaaggaaacagccagggcugggcua

SEQ ID NO: 17894 - RNA, 64 nt, Human
agucuucaauguccacuaauucacucuaagcauuuggccaaaaaaaggagagagaaauaacuga

SEQ ID NO: 17895 - RNA, 64 nt, Human
aggaucaccugaggucaggaguuugagaccagucuggccaaaauaguggaaccccgucgcuacu

SEQ ID NO: 17896 - RNA, 64 nt, Human
cagggccccugugggcacuagguguaaaaggugcuggccaaaugguucagggugaagagggcuc

SEQ ID NO: 17897 - RNA, 64 nt, Human
uccagggccccacgguccccaggaggacgcuuccuggccaaagccccaagccuuuggugagaag

SEQ ID NO: 17898 - RNA, 64 nt, Human
acaagaauaauuagcaauacugagugaaggauguuggccaaaagcugcuuuccauggcacacug

SEQ ID NO: 17899 - RNA, 64 nt, Human
uccauaauauuucauaaaaugaagaaaaagaauguggccaaacaauuauucaccauggauugcc

SEQ ID NO: 17900 - RNA, 64 nt, Human
uacuuuguagacuuugaccacuuaaaauacuaaguggccaaaugauaaaaaaaacugcucccug

SEQ ID NO: 17901 - RNA, 64 nt, Human
gguucucccuuggccacugucagcuuuucuugacuggccaaaacugcccauucuuccuggaaug

SEQ ID NO: 17902 - RNA, 64 nt, Human
uuccuggaccagugaccaaaccucauaugugaaauggccaaagcacaugcaggcuccugguugu

SEQ ID NO: 17903 - RNA, 64 nt, Human
acccucacagggagggauaauuuagacucugguauggccaaagauuugagcacaaaggcaaccg

SEQ ID NO: 17904 - RNA, 64 nt, Human
ugcagaaacccugagcagaaagaggccuucuggauggccaaacccaagauuauuaaaagauguc

SEQ ID NO: 17905 - RNA, 64 nt, Human
acuaagccacaagaaauuugauuucuauucaagguggccaaauuauuuguguaauagaaaacug

SEQ ID NO: 17906 - RNA, 64 nt, Human
acaaccucucugugccaugaagauaagucuuccauggccaaaucggucauccgcacugcccuug

SEQ ID NO: 17907 - RNA, 64 nt, Human
ccaucugucaacaggggcgugaggucccaggaaguggccaaaagcuagacagauccccguuccu

SEQ ID NO: 17908 - RNA, 64 nt, Human
aagcagccaccagagggccccaaguggcagcaacuggccaaaggagaugcagccagcuaagacu

SEQ ID NO: 17909 - RNA, 64 nt, Human
cuggguucuucaucccaaguuucccaggcacuuuuggccaaaggaaggaaggaacuaauucuuc

SEQ ID NO: 17910 - RNA, 64 nt, Human
gucucacuggccccaagucucccacccagaacucuggccaaaaauggcucucuaggugggcugu

SEQ ID NO: 17911 - RNA, 64 nt, Human
ggggacugaguuaugggagaaggggacauauuuguggccaaaaugauacuaaccaaaggggcuu

SEQ ID NO: 17912 - RNA, 64 nt, Human
ucagaugccauuuuauauguggacguauuuauacuggccaaacauauuuuuucuuuugucccuu

SEQ ID NO: 17913 - RNA, 64 nt, Human
uguaaggcuauauauuuuucuuuaaauaaagcuuuggccaaaucccauauacuuugauaaagug

SEQ ID NO: 17914 - RNA, 64 nt, Human
guccauuucugggguucccgaugggaagguucaguggccaaaugaagauaagugugcaguuucu

SEQ ID NO: 17915 - RNA, 64 nt, Human
aucaccguggagugaggaaaacagucagcuguccuggccaaagggguuuggaaggacaccaaga

SEQ ID NO: 17916 - RNA, 64 nt, Human
gugcagaccagauccagaagaaaggccuggcguguggccaaacagcgugaaaccuuggcacagg

SEQ ID NO: 17917 - RNA, 64 nt, Human
cuccaccagaagagacaucuauuuaaaggcacacuggccaaaacguuugugcaucugucacucu

SEQ ID NO: 17918 - RNA, 64 nt, Human
uuacauaguagcauguaucaacacuucauuuuuauggccaaauaaaauuguauuauguguuuau

SEQ ID NO: 17919 - RNA, 64 nt, Human
cagucaaucaaacuuacauuccugccaagaugcauggccaaaaaacuaaguaucaaagcagcag

SEQ ID NO: 17920 - RNA, 64 nt, Human
uauauuccagguuuaaguagauuucaugccuggguggccaaacaacagucuucauuuuuuuuaa

SEQ ID NO: 17921 - RNA, 64 nt, Human
uuuccuggaacaaugcuaauuaggauugcauuccuggccaaagacaugacaucaaauaaguaau

SEQ ID NO: 17922 - RNA, 64 nt, Human
auuuugcucuuuggccugguguggacggaaaggguggccaaauggauugagugaugagcagaca

SEQ ID NO: 17923 - RNA, 64 nt, Human
agauacugaaucaucaugaaaugaacucuacuucuggccaaagcacaauguauuugcaguuuuc

SEQ ID NO: 17924 - RNA, 64 nt, Human
gggugaaauccauacuguagacacucugacaagcuggccaaagucacuuccccaagaucugcca

SEQ ID NO: 17925 - RNA, 64 nt, Human
uacauugaaaauguuaauauuauuuauggaccucuggccaaaugguacauguacuggaagugga

SEQ ID NO: 17926 - RNA, 64 nt, Human
cugagcgcagggcuugaauuguuagucccaacucuggccaaagauacuuuuuuccagagacaga

SEQ ID NO: 17927 - RNA, 64 nt, Human
gaaaguuaaccccauguccucagcauuucuuuucuggccaaaagcaguaaauuugcuagcagua

SEQ ID NO: 17928 - RNA, 64 nt, Human
accuuguccuuguaauuacauucauuguuuguuuuggccaaauaaaaaugcuuguauuucuuua

SEQ ID NO: 17929 - RNA, 64 nt, Human
uuugaauuguauuagcuuaaugucuacauaucuuuggccaaaacucuauugucauauuagaaac

SEQ ID NO: 17930 - RNA, 64 nt, Human
gagugcagggauuacaggcgugagccacugcucguggccaaaaguuuucuuuuuuuuuuuuuuu

SEQ ID NO: 17931 - RNA, 64 nt, Human
cuaaaaaguggcuaauucaauuuaugggguauaguggccaaauagcacauccuccaacguuaaa

SEQ ID NO: 17932 - RNA, 64 nt, Human
ccaaguaugaggugaacggggugaaaccucccauuggccaaaggacacggcucagcaaggggga

SEQ ID NO: 17933 - RNA, 64 nt, Human
uuaauagaaagaucuauguuuauaaaccagcacuuggccaaaaacaaaauuguaaaggaaauuu

SEQ ID NO: 17934 - RNA, 64 nt, Human
auacaaguuucagacagggucugaaggacuggauuggccaaacaucagaccugucuuccaagga

SEQ ID NO: 17935 - RNA, 64 nt, Human
cugaucgcuugaggucaggaguucgagaccagccuggccaaaauagugaaacucacguuucuac

SEQ ID NO: 17936 - RNA, 61 nt, Human
uggagauuauugggaaauaaaacggugcguuuggccaaaaagaaucugcauuuagcacaaa

SEQ ID NO: 17937 - RNA, 64 nt, Human
ccaaaacauagagccagcuugaaggggcucccacuggccaaacuugagccaaucugagagcaaa

SEQ ID NO: 17938 - RNA, 64 nt, Human
uuuuuucaaucuugcaauuugauaauuuugauuuuggccaaauuacuuuaauuugggaauaucc

SEQ ID NO: 17939 - RNA, 64 nt, Human
aacgauguugaccuguuaaguauucucugaaacauggccaaaaugcauuuuaugagcuuuuuuu

SEQ ID NO: 17940 - RNA, 64 nt, Human
uuauggacaauguucagcugacauaagcagaaguuggccaaaauacugccuguacuguuaauuu

SEQ ID NO: 17941 - RNA, 64 nt, Human
uggguuggcaauggcuuugugggaucauaugucuuggccaaagaugggaaaaccuauguugaag

SEQ ID NO: 17942 - RNA, 64 nt, Human
uaacccuugaauuucuagacaguauugccaccucuggccaaauaugcacuuucccuagaaagcc

SEQ ID NO: 17943 - RNA, 64 nt, Human
aagaaacuccagauaucaaggaauugggaaauccuggccaaaccaccccaagaugauuacacug

SEQ ID NO: 17944 - RNA, 64 nt, Human
uuuguuauucguggggguuuaauuacauuacaaguggccaaaaccccuguucucagugaagaac

SEQ ID NO: 17945 - RNA, 64 nt, Human
guaaccagagagcacagagaaaugcuggugaaacuggccaaacagaacaccaacaaggccaaag

SEQ ID NO: 17946 - RNA, 64 nt, Human
agagugggcagggacagugguagcauccaucugguggccaaagagaaucguagccccagagcug

SEQ ID NO: 17947 - RNA, 64 nt, Human
cucaccagcaggcugcggggcacuguguucucauuggccaaaaacauccuuuugcucugucucg

SEQ ID NO: 17948 - RNA, 64 nt, Human
caagauaggcaaaguuuuuucccuacaucucuuuuggccaaaagaauaucugaccaucacagag

SEQ ID NO: 17949 - RNA, 64 nt, Human
cgggaggcugaggcaggagaaucucuuucuuaauuggccaaauauaaguuggugucguaacucc

SEQ ID NO: 17950 - RNA, 64 nt, Human
guauagguuaaauggaagaagaaacagaacuucauggccaaaguagaccuauagauuuugauug

SEQ ID NO: 17951 - RNA, 64 nt, Human
ugcacgcuccucaaacaucuuuggaggaacuaccuggccaaaacacuggccaggaugcagcaag

SEQ ID NO: 17952 - RNA, 64 nt, Human
gugguuccuauuuauugaggaagaaagagcugucuggccaaaggaaaucuauuuuuucccuuca

SEQ ID NO: 17953 - RNA, 64 nt, Human
ucauguuuugguuuaguuauagucgcuauggauuuggccaaauaaaaaggcaaacaacaugaca

SEQ ID NO: 17954 - RNA, 64 nt, Human
cauaaauuuuuuuuagaugugauaaagcuaaacuuggccaaagugugugccugaauuauuagac

SEQ ID NO: 17955 - RNA, 64 nt, Human
aucuuuaguuggagcacacccuugaacugaacaguggccaaaggaaagcuuucugggcuuugga

SEQ ID NO: 17956 - RNA, 64 nt, Human
gaaacacuugauauugcacagugcacuuauuuuguggccaaagcauggccuuaccagcuugucu

SEQ ID NO: 17957 - RNA, 64 nt, Human
auauagcuuaguauaaaaauaaaauucaacguuuuggccaaaauguuuguuuuucacuggauuc

SEQ ID NO: 17958 - RNA, 64 nt, Human
aauguguauauagaauuguucacuguaaaaaaaauggccaaaauguguuuuuuuuuuaauaagu

SEQ ID NO: 17959 - RNA, 64 nt, Human
ugcguuucacacuucuuuagagcuagcugaccuuuggccaaaaauaaacuuugaaaagaaacaa

SEQ ID NO: 17960 - RNA, 64 nt, Human
ucuuuauaagcugguaaaccaagaaucuagggaguggccaaacuaaauauaauuucuuuaaaaa

SEQ ID NO: 17961 - RNA, 64 nt, Human
uccuuucaggauuuguaguaacguaaggugauaauggccaaaagugguucucucucauuaaacc

SEQ ID NO: 17962 - RNA, 64 nt, Human
ccaccagccaccucucaggagaagccagaggcccuggccaaagauaggaggaagaaagagaacu

SEQ ID NO: 17963 - RNA, 64 nt, Human
guauacuguauuuuuuuaaaaaaauggugcagcguggccaaaccuaccaauuguaugcauuaac

SEQ ID NO: 17964 - RNA, 64 nt, Human
auuaggugauuuugcauaggggccauaucauucauggccaaaaaaaaccaaaaagcaaaaaaca

SEQ ID NO: 17965 - RNA, 64 nt, Human
ugacaguaucugcagauacuauaauaauaugcuuuggccaaauuugcuguuuauagagugaacc

SEQ ID NO: 17966 - RNA, 64 nt, Human
uguuacuugggggaggaaagaaacuccugaucauuggccaaagggacuuaccccuggagaggcc

SEQ ID NO: 17967 - RNA, 64 nt, Human
gcuggcuaccagcuuugacacagcacuguucaucuggccaaacaacugugguuaaaaacacaug

SEQ ID NO: 17968 - RNA, 64 nt, Human
ucccuggugauguuggaacauuaaugauggaacauggccaaacuucagucaugauccugaagcc

SEQ ID NO: 17969 - RNA, 64 nt, Human
cagaagacgugaaggcagauuuucauucuucuucuggccaaagcucaguacaagacacauguuu

SEQ ID NO: 17970 - RNA, 64 nt, Human
agaacugcccauuuccauggugcaaaaacucuuauggccaaauucaaacuauaaacaugauguc

SEQ ID NO: 17971 - RNA, 64 nt, Human
uaaaaguaaaguguuuccaugcuauuucauguuuuggccaaaaauuuuuaaaaaauaaauuaca

SEQ ID NO: 17972 - RNA, 64 nt, Human
cagagcuagacacucauucagaagcuuuucguuuuggccaaaguugaccacuacucuucuuacu

SEQ ID NO: 17973 - RNA, 64 nt, Human
gcaauguuguuccagagucaacgaggaagacuaauggccaaaacauaguggaggugcugugugu

SEQ ID NO: 17974 - RNA, 64 nt, Human
gaccuuuacugauacuacaacuuuuguuuucugauggccaaaauaccaaaugccuguuguauuu

SEQ ID NO: 17975 - RNA, 64 nt, Human
aagugcugggauuacaggcgugagccaccgcgccuggccaaaacaacauuuuaaguagaagauc

SEQ ID NO: 17976 - RNA, 64 nt, Human
uugauuauuuugugcaacauaacaauucggcaguuggccaaaacuuaaaagcaagaucuacuac

SEQ ID NO: 17977 - RNA, 64 nt, Human
ggccugagccacguccucuaggagcagcuggagauggccaaaagagugagcucaggacuacugg

SEQ ID NO: 17978 - RNA, 64 nt, Human
cagcucucaguauauuccgugucguguguguguguggccaaagcccccaaggguggcaagugcc

SEQ ID NO: 17979 - RNA, 64 nt, Human
aaaccucagauauuuauguggguagguacuuaaauggccaaaaacuuuaacuaugaaauguuac

SEQ ID NO: 17980 - RNA, 64 nt, Human
uuggcucugucccuguggcgauggcagggcaggguggccaaacaggucaggugcuuguucuguc

SEQ ID NO: 17981 - RNA, 64 nt, Human
ccuggcagagaagagaccaagcuuguuucccugcuggccaaagucaguaggagaggaugcacag

SEQ ID NO: 17982 - RNA, 64 nt, Human
aggucaacucugauagauucagaugacuagaaauuggccaaaaaagcagggagaagaacaugag

SEQ ID NO: 17983 - RNA, 64 nt, Human
cccagccugccaaauuuugauccuuccccucuuuuggccaaauccuagggggaagaaauccuag

SEQ ID NO: 17984 - RNA, 64 nt, Human
uuugugccuuaaagauuaacuacaaagauaaacauggccaaaaauaaauaaauaaauauggcca

SEQ ID NO: 17985 - RNA, 64 nt, Human
cagauuuccaggugaaguucugacccuaccuguuuggccaaagacguaaauugagaggaaaggc

SEQ ID NO: 17986 - RNA, 64 nt, Human
gcucuuucacuaauuccuaauaugaaauguaugauggccaaagacaaauuguauugauuauaau

SEQ ID NO: 17987 - RNA, 64 nt, Human
cuagacauggccucuggaaaaaggaaaucuuugguggccaaagauuuccuuucuguggugaggg

SEQ ID NO: 17988 - RNA, 64 nt, Human
cugaugcucaacaucccuuaccuccuuucguugauggccaaagcaaaggagaguccugggagcc

SEQ ID NO: 17989 - RNA, 64 nt, Human
aaggucucugccccaggcauggugcucuauaucuuggccaaauaaauuacuuuccuugaauauc

SEQ ID NO: 17990 - RNA, 64 nt, Human
cccaucucuacaucugggcacagcaacccagagauggccaaaagcauucaagccugggggaaga

SEQ ID NO: 17991 - RNA, 64 nt, Human
auuuccuacuccuuugcuacguguauuggaccucuggccaaauuacaaaagauguacucuuugu

SEQ ID NO: 17992 - RNA, 64 nt, Human
ggccagcucauaaaauggaagcaauugcucauguuggccaaacauggugcaccgagugauuucc

SEQ ID NO: 17993 - RNA, 64 nt, Human
aauugaccaaccuaauguuacaacuacuuugagguggccaaauguaaacuaaaagccuuaauua

SEQ ID NO: 17994 - RNA, 64 nt, Human
uuggcagugaauuuuuuuuuaagccacuuaauuguggccaaagcuauucagcugugauaauagu

SEQ ID NO: 17995 - RNA, 64 nt, Human
gggaaccugaggcuuguucuugaagugggcaagcuggccaaaauauuggaacacacagaaccaa

SEQ ID NO: 17996 - RNA, 64 nt, Human
guaguggauaauucauuuugauggcuucuauuuuuggccaaaugagaauuaagccagugccuga

SEQ ID NO: 17997 - RNA, 64 nt, Human
agauucugcauccccacagccuaaacugagccaguggccaaacaaccgugcucagccuguuucu

SEQ ID NO: 17998 - RNA, 64 nt, Human
gucuguauuuaauggccugaacugagaguugauauggccaaagggagagaggccuuuuaaaaua

SEQ ID NO: 17999 - RNA, 64 nt, Human
aagugcugggauuacaggcgugagccaccaugccuggccaaaauaugcaaauauuuuuuauccu

SEQ ID NO: 18000 - RNA, 64 nt, Human
ucuuccgugcagagcaaaaucacucaggaucucauggccaaagucagagcgaugcuugcagcuu

SEQ ID NO: 18001 - RNA, 64 nt, Human
ucuacgguuacaugccugaaacagucagaaggguuggccaaaucucacuaaaugcaaauuugaa

SEQ ID NO: 18002 - RNA, 64 nt, Human
aaacguucuaugugcaguccaauaggguagcaacuggccaaaugaggccuacugauuacuugag

SEQ ID NO: 18003 - RNA, 64 nt, Human
caucccauaggaggccuauguggagcauuaacuguggccaaaggaggcagcgggaacaggcugc

SEQ ID NO: 18004 - RNA, 64 nt, Human
aaaucacccaauuuuaggcucuuuucugcaaggauggccaaaauuaaucauuuuuaaaaaguag

SEQ ID NO: 18005 - RNA, 64 nt, Human
cucucuuccaagccccacccuaaggguuagcccuuggccaaaucuuuugccgucuaggcccagc

SEQ ID NO: 18006 - RNA, 64 nt, Human
aacugagaugcugaaggugagaggaaauguugacuggccaaaaauaucuuuuuucccccacugc

SEQ ID NO: 18007 - RNA, 64 nt, Human
cauugucuuugauacauuuauuuuaauucuuaaguggccaaauaacagauuagguaaaaugaga

SEQ ID NO: 18008 - RNA, 64 nt, Human
ggugcuauuuuguaguuuguuauaugaaagagucuggccaaaacgguaauacgugaaagcaaaa

SEQ ID NO: 18009 - RNA, 64 nt, Human
agaguuuacuaaaaguaaccaucuaaagagcuuguggccaaaccagcagaacauucuucucuuc

SEQ ID NO: 18010 - RNA, 64 nt, Human
gcccccuuccuccccccgugucaacuuucagugcuggccaaaaccuggccgucucuucuauuca

SEQ ID NO: 18011 - RNA, 64 nt, Human
acaaacagaaaacauguaaagcaguauuaaaauuuggccaaacaaguguucuguaucuacuuua

SEQ ID NO: 18012 - RNA, 64 nt, Human
uugaugaaaccugagguauaagagauauuuuuacuggccaaaauggaacuucuagggaugaaau

SEQ ID NO: 18013 - RNA, 64 nt, Human
gcuggagaaagccagacugaugggaaugagacuuuggccaaaaaucccaaaacaucauuuucaa

SEQ ID NO: 18014 - RNA, 64 nt, Human
uucucuuguaaagaagcugaaauucguacuauauuggccaaagugagcgaguuaggugaucuug

SEQ ID NO: 18015 - RNA, 64 nt, Human
agaacugcaaugaacaaucugacaaaugugaagcuggccaaaagucggaaaaugagaaugaggg

SEQ ID NO: 18016 - RNA, 64 nt, Human
gaaagucuggcuguucucaauaauuucauuuucuuggccaaagccaaaaggaaucaaaaaaucc

SEQ ID NO: 18017 - RNA, 64 nt, Human
cuucaugaaccagaaugaaucaaaucuuuuuguuuggccaaaauguaauacauuccagucuaca

SEQ ID NO: 18018 - RNA, 64 nt, Human
guucaaacaccuuuuaguauugauagcuuacauauggccaaaggaauacaguuuauagcaaaac

SEQ ID NO: 18019 - RNA, 64 nt, Human
cacugcuaauaauucuguaaggacacaucaaagcuggccaaaauaaugaauuuuuuuuaaaaag

SEQ ID NO: 18020 - RNA, 64 nt, Human
augcucacuggccaauaaagagcuugaugcugccuggccaaaugaggugacucagauagaaucu

SEQ ID NO: 18021 - RNA, 64 nt, Human
auauaauguucauaauccaccaugaaaacagcauuggccaaagguacugaggcugcuuaaaaua

SEQ ID NO: 18022 - RNA, 64 nt, Human
acccucugcuuuuccccuuuuugcaaaaaaccacuggccaaauccgaaccauugcccuuguuuc

SEQ ID NO: 18023 - RNA, 64 nt, Human
gaaauccuaucaucaugguggauuugaucuucaguggccaaacacgaauuaaaguauaauucuu

SEQ ID NO: 18024 - RNA, 64 nt, Human
guuuuuuuuuuuuuuuuuuuuucccuaaaugguauggccaaaagucagaguuaaaauauauaua

SEQ ID NO: 18025 - RNA, 64 nt, Human
aaacccauauuucacuggugguuggagaaaaccauggccaaaacgauuguggcaggucucaauc

SEQ ID NO: 18026 - RNA, 64 nt, Human
gaaauaauuucagcuuaauugaccauaagaacuguggccaaaaagaacaguuuuuuggagaggc

SEQ ID NO: 18027 - RNA, 64 nt, Human
uagcaucuaaugaaaaggacuguucaagugggucuggccaaaugugacagaugcagaucuuaga

SEQ ID NO: 18028 - RNA, 64 nt, Human
cuuuuuaucaguuacauuuuauuuuuauuuaaacuggccaaaagcaaaauuauuuuauguuaaa

SEQ ID NO: 18029 - RNA, 64 nt, Human
augcaguccacuuggucuaccuuaauuuaaccuguggccaaacucagagaugguaccagccagg

SEQ ID NO: 18030 - RNA, 64 nt, Human
acaagagacucgcuuguauuuuaagagaaccaaguggccaaagaaacucuuucuaacuuuggca

SEQ ID NO: 18031 - RNA, 64 nt, Human
aagaaaacauauauuuuauguaaaaacacauacauggccaaaugcaauacugaagagacaauca

SEQ ID NO: 18032 - RNA, 64 nt, Human
aaggaaccuaucgaagaauaauggcuuguuccacuggccaaagaugggacaauuugaacaucaa

SEQ ID NO: 18033 - RNA, 64 nt, Human
aagugcacaacauuacagggaaugccugagugccuggccaaagggauauuugguuuggccaucu

SEQ ID NO: 18034 - RNA, 64 nt, Human
ccagacacccaaacagccguggccccagagguccuggccaaauaugggggccugccuagguugg

SEQ ID NO: 18035 - RNA, 64 nt, Human
agaucacacagcuuuguacugccucucccgccuguggccaaagucguguugcagcaggcaggcu

SEQ ID NO: 18036 - RNA, 64 nt, Human
guuguuguuuuaaguuuacuggggaaagugcauuuggccaaaugaaaugguagucaagccuauu

SEQ ID NO: 18037 - RNA, 64 nt, Human
gauuaagagaauagaugcaaacaaggcaugcauuuggccaaaauaaacaaaugcuggucugucc

SEQ ID NO: 18038 - RNA, 64 nt, Human
aagguaaagaugagaagaaugauaauggagcaaguggccaaacaucagaaucgauuaaaaaaag

SEQ ID NO: 18039 - RNA, 64 nt, Human
cuucuucacaggcugaggggguucagaaccagccuggccaaaaauuacaccagagagacagagu

SEQ ID NO: 18040 - RNA, 64 nt, Human
ccagguccuuucagucuucacaguggagaacucuuggccaaagguuuuugcggggaggaggagg

SEQ ID NO: 18041 - RNA, 64 nt, Human
cuaacuugauuuuucaucucuuuaaccaaacuuguggccaaaagauauuugaccguuuccaaaa

SEQ ID NO: 18042 - RNA, 64 nt, Human
aagugcugggauuauaggcguaagccaccaugccuggccaaaaauuaaaagauuuuaugaaacg

SEQ ID NO: 18043 - RNA, 64 nt, Human
cuuuugucuaugggacucaaugcacugacauuguuggccaaagccaaagcuaggccuggccaga

SEQ ID NO: 18044 - RNA, 64 nt, Human
ugaaguuacuagggcuguucuuaccaucuccuucuggccaaauagcacaacauuuccucguucu

SEQ ID NO: 18045 - RNA, 64 nt, Human
ugucacuacgugacuguggcacacgccuuguucuuggccaaagaccaaauuccuuggcaugccu

SEQ ID NO: 18046 - RNA, 64 nt, Human
uguaguaauugcucuacagauaaugucuauauauuggccaaacuggugcaugacaaguacugua

SEQ ID NO: 18047 - RNA, 64 nt, Human
cugugauuuuuuucaauauaaaaggcacagcuguuggccaaagugaaggaaucuuuuuucaguu

SEQ ID NO: 18048 - RNA, 64 nt, Human
auggaagcaucuguaguguccaucagcaggugaauggccaaagugguauauacuguagucacau

SEQ ID NO: 18049 - RNA, 64 nt, Human
uggaucaccugaggucagcaguucaaaaucagccuggccaaaaugcugaaacuccgucucuacu

SEQ ID NO: 18050 - RNA, 64 nt, Human
cagauuuguagcgugaaagacugaauacaguguuuggccaaaaauuuuuuuaaaaaucauauua

SEQ ID NO: 18051 - RNA, 64 nt, Human
acguuccaaaguuuaaaugcauuuuuuugacucuuggccaaaauuuagaagaugcugugaauau

SEQ ID NO: 18052 - RNA, 64 nt, Human
cuuuucaauacccuaucuucccuuguuguuaagauggccaaauaauacauuuacucuaaauuga

SEQ ID NO: 18053 - RNA, 64 nt, Human
ugauccgcacgcagccacuucggcuaccuucuacuggccaaagggagucccagggcucacccag

SEQ ID NO: 18054 - RNA, 64 nt, Human
uccucguucaucacccucagucagugcccaagaguggccaaaccgcuucacaucugcagugcuu

SEQ ID NO: 18055 - RNA, 64 nt, Human
uagggcuuugguuuucauuccuuuuuguuuggcuuggccaaaccagaauucagcuuaucugaau

SEQ ID NO: 18056 - RNA, 64 nt, Human
uugagguaacaagauaaagacaaauccacuucuuuggccaaauucaggcuuuggcuuuaugacu

SEQ ID NO: 18057 - RNA, 64 nt, Human
uacuaguggcuuuaguauuuuucuuuguuuuaaauggccaaaagaauccagaaacauuaaggca

SEQ ID NO: 18058 - RNA, 64 nt, Human
ccaccacggcuucccucuuggcucauuccaagcuuggccaaauuggggaagugggauggagguu

SEQ ID NO: 18059 - RNA, 64 nt, Human
ggagggacaaguggugcccuguccccugcuccccuggccaaagaaagcuguccuugaggcugag

SEQ ID NO: 18060 - RNA, 64 nt, Human
ucagugucuucccuuugacaugggaaaggaguuguggccaaaauccccaucuucuugcaccuca

SEQ ID NO: 18061 - RNA, 64 nt, Human
ggcaugcagcuuguggugaguacuguucuaggacuggccaaaaaugggcaaaauguaucacucc

SEQ ID NO: 18062 - RNA, 64 nt, Human
uuaacaaauccccuccuuaaacggagcuauaagguggccaaaucugagaacaauuaaauucauu

SEQ ID NO: 18063 - RNA, 64 nt, Human
ccuccuugccuucccuucugugugaccgaccccuuggccaaaaaaaaacaaaaagcaaaaaaca

SEQ ID NO: 18064 - RNA, 64 nt, Human
ccagcagcccugucuguuaccaugugagucauacuggccaaagcuuaguccuagcauaugcacc

SEQ ID NO: 18065 - RNA, 64 nt, Human
acaucucugcccucuucucaucccccagccacaguggccaaagaggcccccacuaggcacugug

SEQ ID NO: 18066 - RNA, 64 nt, Human
aauuuaugagauuuacugcucuagaaaguauagauggccaaaggaccguuuuguauugcuuccu

SEQ ID NO: 18067 - RNA, 64 nt, Human
aagcucuaagaugagagcaaaugccugaucacucuggccaaaugucagauacuaaagcccauuc

SEQ ID NO: 18068 - RNA, 64 nt, Human
ugcaccaggguacuccucacagcgccaucaccaauggccaaaacuccucucaacggugaccucu

SEQ ID NO: 18069 - RNA, 64 nt, Human
gcaggagcaucaggcggccggcgcauggcgugucuggccaaaucuucccgacaggugagccagc

SEQ ID NO: 18070 - RNA, 64 nt, Human
gccaggucuucuggagaugacauuugaggacugauggccaaagagcaugggggacugaagcccu

SEQ ID NO: 18071 - RNA, 64 nt, Human
gccagcccagcucuccccucugcacccuuggcucuggccaaagcuugcucccugcucccacaca

SEQ ID NO: 18072 - RNA, 64 nt, Human
uccuuuucuguuauuauucacuacgaagcuaaaauggccaaauauauaccgugaaaauugguuu

SEQ ID NO: 18073 - RNA, 64 nt, Human
uuucagagcuguuguggguguaagugacaugauguggccaaaaauccaaacugugcaguugcgu

SEQ ID NO: 18074 - RNA, 64 nt, Human
uuggagaguuuacccauacauuuagcaaauugaauggccaaaacauuugacuccagugagggcu

SEQ ID NO: 18075 - RNA, 64 nt, Human
cuucuucaagaguugcggcccugauccucucaaguggccaaaagcuuuuuuaacuuuucaaucu

SEQ ID NO: 18076 - RNA, 64 nt, Human
aggcauuucuauuucacaaucgaauugaacacauuggccaaauaaaguugaaauuuuaccaccu

SEQ ID NO: 18077 - RNA, 64 nt, Human
guugucccugcugccucccucuggaguggccacuuggccaaagcgcccauccacaucuggaaag

SEQ ID NO: 18078 - RNA, 64 nt, Human
caugcucccagggacuugcagacgaugcauuucuuggccaaaguggcuuccucaagaaagcagc

SEQ ID NO: 18079 - RNA, 64 nt, Human
auauauuuuaugauaaagggccuuuaacuuaagauggccaaagcacugauauuauauauuugcu

SEQ ID NO: 18080 - RNA, 64 nt, Human
cggaucuuuugaggucgggaguuggaggccagccuggccaaaauggcaaaaccccgcaucuacu

SEQ ID NO: 18081 - RNA, 64 nt, Human
agugcugggguuuacaggcuugagccacugcaccuggccaaaaaauuaacauucuaaaggauuu

SEQ ID NO: 18082 - RNA, 64 nt, Human
auuuuuacaccaggagucaacaaacuguggccauuggccaaauauggccucccaacuguuuuuu

SEQ ID NO: 18083 - RNA, 64 nt, Human
ccccacgguaggaacauagcguguuuauauuuuauggccaaacuauuuugaauuuuguuguccg

SEQ ID NO: 18084 - RNA, 64 nt, Human
uuucccugccagaccuuguuuacuagaaaucagguggccaaaacaugacucucagaguggggcu

SEQ ID NO: 18085 - RNA, 64 nt, Human
cgcuccgccuguccccaacccagucccauuuuuauggccaaacugauucugaaacaaaaugaaa

SEQ ID NO: 18086 - RNA, 64 nt, Human
cagcgacaugccccagacacguuaagggacugguuggccaaacucagacacguggacagggaua

SEQ ID NO: 18087 - RNA, 64 nt, Human
acggacccauauaucccuaccucccaccaccuaguggccaaacaccccgccaggaguucaaugc

SEQ ID NO: 18088 - RNA, 64 nt, Human
cccugcugauccgcaccccauuccuccccucccauggccaaaaaccccacugucuccuucucca

SEQ ID NO: 18089 - RNA, 64 nt, Human
ccccauugcgggcccgggaggggaaugguuucuauggccaaaguuugguuuucucaacacuguc

SEQ ID NO: 18090 - RNA, 64 nt, Human
gacaggauggcccccaggaucgcucucuuugguauggccaaagucacuuccucgucuccuccuc

SEQ ID NO: 18091 - RNA, 64 nt, Human
auugagaguuuaacaugccaagagaugugaaauguggccaaagagaugugaggguaaggggaaa

SEQ ID NO: 18092 - RNA, 64 nt, Human
cgccuggccacuccgaaggcuuuucaccccauuauggccaaauaguauagggccacuggggagg

SEQ ID NO: 18093 - RNA, 64 nt, Human
acuucuauuuaacagcuugaguauugcauuuccuuggccaaacaaaaauagcuacaaauccaca

SEQ ID NO: 18094 - RNA, 64 nt, Human
aagaaaacaccaaaaauaaagaaaagagcaaaaguggccaaaaaaugcaugucuguaauuuugg

SEQ ID NO: 18095 - RNA, 64 nt, Human
cuaaaguuuuauugaugugaaauuaaauucuuauuggccaaaugccuguuuugaugaguugauu

SEQ ID NO: 18096 - RNA, 64 nt, Human
cugauugcuugaggucaggaguuugagaccagccuggccaaaaucuauacuaaaaaaaauacaa

SEQ ID NO: 18097 - RNA, 64 nt, Human
cacuucugugccacccccggucuaugucgagagcuggccaaagagccuuuccaaagaggagcga

SEQ ID NO: 18098 - RNA, 64 nt, Human
ucuugaaaacaggggcacacagaaauuugauuuguggccaaauuggaugaaaaagaugaggcuc

SEQ ID NO: 18099 - RNA, 64 nt, Human
ggaugaucgcaaaacugagguguagagaggggaauggccaaaaucacaaagcaaguuagcguua

SEQ ID NO: 18100 - RNA, 64 nt, Human
aagugcugggauuacaggcgugagccaccuugccuggccaaaaaucucagaauucuuuaagacu

SEQ ID NO: 18101 - RNA, 64 nt, Human
ucuguccccugaguguuaauuugauuuuuagaaauggccaaaagucacgugauccaaacuuuuu

SEQ ID NO: 18102 - RNA, 64 nt, Human
ggauuuuuauuuguagucuaauuuugucaaaucauggccaaaucgcagugauaguugacuuugg

SEQ ID NO: 18103 - RNA, 64 nt, Human
gugcccuuucucaaauggguacaauguucccuuguggccaaauuucccucccagggagcaauuu

SEQ ID NO: 18104 - RNA, 64 nt, Human
augaggacccgucuuuuugcagugccaggcaggguggccaaagaggacuggacucuggaccugg

SEQ ID NO: 18105 - RNA, 64 nt, Human
gugugagcauacgaggcugaugacugcccugugcuggccaaaagauuuuuauuuuaaaugaaua

SEQ ID NO: 18106 - RNA, 64 nt, Human
ugaauuacgguuauuuaaaaacuaacauuugcuauggccaaaguguuuacaauaagcaauaaag

SEQ ID NO: 18107 - RNA, 64 nt, Human
agccuucuuuuguacuuuucauucuggaugggcuuggccaaaacaggcucaggccaaagaccuc

SEQ ID NO: 18108 - RNA, 64 nt, Human
uuuuuuguuuuguuuuuugguuuuuuuuuuuuuuuggccaaaucucgugguguuucgcagaaaa

SEQ ID NO: 18109 - RNA, 64 nt, Human
guuucaaaggaagaaccagucaccuuucacuucuuggccaaauuuuauccugagaaugcugaag

SEQ ID NO: 18110 - RNA, 64 nt, Human
ggcaccuuggcaucugugcagagacggcccagucuggccaaauccucuuccucuccccugcucu

SEQ ID NO: 18111 - RNA, 64 nt, Human
caacuuuguggaggaccuggguaacucuuacccuuggccaaaggaagagguuuuccugucuggc

SEQ ID NO: 18112 - RNA, 64 nt, Human
gcccagcagcaccugcacccacuuccagcugcucuggccaaaaucuccgcucggccaggccccg

SEQ ID NO: 18113 - RNA, 64 nt, Human
ggugccccaggaugggcuccucccggcgggggcuuggccaaagcuuucuuaauaaaaugccuuu

SEQ ID NO: 18114 - RNA, 64 nt, Human
aguuauggagcgcuccgaccagacagcgucucauuggccaaagaugggaggguuccgcuuaaag

SEQ ID NO: 18115 - RNA, 64 nt, Human
uauugguagguuacucaauuucaaaagggccccauggccaaauauguuuaggaaccgcuguuug

SEQ ID NO: 18116 - RNA, 64 nt, Human
aagugcugggauuacaggcgugagccaccgcgccuggccaaaaugcagacauuuuauuaggggg

SEQ ID NO: 18117 - RNA, 64 nt, Human
uggcugugccccugaugcagccuguggcuuggaguggccaaauaggagggagacugugguaggg

SEQ ID NO: 18118 - RNA, 64 nt, Human
guuacaucuagcagcacuaaaacuuauucaacuuuggccaaauacaaaugcgaaauuagaaaaa

SEQ ID NO: 18119 - RNA, 64 nt, Human
uggaccauguccuaauauggugguuuuaaguuguuggccaaaauccuuuaaagacauacgaaac

SEQ ID NO: 18120 - RNA, 64 nt, Human
uuggaugaugaggaauauuaccgcauggaguugcuggccaaagaauuccaggacaagacugccc

SEQ ID NO: 18121 - RNA, 64 nt, Human
ccaucugaggcuucauggacaaagauucuccacuuggccaaacuuuagccaagcuccucaaccu

SEQ ID NO: 18122 - RNA, 64 nt, Human
auucuacugaauggggguggaccuggcauuuaucuggccaaaaacaggagccagagaaauauga

SEQ ID NO: 18123 - RNA, 64 nt, Human
gguuguuuucuggauucaauuccuccugggcuauuggccaaaggcuauacucauguaagccaug

SEQ ID NO: 18124 - RNA, 64 nt, Human
uaggucuugcucugcugcccaggcuagagugcaguggccaaaugauagcucacugcagccuuga

SEQ ID NO: 18125 - RNA, 64 nt, Human
uuccauuguauuuauagucuguuuaugcuaaaucuggccaaagaugagcauuguccaccacuaa

SEQ ID NO: 18126 - RNA, 64 nt, Human
ugugcgugucucugugugugcacgugcacgcucauggccaaaugugcgcacucuacauaaagga

SEQ ID NO: 18127 - RNA, 64 nt, Human
uuuggcuuuaccuucaucuaucuugauccuuuccuggccaaauauccucuugggcccaaaugaa

SEQ ID NO: 18128 - RNA, 64 nt, Human
agaaauccaaggcugaagccaaaaguaaggaggguggccaaaugguaaacuauugguacuuguu

SEQ ID NO: 18129 - RNA, 64 nt, Human
ggagagaucaagcaaggagaaccuggggcugccauggccaaagcaacucaacagaugccaaugc

SEQ ID NO: 18130 - RNA, 64 nt, Human
ugacgggaucacuggggcucuuugugagugaggguggccaaacuaccgccggaggagauggggu

SEQ ID NO: 18131 - RNA, 64 nt, Human
ccguguggggcuaggagagcgcucuguagaguuguggccaaacuucagcuggcuuggcccucuc

SEQ ID NO: 18132 - RNA, 64 nt, Human
ugggugccugccucaugugaugauuuguauacaguggccaaagacaugcuucugcuuuucugcu

SEQ ID NO: 18133 - RNA, 64 nt, Human
auugagaauaaagaagaaaagacaccccugcaaguggccaaagguggccuggguuuaauacuca

SEQ ID NO: 18134 - RNA, 64 nt, Human
agagacaugguauugacucaacaguuuccagucauggccaaauguucaauaugagucucaauaa

SEQ ID NO: 18135 - RNA, 64 nt, Human
accccaagucccccggcccugccuggugucacuguggccaaacagugcccagcuuaagcauccc

SEQ ID NO: 18136 - RNA, 64 nt, Human
uguuaaacaacuacagaauacuaaauaaaaaguuuggccaaaaccaaccaugaagcugcaaagg

SEQ ID NO: 18137 - RNA, 64 nt, Human
cuuaagcauuuaccauuauuguaaguagccuuuauggccaaagcuguaaguuaagaauuauaug

SEQ ID NO: 18138 - RNA, 64 nt, Human
cagcaguaccuggaugauucccaccaaggaggaauggccaaaccagaugggugagaacaagccc

SEQ ID NO: 18139 - RNA, 64 nt, Human
ccucacuucuuaacauauuccugugucuuuguaauggccaaauuucuccuuccacucguccgca

SEQ ID NO: 18140 - RNA, 64 nt, Human
uuuccaugguauuuauagucucuugugcuaaauuuggccaaagaugauuguccaccacuaaaaa

SEQ ID NO: 18141 - RNA, 64 nt, Human
uaccaacagcuccuucacacugaauccuuuaacuuggccaaaggacccuuaaagaacaucuagu

SEQ ID NO: 18142 - RNA, 63 nt, Human
aguuucugaaaccgcucagauguuuuggggaaaguuggagaagccguggccuugcgagaggug

SEQ ID NO: 18143 - RNA, 63 nt, Human
cuggaggggagagaaggauucuagggguguggaguuggagaaagaggcuuccuugagccaccc

SEQ ID NO: 18144 - RNA, 63 nt, Human
acuugaguauuuguguagcaaacagccucuuagguuggagaguauugauuucaaauaggaagu

SEQ ID NO: 18145 - RNA, 63 nt, Human
ggggaggguagggauaauuuauuuuuaaauaagguuggagaugucaaguuggguucacuugcc

SEQ ID NO: 18146 - RNA, 63 nt, Human
auaugcacaaacucucuauggccuugagaagcaguuggagagacaugacuuguuaaaaccuca

SEQ ID NO: 18147 - RNA, 63 nt, Human
gcuaugguauagcuaaaaacaaaagcccauaaaguuggagauagggaccagaguuuaacauag

SEQ ID NO: 18148 - RNA, 63 nt, Human
uuagggaugcuguacuuuuugaauuguugcaguguuggagaugccauuuucaccuuuuuaaaa

SEQ ID NO: 18149 - RNA, 63 nt, Human
agacuuaaaucucucuccuaucugcagcacuggguuggagagagggcacgggaguuggucuug

SEQ ID NO: 18150 - RNA, 63 nt, Human
uucucacaguuccuggggaagaggccaugguuuguuggagacaagguaaugggggcaugugau

SEQ ID NO: 18151 - RNA, 63 nt, Human
accuggcauggacugauguuuuuaggcacagaaguuggagaagagauuucaugaaagacaaca

SEQ ID NO: 18152 - RNA, 63 nt, Human
ccccacuacagguuuucccuacuaaacaaagguguuggagagcagcuuuggguucugugcugg

SEQ ID NO: 18153 - RNA, 63 nt, Human
cauugucaaaacuaccaauuccagguuaacuuuguuggagaauuucccccacccccauccagu

SEQ ID NO: 18154 - RNA, 63 nt, Human
cugucagaaucccguguauccauuuguucuucuguuggagagaugagacauuugacccuuagc

SEQ ID NO: 18155 - RNA, 63 nt, Human
ugagguaggagcaucaccuggggcugggagggaguuggagaccagccuggaugacauaaugag

SEQ ID NO: 18156 - RNA, 63 nt, Human
ugucguagacuugugcaauauauacuguuguggguuggagaaaaguggaaagcuacacuggga

SEQ ID NO: 18157 - RNA, 63 nt, Human
ugguaggcaaauuguuaggcagaauaaugguauguuggagaaauacaccugucucuuauucuu

SEQ ID NO: 18158 - RNA, 63 nt, Human
gccaaaccagcacccuccuuugugcucugagagguuggagacaucugguccaccccauugccc

SEQ ID NO: 18159 - RNA, 63 nt, Human
cuguggcuccauauuucaacuaaaaauauaucuguuggagaaagaaauuaacaauaaagaauu

SEQ ID NO: 18160 - RNA, 63 nt, Human
aaagcuuggggcuccaggaaaucauccaguagaguuggagauucagagauuucuugaagccag

SEQ ID NO: 18161 - RNA, 63 nt, Human
cguugaaggcgccugggccgcagcccagcaguaguuggagaggcaggcagagggcagugguuc

SEQ ID NO: 18162 - RNA, 63 nt, Human
aaucccaaagcagauuccuuugaucggguuucuguuggagauggggcuucccuuaggagccau

SEQ ID NO: 18163 - RNA, 63 nt, Human
ccuguucagcacucccagcugugugacuuuaucguuggagaguauuguuacccuuccaggaua

SEQ ID NO: 18164 - RNA, 63 nt, Human
aaacugguuuaacuagcaaaagccuuggcaccuguuggagacuaugaccaagccaauaaaaag

SEQ ID NO: 18165 - RNA, 63 nt, Human
uguacgcaaagggcagccccaggcugucuggaaguuggagaauucccuaucagcacagggauc

SEQ ID NO: 18166 - RNA, 63 nt, Human
uccugaguuaaaagucuauuuauuuacuuccuuguuggagaagggcaggagaguaccugggaa

SEQ ID NO: 18167 - RNA, 63 nt, Human
aagaaggccuguauuauacguguccuccuggggguuggagaugaucccucaaguacacaaagg

SEQ ID NO: 18168 - RNA, 63 nt, Human
gcuccagguggaagcaugcuuucccuuguuacuguuggagaaacucaaaccuucaagcccuag

SEQ ID NO: 18169 - RNA, 63 nt, Human
gagaguggguacuagaaaaaacgagauugcacaguuggagagagcagguguguuaaaugggac

SEQ ID NO: 18170 - RNA, 63 nt, Human
ugaggggugggagggggguuuccagggccugguguuggagagugcagagaaauaucuaccucc

SEQ ID NO: 18171 - RNA, 63 nt, Human
aggggugcggcgcccccuugggguuuccucccaguuggagaguagaguuaagacaaggcccag

SEQ ID NO: 18172 - RNA, 63 nt, Human
uaggcacggacacacccagucucaaugcacgaaguuggagaaccugacagggcugguccaggc

SEQ ID NO: 18173 - RNA, 63 nt, Human
cgaugggcaucuaacaucaucaucuucuaauguguuggagauuuucauuucaaauauauuuuu

SEQ ID NO: 18174 - RNA, 63 nt, Human
cucuuuaauucuuauucaauuccaugacuuaagguuggagagcuaaacacugggauuuuugga

SEQ ID NO: 18175 - RNA, 63 nt, Human
cauggcuugugcuggccggugugccauauucuuguuggagaugaaccguagcaccagagccca

SEQ ID NO: 18176 - RNA, 63 nt, Human
ugcugcaagaaggggugcagagaagacuccuguguuggagacacucagcaggucuugaacuac

SEQ ID NO: 18177 - RNA, 63 nt, Human
ugaguggcucuuugcaugaacacugugcaagguguuggagaaauccaaagcugaccaaaacau

SEQ ID NO: 18178 - RNA, 63 nt, Human
cuuuguauuggagaaggacugggucagagaucuguuggagagagagaauaaagagauuauuuu

SEQ ID NO: 18179 - RNA, 63 nt, Human
guguuuuuuacucuuuucucaugcacauguuacguuggagaaaauguuuacaaaaaugguuuu

SEQ ID NO: 18180 - RNA, 63 nt, Human
gugccggcauccuugauggguucaaagagaaagguuggagaugauagugggugagaagcaggc

SEQ ID NO: 18181 - RNA, 63 nt, Human
gggugagaagcaggcuggugagacugggcugagguuggagaaggggcagccgggggcacugcu

SEQ ID NO: 18182 - RNA, 63 nt, Human
agcuaaaauacagacauguuucaaagggcuaaaguuggagaugaguagauagggugaaaaaug

SEQ ID NO: 18183 - RNA, 63 nt, Human
uuuuucauuuuacccuuuuguuuuucaguccagguuggagaucguagcugcugcugcuugcac

SEQ ID NO: 18184 - RNA, 63 nt, Human
cgcgccuggccacccagcuaaguuuguauuuuuguuggagacgggguuucaccauauuggcca

SEQ ID NO: 18185 - RNA, 63 nt, Human
aggccgaggugggcggaucacuugaggucaggaguuggagaccagccuggccaacguggugaa

SEQ ID NO: 18186 - RNA, 63 nt, Human
ucagggccaugcugaggccugggccgcugccacguuggagaagcccgugugagaagugaaugc

SEQ ID NO: 18187 - RNA, 63 nt, Human
aucagcccaugguuucaggaucaaagcugucauguuggagauugguaauggcuuuccugucuu

SEQ ID NO: 18188 - RNA, 63 nt, Human
ucgucauccaagcauguuucucuuacuuuugguguuggagagacucuacgcuuccccgaugga

SEQ ID NO: 18189 - RNA, 63 nt, Human
ggucugcgaugcagcggcgugaggccugggcugguuggagaaggucacaacccuucucuguug

SEQ ID NO: 18190 - RNA, 63 nt, Human
acugaugacuuuuuauacuuuguaaagacaauuguuggagagccccucacacagcccuggccu

SEQ ID NO: 18191 - RNA, 63 nt, Human
caguguuccucaccaauaacuucagagaagucaguuggagaaaaugaagaaaaaggcuggcug

SEQ ID NO: 18192 - RNA, 63 nt, Human
ugguaccgucuaguacuaugcagcgguccucaaguuggagaaaaugugccuuucauucauuac

SEQ ID NO: 18193 - RNA, 63 nt, Human
uacauuaaaacauuucugaauugcaguugaaugguuggagauugcuggcgaugugaugcugca

SEQ ID NO: 18194 - RNA, 63 nt, Human
guucuccucgcugaccuuccauggaggccguguguuggagagugcccugaugcagauggaggu

SEQ ID NO: 18195 - RNA, 63 nt, Human
aaauauaaucccaaguauccucucuccuuccuuguuggagaugucuuaccucucagcucccca

SEQ ID NO: 18196 - RNA, 63 nt, Human
gcuuguggauguugcaccagaagagagugcaguguuggagagugacacugucggggcagcugg

SEQ ID NO: 18197 - RNA, 63 nt, Human
uaaaugaaaaggacacauucugaaaucccuuuuguuggagaauaagucagucugaggggaaau

SEQ ID NO: 18198 - RNA, 63 nt, Human
aucaaggacauuuucuuugagacauuccuuauaguuggagacucaagauauuuuuguugcauc

SEQ ID NO: 18199 - RNA, 63 nt, Human
acccugcagcacuuucagcauaugcacaucaaaguuggagaccgcgcugaacuuaggagggcc

SEQ ID NO: 18200 - RNA, 63 nt, Human
uaaaaaaaaacacuauaguguaguuuuuggaauguuggagauuauacugguaaagcuguaucg

SEQ ID NO: 18201 - RNA, 63 nt, Human
ucuggagagacauaaggaguccuacccguugagguuggagagggaaaauaaagaagcugccac

SEQ ID NO: 18202 - RNA, 63 nt, Human
uuuuauuccaaggaacaacaucaguucacuguuguuggagacaugacaaucauuuucauccca

SEQ ID NO: 18203 - RNA, 63 nt, Human
uaguuccuauuucuguggguuugccuggccaugguuggagagggaaugguguuugaugguaaa

SEQ ID NO: 18204 - RNA, 63 nt, Human
agaaauugcuagauuacccaaagaaauagaucaguuggagaaaauacaaaacaauucaaagcu

SEQ ID NO: 18205 - RNA, 63 nt, Human
guauuuaaaagaaauaccagugagugccuuaaaguuggagaaguaacugcccaugcccagaaa

SEQ ID NO: 18206 - RNA, 63 nt, Human
aaugaugucauacuacgauguguuucauuaacuguuggagauuaucacauuaaauugagcaga

SEQ ID NO: 18207 - RNA, 63 nt, Human
gauuuucugcccugccccaccagggcccugcauguuggagacugagcugggugcacuggccau

SEQ ID NO: 18208 - RNA, 63 nt, Human
ccaaggcagcucuggccugugacucaggcguuuguuggagagcugcaggaaaaccacugcagu

SEQ ID NO: 18209 - RNA, 63 nt, Human
caggacuguagcuuuaaaaacagcauguaccauguuggagauuacgucuauguggaaccugca

SEQ ID NO: 18210 - RNA, 63 nt, Human
ggagauggcaagagggcaggcuuuuaaguuuggguuggagacaacuuccuguggcccccacaa

SEQ ID NO: 18211 - RNA, 63 nt, Human
agggugaugcaggaggaucacuugaggccaggaguuggagaccagccuggccaacauggugaa

SEQ ID NO: 18212 - RNA, 63 nt, Human
cacgcccaucuggagugggagcugggagucaguguuggagaagaaacaacaaaagccaauuag

SEQ ID NO: 18213 - RNA, 63 nt, Human
gagguaggguugaggaacacaggguugaaagcuguuggagaggggaaaaguugugcauaaaga

SEQ ID NO: 18214 - RNA, 63 nt, Human
cuaucugggaacacugagaagggugaccaaugcguuggagaacgagggagggcuucauagcag

SEQ ID NO: 18215 - RNA, 63 nt, Human
gcuuugcauaaaacugggaagaaagagaagacaguuggagauggaagaugguuuuguauauau

SEQ ID NO: 18216 - RNA, 63 nt, Human
gcacauaacagaacaaacuauaauuacuuggcuguuggagauuuguacuugaguauaaaugua

SEQ ID NO: 18217 - RNA, 63 nt, Human
cuaguguuuucauaauguaauucaaugaaaacuguuggagaaauauuuaaacaccucaaugua

SEQ ID NO: 18218 - RNA, 63 nt, Human
guauuaaggaauuuuaaacuaaauaaaauguauguuggagauacuguuacccauucuaagaaa

SEQ ID NO: 18219 - RNA, 63 nt, Human
aacauaagaauagaggaacauauuaugcuacacguuggagaugcaacagcaaaucuagaucau

SEQ ID NO: 18220 - RNA, 63 nt, Human
gccauaccugugugcaugacacuaagauuuuauguuggagauacuucuuuaaauaaccuacag

SEQ ID NO: 18221 - RNA, 63 nt, Human
gugcuuuuuauacaacuuuccaucccccacacaguuggagaauaauuuguagaccauggcagu

SEQ ID NO: 18222 - RNA, 63 nt, Human
augaggaacauucauucuguauuuuuuuucccuguuggagaaagugggaaauuauaaugucga

SEQ ID NO: 18223 - RNA, 63 nt, Human
ggaugcugagcugccugggcagagaccaagaggguuggagacacuaguuuuaccagguuacag

SEQ ID NO: 18224 - RNA, 63 nt, Human
aaauauaauuaaggguggcaaggacuggagucaguuggagagugcauagccagucugugaaga

SEQ ID NO: 18225 - RNA, 63 nt, Human
ccuuggaaccccaaggccaaguugguucaaacuguuggagaacagaguuggccugcaucugga

SEQ ID NO: 18226 - RNA, 63 nt, Human
aguuuaugguucugcagucaagguugucaauuuguuggagaugcagccuucaccauggauccu

SEQ ID NO: 18227 - RNA, 63 nt, Human
uugggagccuggccuccaaaagccagugucuggguuggagacagugcaggccccuucuuggcc

SEQ ID NO: 18228 - RNA, 63 nt, Human
acuauuuaacuucuaaaauuauuucugaauacaguuggagauaggcugguuuucaugaggaag

SEQ ID NO: 18229 - RNA, 63 nt, Human
uuuguuuuauuggaaugcauaucucuuuucaggguuggagaaauuagcacuugccuugaaaag

SEQ ID NO: 18230 - RNA, 63 nt, Human
ggguuaccuccaugugcccuuuuuagggaagcuguuggagaaaauacuccagcaaaaugaagg

SEQ ID NO: 18231 - RNA, 63 nt, Human
aauauucuaggcaugagaauaccuuaauacugaguuggagauuuuguaucuguuucuccuccu

SEQ ID NO: 18232 - RNA, 63 nt, Human
gaguuguauuggcaagagggaggggugagagcuguuggagaacugagaaugagguuuuuuuuu

SEQ ID NO: 18233 - RNA, 63 nt, Human
cuauugcccugcaacgucccaucuauacgagguguuggagaaggugaagaacccucccauuca

SEQ ID NO: 18234 - RNA, 63 nt, Human
cuauauuguuaauccaugguuaggaaauguuuaguuggagauuacaaauugaaacaaccauug

SEQ ID NO: 18235 - RNA, 63 nt, Human
cugagaaagggaaaagacacacaagucgcguggguuggagaagccagagccauuccaccuccc

SEQ ID NO: 18236 - RNA, 63 nt, Human
guacuuuaccauauuaauacugaggaaaaaucuguuggagacauaggucuaggaugugugaag

SEQ ID NO: 18237 - RNA, 63 nt, Human
cugaaacagacuacucuuugccuuuuugcugcaguuggagaagaaacugaauuugaaaaaugu

SEQ ID NO: 18238 - RNA, 63 nt, Human
cucagcaguguacagaguccccggcgcucugagguuggagagaaagaacagaccagcgcccuu

SEQ ID NO: 18239 - RNA, 63 nt, Human
caaaucuggcugguggacagaagcaccuggagaguuggagagcuuuuuaaaaagacaucucuc

SEQ ID NO: 18240 - RNA, 63 nt, Human
uguauauuugucuuaaguauggcaaaagcauucguuggagagccuuacuuggguuugcaccca

SEQ ID NO: 18241 - RNA, 63 nt, Human
cggacaccuccacuggggacucuuccaggauggguuggagaggaguaacuuugucuuauucga

SEQ ID NO: 18242 - RNA, 63 nt, Human
gaccaacaacaacgaggaggagaagucccggcuguuggagaaggagaaccgugaacuggaaaa

SEQ ID NO: 18243 - RNA, 63 nt, Human
guggagaugggggcgggggugguggugaagagaguuggagaaggaauggacgaauucuugagc

SEQ ID NO: 18244 - RNA, 63 nt, Human
augccuauaauccuggcauuuuaggaggcugagguuggagaaucgcuugaggccagaagugca

SEQ ID NO: 18245 - RNA, 63 nt, Human
gaucugggcucagcauguuuggggucagucaguguuggagagcccacauaugggauugccacu

SEQ ID NO: 18246 - RNA, 63 nt, Human
uuuuguuugguauguacaaaauggucagagcuaguuggagaaugagacaugcuuuuccagcug

SEQ ID NO: 18247 - RNA, 63 nt, Human
cuguaggucuugaagcagcaacgucuuucagggguuggagacagaaacccauucuccaaucuc

SEQ ID NO: 18248 - RNA, 63 nt, Human
cuuauugucuagugaaacucguuaauuuguaguguuggagaagaacugaaaucauacuucuua

SEQ ID NO: 18249 - RNA, 63 nt, Human
ccuuuuauuaguucuuugauagcuaagaugguuguuggagaaagugcuuaagccacuguuuau

SEQ ID NO: 18250 - RNA, 63 nt, Human
ggaaauauuucuccucuaaaugcaugaaaucauguuggagaucucuauuguaaucucuauugg

SEQ ID NO: 18251 - RNA, 63 nt, Human
aaagucaaaagaaacccucccaaaacagggaaaguuggagaguacggcuaccugggucaaccc

SEQ ID NO: 18252 - RNA, 63 nt, Human
gugaggauggggguggugggaagaauuggccacguuggagaccccaugccaccccaccauggu

SEQ ID NO: 18253 - RNA, 63 nt, Human
uagucuuuuguauuuucccugccgaagugaauuguuggagaauguaaaccgccuccacguggc

SEQ ID NO: 18254 - RNA, 63 nt, Human
aggcuaaggcgggaggaugacuugaggccaggaguuggagaccagccuggccaacauggugaa

SEQ ID NO: 18255 - RNA, 63 nt, Human
uguuugucauggugaaauuauaacuauuacaguguuggagaacaacaaauauguucucugaau

SEQ ID NO: 18256 - RNA, 63 nt, Human
gcccacagaagucaucagaccuuaccaaaguagguuggagaauuagauugccuuuucaugcag

SEQ ID NO: 18257 - RNA, 63 nt, Human
ucacacuaccaggcccugcagccacaguguucuguuggagaaacuuggggaaguguuuucuga

SEQ ID NO: 18258 - RNA, 63 nt, Human
acagccucaggucuaccuggacacucauccacuguuggagaugcucaacagcuagacacagau

SEQ ID NO: 18259 - RNA, 63 nt, Human
gacauggggaggguuggagacuggguggggaggguuggagacugggcugggaggagagcaagc

SEQ ID NO: 18260 - RNA, 63 nt, Human
ggaacauggcaguggugcugagacauggggaggguuggagacuggguggggaggguuggagac

SEQ ID NO: 18261 - RNA, 63 nt, Human
cgugugucuuauucagaagucacauucuuuucaguuggagagaauugggcuaagauagaaaau

SEQ ID NO: 18262 - RNA, 63 nt, Human
cuucagcacgagcacacugcaucucuccugugaguuggagacuucuuucccaagauguccuug

SEQ ID NO: 18263 - RNA, 63 nt, Human
ccccccguggcugcccagauagucacagucaagguuggagagucuccuuccagccagugaccu

SEQ ID NO: 18264 - RNA, 63 nt, Human
augaguucagaugaucacaaacaggugaguuuuguuggagaagaaaguuggaguaggagacuu

SEQ ID NO: 18265 - RNA, 63 nt, Human
aggcugaggcgggcagaucaccugaggucaggaguuggagaccagccugaccaacauggacaa

SEQ ID NO: 18266 - RNA, 63 nt, Human
ccaauaagaggcucuguuuuccacugaagcuuuguuggagaaagagaauaugaaaauuacaca

SEQ ID NO: 18267 - RNA, 63 nt, Human
gugugaagacaugaaaguuuaauguacagaaugguuggagaaaugccuauggugaauuaaagc

SEQ ID NO: 18268 - RNA, 63 nt, Human
agugccagggagaacagccaggugaggugggagguuggagagccaggugaggucucuguaagu

SEQ ID NO: 18269 - RNA, 63 nt, Human
ugggguccucugggagcugaagcacacggccauguuggagagcaaaacuuaauaauaauucuu

SEQ ID NO: 18270 - RNA, 63 nt, Human
uacuucauaugcugcuuuagucaccugaagaugguuggagaggcccugucgacuguucuccca

SEQ ID NO: 18271 - RNA, 63 nt, Human
aucaaacauguuaugugcuuccaaaauacagugguuggagaggcauaggauaaacauucccau

SEQ ID NO: 18272 - RNA, 63 nt, Human
ccuguuuuauuuuccucaacaucuugaaguuauguuggagaguaaucauacaauuguagagaa

SEQ ID NO: 18273 - RNA, 63 nt, Human
gaugaggaaaagaagagccuuugcugauaaagaguuggagaacauuaugcuggagagagaaua

SEQ ID NO: 18274 - RNA, 63 nt, Human
auggauuuccccucuuacaacuuucaaaccagaguuggagacucagcauugggguucggcccu

SEQ ID NO: 18275 - RNA, 63 nt, Human
acagauaagcaaaaaaguccuugcauucaaaggguuggagauugcugcuuugagugcugggua

SEQ ID NO: 18276 - RNA, 63 nt, Human
ggaugaggcauggguauaggaagggagaaaggaguuggagacaagauccucuucauuuuccaa

SEQ ID NO: 18277 - RNA, 63 nt, Human
guguaaaaaguacucagaaaaacaucuaaagcuguuggagaagagggacucauauaaauaguu

SEQ ID NO: 18278 - RNA, 63 nt, Human
gcuccuggacuucaaauucuauauauugagagaguuggagaguauaucagagauauuuuugga

SEQ ID NO: 18279 - RNA, 63 nt, Human
gauuccuuuuuucaaaauccaaaaagaaaugauguuggagaagggaaguugaacgagcauagu

SEQ ID NO: 18280 - RNA, 63 nt, Human
gcaaaucacgaccacugauagaugucuauucuuguuggagacaugggaugauuauuuucuguu

SEQ ID NO: 18281 - RNA, 63 nt, Human
aggccaaggugggaggauugcuugagcccaagaguuggagaccagccugggcaacauggugag

SEQ ID NO: 18282 - RNA, 63 nt, Human
uuuuuaagcaagagaaagacaacuguucugcggguuggagaaaauacaauuuuuuuuuuuuuu

SEQ ID NO: 18283 - RNA, 63 nt, Human
acuauugcugcauacccggggugggauggggugguuggagaaccagaacuauuuuuaaaacau

SEQ ID NO: 18284 - RNA, 63 nt, Human
cugaacuggggaauuugaacauuccuuuacauuguuggagaaaugaagccaaaguuauucaga

SEQ ID NO: 18285 - RNA, 63 nt, Human
agcagaguaauacuggaggcagaguagggggugguuggagagcaguuaguacaaagaggcaga

SEQ ID NO: 18286 - RNA, 63 nt, Human
auuauguucuuuagacacugcuaccugaaaacuguuggagaaauaauguuuaaaguuauuuaa

SEQ ID NO: 18287 - RNA, 63 nt, Human
uuaaaacccugaugcaaacuucuccuuucagugguuggagaaauuggccgaguucaaccauuc

SEQ ID NO: 18288 - RNA, 63 nt, Human
uuugccaaauaacaaaagcauacaaugcauacuguuggagaacaagaaugcuacuguauuuua

SEQ ID NO: 18289 - RNA, 63 nt, Human
caccuuaaauaaaagugauugugacuaaggcacguuggagaacauuccaaucuuuccucccaa

SEQ ID NO: 18290 - RNA, 63 nt, Human
gcuuaccagagaugcagucccucccaggaaccuguuggagaggcaggaccugcugcuuuagag

SEQ ID NO: 18291 - RNA, 63 nt, Human
ucuuuggcagaggccccuaagcaagggagggguguuggagagccagugcccuuaagacuggag

SEQ ID NO: 18292 - RNA, 63 nt, Human
gccacacaggaguaggugccacugaccucuauuguuggagacuuuguuccacuuuuuguuuca

SEQ ID NO: 18293 - RNA, 63 nt, Human
ugaauuuugauaauggcuuccagacucuuuggcguuggagacgccuguuaggaucuucaaguc

SEQ ID NO: 18294 - RNA, 63 nt, Human
aauucugacauguccuuggcaauggaagccuggguuggagauccugaggcagcugugccuacu

SEQ ID NO: 18295 - RNA, 63 nt, Human
uuauuuauacuuaaauugugaccugaaagaugaguuggagauaauuagucaaagggcacaugg

SEQ ID NO: 18296 - RNA, 63 nt, Human
gccaugaauuaagauggaugacuggaaaaagguguuggagaaagaguuaaagaugaggaagag

SEQ ID NO: 18297 - RNA, 63 nt, Human
gcaaguaccaggaggacauaaccgcuguggccuguuggagaacagccaguagccuugguaaua

SEQ ID NO: 18298 - RNA, 63 nt, Human
guugaaggacuacagguauuuucaucaaguagcguuggagacauacacaaaugggcauacaag

SEQ ID NO: 18299 - RNA, 63 nt, Human
acugcaggaccaguuucucugccaaggggaggaguuggagagcacaguugccccguuguguga

SEQ ID NO: 18300 - RNA, 63 nt, Human
aggacagugccaaccuccuccuggggaucccauguuggagacucuaaggauaaggcuggugcu

SEQ ID NO: 18301 - RNA, 63 nt, Human
cugggguuaccccugucugcuucugguuuuucuguuggagaucuauagguccuuuuccugccu

SEQ ID NO: 18302 - RNA, 63 nt, Human
aggcugagguaggcagaucacuugaggucaggaguuggagaccagccuggccaacauagugaa

SEQ ID NO: 18303 - RNA, 63 nt, Human
cacugccugaaagacuuggguugaacuauaacuguuggagagagauguuccucuuuaaucaug

SEQ ID NO: 18304 - RNA, 63 nt, Human
uuggaaagcaucuaguccagugggaagccagggguuggagaaggugcuacaucccucuuccca

SEQ ID NO: 18305 - RNA, 63 nt, Human
gccuucuagaaucagaucuguuuggggcuggggguuggagaauaaaagcaggagaagucuaug

SEQ ID NO: 18306 - RNA, 63 nt, Human
aaguugucauaaauggucagaaagaacgaucagguuggagacuugggaaacccagggccuaaa

SEQ ID NO: 18307 - RNA, 63 nt, Human
ugucaagguuguccccagaccuugcuugcagugguuggagaacccagggggcugccuugggcc

SEQ ID NO: 18308 - RNA, 63 nt, Human
gucuuuuccccuugguuuuguguuacaagaguuguuggagacaguuucagaugauuauuuaau

SEQ ID NO: 18309 - RNA, 63 nt, Human
aaccaagauagauccauuuggacaaaauggaagguuggagacguguauccccgugaaaucugg

SEQ ID NO: 18310 - RNA, 63 nt, Human
cuguccaaugcugcugguuucgcagagcgaccgguuggagaugucugaggaagaaaguucaag

SEQ ID NO: 18311 - RNA, 63 nt, Human
cagaggagggaugggaacaggcugugcaucuuaguuggagagaggggugugggaggaagcuug

SEQ ID NO: 18312 - RNA, 63 nt, Human
uaaugcucuauccucuaagguuggaacucugaaguuggagaagguggaauaaaguuacaccug

SEQ ID NO: 18313 - RNA, 63 nt, Human
gccugucaguggucagagcggugagcgagguggguuggagacucagcaggcuccgugcagccc

SEQ ID NO: 18314 - RNA, 63 nt, Human
cagguuugaccaggaaagcagcgcuaguggaggguuggagaaggagguaaaggaugaggguuc

SEQ ID NO: 18315 - RNA, 63 nt, Human
gaccgcgugggccgcggggugcugguaggagugguuggagagacuugcgaaggcggcuggggu

SEQ ID NO: 18316 - RNA, 63 nt, Human
cugcuauuauguauauugucauuugugaaggaaguuggagagucacagcuuuacugugacagg

SEQ ID NO: 18317 - RNA, 63 nt, Human
agaugagucaguugaauuaguacuggacaaacaguuggagauuaguuugcaaauaagcauauc

SEQ ID NO: 18318 - RNA, 63 nt, Human
gaagugugggauaaagauuaugauuaggggaggguuggagacaaaagcuguaaauuacuaugg

SEQ ID NO: 18319 - RNA, 63 nt, Human
gggcucuggccaucugcaacccugaacgugcagguuggagaacgaaugaauacaaauuuuauu

SEQ ID NO: 18320 - RNA, 63 nt, Human
aggccgaggcaggcagaucaccugaggucgggaguuggagacccgccuggcuaacaaggcgaa

SEQ ID NO: 18321 - RNA, 63 nt, Human
cggcuccaagcacacugugcccugcucuuugagguuggagauuuacaguaugccuccccugca

SEQ ID NO: 18322 - RNA, 63 nt, Human
gugcuaauugcuuggaucuccuucauugggauaguuggagagggauuggaguaccacuuuccu

SEQ ID NO: 18323 - RNA, 63 nt, Human
gaucggaguagugcucagcauuuggaaguuacuguuggagaucugacagucauuauuacagac

SEQ ID NO: 18324 - RNA, 63 nt, Human
cccacucuggcccaucucccuuucuuacugggaguuggagauuugaagccagucaucucagca

SEQ ID NO: 18325 - RNA, 63 nt, Human
gugugauuauuuuaauauggaggugggagugugguuggagauagaaaggcuccuccccaccau

SEQ ID NO: 18326 - RNA, 63 nt, Human
acugacugggacccugaagaggcauuucagaguguuggagaagaaucuguagcuuguugaaaa

SEQ ID NO: 18327 - RNA, 63 nt, Human
acaauuggugucauuuucuugaugucacuauuuguuggagaguuaaauggucucuucccuuug

SEQ ID NO: 18328 - RNA, 63 nt, Human
agaccacggugggggaaucccuugagcccaggaguuggagagcaacaucacaacaccccauuu

SEQ ID NO: 18329 - RNA, 63 nt, Human
cauaauagagauugauaagauuuagcaacugguguuggagaaaaaaagaaaagcaaaugagug

SEQ ID NO: 18330 - RNA, 63 nt, Human
ugccuaaaaauggaaacguuaagaaguuggaauguuggagaugcaagaauuuccaagaacuuu

SEQ ID NO: 18331 - RNA, 63 nt, Human
uguaccauacugacccaggcugggggcagguguguuggagacaggcuggucaaagaggugaca

SEQ ID NO: 18332 - RNA, 63 nt, Human
aagccuggcugcagcuucccauuugguuacgagguuggagaaaaagucaaaguccccuccugg

SEQ ID NO: 18333 - RNA, 63 nt, Human
cugccuuucccaaaugggaaaggugcugacagaguuggagaaaaaagaauagacucauuuuuc

SEQ ID NO: 18334 - RNA, 63 nt, Human
ucauucacuugauaaaugaauauuuauuagcugguuggagagcuagaaccuggagagcuagaa

SEQ ID NO: 18335 - RNA, 63 nt, Human
aucaauauaacaauauaauccuaaaccuugacaguuggagaagccaaugcagaacugauggga

SEQ ID NO: 18336 - RNA, 63 nt, Human
uucacuaauuuagaagucaggaagcaauagaaaguuggagaugaggaagugcuagaguaggug

SEQ ID NO: 18337 - RNA, 63 nt, Human
aaggaacguaucaagcucucucaguguuucaguguuggagauugaggcugugccacaucuucu

SEQ ID NO: 18338 - RNA, 63 nt, Human
acuaaaaugaaccaaacccauauuucacuggugguuggagaaaaccauggccaaaacgauugu

SEQ ID NO: 18339 - RNA, 63 nt, Human
aagaccaagacuauuaaaaugauuuuuaaaguuguuggagacgccaauagcaauaucuaggaa

SEQ ID NO: 18340 - RNA, 63 nt, Human
uaucaacagcaaacuucagccguuucacuuuuuguuggagaaaaauaguagauuuuaauuuga

SEQ ID NO: 18341 - RNA, 63 nt, Human
guccuaugaggauuucaucuaccauuucacaaaguuggagaucugcaaccucacggccgaugc

SEQ ID NO: 18342 - RNA, 63 nt, Human
uauacuauauccuauguuguggagaauuuauauguuggagacuaacugaauuuaagugaccca

SEQ ID NO: 18343 - RNA, 63 nt, Human
uguaguaccuauggaguauuguaagagcuaauuguuggagaugaauugcuucucaucuuguuc

SEQ ID NO: 18344 - RNA, 63 nt, Human
augcucccugucagagcucuccagaauaugcuuguuggagauccuucaggcaguaagggagag

SEQ ID NO: 18345 - RNA, 63 nt, Human
cuaaagugggugccauucacggaggagagggagguuggagacuucaaccgggcaaaggagcac

SEQ ID NO: 18346 - RNA, 63 nt, Human
cgucacuccccagcuuuguucagcaauggugugguuggagaguugugcugggauagcgcagga

SEQ ID NO: 18347 - RNA, 63 nt, Human
aguccgaggcaggggaauugcuugaacucaggaguuggagaccagccugggcaacauggcaaa

SEQ ID NO: 18348 - RNA, 63 nt, Human
ugauaugccagagaugaguuaguguuucuugacguuggagaccuuuuaaaugccucaucuguu

SEQ ID NO: 18349 - RNA, 63 nt, Human
acagacucugagaagcgaagaccaugucuccucguuggagaaacccaauagcaggggaagcug

SEQ ID NO: 18350 - RNA, 63 nt, Human
uuuuuggguguuccuggcaguuuaaaaaaauugguuggagaauuuagguuuuuauuaguacca

SEQ ID NO: 18351 - RNA, 63 nt, Human
ccagggcuguaacugccaggcucucuuugcccaguuggagacugucuggccccccuggucccc

SEQ ID NO: 18352 - RNA, 63 nt, Human
uguuuuagcuucuguucuguaaucaugaguuugguuggagauauucuccauagaugaucuucu

SEQ ID NO: 18353 - RNA, 63 nt, Human
gaaaaucuaauauauucuucuguugccccugggguuggagagucagugccugcagucaagugc

SEQ ID NO: 18354 - RNA, 63 nt, Human
aggccgaggcgggcggaucaccugaggccaggaguuggagaccagccaggccaccauggugaa

SEQ ID NO: 18355 - RNA, 63 nt, Human
aagccgaagcaggaggaucacuggaggccaagaguuggagagcagacugggcaacauagcgag

SEQ ID NO: 18356 - RNA, 63 nt, Human
cagccuggggcuaccuagcucccaaacccagaaguuggagacaucaggcuguuuaaaugauca

SEQ ID NO: 18357 - RNA, 63 nt, Human
acgugggggaggucccauuuccacuucaucacuguuggagaucauggagcuaagaagcagagc

SEQ ID NO: 18358 - RNA, 63 nt, Human
aaccggccucaugacuagccuuguugccgucgaguuggagaaaguggugcugaaauccaccuu

SEQ ID NO: 18359 - RNA, 63 nt, Human
gugugauggugcaaggaauggauucaggauguuguuggagaaacaaguuugugauuaguccuu

SEQ ID NO: 18360 - RNA, 63 nt, Human
cuuuucuccagcaacugcagaggcauuucaggaguuggagaacggaguacauuuuuaaaauuu

SEQ ID NO: 18361 - RNA, 63 nt, Human
acauugacuugugaaaacgcaaacaugaauaugguuggagagcccuggauuaggagggugaca

SEQ ID NO: 18362 - RNA, 63 nt, Human
caccuaccugcuaacuccagauauuauuuuuaaguuggagaccuaaaaauaauucucuuguau

SEQ ID NO: 18363 - RNA, 63 nt, Human
uuguguugccucauacgaaauguauuugguuuuguuggagagugucagacugaucuggaagug

SEQ ID NO: 18364 - RNA, 63 nt, Human
aggcggaggcaggaggaucgcucaagccccggaguuggagaccagccagagcaacacagugag

SEQ ID NO: 18365 - RNA, 63 nt, Human
acuggucuuccucugauucagcuguggagugugguuggagaugaaguaaguucugcccuucuu

SEQ ID NO: 18366 - RNA, 63 nt, Human
aggccaaggcgggcggaucagcugaggucaggaguuggagaccagcguggccaacauggugaa

SEQ ID NO: 18367 - RNA, 63 nt, Human
caaaauaauggcauucacagcaaccuggauggaguuggagaucauuauucuaagugaaauaac

SEQ ID NO: 18368 - RNA, 63 nt, Human
caagcccuuggggugacucggcuuccaggagcuguuggagaaaugaggaugucugucccuguc

SEQ ID NO: 18369 - RNA, 63 nt, Human
ucaacugcugguagcauuuaucugacuuggaaaguuggagaagaggcauuccuacuggagaaa

SEQ ID NO: 18370 - RNA, 63 nt, Human
gggcucggaccccucacuggggacagggccaguguuggagaauucugauuccuuuuuuguugu

SEQ ID NO: 18371 - RNA, 63 nt, Human
cguccugucuguggaguccucagucacucugcuguuggagagugcuggaggaaaugcacuuuu

SEQ ID NO: 18372 - RNA, 63 nt, Human
ucuacuuaagcuaaaggauuaugaucauaugguguuggagacuauuagcuauuagauuuuucu

SEQ ID NO: 18373 - RNA, 63 nt, Human
gucgcccagggcaaggaugcccaaagacaccagguuggagaggcaccugccaacuacuugcuu

SEQ ID NO: 18374 - RNA, 63 nt, Human
gaacugucugcccaggagccugagccucaggcuguuggagaagcaucugaugccuuuuucuuu

SEQ ID NO: 18375 - RNA, 63 nt, Human
guguugcaacucacuuuguggcgcgauuaaagaguuggagaggaaaugaaccagaagagugga

SEQ ID NO: 18376 - RNA, 63 nt, Human
agccuugacaaacagcagacccuacagagauguguuggagagcacgucgugaccuugggggca

SEQ ID NO: 18377 - RNA, 63 nt, Human
acccaacccacgaggaccaucgggggcagagucguuggagacugaagaggaagaggaggagga

SEQ ID NO: 18378 - RNA, 63 nt, Human
ugggaggcugagcuggaucacuugaguucaggaguuggagaccaggccugagcaacaaagcga

SEQ ID NO: 18379 - RNA, 63 nt, Human
cgccacauguuagccccccuggagggggcgccaguuggagacgggggcugggugucccuggcc

SEQ ID NO: 18380 - RNA, 63 nt, Human
cugaagaacuuggagguuuuggggcauucaggaguuggagauagccuccaacugggucagccu

SEQ ID NO: 18381 - RNA, 63 nt, Human
uuggggugugaaagccucaagugacucagccugguuggagaacugccccacccaguaucuucu

SEQ ID NO: 18382 - RNA, 63 nt, Human
cugcagcugcccugcccgugcccgccugcagugguuggagacgggaguggcccuucggcuccc

SEQ ID NO: 18383 - RNA, 63 nt, Human
cucuaagaaaaaaaaucaguguuucgugaagguguuggagaggggcugugucugggugaggga

SEQ ID NO: 18384 - RNA, 63 nt, Human
augucacaggaaguucugggaucaccaaggauuguuggagaguccagugagauggaaccacac

SEQ ID NO: 18385 - RNA, 63 nt, Human
agucgccuggagaacuucacgggacugucgcugguuggagagccacugcgcagggcauggaag

SEQ ID NO: 18386 - RNA, 63 nt, Human
ggggagccagucauuucuuucaggccagcugacguuggagagccagccagacuccucggagga

SEQ ID NO: 18387 - RNA, 63 nt, Human
aggcagaggccggcagaucacuugagcccaggaguuggagaccagacuggggaacauggcaag

SEQ ID NO: 18388 - RNA, 63 nt, Human
ggaaaacaagaaauacugucaaggauguggaauguuggagaacauugugcacuaucacuggga

SEQ ID NO: 18389 - RNA, 63 nt, Human
uuuauuuaguuagaacacuucauuuuguuuuuaguuggagaacucuauagcccuuuaguuauu

SEQ ID NO: 18390 - RNA, 63 nt, Human
ggacuacagcuuauucagccugggaaaaauaauguuggagaaauacucuaugaauagaauaua

SEQ ID NO: 18391 - RNA, 63 nt, Human
gcugccuucucccggguuccagccucucaguguguuggagagguaggggugcggggugggggg

SEQ ID NO: 18392 - RNA, 63 nt, Human
aggccaaggcgggaggacugcuugaggccagaaguuggagaccagccugggcaaguggacacc

SEQ ID NO: 18393 - RNA, 63 nt, Human
gugcccguauccagagugauucuaguugggagaguuggagagaagggggacguuucuggaacu

SEQ ID NO: 18394 - RNA, 63 nt, Human
cagagacccagagggcagcgucagacacccagaguuggagacagaacaacagagucucaggga

SEQ ID NO: 18395 - RNA, 63 nt, Human
caucccccccauuagaggggcccccaaaacuugguuggagagcugaacaggcugggacugagg

SEQ ID NO: 18396 - RNA, 63 nt, Human
uguacuuguaccuaaggcccuggguucaagagaguuggagaaaccccucuagaaacauauugg

SEQ ID NO: 18397 - RNA, 63 nt, Human
agauguuaaaacagucccguggaaggagcagggguuggagaaaggcaucccaaagcuucgaug

SEQ ID NO: 18398 - RNA, 63 nt, Human
aagaauagggagacaaucuaaaaaauaucuuagguuggagaugacagaaauaugauugauuug

SEQ ID NO: 18399 - RNA, 63 nt, Human
cugcagcgccaagcggcauccaccaagcaucaaguuggagaaaagggaacccaagcaguagag

SEQ ID NO: 18400 - RNA, 63 nt, Human
ugcagccuggacggccauggcaggaagcuuuuaguuggagagauacaggaagccuccuagggu

SEQ ID NO: 18401 - RNA, 63 nt, Human
gaaggaccucucuagcuggccagugcugaggagguuggagagagaaagggugaaagcagagag

SEQ ID NO: 18402 - RNA, 63 nt, Human
gaugauaaacggaaugagagccaaaaaaguuuaguuggagacaguuguaaauucaauuuggag

SEQ ID NO: 18403 - RNA, 63 nt, Human
uucccuguaggucuccuggguguugagagacaaguuggagaccaaccuccaaugaaugagccg

SEQ ID NO: 18404 - RNA, 63 nt, Human
ggagacaaccgccucuaguuguaccccagccucguuggagagcagcaggugcugugcgccuug

SEQ ID NO: 18405 - RNA, 63 nt, Human
aggcugaggugggagaaucacuugaguccuggaguuggagaacagccuggaaagccuggcgau

SEQ ID NO: 18406 - RNA, 63 nt, Human
accuuugcaguguugccgaaucacagcaguucuguuggagaaacgcuugguuuccggauccag

SEQ ID NO: 18407 - RNA, 63 nt, Human
uuggggggccagucccgaugcacuuugagggguguuggagaggggacucccccacucgcacuu

SEQ ID NO: 18408 - RNA, 63 nt, Human
ggggagucaugcucccuuucucggcacccccuuguuggagauggaggcagcagacgugcagug

SEQ ID NO: 18409 - RNA, 63 nt, Human
agcccccuacaaggugccagguugggguaaagaguuggagaugauggccaggaguggccucca

SEQ ID NO: 18410 - RNA, 63 nt, Human
ccuguacaugaaccaggucauguuuggccuuguguuggagaaagagaauuauccccacuucac

SEQ ID NO: 18411 - RNA, 63 nt, Human
uuacaaacacgggcggaaggcacucaggcuuucguuggagaaacagaaauaaggccuucuuuu

SEQ ID NO: 18412 - RNA, 63 nt, Human
acggcaccgucaacccucuguuuuuuaaaggugguuggagacuguuaacacugagcucauuga

SEQ ID NO: 18413 - RNA, 63 nt, Human
aaacucauucuuacgaaauuagaacgacuucacguuggagaaagcaugaagagguauucaucu

SEQ ID NO: 18414 - RNA, 63 nt, Human
aaacaaaauauuuuuuaaacaagaauaauaaagguuggagauuguuacgcuugaaauuaaguu

SEQ ID NO: 18415 - RNA, 63 nt, Human
gaugagggaggaggcugaacgcacgagggaugaguuggagaggaggcugcugcagaugaaaga

SEQ ID NO: 18416 - RNA, 63 nt, Human
ccuccuguccucccacuucucuacgcccucaagguuggagaccccgcucccaugccccagcug

SEQ ID NO: 18417 - RNA, 63 nt, Human
caaagaauucugguuuucaaaacaggagccagaguuggagauauuacagucaacuuuggcuuc

SEQ ID NO: 18418 - RNA, 63 nt, Human
ucaagaauauuuguggagguagguguggggaagguuggagaagaguuagguuugugcuuugua

SEQ ID NO: 18419 - RNA, 63 nt, Human
ugaauuccuuccguauggcugugagcaacuuggguuggagacauaucuaaauccuuuuuacuu

SEQ ID NO: 18420 - RNA, 63 nt, Human
augucugugucugaauccaggauugggguggguguuggagagggcuuucagcuccccuccucc

SEQ ID NO: 18421 - RNA, 63 nt, Human
ucuuuuccaaguucccaaggccuacagcugaagguuggagaaaugccagcugcccuuucgucc

SEQ ID NO: 18422 - RNA, 63 nt, Human
ggcaugaaucacucauuuauuaaaauauaucagguuggagagugagaauuuuugcauuaugua

SEQ ID NO: 18423 - RNA, 63 nt, Human
cccaagccagucuacauugcccaaacagcaaggguuggagaguggcuuaaguggaaugcuuca

SEQ ID NO: 18424 - RNA, 63 nt, Human
agaaaccaucccuguccuucaguuuauaaucuaguuggagagauaagaaacguacaaaccaaa

SEQ ID NO: 18425 - RNA, 63 nt, Human
ggugaggcacucuggaauaugacccuaccagagguuggagaacaaacuugggcagccggaacc

SEQ ID NO: 18426 - RNA, 63 nt, Human
aaaggcaggagggccucgccguggccggcucugguuggagaugguacaguuuuauuguacagg

SEQ ID NO: 18427 - RNA, 63 nt, Human
cugaugaucaaccugccuccccuccauagucuuguuggagaagcccagagagaaugggacucc

SEQ ID NO: 18428 - RNA, 63 nt, Human
augcccccaccucccccccaccaacucucgcguguuggagagaaggggcccucccagcacaaa

SEQ ID NO: 18429 - RNA, 63 nt, Human
aggcugagguggguggauugcuugagcccaggaguuggagaccagucugggaaacguggugag

SEQ ID NO: 18430 - RNA, 63 nt, Human
ugcaauuuuuaaaaucuagaaguuagggguuuuguuggagaaaaauggacugaucuuuaaacu

SEQ ID NO: 18431 - RNA, 63 nt, Human
ugugcaauauucuuaaauacuacugcucuaaaaguuggagaagucuugcaguuaucuuagcau

SEQ ID NO: 18432 - RNA, 63 nt, Human
agaaucuguccguuucucuaguaagggagacuuguuggagaggcgggacucugaguuaucuaa

SEQ ID NO: 18433 - RNA, 64 nt, Human
gugucccaagcaguacccaggcuuugcagaccacgcggggcagggcuccacugaagccaccccc

SEQ ID NO: 18434 - RNA, 64 nt, Human
uucaccagggguccgucaguagucauugccacccgcggggcaccucccuggccacacgccuguu

SEQ ID NO: 18435 - RNA, 64 nt, Human
cacugaagaaaggcaagggccgugcugcugcugggcggggcaggagaggagccuggccagugug

SEQ ID NO: 18436 - RNA, 64 nt, Human
agggggcguggugggggcggagggaaggagggcggcggggcacagagacagagagcaaggcugu

SEQ ID NO: 18437 - RNA, 64 nt, Human
cguguaggggccagagccuggcuggggcaucucugcggggcagaggagaaggcuuucacagcug

SEQ ID NO: 18438 - RNA, 64 nt, Human
ucuccuaaaaaauacguauggcauaccaaucugugcggggcaguguccuaagcacuuagacuac

SEQ ID NO: 18439 - RNA, 64 nt, Human
gcaguuucuggccagaagcaccagccugcugccagcggggcagccccucauaggaggcccagga

SEQ ID NO: 18440 - RNA, 64 nt, Human
aggccccucccaguaagggcguggcucugggugggcggggcacuagguaggcuucuaccugcag

SEQ ID NO: 18441 - RNA, 64 nt, Human
gcacagcugugcccaggcccccagggugguccaugcggggcaacccccugcggugcacaggccc

SEQ ID NO: 18442 - RNA, 64 nt, Human
agauggagaaucagaauuccuugggcaucaccgggcggggcaugucccugucccuucgcuccca

SEQ ID NO: 18443 - RNA, 64 nt, Human
gcugcugagcccacccagagguuguuggaguucagcggggcagcuugucucccuugucagcagg

SEQ ID NO: 18444 - RNA, 64 nt, Human
ggcacgggccucggugcagguaacuggcaccucugcggggcagugccccacuccuuugugcaca

SEQ ID NO: 18445 - RNA, 64 nt, Human
ccggcugccugccgcccaaagagaaaucacaggggcggggcaggaaugcaaaguguuuucucag

SEQ ID NO: 18446 - RNA, 64 nt, Human
aaaugagcccaggaaaccagagcagugagggcgggcggggcauuucacccaggaauauugagaa

SEQ ID NO: 18447 - RNA, 57 nt, Human
gaaaggaaccgagcuuguagguacccggcggggcaggggauggggugggguaccgga

SEQ ID NO: 18448 - RNA, 64 nt, Human
aaaaggagagggaaugcagccuugugggggagaagcggggcagaggguucucuaaucuaaucag

SEQ ID NO: 18449 - RNA, 57 nt, Human
guuuagguacuuuagauugauugccgagcggggcaguuuugugagccuucaucugaa

SEQ ID NO: 18450 - RNA, 64 nt, Human
ucuugcuguaguggugggguagaggguggggcccgcggggcaguucgggaacccccuuccccgc

SEQ ID NO: 18451 - RNA, 64 nt, Human
ccuguaucugcuucagccuccugcccuagggaccgcggggcagcccccucccagcucuugcagc

SEQ ID NO: 18452 - RNA, 64 nt, Human
cguugaccccuuucccccaccccagaguugggaugcggggcagagccaccagggcacugucugc

SEQ ID NO: 18453 - RNA, 62 nt, Human
uucaucgcaaaacuuucuagugcccaaggagggcggggcauguugggagagggggagggagg

SEQ ID NO: 18454 - RNA, 64 nt, Human
gcugcucuagcgguccuggagguccuguggccacgcggggcaagugccuuuccgacaagacccc

SEQ ID NO: 18455 - RNA, 64 nt, Human
ugauauugugugguggugucacaggauggugggggcggggcagaagucuccuguugguguucug

SEQ ID NO: 18456 - RNA, 64 nt, Human
guggcucagucacaucccugcguguauacugucugcggggcacauauguauccauuuagagcua

SEQ ID NO: 18457 - RNA, 64 nt, Human
ccugugccccugcgucucacccuaggcgggcugggcggggcaggccuccuuuguucuccacaau

SEQ ID NO: 18458 - RNA, 64 nt, Human
ggccucccccagccaggaccaccucguccucguggcggggcagcaggagcgguagaaagggguc

SEQ ID NO: 18459 - RNA, 64 nt, Human
agcucuacugagagccaaggccccuagaauaguugcggggcacucugaucguucacuuuggucc

SEQ ID NO: 18460 - RNA, 64 nt, Human
gcugaucggggguugugagcagcgcggccuggacgcggggcacucucagggggcugugucugcg

SEQ ID NO: 18461 - RNA, 64 nt, Human
uuuuuuuuuuuuuuuuuuuuuuuuuuuuugagcugcggggcaugauggggauugcugcauauca

SEQ ID NO: 18462 - RNA, 64 nt, Human
gaaaccccgucucuacuaaaaauacaaaaaauuagcggggcaugguggcacgcgccuguagucc

SEQ ID NO: 18463 - RNA, 64 nt, Human
gacaacacuguacuccugggauaugggggcgggggcggggcagggcaggguggggggaagaacg

SEQ ID NO: 18464 - RNA, 64 nt, Human
acgcucuaucauauggagcgagguguuggggaaggcggggcaggcagccuguugcaggcagggg

SEQ ID NO: 18465 - RNA, 64 nt, Human
uggacacggaccucggcgggcgggacugggcggggcggggcaucagaacucagguguuuuuuau

SEQ ID NO: 18466 - RNA, 64 nt, Human
gaguucaggcccacugagccgcagcugagcacaggcggggcaggaaaaaggaugaggugaggga

SEQ ID NO: 18467 - RNA, 64 nt, Human
agaggccuucagccccucucccggagauggaaucgcggggcagggaggggcaggguguucuaga

SEQ ID NO: 18468 - RNA, 64 nt, Human
gaggagaacugagacucugccuuaccaccgcagugcggggcaccucucccagcguuucuccggu

SEQ ID NO: 18469 - RNA, 64 nt, Human
guccccacaggguccuaguggaggauguggaggggcggggcagagggguccagccggaguuuau

SEQ ID NO: 18470 - RNA, 64 nt, Human
uucaauuagagacacccucagguuggggggaggggcggggcaugguacaaccugugggaaggga

SEQ ID NO: 18471 - RNA, 64 nt, Human
gaggcgggcgcccugggcagagagacucuguggcgcggggcauccuaugaggcaggcacccugg

SEQ ID NO: 18472 - RNA, 64 nt, Human
ggaagccacauccuuagucaaccaguugcaucgugcggggcaaaaugaggagcagaggcaugga

SEQ ID NO: 18473 - RNA, 64 nt, Human
uggggaagugcuccccacacgugcucgcagccuggcggggcaggaggccuggccuugucaggac

SEQ ID NO: 18474 - RNA, 64 nt, Human
gcccggaguccugccggcccacaggcccaucccggcggggcaccggggacucgcgggcuucugc

SEQ ID NO: 18475 - RNA, 64 nt, Human
ccugcccccagcccaagaggagcccccacugccugcggggcagugaugucuggccaccggcuca

SEQ ID NO: 18476 - RNA, 64 nt, Human
aaucuuuaauccauaaaaauacauccccacuguagcggggcaggggguguccaacuucccugug

SEQ ID NO: 18477 - RNA, 64 nt, Human
ggacccgcugggggcuggcagagggcaucggucagcggggcagcggggcuggccaugagggucc

SEQ ID NO: 18478 - RNA, 64 nt, Human
acuauaugauaugaaccuuuuuuggguggggggugcggggcaguucacucugucucccaggcug

SEQ ID NO: 18479 - RNA, 64 nt, Human
ggugcuuggccaaugggccagaaaccgcuucugagcggggcacuucggcugcuccacagggaag

SEQ ID NO: 18480 - RNA, 64 nt, Human
cuggggggcacugggugguucucaccagcaggcugcggggcacuguguucucauuggccaaaaa

SEQ ID NO: 18481 - RNA, 64 nt, Human
gugagucuguggccugugcccuccccacucccaggcggggcaggaaggggccaagggggcuugc

SEQ ID NO: 18482 - RNA, 64 nt, Human
cgugugggacccgccgcggccucaacccggguccgcggggcacccgccggaugcgcagccuggc

SEQ ID NO: 18483 - RNA, 64 nt, Human
ugcagcuucuggggccuccacagaccccccuccugcggggcacgcuggccuaagagacguggca

SEQ ID NO: 18484 - RNA, 64 nt, Human
cggugugugagggugacuagguguugggggcagagcggggcaggaaagguagggcagaguuguu

SEQ ID NO: 18485 - RNA, 64 nt, Human
uucccaggaggugcagacuucuuaaaaggagcucgcggggcagcaaagcagcugauucagcagu

SEQ ID NO: 18486 - RNA, 64 nt, Human
gaaggcgaaggugguaguacagcaagaggcacuggcggggcagcaggccugcaggagcuguuuu

SEQ ID NO: 18487 - RNA, 64 nt, Human
ggagggcacccuggucugugccuuguggguggaggcggggcagggcuguguggcaccgccaggg

SEQ ID NO: 18488 - RNA, 64 nt, Human
cggcaggcuugccacguucugcagccgugccuuugcggggcaggcucugaagccucagcccgac

SEQ ID NO: 18489 - RNA, 64 nt, Human
aggcagucaccgccgucggaaggcgcuggagccugcggggcagcaggggccaagcaggcacucu

SEQ ID NO: 18490 - RNA, 64 nt, Human
ugggccaggaacaggacagggagaccuugugauggcggggcagggagccuguucguagggaaga

SEQ ID NO: 18491 - RNA, 64 nt, Human
gccugaagcugaaguuggaggcauccaaaauaaggcggggcacagugugggcggcggagucccu

SEQ ID NO: 18492 - RNA, 64 nt, Human
uggucacugugcacugcccuguucaugugccucugcggggcagggccuuccugguuuuguucac

SEQ ID NO: 18493 - RNA, 64 nt, Human
cuaaaacaccuucacuggugguuggggguaaggagcggggcacgggggaggaggagguaggggg

SEQ ID NO: 18494 - RNA, 63 nt, Human
aucuuggcucaguauguuaggaggggccaggcagcggggcagggacagggagccgagugcccc

SEQ ID NO: 18495 - RNA, 64 nt, Human
cgcccuggggauccaaccaacuuguaucgagugggcggggcaacggcuccccauuuuucccgag

SEQ ID NO: 18496 - RNA, 64 nt, Human
cagcccuggcagacugaggagccucccaggagcagcggggcaguguggggcuuugugucaucac

SEQ ID NO: 18497 - RNA, 64 nt, Human
cgcccucauggaaagagcugagccgcuucagacugcggggcaagcgggccgcggcucccuuccc

SEQ ID NO: 18498 - RNA, 64 nt, Human
cuagagccagggcccugcggauuuggagaagggagcggggcaggacuuccaggaggaccccaac

SEQ ID NO: 18499 - RNA, 64 nt, Human
ucagccagugacaguccuggcaaaugaagguggggcggggcagugaggggugggagaaggugaa

SEQ ID NO: 18500 - RNA, 64 nt, Human
gcaucuguacagccuugucugcaaacuggaggaugcggggcaagcccuuaggggccugccaggg

SEQ ID NO: 18501 - RNA, 64 nt, Human
aggcuguauaaaacgcacuuguuuucaugcaggagcggggcaaguaagguugagccugacugua

SEQ ID NO: 18502 - RNA, 64 nt, Human
agcgcugccgcaccccagagugugggaagggagagcggggcagucucggguggcuagucagaga

SEQ ID NO: 18503 - RNA, 64 nt, Human
auguauaggugccagguagaggcagagaggccaggcggggcaggaguggccaagcgcgcaaggg

SEQ ID NO: 18504 - RNA, 64 nt, Human
agggcaucucagaugcgcuuaaggagcggcgggggcggggcauggggggugucacaacuaaugu

SEQ ID NO: 18505 - RNA, 64 nt, Human
uuuuuggugauucaaauggguuuuccacgcuagggcggggcacagauuggagagggcucugugc

SEQ ID NO: 18506 - RNA, 56 nt, Human
ugcagugccagacggcaugacguggugcggggcagcguggccccaccggacuagca

SEQ ID NO: 18507 - RNA, 64 nt, Human
cagagcccuggggcggcugaugccagggcggcccgcggggcagccucacggaagggcccggugg

SEQ ID NO: 18508 - RNA, 55 nt, Human
ugcccgggggcucggccugagcgccgcggggcagcucgccccgccuccucccgcu

SEQ ID NO: 18509 - RNA, 64 nt, Human
agccaggggcugggggagguggaaggggcggggggcggggcagacagcagaccaccaaggguuc

SEQ ID NO: 18510 - RNA, 64 nt, Human
gcucgauuucucgcugggccuuagcugccuccccgcggggcagggcucgggaccugcagcccuc

SEQ ID NO: 18511 - RNA, 64 nt, Human
ugccccgccuggcagaccaccgcacacagaucaagcggggcagcaccuacuaccugcaugucca

SEQ ID NO: 18512 - RNA, 64 nt, Human
gugaacagaggacucagguuucauagcagcuagugcggggcauccucauccuguaccuauagag

SEQ ID NO: 18513 - RNA, 64 nt, Human
ccacugcugugugauuagacaggcccagugagccgcggggcacaugcuggccgcuccucccuca

SEQ ID NO: 18514 - RNA, 64 nt, Human
cuggagagagcugacggcagaugaaaucaccagggcggggcacccgcgagaacccucugggacc

SEQ ID NO: 18515 - RNA, 64 nt, Human
agcagaaacugccaggcaggaccugcugggccgugcggggcacccucggccucacccugcagug

SEQ ID NO: 18516 - RNA, 64 nt, Human
cggggucaagacacgggaugacgggaagcaggaagcggggcagcagcacagcgugggguccugg

SEQ ID NO: 18517 - RNA, 64 nt, Human
acccacgucccucacccgccgggguccccuccgggcggggcagacgaugacucgccccucgccc

SEQ ID NO: 18518 - RNA, 64 nt, Human
uccggccugggcaccagcauuuggcagcacgcaggcggggcaguaugugauggacuggggagca

SEQ ID NO: 18519 - RNA, 64 nt, Human
acacuggcuuugcauccuggaagaccugcagggggcggggcaggaaauguaccugaaaaggauu

SEQ ID NO: 18520 - RNA, 64 nt, Human
uagguagccguaguuggacggacgggcagggccggcggggcagcccccuccgcgcccccggccg

SEQ ID NO: 18521 - RNA, 64 nt, Human
uggaggggccccaggggaguguacgucaggcuuugcggggcacgggggccacucagcagcgcug

SEQ ID NO: 18522 - RNA, 64 nt, Human
aggcgcccacugggugcugugggcucaggagggggcggggcaggagcuggugccaaccgggaac

SEQ ID NO: 18523 - RNA, 64 nt, Human
gccccacgccgccccagggaggaggcgccagagcgcggggcagacgcaaagugaaauaaacacu

SEQ ID NO: 18524 - RNA, 64 nt, Human
ugcccgagcaggcuccuugcaaagacagcagcgugcggggcagagccccgggagggcgcgucug

SEQ ID NO: 18525 - RNA, 64 nt, Human
uguuguugguuuuagcuuccaguggcuucuuucugcggggcaucaggcugcugggguagccgcc

SEQ ID NO: 18526 - RNA, 64 nt, Human
agcuacuucagaggagcuguuuaucccucuccacgcggggcagacucuggcgggucuccuagcg

SEQ ID NO: 18527 - RNA, 64 nt, Human
acgcucaaacccccacuuccugccccaggcuggcgcggggcacuuuguacaaauccuuguaaau

SEQ ID NO: 18528 - RNA, 64 nt, Human
accgugaccgugaccgcgagcacaaacggggggagcggggcagugagcggggcagggaugaggc

SEQ ID NO: 18529 - RNA, 64 nt, Human
accgcgagcacaaacggggggagcggggcagugagcggggcagggaugaggcccgagguggggg

SEQ ID NO: 18530 - RNA, 64 nt, Human
cucccaucaaaggaugaccccuaaacacagaggagcggggcaggcagggaggcaaugacuggag

SEQ ID NO: 18531 - RNA, 64 nt, Human
cccgcacagagaccccgacucacugccagccggggcggggcagggugccgcaggcugggcuugc

SEQ ID NO: 18532 - RNA, 64 nt, Human
ccccgcuccccaacuucucgcccagcuggccgaggcggggcaacacuaaggugcucuuagaaac

SEQ ID NO: 18533 - RNA, 64 nt, Human
gguggggaacugggccuagcugugggaggucaucgcggggcauugcagggagugcguuguggga

SEQ ID NO: 18534 - RNA, 64 nt, Human
ugaguguugagcccguccuugggcucuggucccugcggggcaggcucucccgggcccacggggc

SEQ ID NO: 18535 - RNA, 64 nt, Human
cuaagccucccauccuguguuagcguugccuggugcggggcagggccuaacaaggaaaccuggg

SEQ ID NO: 18536 - RNA, 64 nt, Human
gccuuaaggaacccgccgcgugcccaggugccccgcggggcauccagcucggccccuuggccgc

SEQ ID NO: 18537 - RNA, 64 nt, Human
gugccggcuggacccaagcccugcauccccacaugcggggcagaggcccuucucuccgccaaau

SEQ ID NO: 18538 - RNA, 64 nt, Human
ugcgcccacccgggccucggagccugccucggccgcggggcauugcccugaguggacagucguc

SEQ ID NO: 18539 - RNA, 64 nt, Human
aucuccuugaagccauaacguccgagcugcuggugcggggcagcccuggcccuaggcuuccuaa

SEQ ID NO: 18540 - RNA, 64 nt, Human
gggagaccuccauucagguggaggucccgagugggcggggcagcgacugggagaugggucgguc

SEQ ID NO: 18541 - RNA, 64 nt, Human
gcucugcccuucugcucggugcccuccacgugaggcggggcaccugcaugcacugggagggggc

SEQ ID NO: 18542 - RNA, 64 nt, Human
acugaggugcauucugggcuccagggacgccacugcggggcaaaggcgccguuaccuggagucu

SEQ ID NO: 18543 - RNA, 64 nt, Human
uagcauuugcuucucugggcaaaugggaaguucagcggggcagcagaaucaguggcauuccccc

SEQ ID NO: 18544 - RNA, 64 nt, Human
cagccaccugcuguaguuggaccugaggucagaggcggggcaucagaggcucaaggugcugaga

SEQ ID NO: 18545 - RNA, 64 nt, Human
ugauguaugucaggaggccacagggagcagaggagcggggcaggcagccacagggcccugcggg

SEQ ID NO: 18546 - RNA, 64 nt, Human
accugaaaguuuuuuugguuuaaaagaagaauaggcggggcacgguggcucaugccuguaaucc

SEQ ID NO: 18547 - RNA, 64 nt, Human
cacccacccagagauggagcugcucugccuuccagcggggcacccggagggcugccccagcaga

SEQ ID NO: 18548 - RNA, 64 nt, Human
gggugaggggcaggcagcaguuguaguuacugccgcggggcacugcuaugugcagggacagcca

SEQ ID NO: 18549 - RNA, 64 nt, Human
guuuugcagcuggaauucuccucuuggucccagggcggggcagggaauucuaaguguccacccc

SEQ ID NO: 18550 - RNA, 64 nt, Human
aggcagugcugucucgcucagucuuuccagaccagcggggcagcaccugggaggccugucugaa

SEQ ID NO: 18551 - RNA, 64 nt, Human
ugcuaaccuggccugcucaggcuucccacccugugcggggcacacccccaggaagggacccugg

SEQ ID NO: 18552 - RNA, 64 nt, Human
ccucauccuuccugggcucccuauuuggaagcaagcggggcaaggggcccuuccagaugccacc

SEQ ID NO: 18553 - RNA, 64 nt, Human
acaaggugaugcagaugugaccuaggacgauggaccgccggacucuuuucugcagcacacgccu

SEQ ID NO: 18554 - RNA, 64 nt, Human
ccggcgugccggagaggagaaagggcccgacugcccgccggacccugcacccagcgacugggcc

SEQ ID NO: 18555 - RNA, 64 nt, Human
cagcggagugcgcuggggcgcgccagggcuaggcccgccggaggagcgcguccccagccuuccg

SEQ ID NO: 18556 - RNA, 64 nt, Human
caggggucacauauaaggucaguguuucucguccccgccggaucugcacugccaacugggauug

SEQ ID NO: 18557 - RNA, 64 nt, Human
uucuccugcagucuguggagcguccuuguccccgccgccggaaugaaugagcauucugcagccc

SEQ ID NO: 18558 - RNA, 64 nt, Human
guccguccuguguccgcgcgcgcgggugccuuucccgccggagacucggccggugugcuucgug

SEQ ID NO: 18559 - RNA, 64 nt, Human
auggcucagccuaaccucuccuggccaaucccccccgccggagagcaggacacuagggaggacc

SEQ ID NO: 18560 - RNA, 64 nt, Human
ugacuugugccagcagcauggacugcgugccucuccgccggaggucuagcugugggcggccaag

SEQ ID NO: 18561 - RNA, 64 nt, Human
cccgccgcggccucaacccggguccgcggggcacccgccggaugcgcagccuggccucuacuac

SEQ ID NO: 18562 - RNA, 60 nt, Human
ccccagccaucaucucuuaacuacggaggcccgccggaggccacaccaucccuuaguuuc

SEQ ID NO: 18563 - RNA, 64 nt, Human
agcugggggggccucaccuguuccccugaggaccccgccggacccggaggcucacagggaacaa

SEQ ID NO: 18564 - RNA, 64 nt, Human
agcaguuuucuaauuuugacuuuaaauuuuucauccgccggagacacugcucccauuugugggg

SEQ ID NO: 18565 - RNA, 64 nt, Human
ccagccagcgggcaucugaagccggguccuucgcccgccggaggcugccguccgucucuccugc

SEQ ID NO: 18566 - RNA, 64 nt, Human
gucccaucggaaguuuuggguuuuccgcccacagccgccggaaguggcuccguggccccgcccu

SEQ ID NO: 18567 - RNA, 64 nt, Human
ucuuccucugcaagugcucagggaaauggccuucccgccggaggccagcuaucugccugacagg

SEQ ID NO: 18568 - RNA, 64 nt, Human
agugagccccuccccagccagcccuucccuggccccgccggauguauaaauguaaaaaugaagg

SEQ ID NO: 18569 - RNA, 64 nt, Human
uuggcauugcuccccagacugaacagaaaccuggccgccggaugggaccuccuuuggcacagac

SEQ ID NO: 18570 - RNA, 64 nt, Human
ccggucuccacccugagggagcaccgacccggugccgccggagcuggcccugugcgcaugcuca

SEQ ID NO: 18571 - RNA, 64 nt, Human
cacuuuccuccgcguugcuuccggacggcgccgaccgccggagcccaagugacgcggagcucgu

SEQ ID NO: 18572 - RNA, 64 nt, Human
ugcacauuuugaaaagagcagcugcugcuuagggccgccggaagcugguguccugucauuuucu

SEQ ID NO: 18573 - RNA, 64 nt, Human
ggcccucaggggcgauuagcuuagugagcuuaccccgccggagcgggggagcgcuagagguagu

SEQ ID NO: 18574 - RNA, 64 nt, Human
cuuguucuuguuuuacuguauugagcggcggcacccgccggacccgcauuauggcugggggcgc

SEQ ID NO: 18575 - RNA, 64 nt, Human
aaccgagcuuggaguucuccaaguggaguuccacccgccggacuccugacaccccugggcuagg

SEQ ID NO: 18576 - RNA, 64 nt, Human
cugccguaguaauccaccccaacggccggaggagccgccggagcccgccugcccgcccgccgcc

SEQ ID NO: 18577 - RNA, 64 nt, Human
cauucugggguguggcuccagccuucccuggcccccgccggaggccgggagggagcagggucuc

SEQ ID NO: 18578 - RNA, 64 nt, Human
uugccaccacacucgcccacuugcccaccgggucccgccggauaaaugacaggcccgaggucag

SEQ ID NO: 18579 - RNA, 64 nt, Human
cuuccuucacuuugcagaggcuggaagacggcagccgccggacugggcagauccucaagcagac

SEQ ID NO: 18580 - RNA, 64 nt, Human
gcccgaggacgcucccugcuccacgucugcgccgccgccggaguccacucccagugcuugcaag

SEQ ID NO: 18581 - RNA, 64 nt, Human
cugguggggcagacccgaaaauccagcgugcaccccgccggaggaaggucccauggccugcugg

SEQ ID NO: 18582 - RNA, 64 nt, Human
agaucugguaccgcagguagcgccgccgccgccgccgccggagccugucgccguccugucccca

SEQ ID NO: 18583 - RNA, 64 nt, Human
cagcugcggcaagccuagggaccagggugaggacccgccggaugacagccacccucaccgcggc

SEQ ID NO: 18584 - RNA, 64 nt, Human
gccaaucggagcgcgaggacguggucuggagguaccgccggagaucugggaccacucagggcau

SEQ ID NO: 18585 - RNA, 64 nt, Human
gugccauuccccagccacugccuucaugcugcccccgccggacuggcagagccaggggucagcc

SEQ ID NO: 18586 - RNA, 64 nt, Human
gcccgacuagcaggcaugccgcgguagguaagggccgccggaccgcguagagagccgggccccg

SEQ ID NO: 18587 - RNA, 64 nt, Human
uguggccugccuuugcugaccguuuugggguuccccgccggagcuacaggggcauuuucuuccc

SEQ ID NO: 18588 - RNA, 64 nt, Human
gugagagcuguguggccccccgaugccacucugcccgccggagggaugugccugcugagccuuu

SEQ ID NO: 18589 - RNA, 64 nt, Human
cgauccaguacaacgugguggauggccugagggaccgccggagcuuccacgggccguacacagu

SEQ ID NO: 18590 - RNA, 64 nt, Human
guuaacuacccucaccaggacgcagccaguguguccgccggauguccagaugccccgcuugucu

SEQ ID NO: 18591 - RNA, 64 nt, Human
cggguggcaggccgggcuccgccacugcaugcucccgccggaccgagccccagcaagggcuccu

SEQ ID NO: 18592 - RNA, 64 nt, Human
cuggggcucuuugugagugaggguggccaaacuaccgccggaggagauggggucucagagcgag

SEQ ID NO: 18593 - RNA, 61 nt, Human
cuuacaagcaagggugcuaggggcucagcuauacgaccauucucccugacagggaguccaa

SEQ ID NO: 18594 - RNA, 61 nt, Human
cuguuguaggugguuccgaguugagacaaauuacgaccacuggaagccagcacccaaggaa

SEQ ID NO: 18595 - RNA, 61 nt, Human
uagaaauuuagauuuuaaaaggcgugggacauacgaccaggcccuauagccacauaaauau

SEQ ID NO: 18596 - RNA, 61 nt, Human
uuugguaaauuggauaucuuuuuuuuacaaauacgaccauuaaccucaguuaaauuuuugu

SEQ ID NO: 18597 - RNA, 61 nt, Human
aaaaggaagcccuacuucugggaccacauuuuacgaccaccuagcugagugauguaagcgu

SEQ ID NO: 18598 - RNA, 61 nt, Human
ggauaggcuuauauucaaaacaucuuagucauacgaccauaaauuaaaaguggagucacua

SEQ ID NO: 18599 - RNA, 61 nt, Human
uaaauaggucaaucagacuaugacagcuauguacgaccauuuguauguguaucuaugucag

SEQ ID NO: 18600 - RNA, 61 nt, Human
gagaaagugguauauaagucuuuguauacauuacgaccauugugauuauccauuaaaucca

SEQ ID NO: 18601 - RNA, 61 nt, Human
ugaacaaacaaaaaacaaaacgcucaagccuuacgaccagagaaggauuucagcaaaccac

SEQ ID NO: 18602 - RNA, 61 nt, Human
ggugcugcuggacggcaagcccaucagcgccuacgaccacaaguacuugcaccguguggua

SEQ ID NO: 18603 - RNA, 61 nt, Human
uuaaaaacaagucacugauuuguuuugaacuuacgaccauuugguuucagcaugucaggag

SEQ ID NO: 18604 - RNA, 61 nt, Human
agauucauuuaauuuuccugugguugaccuauacgaccaggauguagaaaacuagaaagaa

SEQ ID NO: 18605 - RNA, 61 nt, Human
ugcaaaaucuuuaaggaaaaaagcugaaggguacgaccaugcacauaugugaccuggaaaa

SEQ ID NO: 18606 - RNA, 61 nt, Human
ggaguggccguugcuacaagucaccuggugcuacgaccagggugagaauaaagacgucucc

SEQ ID NO: 18607 - RNA, 64 nt, Human
gggcugggcagccgggggccgguggccagagcgagggcaccagccacgaaggacggaggcgggc

SEQ ID NO: 18608 - RNA, 64 nt, Human
gagcacccccaggccuuccacuccucuacccucugggcaccagaaggcuccuggaccaugagcu

SEQ ID NO: 18609 - RNA, 64 nt, Human
agucuuggcacuuugcaaacauccuggccaccaugggcaccaggacacagggauggauaccacc

SEQ ID NO: 18610 - RNA, 64 nt, Human
uguuuuuucucgcacguugaggcuuaguggagaugggcaccacugccauuugcucagaagaagg

SEQ ID NO: 18611 - RNA, 64 nt, Human
ugcugccacugccucuggccauuuaaagugagaggggcaccaacagacaauucggggaccuuag

SEQ ID NO: 18612 - RNA, 64 nt, Human
ccaggggugccccaggcuagcucuucuaccucuggggcaccacggacuccccuuggccacucuu

SEQ ID NO: 18613 - RNA, 64 nt, Human
agccagugaugugaguguaucagaaugccagggagggcaccagcccugauccacagaccucgga

SEQ ID NO: 18614 - RNA, 56 nt, Human
aggacaugggucaucacugaggcugcgggcaccacgcgggguccggccugggaucc

SEQ ID NO: 18615 - RNA, 64 nt, Human
cuugacccagaccugagucggcugcucuuggggugggcaccaggucaacccuucuccuccugcu

SEQ ID NO: 18616 - RNA, 64 nt, Human
ugaagucuuggguacucaaagugucuuucuaccagggcaccagaucccuuccauggagcagguc

SEQ ID NO: 18617 - RNA, 64 nt, Human
uggggucccagauggcucaggcugugaccucccugggcaccacccuccccaggcugggugugga

SEQ ID NO: 18618 - RNA, 64 nt, Human
ucugcugccuuugccugguccuccagguugcugggggcaccacagacaucaagauuccaguuca

SEQ ID NO: 18619 - RNA, 64 nt, Human
aucaaccuguaugggaaggugguccagaagcuucgggcaccacgcacucaggccauggaggagc

SEQ ID NO: 18620 - RNA, 64 nt, Human
aaagaguugagaggccagggcccuugguggaaaggggcaccagccuuggucugagauagucaca

SEQ ID NO: 18621 - RNA, 64 nt, Human
gccuuucucccugggaagcagcacagcugagacugggcaccaggccaccucuguugggacccac

SEQ ID NO: 18622 - RNA, 64 nt, Human
aaaguguaacucagacugaccuguggggcacagggggcaccagcuggccuugcccucucugguc

SEQ ID NO: 18623 - RNA, 64 nt, Human
uuauuuauugccgaaaccaggcaggcaaccccaagggcaccaaccagggccuccccaaagccug

SEQ ID NO: 18624 - RNA, 64 nt, Human
guaaaaugaguucuuugaaauggaugaucucuaagggcaccaaaucugguauucuaagguucuc

SEQ ID NO: 18625 - RNA, 64 nt, Human
ugagaaggggccaggccaagggccggguggggaugggcaccaagaaucucucccaccaccugaa

SEQ ID NO: 18626 - RNA, 64 nt, Human
gagcugggggaagaagggauaucuacuguggucugggcaccaccucugugggcacuggugggcc

SEQ ID NO: 18627 - RNA, 64 nt, Human
uuaugaucaggcugcauggacaaagcagguagaggggcaccaucaggggcucuugcacuauuuu

SEQ ID NO: 18628 - RNA, 64 nt, Human
uuugacaacucugcagucugcuucuaaugggaaagggcaccacucuccucagccacauuauugg

SEQ ID NO: 18629 - RNA, 64 nt, Human
gaaccuugggucugggaaaaagcuuuaaccugcagggcaccaggacccaaggcaggcuguuccu

SEQ ID NO: 18630 - RNA, 64 nt, Human
ucagcaucacggaaggucuugucaaaagagugcugggcaccacucccagcauuucuggcacguu

SEQ ID NO: 18631 - RNA, 64 nt, Human
aggguuugccccagagaucuaaauuccagaaggagggcaccacaccuaggaagguaaauccagu

SEQ ID NO: 18632 - RNA, 64 nt, Human
cugcugccucagcacagagagccagaacucuaucgggcaccaggauaacaucucucagugaaca

SEQ ID NO: 18633 - RNA, 64 nt, Human
cuguccugcucaccugugugcccagcaccuggaggggcaccagguggaggguuugcacuccaca

SEQ ID NO: 18634 - RNA, 64 nt, Human
uguuuugcuaaaggaaaaaaccauccaggucacggggcaccaaauuugagacaaauagucggau

SEQ ID NO: 18635 - RNA, 64 nt, Human
ggcccacagggccaccagcacacccccgcacgcugggcaccaacagagccacggagcgcgagca

SEQ ID NO: 18636 - RNA, 64 nt, Human
cagagccagguuuugcugguuuggggcaugcccugggcaccagagcuuuaacauuugaagccac

SEQ ID NO: 18637 - RNA, 64 nt, Human
gcuucccaccugcccuccccacccccugccccucgggcaccagccugcauauguguucacuuuu

SEQ ID NO: 18638 - RNA, 64 nt, Human
cucaucccuccccaccucccacugcuuccugcaagggcaccaguuguaugagaaaguuggccuu

SEQ ID NO: 18639 - RNA, 64 nt, Human
cagggaagauuaguccagugauuacauaagaguugggcaccauaaauucucuauauuuugccuc

SEQ ID NO: 18640 - RNA, 64 nt, Human
cagcccuggggccugugcccccagaggccuacaggggcaccaugcugcacugcccgcugaacuu

SEQ ID NO: 18641 - RNA, 64 nt, Human
aaaauagaucaaugaauauaauucagucuuuuaggggcaccaaguaaagcauaaggucauauau

SEQ ID NO: 18642 - RNA, 64 nt, Human
gagaaucuauuauuuaaaaccacucuguucaaaggggcaccaguuuguagucccucuguuucgc

SEQ ID NO: 18643 - RNA, 64 nt, Human
ugaaacucaauaauaaacagugccaccuguacaugggcaccaugcccuccuccucgugcugugu

SEQ ID NO: 18644 - RNA, 64 nt, Human
cacucugcuucucugacuucugccuggagacuuagggcaccagggguuucucgcauaggaccuu

SEQ ID NO: 18645 - RNA, 64 nt, Human
cagaucugaugcuucaagaggcuguaaccucagagggcaccaaggaggguggcagagccugcuu

SEQ ID NO: 18646 - RNA, 64 nt, Human
cacuuucgauguugggcgcuggcguuuguguucugggcaccaccgugacccugcccagauggcu

SEQ ID NO: 18647 - RNA, 64 nt, Human
accaaauacgccugggcagccgggacgggccggcgggcaccaggcuggggucuccuugucugug

SEQ ID NO: 18648 - RNA, 64 nt, Human
cagcacgggcacugccacuugguguggcucaccagggcaccagccucgcagaaggcaucuuccu

SEQ ID NO: 18649 - RNA, 64 nt, Human
cuucauaagcggacgccacguuaggguuggacgugggcaccacgaguccuuugaggcuccugga

SEQ ID NO: 18650 - RNA, 64 nt, Human
ggggcaggcaugcacccggugccagccccgcucugggcaccaccugccuuccagccccuccagg

SEQ ID NO: 18651 - RNA, 64 nt, Human
cuggcaccgcgagcuggccugacgccucaagcacgggcaccagccgucaucuccggggccaggg

SEQ ID NO: 18652 - RNA, 64 nt, Human
acucaacaugagacauuccuuucugcuuucuggagggcaccaggggccuuucucuuugauaaau

SEQ ID NO: 18653 - RNA, 64 nt, Human
guuuaagugacuccuguugccugagcacaaaaaugggcaccaauggaggaaaaugacccuuggg

SEQ ID NO: 18654 - RNA, 64 nt, Human
ccucaucuugccaucucccggccaggcugggaacgggcaccaagcagccgccucuaacaaacac

SEQ ID NO: 18655 - RNA, 64 nt, Human
cuguguuccugugccaaaguccugucaggcuggugggcaccaggaaaggccugcacccucuucc

SEQ ID NO: 18656 - RNA, 64 nt, Human
guccugggcacuggcugugugaagggaucuggcagggcaccacagcgcccccuacugaaccauc

SEQ ID NO: 18657 - RNA, 64 nt, Human
gcaaaauuggccugaauauucucuuggggaaagagggcaccaaagaaaaggguaagugcaucug

SEQ ID NO: 18658 - RNA, 64 nt, Human
caaugugcccccagaugucagaaugaggcgacuagggcaccauacucacuuuccagggcugggg

SEQ ID NO: 18659 - RNA, 64 nt, Human
ggcugcacacaggcacauuccuucuuccacaguggggcaccaaggauucuguccucauugcugg

SEQ ID NO: 18660 - RNA, 64 nt, Human
uuugauugucuuuccagagaugcugcucucugcagggcaccaccuucaaggcacagcccuuguu

SEQ ID NO: 18661 - RNA, 64 nt, Human
cugagccagaggcaucugacagcccuuucccagagggcaccacgcaagggcagagcugggcggc

SEQ ID NO: 18662 - RNA, 64 nt, Human
gcacugcuguggagucugcuucucccauguaccagggcaccaggcccacccaacugaaggcaug

SEQ ID NO: 18663 - RNA, 64 nt, Human
ucaggguaaccaacucgauuugggaugaaucuuagggcaccaaagacuaagacaguaucuuuaa

SEQ ID NO: 18664 - RNA, 64 nt, Human
acuacacuccaaauuuaauguguuuaaauugguggggcaccagcagaaaauauucuagcucagc

SEQ ID NO: 18665 - RNA, 64 nt, Human
ugcccagccuaauugcaguaagacaaaaauucuagggcaccaagaggcuaaagucagcacagcu

SEQ ID NO: 18666 - RNA, 64 nt, Human
acagggcaguguccacagccagaaaacuccugcugggcaccaaccacuacgagcauaccccaug

SEQ ID NO: 18667 - RNA, 64 nt, Human
uuuguugcauauuugcuaguacuaaucagucaaagggcaccauucuuuuuuuuuuuuuuugaaa

SEQ ID NO: 18668 - RNA, 64 nt, Human
gucacuguacugacuugagggugauuaacagagagggcaccaucacaauacagauaacauuagg

SEQ ID NO: 18669 - RNA, 64 nt, Human
agucuugaaauuuggugugucuugggguggggaggggcaccaacgccugccccugggguccuuu

SEQ ID NO: 18670 - RNA, 64 nt, Human
auaugcugcugcagaaugagcucuuccugaacgugggcaccaaggacuucccagacggagagcu

SEQ ID NO: 18671 - RNA, 64 nt, Human
ggagggaucaaguuaaugaaggccacaaggcacugggcaccaguccuuuuggaguggaccuuuu

SEQ ID NO: 18672 - RNA, 64 nt, Human
ucacauucucaccuagcaacaacuggcuggagcugggcaccagcucugccuuuagaaggggugu

SEQ ID NO: 18673 - RNA, 64 nt, Human
ccagggaagccuggcuuacagugccauuucugcugggcaccaccaccugccugagggccuagcu

SEQ ID NO: 18674 - RNA, 64 nt, Human
ugggugucagcuagcucuuuaauaggugcccucagggcaccacagggcugacugcacaaagcug

SEQ ID NO: 18675 - RNA, 64 nt, Human
ucaagccggagaacaucaugugugucaacaagacgggcaccaggaucaagcucaucgacuuugg

SEQ ID NO: 18676 - RNA, 64 nt, Human
gacugaaacuagcuaaaccugaauguaccuacuagggcaccauaauacugcagcaagaccaaag

SEQ ID NO: 18677 - RNA, 64 nt, Human
auucccuggacccuuaacugccucacccugagcugggcaccaagguuagaaggcaaaagugggg

SEQ ID NO: 18678 - RNA, 64 nt, Human
cuuuggaagaaacucuugaauacugccugcauccgggcaccauggccagguugccuaggagugg

SEQ ID NO: 18679 - RNA, 64 nt, Human
gaggcggcacauuggcagugugucacacugagcugggcaccacaggcugccucaugacccuccu

SEQ ID NO: 18680 - RNA, 64 nt, Human
cauggaagugccgcccagaggcaugcaggcugcugggcaccacccccucauccagggaacgagu

SEQ ID NO: 18681 - RNA, 64 nt, Human
caaacauuuguccuaauagcuuucucauaaauaugggcaccacuuuacauugugguaagacauu

SEQ ID NO: 18682 - RNA, 64 nt, Human
aggcccagggcggcgggcucagccauucggcuuggggcaccaggcuccccagagacaaugcuca

SEQ ID NO: 18683 - RNA, 64 nt, Human
aggcugaguagcugagccacugugcccaggcugugggcaccaggcagagugggagccuagguca

SEQ ID NO: 18684 - RNA, 64 nt, Human
ggagcaacgccaguggcaacguagugacucaggcgggcaccaaggcaacggcaccauuggucuc

SEQ ID NO: 18685 - RNA, 64 nt, Human
uuugccauggaaucugggugggagaggauacugcgggcaccagaaugcuaaaguuuccuaacau

SEQ ID NO: 18686 - RNA, 64 nt, Human
agcugauauuuugauaacaaucucuaauuugcaugggcaccacauuucuuauauuaaaagaauu

SEQ ID NO: 18687 - RNA, 64 nt, Human
gucuugaauaaaauaauuguaaugagugcuaaaugggcaccauuauucgaaucagauaccuuuu

SEQ ID NO: 18688 - RNA, 64 nt, Human
caggauguuggguuugcucaaggagucaagaggagggcaccaaguuuuccuuuuuucuaaauag

SEQ ID NO: 18689 - RNA, 64 nt, Human
auucugccuccauccugguuuccccaaagccccagggcaccauccuuaggggagaaggucuaca

SEQ ID NO: 18690 - RNA, 64 nt, Human
aaggcugggccuucgacccuggggaugggccacagggcaccaaacacaucauaugucucucucu

SEQ ID NO: 18691 - RNA, 64 nt, Human
gaagcaaaaaggcggcuguggaucgcccugggcugggcaccagugacaggucaggaucuccaaa

SEQ ID NO: 18692 - RNA, 64 nt, Human
gaagacuuacucugaauguucguucaccauccgugggcaccaggucugugccaagcacagggac

SEQ ID NO: 18693 - RNA, 64 nt, Human
ggcccugagcacgagaagagccuccgcccggcccgggcaccacccgaccucgcagggagcaggc

SEQ ID NO: 18694 - RNA, 64 nt, Human
ucuguggggacgagggacacugaggagaggugcugggcaccaggacgcugccuccuggucccug

SEQ ID NO: 18695 - RNA, 64 nt, Human
ggaagagcagcaggaaggcaccgcuguccaccuugggcaccauuuauccuccuuucaucguccc

SEQ ID NO: 18696 - RNA, 51 nt, Human
gcucgcuggagaacaacuaaggggcaccaaacccucugagguuuuacuuua

SEQ ID NO: 18697 - RNA, 64 nt, Human
augugcagaugcuaacuggacauucuggggaacugggcaccaggagugccuucauacacuguac

SEQ ID NO: 18698 - RNA, 64 nt, Human
guugggaagggggugcaggaagcucaaccccucugggcaccaacccugcauugcagguuggcac

SEQ ID NO: 18699 - RNA, 64 nt, Human
gccugugggugggcagccaccuggugccaccacagggcaccagggaugauccugauguggcagg

SEQ ID NO: 18700 - RNA, 64 nt, Human
cucuuggcaccagguuggggggcaugugcuuguugggcaccaaagugauggaacccucaggugc

SEQ ID NO: 18701 - RNA, 64 nt, Human
ugaucacuugaucccaggaguuugagaccagccugggcaccauggugaaaccucgucuuuacca

SEQ ID NO: 18702 - RNA, 64 nt, Human
gagaaugaaaagguguuugauggacauguugugggggcaccaaugcagaacacugcacugaguc

SEQ ID NO: 18703 - RNA, 64 nt, Human
uuccgccacucagccauuucccccuccucagauggggcaccaauaacaaggagcucacccugcc

SEQ ID NO: 18704 - RNA, 64 nt, Human
ugugacaucaaguaaguucauuuccaucugcucagggcaccagaacccacauagacagccugug

SEQ ID NO: 18705 - RNA, 64 nt, Human
cagugugaacucaggaggggcaggugucagaacugggcaccaggacuggagcccccuccggaga

SEQ ID NO: 18706 - RNA, 64 nt, Human
ugaauagucuuuuacauuuuuguaugcugaauaugggcaccaaagaaccuguaaaaguuaucuu

SEQ ID NO: 18707 - RNA, 64 nt, Human
cuuggcaagggcaggcaccacuuuguagcaacuugggcaccagcuuuucuggacagccuggcuu

SEQ ID NO: 18708 - RNA, 64 nt, Human
cuccaggccuguccaucaggaaguaaauuuuacagggcaccaagcuuugcccccuaaaaucccu

SEQ ID NO: 18709 - RNA, 64 nt, Human
acagaaaugggcacuaccuccuggcccacucccugggcaccaugcccucuggugaccuguuggc

SEQ ID NO: 18710 - RNA, 64 nt, Human
ucauccaacuccgaaagucugaaucucccaaggagggcaccaucuuacagagacucucccugac

SEQ ID NO: 18711 - RNA, 64 nt, Human
aguaaguccucuuuguagaugauguauuuugcuugggcaccaacagaauuaaaaacgaaaaaca

SEQ ID NO: 18712 - RNA, 64 nt, Human
uuugagugcaaauacagguacuguuggaguugaugggcaccaugcuuucucaugaaguagcauu

SEQ ID NO: 18713 - RNA, 64 nt, Human
gauauuuuuuagcaccugaagcaccaucugaaaggggcaccauuuucuucuucccuuugaucuc

SEQ ID NO: 18714 - RNA, 64 nt, Human
guagguuuuacuaagcagauggucgggcacugcagggcaccaggcaggauccuagggcgccucu

SEQ ID NO: 18715 - RNA, 64 nt, Human
agcggccacgguuuucccuccuugugugcccauggggcaccagcucauggucuuuuucagucau

SEQ ID NO: 18716 - RNA, 64 nt, Human
caggcugcugggcaguucugcucuguggaggggcgggcaccagcgccacuuaugugccucugcu

SEQ ID NO: 18717 - RNA, 64 nt, Human
guggugagguaccgucuacauuucacauuauucugggcaccacaaaauauacaaaacuuuauca

SEQ ID NO: 18718 - RNA, 64 nt, Human
aaaccaggaguguuuccaguuccacccuuuccuggggcaccaccacccuuuuuauauugcugaa

SEQ ID NO: 18719 - RNA, 64 nt, Human
cugcguccacgccugcacaucccggcgcacgugugggcaccacagaggacacgugaggggaaug

SEQ ID NO: 18720 - RNA, 64 nt, Human
uugcccaccgucuuccagacaccccaccugaggggggcaccagguuuagugcugcugcuuucac

SEQ ID NO: 18721 - RNA, 64 nt, Human
acgcucagcaggugugccauccuuccaccugcuggggcaccauucuuaguauacagagguggcc

SEQ ID NO: 18722 - RNA, 64 nt, Human
aagaguaaagauauuuuuaaaauggcuagcuauugggcaccaguuuuucuguuaucuaaaauuu

SEQ ID NO: 18723 - RNA, 64 nt, Human
ugcaggacaggaggcggcccggccagcgggcacagggcaccagaggccgaaggugccucagacu

SEQ ID NO: 18724 - RNA, 64 nt, Human
ggcccagaggagcugugccagggcguggagaggagggcaccagggggccgcaggggucucucca

SEQ ID NO: 18725 - RNA, 64 nt, Human
ccacucggcacugggccaccugccccugcuggaggggcaccaugugugagccgcccuacucccu

SEQ ID NO: 18726 - RNA, 64 nt, Human
gcauggccccuuuaguccucccgcccccgccaaggggcaccaaggccacguuuccgugccaccu

SEQ ID NO: 18727 - RNA, 64 nt, Human
ucagccucucgaguagcugggacuacuggcaggugggcaccaugccuggcuacuuuuuuguauu

SEQ ID NO: 18728 - RNA, 64 nt, Human
cugggagagcccuuguggcgaggcauuaaaacuugggcaccagcuucuuucucgguggcagaaa

SEQ ID NO: 18729 - RNA, 64 nt, Human
gcaugaaauucaaauacauggaggcacaucuucagggcaccaguguuaaaauuuuggagucuua

SEQ ID NO: 18730 - RNA, 64 nt, Human
ugugugggaaggacaaagccacucucacaagaaagggcaccaggacugcucuccaaggaacugg

SEQ ID NO: 18731 - RNA, 64 nt, Human
cucaagguucccacaaagucuuugcugcugugcugggcaccacccaccccucaccuugcaggcu

SEQ ID NO: 18732 - RNA, 64 nt, Human
gcggccaccacccgucaacccugccaggagcugagggcaccacccagcaaccugggccugcauu

SEQ ID NO: 18733 - RNA, 64 nt, Human
acaggucccuuccucuccaucucccaccaaacuagggcaccauugauuagacaaagguacagug

SEQ ID NO: 18734 - RNA, 64 nt, Human
acugaaucuguagcuuccggauaccguagcccaugggcaccagcuuggaggcccccuagaccag

SEQ ID NO: 18735 - RNA, 64 nt, Human
gcgaugucgcacgguaccugcgcgcggcugcggggggcaccagaggcaguaaccaugcccgcau

SEQ ID NO: 18736 - RNA, 64 nt, Human
ugccuaugaccgucacugacccuuggagccaggcgggcaccaaacacugauggcaccuauugag

SEQ ID NO: 18737 - RNA, 64 nt, Human
ucauuaagguuaugcacugccugccauguaguuggggcaccauacauuauuucuucccagaauc

SEQ ID NO: 18738 - RNA, 64 nt, Human
cagaaacacugucggcucuggcugcggagaagcugggcaccauggcuggccucucaggaccacu

SEQ ID NO: 18739 - RNA, 64 nt, Human
cugacucuccuucaacauccucacccccaccccugggcaccauuuaggacaagacuuccuuauu

SEQ ID NO: 18740 - RNA, 64 nt, Human
ggaaaauggacaaaagugccuugacguggagggugggcaccagauggggaccagccuugccaac

SEQ ID NO: 18741 - RNA, 64 nt, Human
cagucugccacccuugccccuugccuccuuggucgggcaccauaccuccuccccuccaccccac

SEQ ID NO: 18742 - RNA, 64 nt, Human
agagcagccccgaagcccgcucaaugcucucgaugggcaccaggaagcgcuccagugggauggc

SEQ ID NO: 18743 - RNA, 64 nt, Human
agguggccuggggagggcagaggcaagguuaccagggcaccaugcaagcggaugucggcacugg

SEQ ID NO: 18744 - RNA, 64 nt, Human
ccaccucaccgggcaaauggggucggggggacuggggcaccagaccaggcaccaccuggacacu

SEQ ID NO: 18745 - RNA, 64 nt, Human
cuuuuuugggcagucagguccacaccuauguccagggcaccagggaugcaauuccauguggaug

SEQ ID NO: 18746 - RNA, 64 nt, Human
aaggaagacccggcuuugcccucacaagucuuaugggcaccacagggaacauccuggacuuaaa

SEQ ID NO: 18747 - RNA, 64 nt, Human
gaauugagaauuaacuauacuacuagccauuuuagggcaccaaaacuugggauuaaacacuucc

SEQ ID NO: 18748 - RNA, 64 nt, Human
uggggcagcugcugaccaaaccccacagaacagagggcaccaggcaucacacgacaucuuuccc

SEQ ID NO: 18749 - RNA, 64 nt, Human
ggccuggcccucugaggguccccagggaggaaacgggcaccacccgcuuucuugcugguuguca

SEQ ID NO: 18750 - RNA, 64 nt, Human
gauacuggaggcaguugcauaggucucccucucugggcaccaggacucaguccagcccaagacu

SEQ ID NO: 18751 - RNA, 64 nt, Human
ugaaggaaaaggccaacuaggguguuagcccucugggcaccaaggaaacuaacagcuuucucaa

SEQ ID NO: 18752 - RNA, 64 nt, Human
gagaacaaugaagcuccaggcucucucuucuccagggcaccaagaggcugggcuuaguuuuggg

SEQ ID NO: 18753 - RNA, 64 nt, Human
agauccagccaaagagcugcccccagggguaugagggcaccagcuggguucuccagggagcagg

SEQ ID NO: 18754 - RNA, 64 nt, Human
ccugcgcgagggagcagguucuccgcauucccaugggcaccaccugccugccugucgugccuug

SEQ ID NO: 18755 - RNA, 64 nt, Human
agucccaacucagaggaaaagggccagugccaaggggcaccaagaaccugcucaggaagccuuu

SEQ ID NO: 18756 - RNA, 64 nt, Human
acauucaccgcagcugccagccaggggucugggugggcaccacccugacccacagcgucacccc

SEQ ID NO: 18757 - RNA, 64 nt, Human
gacaccuuccuuuccacuggcugucaagcccacagggcaccagugccacccagggcccggcaca

SEQ ID NO: 18758 - RNA, 64 nt, Human
aggcggaggcggaaggcccaccgugccagaggcugggcaccagccuuaacccucacucugcuag

SEQ ID NO: 18759 - RNA, 64 nt, Human
cuaccagcgccgcauguagggccauccugggauggggcaccacagggagggagggagaaaagag

SEQ ID NO: 18760 - RNA, 64 nt, Human
ccccagaccuccugugacaccacgccagaucacagggcaccaggccagagauagucuucuuuuu

SEQ ID NO: 18761 - RNA, 64 nt, Human
agggaagggguuggcugagucaagggaccccagagggcaccaggaauaaaaucuucuugaacag

SEQ ID NO: 18762 - RNA, 64 nt, Human
cauccagugacaaaccauccaguggagguuugucgggcaccagccagcguagcagggucgggaa

SEQ ID NO: 18763 - RNA, 64 nt, Human
uccugggcagccuucauauuugccauuguguccggggcaccaggagccccaccaaccccaaacc

SEQ ID NO: 18764 - RNA, 64 nt, Human
ucauaacucagcccuuugggcggccucugggcuugggcaccagcucaugccagccccagagggu

SEQ ID NO: 18765 - RNA, 64 nt, Human
ucugcccggagcagcagcuucuccaggaagcccagggcaccauccagcuccccagcccaccugc

SEQ ID NO: 18766 - RNA, 64 nt, Human
cagguggccccugggcaucagaacagccugcccugggcaccagguggcagacacacucagagca

SEQ ID NO: 18767 - RNA, 64 nt, Human
uuuggucaguauuuccuucccuauaugucacagagggcaccacugagaacugcgugcauaggac

SEQ ID NO: 18768 - RNA, 64 nt, Human
ccuccccacagcuucucgacugcaguggggcggggggcaccaacacuuggagauuuuuccggag

SEQ ID NO: 18769 - RNA, 64 nt, Human
ugaccuuugccgaccuccagcggaaccccccagggggcaccagccccccagcagacaauggccc

SEQ ID NO: 18770 - RNA, 64 nt, Human
gaaggcaacacccaggcgggcagagaagggcucagggcaccagcaaccaagccagcccccggcg

SEQ ID NO: 18771 - RNA, 64 nt, Human
agugauuaugcuauaauccaaucauguauuaauugggcaccaacuaugcacuaggcaugguauc

SEQ ID NO: 18772 - RNA, 64 nt, Human
gccauguguggcaucaucugggcuaauggccaccgggcaccaucggacucccaccuccacuguc

SEQ ID NO: 18773 - RNA, 64 nt, Human
gagaaagccaaggcacguagaguagggagaagaagggcaccauccucucuuuccuccccagggu

SEQ ID NO: 18774 - RNA, 64 nt, Human
aggcauggcuggugccugaagaccccagaugugagggcaccaccaagaauuuguggccuaccuu

SEQ ID NO: 18775 - RNA, 64 nt, Human
uaaggacagacuugaggaauaaaaaugaccuugagggcaccaaucugugagggaaguuaggaac

SEQ ID NO: 18776 - RNA, 64 nt, Human
gaugccccauuaaagugacaaaaggguggggugugggcaccauggcaugaggaagaaacaaggu

SEQ ID NO: 18777 - RNA, 64 nt, Human
gcuggcugggcaaggcgcucaggcaugcaaccaugggcaccaggcaauacccauccaucaccca

SEQ ID NO: 18778 - RNA, 64 nt, Human
cgguagggaagggugagcagauuccuauguuggugggcaccaauauuccaagggcagcucucuu

SEQ ID NO: 18779 - RNA, 64 nt, Human
gccauuugcauccuucuuccugagccaacugcuugggcaccaccacagcgucuucuauagcucg

SEQ ID NO: 18780 - RNA, 64 nt, Human
auuccaaaaggucauuguuucucacuagaccccagggcaccagaugaauuuccaaguuuaaacu

SEQ ID NO: 18781 - RNA, 64 nt, Human
cgaagaugaauaaagagaaucuggaccacuacccgggcaccagggaccacagcacugguuugga

SEQ ID NO: 18782 - RNA, 64 nt, Human
gggcaccucaguagcggagcaucuccacgaaacggggcaccacaggaucccugugcaagggcug

SEQ ID NO: 18783 - RNA, 64 nt, Human
cucuucuuuacauuuucuacagcauucuguaugagggcaccaaauaaauccaucuagcugguag

SEQ ID NO: 18784 - RNA, 64 nt, Human
uauaaaguggagggagggagccguccggucaguagggcaccaaucccaccuccuucauuaccuc

SEQ ID NO: 18785 - RNA, 55 nt, Human
uggaggugacugugcagugaggagggggcaccaugcagagauggcaguugcuucc

SEQ ID NO: 18786 - RNA, 64 nt, Human
uugugucucugcaaugcugugggcacaaaagaaggggcaccagagucccugugcaaacaccuag

SEQ ID NO: 18787 - RNA, 64 nt, Human
uagaugagaucuggcauaugcacccgcaauagaagggcaccacuuggaugaccacaggcacuua

SEQ ID NO: 18788 - RNA, 64 nt, Human
ugcacuggcccucuuugaaagggcuuuacagugggggcaccaagaccccaaagggcccaggcca

SEQ ID NO: 18789 - RNA, 64 nt, Human
cugucccccuucccccucgacccccgcaaugagugggcaccaggggacgcucuggcgagggcag

SEQ ID NO: 18790 - RNA, 64 nt, Human
gcuggaagcagaaagaagaaaggccaauuucacagggcaccaaacaaguaugaaauguaaauca

SEQ ID NO: 18791 - RNA, 64 nt, Human
ugacacucaagauacuugccagucucuccagugugggcaccagccggccagaacagaugcgagc

SEQ ID NO: 18792 - RNA, 64 nt, Human
cagaauucauaaucaaaccuaaccuuuuuguuuggggcaccaaaucugaagacaaaauuaauuu

SEQ ID NO: 18793 - RNA, 64 nt, Human
caaaaugaaauuccauauaugugcaaacagauaugggcaccacgaaauacauaugcagugccuu

SEQ ID NO: 18794 - RNA, 64 nt, Human
cucuucacgauugauagcaaaaucagaaacguuagggcaccagugaguugaaaaaacuggucuu

SEQ ID NO: 18795 - RNA, 64 nt, Human
gucccuacccuaggcaugagguauauuuuauucugggcaccacacauuugccccauagauaaca

SEQ ID NO: 18796 - RNA, 64 nt, Human
gagcaguggcaaccccuuuuggccagggccaggggggcaccagcaaggggccacccuuucccuu

SEQ ID NO: 18797 - RNA, 62 nt, Human
ccaccacccccaucuacugaauagccaggggagggcaccaaugaacagcacaguaugggaga

SEQ ID NO: 18798 - RNA, 64 nt, Human
agggcagugucuccaugaggguuuuccuguugaggggcaccacauacaauagugugaaguaggu

SEQ ID NO: 18799 - RNA, 64 nt, Human
aaagcuauagagacaggugcauucagaacauccugggcaccagucaugagucuuacugugucaa

SEQ ID NO: 18800 - RNA, 64 nt, Human
uuugaugacaucaccagccuacugcagaagugcagggcaccaguaaacaccauguauuauugaa

SEQ ID NO: 18801 - RNA, 64 nt, Human
gggggguugcagcugaggcuggcugguggauugugggcaccaggcucccuggcacggccuaacu

SEQ ID NO: 18802 - RNA, 64 nt, Human
accucacaggaacuguucaguucccacccucagugggcaccacacaccccacuuccagcagagu

SEQ ID NO: 18803 - RNA, 64 nt, Human
uauccagaacuaucacuucagauguuucuauuuugggcaccauaacuauuugagcucauauuuu

SEQ ID NO: 18804 - RNA, 64 nt, Human
acuuuuccccagcaucacaaacagccauuuccucgggcaccaaaguagguucccuuuguuggaa

SEQ ID NO: 18805 - RNA, 64 nt, Human
acgaagcaaaccugggauugcuucuuccagguaugggcaccagagagggaagccacugcaacau

SEQ ID NO: 18806 - RNA, 64 nt, Human
auucaguagcugaauccgcccagugauagccugugggcaccagcagcaagggcugccaugggau

SEQ ID NO: 18807 - RNA, 64 nt, Human
ccucaccugccgcucaggccucagaggcccugccgggcaccagggcuugugccaucgccccaag

SEQ ID NO: 18808 - RNA, 64 nt, Human
caggcccagcacuguggcuggacugccgcgccacgggcaccaggaccccuaagaccaagugaca

SEQ ID NO: 18809 - RNA, 64 nt, Human
cuuaggccccggccuggacugggaaauggggguagggcaccaggagagaaauccuccuggguac

SEQ ID NO: 18810 - RNA, 64 nt, Human
uuaguuuugucaaugguagugacuuacugaacaugggcaccaacuaauuuuguuguuguucuac

SEQ ID NO: 18811 - RNA, 64 nt, Human
agcuucccuuugccugcugauauucugcaggacugggcaccaugggccaaaauuuuguguccag

SEQ ID NO: 18812 - RNA, 64 nt, Human
gauaaauagaaucagagauuuuauuacucauuuggggcaccauuucaguguaaaagcaguccua

SEQ ID NO: 18813 - RNA, 64 nt, Human
gauagcaggguaggacgcccaggccuucucacaugggcaccaugaaacacuuucuuccaggcca

SEQ ID NO: 18814 - RNA, 64 nt, Human
gcccuaggugagggugggcugcccucuucacauggggcaccaggaacaccgucuggaacaggaa

SEQ ID NO: 18815 - RNA, 64 nt, Human
cuucccguccccaaagugucagcaacuuugaggagggcaccaggaaacaaagaugccuccccag

SEQ ID NO: 18816 - RNA, 64 nt, Human
cugccagcacugggguggcagccugccacaucgggggcaccacccuccaugccuuugcagguaa

SEQ ID NO: 18817 - RNA, 64 nt, Human
cugggugcaggcgggcgccaggcccgcugugggugggcaccaguucucagcaccgcucacugcu

SEQ ID NO: 18818 - RNA, 64 nt, Human
ugcuucccaagguggucccacggaggguguuacugggcaccaguggacucgccccauggcccgu

SEQ ID NO: 18819 - RNA, 64 nt, Human
ggccugagcugcccaucugccuagccggccacuagggcaccaucuucucaagggcuuccauguc

SEQ ID NO: 18820 - RNA, 64 nt, Human
aaaugccaagaaaagggcugacauuuucuuucaugggcaccaaccugcauuuguaugugucccg

SEQ ID NO: 18821 - RNA, 64 nt, Human
gaggacauggggagguuguggggccucaggcuccgggcaccaggggccaaccucaggcuccuaa

SEQ ID NO: 18822 - RNA, 64 nt, Human
caagguuccucccucuccugcagaguaggcaucugggcaccaagaccuucccucaacagaggac

SEQ ID NO: 18823 - RNA, 64 nt, Human
cagccgcccagaucaugccgccgcagcugguugggggcaccaucuggacggggaugguucccca

SEQ ID NO: 18824 - RNA, 64 nt, Human
agucagaccuccgcccccagccagagcaagcuuggggcaccaugcccaggagggaagaagccau

SEQ ID NO: 18825 - RNA, 64 nt, Human
ugaauucuuaggguguguacguacgcagccuccagggcaccauacuguuuccagcagccaaccc

SEQ ID NO: 18826 - RNA, 64 nt, Human
ugugacacgagucaaguggcucacaaccuccucagggcaccagaggacucacucacugguugcu

SEQ ID NO: 18827 - RNA, 64 nt, Human
acggccuggguguggcuggaaugguggcaggagugggcaccagugcggccccgguggccauggg

SEQ ID NO: 18828 - RNA, 64 nt, Human
uccaggcaggcgaggauaacuugagaguuuccuagggcaccagggacagagcucagaggccccc

SEQ ID NO: 18829 - RNA, 64 nt, Human
cgcacaggcucuggcagccgucucaggcaggacugggcaccaagcuugcagccgaaggccuugc

SEQ ID NO: 18830 - RNA, 64 nt, Human
ugacaucccauaaauguguguguggugugacuacgggcaccacaaacuccgcagccuugccucu

SEQ ID NO: 18831 - RNA, 64 nt, Human
cccagcucaguuuuauuagaucaaagcuguuguugggcaccagguuggccaccucaaucaccag

SEQ ID NO: 18832 - RNA, 64 nt, Human
acuucugcccucaccggacucugggcugugacuggggcaccaaacucagcacaugagucucccc

SEQ ID NO: 18833 - RNA, 64 nt, Human
ggaggccucugggccuccucuaacaggggcuggugggcaccaagagccaauggaguagaccccu

SEQ ID NO: 18834 - RNA, 64 nt, Human
uggagcacaaaagccucucaucccccauuaaccagggcaccaagcccacagguguccccagccc

SEQ ID NO: 18835 - RNA, 64 nt, Human
agcugugccucucugccuguugguugugaucugugggcaccagcucauucgugucacccugucu

SEQ ID NO: 18836 - RNA, 64 nt, Human
uguagugauuuucuggcugucacucauacucacugggcaccagccuugcccucuuagccuccau

SEQ ID NO: 18837 - RNA, 64 nt, Human
guuggggaucagagggcuggcgggaacgcgagaagggcaccagcagcauuccacacccagcucu

SEQ ID NO: 18838 - RNA, 50 nt, Human
gcuggcuggggcccaggugagggcaccauucuguucagggugggguacac

SEQ ID NO: 18839 - RNA, 64 nt, Human
cuccacagaagacguuggcaugugaggccagggugggcaccaaagaccaggcccagagccaggg

SEQ ID NO: 18840 - RNA, 64 nt, Human
cccacauacacaguugccauuuuucucucuaacugggcaccagugaacaugcgggcaugaggag

SEQ ID NO: 18841 - RNA, 64 nt, Human
cacugccaugcccgaacacuauccaugcuauggugggcaccaucucucugaugacaguucugug

SEQ ID NO: 18842 - RNA, 64 nt, Human
ggucccaauucggggccugcuggaguuccggccugggcaccagcauuuggcagcacgcaggcgg

SEQ ID NO: 18843 - RNA, 64 nt, Human
uagcagggccccuucccacucagcccgcggcugugggcaccacagcucuuguggggcagcccac

SEQ ID NO: 18844 - RNA, 64 nt, Human
uccucccgacuugacucaccgucaccuggaagcagggcaccagcugcuggggugggacuugggu

SEQ ID NO: 18845 - RNA, 64 nt, Human
cuggauggguggagaggcugagggacucacuggagggcaccaagccagcccacagccagggaag

SEQ ID NO: 18846 - RNA, 64 nt, Human
ccgagguuguguccagggugaugaguguggacgggggcaccagucaguucucccuugaaguaaa

SEQ ID NO: 18847 - RNA, 64 nt, Human
ccacccguggggugcugcccuuaugcccggcgccgggcaccaacuccauguuugguguuugucu

SEQ ID NO: 18848 - RNA, 64 nt, Human
gcacaaggucugcggaaaguucugguugucggccgggcaccacggcucacaccuauaaucgagc

SEQ ID NO: 18849 - RNA, 64 nt, Human
cacagccgccgcgcgacaguggagccaaggguuagggcaccaggaggggccagguggcgucggc

SEQ ID NO: 18850 - RNA, 64 nt, Human
gaaagcccauguagggcaggccuucuauaagugcgggcaccaagggcgccuacauccccaggcc

SEQ ID NO: 18851 - RNA, 64 nt, Human
aaaaaaaaaaaagaaaagaaaaaacacugcauuugggcaccaucucagcucccuugcauccagg

SEQ ID NO: 18852 - RNA, 64 nt, Human
uagcaacaaucaucagagugacgcugaugguuuggggcaccagcuauacaucagccccagugcc

SEQ ID NO: 18853 - RNA, 64 nt, Human
cugggcuauuggcuggagccaggacaugagucaggggcaccauggaccucacgugccagggaga

SEQ ID NO: 18854 - RNA, 64 nt, Human
cuaauccugugugccagggcaggcagugccccaggggcaccacgccugacucuccaucacccag

SEQ ID NO: 18855 - RNA, 64 nt, Human
gagacuuccuaugugugcauugggguggggcuuggggcaccaugagaagguuggcgugcccugg

SEQ ID NO: 18856 - RNA, 64 nt, Human
cagcacucccuguccccaugucccgggcuccacugggcaccaacauaaccuuguucucuguccu

SEQ ID NO: 18857 - RNA, 64 nt, Human
auggauacacaucuaucaggcacagggcggaggugggcaccacugaguugcacucagcaaacac

SEQ ID NO: 18858 - RNA, 64 nt, Human
ccucugcuugggggacucagggcuccauucuggagggcaccacggugacccgggccaucucagu

SEQ ID NO: 18859 - RNA, 64 nt, Human
acuccuccuuguuagugucuuuccuugaaggggcgggcaccaggcuagguccggugccaauaaa

SEQ ID NO: 18860 - RNA, 64 nt, Human
uggguucugucaugaagggaguagcaccuuuugugggcaccaccuuuaugugccucagagggga

SEQ ID NO: 18861 - RNA, 64 nt, Human
cuucaggggcuccuguccugggccagggccugaugggcaccacgugaggggcacuugguggaca

SEQ ID NO: 18862 - RNA, 64 nt, Human
gggccccacaggagaagcggccagggcccgcggggggcaccaccuguggacagcccuccugucc

SEQ ID NO: 18863 - RNA, 64 nt, Human
accaaggugaaauuaaaauugcuaaugaaguuuugggcaccauugucauugauaacaucuuauc

SEQ ID NO: 18864 - RNA, 64 nt, Human
cggugaccgcacgcggcagcaccucugagccggagggcaccagggacucggcccagggccguca

SEQ ID NO: 18865 - RNA, 64 nt, Human
aguccccggcaggcggccuucacucagggucagcgggcaccagguugcucuggaagagcuugag

SEQ ID NO: 18866 - RNA, 64 nt, Human
cagagggccagggcaucaagaacccagugaacaagggcaccaccacaguggacggcgcuggcuu

SEQ ID NO: 18867 - RNA, 64 nt, Human
guugaaucugcacauauggagggcuggcuauaaagggcaccacaaggaagaagccaaacagauc

SEQ ID NO: 18868 - RNA, 64 nt, Human
gcggggccugcugggacuuguaguugccuagacagggcaccacccugcacuuccggacccgccg

SEQ ID NO: 18869 - RNA, 64 nt, Human
uauuaauggagaucauuccauuacacuccagccugggcaccaggaacgaaacucguucucaaaa

SEQ ID NO: 18870 - RNA, 64 nt, Human
ggaccacacuccagggugcauucguugcucccuggggcaccacuucuggauuacagugugccag

SEQ ID NO: 18871 - RNA, 64 nt, Human
ucagcaguaauaaucacuuguguucugaaagaaagggcaccagaaguucuagcaaaauucaguu

SEQ ID NO: 18872 - RNA, 64 nt, Human
aaugagaaaucgcauuuggauccaggccccaggugggcaccaucagcagucuugcuuccaugca

SEQ ID NO: 18873 - RNA, 64 nt, Human
gugggcugggcaggcaugugccccccuagucagagggcaccaacccaccuacucugccccuggg

SEQ ID NO: 18874 - RNA, 64 nt, Human
acaggacagacacguugagaagcugcagggagcagggcaccaagggagugugcacugugcuugc

SEQ ID NO: 18875 - RNA, 64 nt, Human
ucuaagucucaccuggggaauucggucccaccuggggcaccaguucccaccuagagcacugugu

SEQ ID NO: 18876 - RNA, 64 nt, Human
ccgugccccaggcccucucagccgcagcacccgcgggcaccacuuucgugcaguaccaggcgcc

SEQ ID NO: 18877 - RNA, 64 nt, Human
gccggcucgcgggccaggauccucucggugggaugggcaccacagacaggaggccccucaggcc

SEQ ID NO: 18878 - RNA, 64 nt, Human
cuucuguauacauccagauggaucccaggcauccgggcaccacccuggugugucccuagaauuc

SEQ ID NO: 18879 - RNA, 64 nt, Human
acaaauggaucgggcugcagaggguuagaagcgagggcaccagcaguuguggguggggagcaag

SEQ ID NO: 18880 - RNA, 64 nt, Human
ucagcgagcccuccuggcgcccgguccucccugugggcaccagcccucuugguagcuggugugg

SEQ ID NO: 18881 - RNA, 64 nt, Human
ggggguccccaggguaugggguaggggugggggugggcaccagcucaggggcuuccauuugcaa

SEQ ID NO: 18882 - RNA, 64 nt, Human
ugggacaaggauguggcaaggcuuggaugagauggggcaccagugcccaggaauuugaacauuu

SEQ ID NO: 18883 - RNA, 64 nt, Human
accacacuggcccccugcggcggaggccaacgcagggcaccaccaccaccaacuugaauuccgu

SEQ ID NO: 18884 - RNA, 64 nt, Human
caucuagaguaguggccaucagcacccgccuaacgggcaccaugccaagcacuuucaucauuau

SEQ ID NO: 18885 - RNA, 64 nt, Human
aaacacaugccuagugggggaaggcucacuaagagggcaccaaguggggcaaauaccccuggua

SEQ ID NO: 18886 - RNA, 64 nt, Human
caggcuagagacccauggccaucuuuguggcugugggcaccaggcaugggacugagcccauguc

SEQ ID NO: 18887 - RNA, 64 nt, Human
cccugaucuacggaggccugcucccggaccgugcgggcaccagugcagugcugccuugguuccu

SEQ ID NO: 18888 - RNA, 64 nt, Human
cuuggcuggaccgggacccauggcaagagcaccugggcaccaguguuuagcccuggucugcagg

SEQ ID NO: 18889 - RNA, 64 nt, Human
ggcuuucccgggucuccagccccaguccagaguugggcaccacaccggccagcaucuuccgcac

SEQ ID NO: 18890 - RNA, 64 nt, Human
aacaaacccuuggcccagccugggcuggugaccugggcaccagagaccuugcaucccuccucau

SEQ ID NO: 18891 - RNA, 64 nt, Human
cuugcccuccauccuuccucuguuccuucuggccgggcaccacagcacuggggcucaccucuug

SEQ ID NO: 18892 - RNA, 64 nt, Human
gcaggggucagacagacaaggauggggacugccagggcaccacuucaucaugaaugcugguuuu

SEQ ID NO: 18893 - RNA, 64 nt, Human
aagaguagcuuggagaggacccucaggccucugagggcaccaggcccuggagaagaggugcaau

SEQ ID NO: 18894 - RNA, 64 nt, Human
uacuuccccugccacccugcacaccuccaagucagggcaccacaacacgccaccgggagagaug

SEQ ID NO: 18895 - RNA, 64 nt, Human
ugggggaaugcggagaaaagggaggcuugaccccgggcaccaugggccacuccaggaugggaca

SEQ ID NO: 18896 - RNA, 64 nt, Human
agugggcugugauugugccacugcacuccagccugggcaccaaugugagaaccugucuuggaaa

SEQ ID NO: 18897 - RNA, 64 nt, Human
uccugauggcagaacccacccgaucccugggguagggcaccacccccuccuggggugagagcgc

SEQ ID NO: 18898 - RNA, 64 nt, Human
uccuggagccagugaccucaguuucagcuuuccugggcaccagccuggaccuugcccauggcua

SEQ ID NO: 18899 - RNA, 64 nt, Human
cugaguucccacucaccuguguagagugccaucugggcaccauugcuccagacguguuccgacc

SEQ ID NO: 18900 - RNA, 64 nt, Human
gcuccuguugucauggcagacagccgccuugggugggcaccacccuggcaguuccagccuguag

SEQ ID NO: 18901 - RNA, 64 nt, Human
gggccaugcagaggaaggacagagggugggcgcagggcaccaacucagggacauccccucuccu

SEQ ID NO: 18902 - RNA, 64 nt, Human
acagcuagagaacucuuugggaucccuuuuauaagggcaccaaucccauucaugaguucuccac

SEQ ID NO: 18903 - RNA, 64 nt, Human
uuguggaucucccccugcccauugccugcuugaggggcaccacuacuccagcccagaaggaaag

SEQ ID NO: 18904 - RNA, 64 nt, Human
ggcuggucccaggguggcaccacccaggcccccugggcaccaagggagcgagggggaauaagag

SEQ ID NO: 18905 - RNA, 64 nt, Human
cgugugccuuucccgggcccucagcccucgggccgggcaccacccccaguccccccaguaaaag

SEQ ID NO: 18906 - RNA, 64 nt, Human
ugucucuacaaaaaguuuuuuuaaaaaauuaacugggcaccaugacacacaccaguagucccag

SEQ ID NO: 18907 - RNA, 64 nt, Human
gcaaccguugucaaggcuaugcucacgggaggcugggcaccacaguguuuccaagagcaagcug

SEQ ID NO: 18908 - RNA, 64 nt, Human
ggcugccccgcuuugcggacgggcuguccccgcgcgaacggaacguuggacuuuucguuaacau

SEQ ID NO: 18909 - RNA, 64 nt, Human
ccccuuggccgccaguuccguucuccucacgggccgaacggaacaagggguccagcuugcgggg

SEQ ID NO: 18910 - RNA, 64 nt, Human
acacuuuugugauuuuagggauagagucagcugccgaacggagaucagaauagacuucagaaag

SEQ ID NO: 18911 - RNA, 64 nt, Human
gugcccccccggcagcucccggcacugcccccgacgaacggaaacucuucugugaaauagcaau

SEQ ID NO: 18912 - RNA, 64 nt, Human
ucuaggucccacccgcucccacuauggugggagacgaacggaaggguuggugggcuggcccagc

SEQ ID NO: 18913 - RNA, 64 nt, Human
ggauaagaucgcccuggugacgaggagcggaucucgaacggaacuuaauaaagguugccuagau

SEQ ID NO: 18914 - RNA, 64 nt, Human
caugaagugggugccccacucacuucucugagaucgaacggacugugaauccgcucuuugucgg

SEQ ID NO: 18915 - RNA, 64 nt, Human
gauuuuaaaucauuaaaaacacaaaaacuaagugcgaacggaacagaguuuucucaaccuuugc

SEQ ID NO: 18916 - RNA, 60 nt, Human
ugguggaaagugagaauuaaagucccucgccgcuuggaaagugcagccuucuacagguag

SEQ ID NO: 18917 - RNA, 64 nt, Human
aguguucuugcucugacagaauauuaaucuuguacgcuuggauugaguuauuuaauuuuuuuuu

SEQ ID NO: 18918 - RNA, 64 nt, Human
ugugugacagccccuucugauuuggcccccugcccgcuuggagccucccagcaccagacagggc

SEQ ID NO: 18919 - RNA, 64 nt, Human
ucccuggaaugaguugaggccacuguguuccuuccgcuuggagcuauuuuccaggcuucugcug

SEQ ID NO: 18920 - RNA, 64 nt, Human
acauucucuccucagguauggcccaucuccuguacgcuuggagcgaccuuuggcuacguggcug

SEQ ID NO: 18921 - RNA, 64 nt, Human
ggguggggaccuugcagcccccauccucuccgugcgcuuggagccucuuuuugcaaauaaaguu

SEQ ID NO: 18922 - RNA, 62 nt, Human
aggagugagacccagccgggucaauaaaccuggacgcuuggacccugccugcgagucugccg

SEQ ID NO: 18923 - RNA, 64 nt, Human
guucauugcacacacccaaggagaagagcucaagcgcuuggaagaggaugcuuugcugcugcug

SEQ ID NO: 18924 - RNA, 64 nt, Human
ccuuauccccacugcuguggagguuucuguaccucgcuuggaugccuguaaggaucccgggagc

SEQ ID NO: 18925 - RNA, 64 nt, Human
ucucacagccugaaacaagcucacccguagcuuacgcuuggaagcaggacugggaacauccacg

SEQ ID NO: 18926 - RNA, 64 nt, Human
aaaacauuaagacgcaacucauuuuauaucaacacgcuuggaggaaagggacucagggaaggga

SEQ ID NO: 18927 - RNA, 64 nt, Human
caagauuucccuuuauguauauauuuuaacaauccgcuuggacacgaacaaagccacacuucua

SEQ ID NO: 18928 - RNA, 64 nt, Human
cauaguaugaaauuauacccugcaugcugacccucgcuuggaauggaaugccagaaaugcaugg

SEQ ID NO: 18929 - RNA, 64 nt, Human
acaauugugacucagcugaauuuucauccgaggacgcuuggaccccgcucuuggcucugcagcc

SEQ ID NO: 18930 - RNA, 64 nt, Human
agcaguggagauaaauguccuagagucaccaggucgcuuggagaagucauuuaagcugccucgg

SEQ ID NO: 18931 - RNA, 64 nt, Human
caacuaauucaauaaaacugucuugugagcugaucgcuuggaggguccucuuuuuauguugagu

SEQ ID NO: 18932 - RNA, 64 nt, Human
ggacacacuggcacugcaguagggaagcuguugacgcuuggaggacuugggauuuggugguuug

SEQ ID NO: 18933 - RNA, 64 nt, Human
auaaauaaaaaaaaaugcagcugcaggagugaggcgcuuggagguaccuugacccaaagagcag

SEQ ID NO: 18934 - RNA, 64 nt, Human
agaccacggggccacuguggggugagggaaggagcgcuuggagucagagcucuagaccuugguc

SEQ ID NO: 18935 - RNA, 64 nt, Human
guuauuagagauuaccuccugagaaaaaagguuccgcuuggagcagaggggcugaauagcagaa

SEQ ID NO: 18936 - RNA, 64 nt, Human
ugagauuucugacuagcagugacuuuucuagggccgcuuggaaaaguugauaaguauccuuuuc

SEQ ID NO: 18937 - RNA, 64 nt, Human
ugcuccaagaagagcccuguuggugcuuuaccaccgcuuggagucucccgaggacacaaacagg

SEQ ID NO: 18938 - RNA, 64 nt, Human
uucugagcccugggacucggagcacugaccccugcgcuuggauugcuagacuccucuuccuccu

SEQ ID NO: 18939 - RNA, 64 nt, Human
cucauauuauaaauuucuaaauccuaggaagaaacgcuuggagugcuucugaauauacagaagu

SEQ ID NO: 18940 - RNA, 64 nt, Human
auuagcuggugcugaacuuucucucauaggacgucgcuuggauuucaaauccacggucaccugc

SEQ ID NO: 18941 - RNA, 64 nt, Human
gaaggggagguccccagcgguacgggcuccuaggcgcuuggacaugcccgcuugugcccccuag

SEQ ID NO: 18942 - RNA, 64 nt, Human
auuuuuucagcugguuguugaauaggguuaaguccgcuuggauuagcugugccuuucauuacuu

SEQ ID NO: 18943 - RNA, 64 nt, Human
acaacaaacuacuagaagucucccugaguccacucgcuuggauuucugacacaguuuacaaaaa

SEQ ID NO: 18944 - RNA, 64 nt, Human
ugaggcgccgcccguccugggcccggccaggccccgcuuggaggaggcaucgucggcauuuucg

SEQ ID NO: 18945 - RNA, 64 nt, Human
gagcuuggaguacguguggucaccaggacugagucgcuuggaacagcagagccugcuccuugcg

SEQ ID NO: 18946 - RNA, 64 nt, Human
gcaaaaacuagagagagagagaauggaacgcgaacgcuuggaaagggaacgcauucguauugaa

SEQ ID NO: 18947 - RNA, 64 nt, Human
aauugggcagggagagggcggaagggcuggcgaucgcuuggagucauuaacgugaucccagcug

SEQ ID NO: 18948 - RNA, 64 nt, Human
cccaggugggcgggcuucuggccccaccccacagcgcuuggagcaucccuuuggacgggcugcu

SEQ ID NO: 18949 - RNA, 64 nt, Human
ccuuauucuaagauuucauaaggcugaguuugcacgcuuggacuucaguucugcuagcauguaa

SEQ ID NO: 18950 - RNA, 64 nt, Human
ccggaggacugagcccccaccggaacugggcuggcgcuuggaucuggggugggaguaacagggc

SEQ ID NO: 18951 - RNA, 64 nt, Human
cagcugccugacugccucagcagggaccgcaugccgcuuggagaagggguggccucgccggagc

SEQ ID NO: 18952 - RNA, 64 nt, Human
aaccugaucacggggcagggcugggcccucugggcgcuuggacauagacacguggucccaggcc

SEQ ID NO: 18953 - RNA, 64 nt, Human
uggcuagggauguacucaugcucauaugugugcacgcuuggacacccaccuccauggacaccua

SEQ ID NO: 18954 - RNA, 64 nt, Human
cgauggggaggcagcccccgcaguggacaacccccgcuuggacacaguccgaguggaaugggaa

SEQ ID NO: 18955 - RNA, 64 nt, Human
uucucugcccugcuccagucgaguuggccugacccgcuuggaucagugaccauuugcuggcaga

SEQ ID NO: 18956 - RNA, 64 nt, Human
agagucuggggcaucuccuucuuaugccaaggggcgcuuggaguuuucauggcugccccuccag

SEQ ID NO: 18957 - RNA, 64 nt, Human
cugaacguccccugccccuuuacggacacccccucgcuuggacggcugggcacacgccucccac

SEQ ID NO: 18958 - RNA, 64 nt, Human
cuggacuauuuccugcguaaaccgggcgcucaggcgcuuggacccggcccaagauuugacuccg

SEQ ID NO: 18959 - RNA, 64 nt, Human
cgcgcccuccaccccggcccccgaacugugccuucgcuuggagacccacaaagagagugcgccc

SEQ ID NO: 18960 - RNA, 64 nt, Human
agaaaugagagucgaaugcuacaguaucugcagucgcuuggaucuggcuguugaguugacgggu

SEQ ID NO: 18961 - RNA, 64 nt, Human
gcuaucaaaucaucuaagcugaaaacaugagaugcgcuuggaaaggccuagucagaagccauuu

SEQ ID NO: 18962 - RNA, 64 nt, Human
cucagggaugggcucaggcugauggucagcugggcgcuuggaaaguguuuggcuggggccuugg

SEQ ID NO: 18963 - RNA, 64 nt, Human
uccuauuauuuuaaaacuuuccauauuuucacuacgcuuggacauuuaacuaggcauucuuuuc

SEQ ID NO: 18964 - RNA, 64 nt, Human
ugaaagugccuuggugugagaaggaggaaggggccgcuuggagagcugggcucucgcaugucau

SEQ ID NO: 18965 - RNA, 64 nt, Human
cucucuauucuaguugauaaaacuucccuuuuuugauguagaugcagauauucuauacaguucu

SEQ ID NO: 18966 - RNA, 64 nt, Human
uguaauuuuccuguuuuguauuaucugcuuugcugauguagacaagaguuaacugaguagcaug

SEQ ID NO: 18967 - RNA, 64 nt, Human
ugauaauuguauauaauaguauagucaccaucaagauguagaaaauagaaaauaggcuaggcac

SEQ ID NO: 18968 - RNA, 64 nt, Human
ggcacugaaaauauaaaaggacugguaguuuacugauguagaugugaauucuguauaaagaugu

SEQ ID NO: 18969 - RNA, 64 nt, Human
guuugaauuauuaaagguacagaggaaauguggugauguagaacuuuuccuaacacagguaucu

SEQ ID NO: 18970 - RNA, 64 nt, Human
ccuccacccugggcugcuaccgcuucuauuuaaggauguagagaguaauccauagggaccaugg

SEQ ID NO: 18971 - RNA, 64 nt, Human
uuuuuaaacauucaagaacugcugacguacuguggauguagaguauaaaacuugaaaaaugcag

SEQ ID NO: 18972 - RNA, 64 nt, Human
uuucuccuuuugauaaaaacuguugaauacuauugauguagagaauguguauauguguauauuu

SEQ ID NO: 18973 - RNA, 64 nt, Human
uuggacuucaugccuccucacuggugaaacccaggauguagauagagggccacacccacccugu

SEQ ID NO: 18974 - RNA, 64 nt, Human
uuauuuccaugacagggucuaaaauauggaccaugauguagacacagauuuuuaauuuuggaaa

SEQ ID NO: 18975 - RNA, 57 nt, Human
uagaaacucggucuuuguaauuuuuaggauguagagaguucuaaugaggaaucauuu

SEQ ID NO: 18976 - RNA, 64 nt, Human
uugcuuuuuuugucaguaaauuguuuuuacugaugauguagauacuuuuguaaauaaauguaaa

SEQ ID NO: 18977 - RNA, 64 nt, Human
aaaaaaagaugggguaagaaaacuacccaugcaugauguagagagcuguugauuuguuucuguu

SEQ ID NO: 18978 - RNA, 64 nt, Human
ccagaucacugccuaaucucgcuuugcugucugugauguagauggugguuccuauccugagagc

SEQ ID NO: 18979 - RNA, 64 nt, Human
gugaaaacguaacuacuguugggagugaauugaggauguagaaaggugguggaaccaaauugug

SEQ ID NO: 18980 - RNA, 64 nt, Human
uguguacuaugggguaaaagggguaggguuuaaagauguagacaguuggguuuuuuaagggccc

SEQ ID NO: 18981 - RNA, 64 nt, Human
aaugucuaguuucuagugucacugaugaacuagugauguagaaaagagacuucucuguaaguaa

SEQ ID NO: 18982 - RNA, 64 nt, Human
aaauauugaaacuaagcuacgguaccaguaauuagauguagaaucuuguuuguaggcugaauuu

SEQ ID NO: 18983 - RNA, 64 nt, Human
ucucuccucuuuauauccugagacuuugacaccagauguagauauuuaucuggagcuggaaaga

SEQ ID NO: 18984 - RNA, 59 nt, Human
gauuuuuaugcaugacuugaaauucauuugauguagaugaaccuguucacuggaaaauu

SEQ ID NO: 18985 - RNA, 64 nt, Human
ugcuuauaauaucauaugcuugaggcucacuguugauguagaguagggcaaaucugugugugua

SEQ ID NO: 18986 - RNA, 64 nt, Human
cuuaugaguauguuuacucucagaguaucuaucugauguagacaguuggugaugcuucugagac

SEQ ID NO: 18987 - RNA, 64 nt, Human
gugugaagucaacuuacuucaacaaaaaaguuuggauguagaagcagcuguaagaauucaacug

SEQ ID NO: 18988 - RNA, 64 nt, Human
acugcagcccaugacacaagaucucauuguucucgauguagagggguugguagcagacaggugg

SEQ ID NO: 18989 - RNA, 64 nt, Human
aaauuuuaugauaauaacaugauucaagaaaugugauguagauuuuugagaaugccaaaaauca

SEQ ID NO: 18990 - RNA, 64 nt, Human
uacaggaauauuuuaauaaguguaucaccaugcagauguagaagagagcgaaagugauuguguu

SEQ ID NO: 18991 - RNA, 64 nt, Human
ugagcgacagugagacucugucucaguccaugaagauguagaggagaaacuggaacucucgagc

SEQ ID NO: 18992 - RNA, 64 nt, Human
auuuagggaaagccggguggggggaggggauacagauguagaagguggguagggcuacaggggu

SEQ ID NO: 18993 - RNA, 64 nt, Human
uuaaaugaaugcugcacagguccagauguguguugauguagacuugaaaugucuccacauuuug

SEQ ID NO: 18994 - RNA, 64 nt, Human
agcuggcuauuauagaaaauuuagaccauacagagauguagaaagaacauaaauuguccccauu

SEQ ID NO: 18995 - RNA, 64 nt, Human
uaauguuccuuagugguagaggugugugccuagugauguagaaagauacacugacuuggugcaa

SEQ ID NO: 18996 - RNA, 64 nt, Human
uaagucacauaggaaacuugaaaggucugaggaugauguagauuacugaaaaaugcaaauugca

SEQ ID NO: 18997 - RNA, 64 nt, Human
ucagaguucugaagggggccagauguugggugcagauguagaagcagccagucacagacccauu

SEQ ID NO: 18998 - RNA, 64 nt, Human
uuacaauuuaaucuuuacaauuaaaagggcgaaagauguagaauuuuaguuuuuguuguugacu

SEQ ID NO: 18999 - RNA, 64 nt, Human
cugucuccagcucccagcccuguggauccccguggauguagacauugccccacuguaagcugug

SEQ ID NO: 19000 - RNA, 64 nt, Human
agagagggacagaaggggcgguucagccaagacagauguagacggaguuggagcuggguauugu

SEQ ID NO: 19001 - RNA, 64 nt, Human
guagcuguuucaguaaaaguuaguucaaacuaaugauguagaaugcuuugaccaaaugagcugg

SEQ ID NO: 19002 - RNA, 64 nt, Human
acaaccacucauucaaaaguugaaauuaaccauagauguagauaaacucagaaauuuaauucau

SEQ ID NO: 19003 - RNA, 64 nt, Human
ucgugcauguuguguauuauauaacuaaggaauagauguagaaugugcuauuucugguugagaa

SEQ ID NO: 19004 - RNA, 64 nt, Human
aggcaguguggucccuacccugugugaaugugaggauguagacauccaucagugcaacucgagc

SEQ ID NO: 19005 - RNA, 64 nt, Human
aaugugcucuuuccuaaaacauggcaaaugaauagauguagagaauaacaauauuacuuacaag

SEQ ID NO: 19006 - RNA, 64 nt, Human
auuuuugcuugaaucuuaacucuggaaaucaccugauguagaagaagacugugaugagcucguc

SEQ ID NO: 19007 - RNA, 64 nt, Human
ugaguuugauagucucacuggaagcagaucagcugauguagaacagagaccucggccauaaagg

SEQ ID NO: 19008 - RNA, 64 nt, Human
ccgaacaucugacuagccacaaguauguuacccagauguagaauuuucaucacuaaacaguaag

SEQ ID NO: 19009 - RNA, 64 nt, Human
aaucugguaaaacagucucuuguucuuaagaggagauguagaaaaauguguacaauguuauuau

SEQ ID NO: 19010 - RNA, 64 nt, Human
acacuuucccuauauuuuaagauaagucugcuaggauguagaaauauuuguuugugauuucuau

SEQ ID NO: 19011 - RNA, 64 nt, Human
aauaaaaagauggacaagaacgagugucggugaggauguagagaaacugguagaaauuuaaauu

SEQ ID NO: 19012 - RNA, 64 nt, Human
cucuuuuuuuuuccuuuuuuggcccaauguugaagauguagaacuuuguuuuuaaauaauguuu

SEQ ID NO: 19013 - RNA, 64 nt, Human
auuuugcagagcuuugcuuuucauuccuggacaugauguagaagaaacugaggguaguucuucg

SEQ ID NO: 19014 - RNA, 64 nt, Human
uguuguauugcagauaauguucucauuuauuuuugauguagaauuuacauugccauggguguua

SEQ ID NO: 19015 - RNA, 64 nt, Human
gggucuaaaaagauuuuggcaaaacauauuugcagauguagauuagcuggugaagaaaauuacu

SEQ ID NO: 19016 - RNA, 64 nt, Human
uuccuuuuuguauuuucuuagcagagcuccuggugauguagaguauaaaacaguuguaacaaga

SEQ ID NO: 19017 - RNA, 64 nt, Human
uuuaaaagaauuuuccuauuauaugguauccaaggauguagacacauuagaauuauaagaagac

SEQ ID NO: 19018 - RNA, 64 nt, Human
auggaccccagagauaguuuuggagccaggcauugauguagagguucaccaaacauauuuaggg

SEQ ID NO: 19019 - RNA, 64 nt, Human
ucauggacacaauuuccacaaccuuucagaugcugauguagagcuauugggaaagaacuuccaa

SEQ ID NO: 19020 - RNA, 64 nt, Human
auguugggauuaccuguuuaaaucugucuugggggauguagagauuaagucuguacaugugcgu

SEQ ID NO: 19021 - RNA, 64 nt, Human
cauguuccuguuuaugcauucacaaggugacugggauguagagaggcguuagugggcagguggc

SEQ ID NO: 19022 - RNA, 64 nt, Human
uguuaagagauguggagaugagauauaccccuuugauguagaauuauucauuugguuuguuuca

SEQ ID NO: 19023 - RNA, 64 nt, Human
cuugauugucuaggggaaguuaacucccugagaggauguagagauuuggggugguugauuagac

SEQ ID NO: 19024 - RNA, 64 nt, Human
ggugacagucugaagaccucgucaccugugaguugauguagaggagagccaccugacagcugac

SEQ ID NO: 19025 - RNA, 64 nt, Human
ccuaaaaugcagaaauguauuuuauucaaauacugauguagagaguuuuggcacugaaccuuuu

SEQ ID NO: 19026 - RNA, 64 nt, Human
ugccagagugaaguuugauuccuaugggugagaagauguagaugacuauuguucucacuaaagu

SEQ ID NO: 19027 - RNA, 64 nt, Human
gaaauucauuuauuugucuugacaauguucaaaugauguagauugucuuagaaugaauauucau

SEQ ID NO: 19028 - RNA, 64 nt, Human
guggcuucauugaauauuuaugaagauaaugucagauguagacaaaaauaacacaauaacagga

SEQ ID NO: 19029 - RNA, 64 nt, Human
uccaagauuuuauaguucuuguagauaacacagggauguagauaaguugaaacaaaaccagugu

SEQ ID NO: 19030 - RNA, 64 nt, Human
cuugcaucuaccugcuccuuggccuagucagauggauguagauacagauccgcaugugucugua

SEQ ID NO: 19031 - RNA, 64 nt, Human
ccuagcguuuuagaaauauuaauuuacuugaagagauguagaauguagcaaauuauguaaagca

SEQ ID NO: 19032 - RNA, 64 nt, Human
gucaccacugacugggcaaggcuucuugggcauggauguagaacuguuguccuuuucccacuaa

SEQ ID NO: 19033 - RNA, 64 nt, Human
acguggcauacauguauuuaaagaaaaaaaaauagauguagaguguuuuuuuuacacuuuuaac

SEQ ID NO: 19034 - RNA, 64 nt, Human
cucuauagacuuuugacaaauucuuuuucacacugauguagauaacagcuuaacauuuacauag

SEQ ID NO: 19035 - RNA, 64 nt, Human
cugauugagugagccuuuuggugagcucagcugagauguagagggagauuguaaaagguuaaau

SEQ ID NO: 19036 - RNA, 64 nt, Human
ucuaugaaauguguuugacaagccaaaauucuaggauguagaaaucuggaaaguucauuuccug

SEQ ID NO: 19037 - RNA, 64 nt, Human
acuccugauuuuguaguuaauuuauuaagucugggauguagaacuucaagaaguaagagcuaag

SEQ ID NO: 19038 - RNA, 64 nt, Human
agcucccccaucuacuauaaagaaaugucuucgagauguagaaauaaggaauauucugaaaaua

SEQ ID NO: 19039 - RNA, 64 nt, Human
aacauugauguuugaacauuuuaauuugugugaugauguagaaaauauaauuuuaguuuguaca

SEQ ID NO: 19040 - RNA, 64 nt, Human
aaauauuaucuuuguucuccuaaugcucugaaaggauguagaaacaauauuuaaccaaagaacg

SEQ ID NO: 19041 - RNA, 64 nt, Human
caguuuauaaucaguacauuggaaagcugguauugauguagaaccagugcauaacuuuuuaugg

SEQ ID NO: 19042 - RNA, 64 nt, Human
ucaacaaagugcuuuuucacugccuaaaauuuuagauguagauauuugaaauagauuuuuucau

SEQ ID NO: 19043 - RNA, 64 nt, Human
uaauuuguuaaaaugacuucauuuaacauucacugauguagauuaauaauguaaguucugauuu

SEQ ID NO: 19044 - RNA, 64 nt, Human
gugguugauacucaagccuuguacaagcacauaugauguagacauuuuuaaaugugaagcuuua

SEQ ID NO: 19045 - RNA, 64 nt, Human
cuguuucagccaggaaggccaaaaucaagagugagauguagaaaguuguaaaauagaaaaagug

SEQ ID NO: 19046 - RNA, 64 nt, Human
cagccaucgggaaggucauucagccaacccagaggauguagacccuguccucaagaagugcagg

SEQ ID NO: 19047 - RNA, 64 nt, Human
uauuagaggacagaccaaggacaacucugcaugagauguagacuuaagcuuuaucccuacuagg

SEQ ID NO: 19048 - RNA, 64 nt, Human
cuucagaguuucagucggcaauuucuuggccauggauguagaaccuacagauaaggugagccaa

SEQ ID NO: 19049 - RNA, 64 nt, Human
uaccuaagccucugguggguuaucuccucuuugagauguagaaaauggccagauuuuaauaaac

SEQ ID NO: 19050 - RNA, 64 nt, Human
cauucucagaauuguugucuucaaagcauugucagauguagagugcucagauguggcucuuaaa

SEQ ID NO: 19051 - RNA, 64 nt, Human
agacaccacuugucuuuaggugggucucaaagaugauguagaauuuccuuuaauuucucgcagu

SEQ ID NO: 19052 - RNA, 64 nt, Human
agaaauacauaaugucauauguuaaaaauaaagagauguagaaaucuaaaugaauuaucacugu

SEQ ID NO: 19053 - RNA, 64 nt, Human
uaugaagauguccuguuaaauuuacaacacuaacgauguagacucuggaaaugccuaauaaguc

SEQ ID NO: 19054 - RNA, 64 nt, Human
ucuauccguugaucuuaguggugaaaacuuaucagauguagacuuccuagaugauucuucaacg

SEQ ID NO: 19055 - RNA, 64 nt, Human
agacaagauugucaagcauuccguauuaacaguggauguagaaaauuuuuucagauggacaaaa

SEQ ID NO: 19056 - RNA, 64 nt, Human
cugucauuuucuuuucuuuugggugguggggcuugauguagauuuuacucuauguacagaauuu

SEQ ID NO: 19057 - RNA, 56 nt, Human
cggagaucggagcuuuuuaaagaacugauguagaaugagggaggggaaaguuuaaa

SEQ ID NO: 19058 - RNA, 64 nt, Human
uugucccaaccaguaguuuauuuuuugccacggagauguagaagauauuacaagcuacuggaug

SEQ ID NO: 19059 - RNA, 64 nt, Human
aucugugaucaaugaacuaugugguuuugaaucggauguagaccauuaguacuacuacuugagc

SEQ ID NO: 19060 - RNA, 64 nt, Human
gcaugcacgcuugugguugugguuuuauauuacagauguagaacaaugguuauguuucccgaca

SEQ ID NO: 19061 - RNA, 64 nt, Human
cuucuugggacccccacuaagacccuggucugaggauguagagagaacaggugggcuguauuca

SEQ ID NO: 19062 - RNA, 56 nt, Human
ggaucggggcuggaaccuagaucgccgauguagauuuguacaggagucuccguugg

SEQ ID NO: 19063 - RNA, 64 nt, Human
ccagcaaguggauucugggcaagccuguuccggugauguagacaauaauuaacacagaggacuu

SEQ ID NO: 19064 - RNA, 64 nt, Human
uguauguauaauucaaagcaccaaaauaagaaaagauguagauuuauuucaucauauuauacag

SEQ ID NO: 19065 - RNA, 64 nt, Human
uaaaagaaaggcauuggggacaaaugaaagagaugauguagauuuuucggauggguggguauau

SEQ ID NO: 19066 - RNA, 64 nt, Human
cuuuacccauguuauuuucuugguuuuuauuucagauguagauuuuguuuuugagguaaauucg

SEQ ID NO: 19067 - RNA, 64 nt, Human
aauugaaucuguacauccacaaaaauaugcaauggauguagaaaauaaaauucaagaaaagaac

SEQ ID NO: 19068 - RNA, 64 nt, Human
guaaaauuauuacuguauuguguacuggcuauaagauguagacaccuuucaguaagccaaucau

SEQ ID NO: 19069 - RNA, 64 nt, Human
caauuguguuggaaguguccuuggugccuugugugauguagacaauguuacaaggucugcaugu

SEQ ID NO: 19070 - RNA, 64 nt, Human
auagccaggcccucucucccucaagaaaugcccagauguagaaauucaucagugccuauugguc

SEQ ID NO: 19071 - RNA, 64 nt, Human
auucuauuuaagggaaguagcugagauuuagacggauguagaugcucuuugggugaauggaauc

SEQ ID NO: 19072 - RNA, 64 nt, Human
cugucagcacacauggaaagcccccauuugcacagauguagaacuuuaauaauccagaugcaau

SEQ ID NO: 19073 - RNA, 64 nt, Human
gaaaggaagguuuucaauaguguaauacugcagcgauguagauaaaaucacaaauguauaaugu

SEQ ID NO: 19074 - RNA, 64 nt, Human
auauggggauagaaaauggaauaaagauagaagggauguagaauaugcuuuccugccaacaugg

SEQ ID NO: 19075 - RNA, 64 nt, Human
uuucuguauauuguauagagcuguguauaaacuggauguagaagcacgcuggcugccucgaaug

SEQ ID NO: 19076 - RNA, 64 nt, Human
aaauugaacuugguuuuucuuucccagcaucguggauguagacugagaauggcuuugaguggca

SEQ ID NO: 19077 - RNA, 64 nt, Human
uaaaauauugucccuugcuacuugauauauuaaagauguagauuuuaaaguguuucauuuucuu

SEQ ID NO: 19078 - RNA, 64 nt, Human
gcccaugaacaaguuaguuucucauagcuuuacagauguagauauaaauauaaauauauguaua

SEQ ID NO: 19079 - RNA, 64 nt, Human
gucgaagcccaggagccuuccuuuuuaacaagcugauguagaggguggagcacuguauguggag

SEQ ID NO: 19080 - RNA, 64 nt, Human
gcucaaaaggcaaaagaagacaaaagccccccaggauguagaaaugaaggaccuugaagaugag

SEQ ID NO: 19081 - RNA, 64 nt, Human
agguuuucguuuugaauauauauguuguuauuuugauguagauacguuagcagauggagagguu

SEQ ID NO: 19082 - RNA, 64 nt, Human
auucaguccagugugaguauuuuggaguagguuggauguagauuuuguuuuuaucauugauuug

SEQ ID NO: 19083 - RNA, 64 nt, Human
uuuucucauucuugcuuuaauucagggagggggagauguagagaagugguugugaaaacaugua

SEQ ID NO: 19084 - RNA, 64 nt, Human
gaaucauuuacucuugaaaugccagucauugacugauguagauaauuuaggauuuucauauaaa

SEQ ID NO: 19085 - RNA, 64 nt, Human
auaauugaaagguggugguaguuguauucuaaaugauguagaagguuuaaaaauaauuacauua

SEQ ID NO: 19086 - RNA, 64 nt, Human
caagaggcaagaagaucuggcccucaauuagcuagauguagaugcugccuaacaguucccuccu

SEQ ID NO: 19087 - RNA, 64 nt, Human
uugcagaugagaagguuugacaaaaagacagagagauguagagacagugauagagacagaggaa

SEQ ID NO: 19088 - RNA, 64 nt, Human
gcacaggugagaguauaggugggagauuuggggggauguagaggggagggucaaagcacucgug

SEQ ID NO: 19089 - RNA, 64 nt, Human
uaauacagccaagauaugcagcauccuucucauugauguagaaaauucugcgauagaccagaaa

SEQ ID NO: 19090 - RNA, 64 nt, Human
caccaaacccugacuuuauugaaugcuaguagaagauguagaauuagagacaucugauuuguuu

SEQ ID NO: 19091 - RNA, 64 nt, Human
cuuaugaggggauauuuaggccucuugaauuuuugauguagaugggcauuuuuuuaagguagug

SEQ ID NO: 19092 - RNA, 64 nt, Human
ggaagccugaaccaauccuuccacauacuguuaagauguagacuuggaacaaagcuguugggac

SEQ ID NO: 19093 - RNA, 64 nt, Human
agaaaaacacuaguguccaauuucauuuuuaaaagauguagaaagaagaaucaagcaucaauua

SEQ ID NO: 19094 - RNA, 64 nt, Human
uucugggaauaaagcaggguuuccuacuucaggggauguagagagaugcccagguugcacagga

SEQ ID NO: 19095 - RNA, 64 nt, Human
guuugucuauuuaccuauucuuuacucagacauugauguagacuugucagauuauucugaguau

SEQ ID NO: 19096 - RNA, 64 nt, Human
ucuuccuuccucuuccucucuuaaaacuaucuuagauguagaauccugguguaggguuuuauuu

SEQ ID NO: 19097 - RNA, 64 nt, Human
uccaaagcaaacauuugguuuaaaucauuuaucugauguagauaaaagguagagaaacuuguag

SEQ ID NO: 19098 - RNA, 64 nt, Human
gcuggagcccuguuugguuccuucucuuccugcggauguagagguggggccccuuccaagaggg

SEQ ID NO: 19099 - RNA, 64 nt, Human
guagacuuuucccuacuuaccauuggguucaauugauguagacuguuagagcaaguauacucaa

SEQ ID NO: 19100 - RNA, 64 nt, Human
gauuuuuacuaauuuuguguacuuuuauugugucgauguagaaucugccuggucuaucugaugu

SEQ ID NO: 19101 - RNA, 64 nt, Human
uagaaaggaaagugugacacaguuuuuaaauuuagauguagaaaauaaugaauuaaugagauug

SEQ ID NO: 19102 - RNA, 64 nt, Human
cuuuuuaccuuuaacagacuuguuuaaucuucucgauguagauguuuauguagguacuucacau

SEQ ID NO: 19103 - RNA, 64 nt, Human
uagauuucaauuaauguucuuccuaagugauaaggauguagacuuauaagcaggacaagacuaa

SEQ ID NO: 19104 - RNA, 64 nt, Human
ggggccugaagagccuccgggcuccugggacauugauguagaguuuuuagugaagugggcaccu

SEQ ID NO: 19105 - RNA, 64 nt, Human
uaaucuuggacaagacuuuaaaucauauuuuacagauguagaagaaauuuauucaaaagugugg

SEQ ID NO: 19106 - RNA, 64 nt, Human
acuuuguucacaaacgugugauuuagauaugacugauguagaagugaacaacuugguaacaucc

SEQ ID NO: 19107 - RNA, 64 nt, Human
auggagaugaaagcuaucacacugagaauagugggauguagauagaaagcaccugaauugugcu

SEQ ID NO: 19108 - RNA, 64 nt, Human
ucauguaauugaaaauuacuggaaagcacuggaagauguagauuauguacagacauuuaaagga

SEQ ID NO: 19109 - RNA, 64 nt, Human
ccauggagcuuaaaccuccagcagucccuaggaugauguagauucuucuccaucucuccgugug

SEQ ID NO: 19110 - RNA, 64 nt, Human
ucccuuucucuaagaggccaucucuaagaugucagauguagaggagagagagcgagagaacauc

SEQ ID NO: 19111 - RNA, 64 nt, Human
augccaagaacaagccagcaaagcucuuucaccagauguagacuguagcccugcugccuucccu

SEQ ID NO: 19112 - RNA, 64 nt, Human
auuuaauuuuccugugguugaccuauacgaccaggauguagaaaacuagaaagaacugcccuuc

SEQ ID NO: 19113 - RNA, 64 nt, Human
cgccuugaggucagaggccuggcccuucuuuacagauguagauagcaggguaggacgcccaggc

SEQ ID NO: 19114 - RNA, 64 nt, Human
gaugaaacaugacagucugaguaaaauacccagugauguagaagugugccuguuuauuauguag

SEQ ID NO: 19115 - RNA, 64 nt, Human
gaucccuucuuuuccuuuuuuuguuuuuuuguaagauguagaugcuuauucuuugcuuuagaaa

SEQ ID NO: 19116 - RNA, 64 nt, Human
acaagaaaaaaggaauuccuugaaacgcccacgugauguagaucauagguaguuacucauuuua

SEQ ID NO: 19117 - RNA, 64 nt, Human
cagccuuaaguuuaggcguuuguuguucuccagugauguagacaguucccuucacaagucacag

SEQ ID NO: 19118 - RNA, 64 nt, Human
uauacauaauggcugaagccaaacuugucuugcagauguagaaauuguugcuuuguuucucuga

SEQ ID NO: 19119 - RNA, 64 nt, Human
ucuucugucgagaaguaaaggaaacuucaugaaggauguagaagcuuagcugccucagagaaga

SEQ ID NO: 19120 - RNA, 64 nt, Human
aauccgacugggcucaagaggccacuuagggaaagauguagaaagaugcuagaaaaauguucuu

SEQ ID NO: 19121 - RNA, 64 nt, Human
aaauaaauauuguccuuucauguaaauuauucuggauguagauugagcuuauuaaauguuacac

SEQ ID NO: 19122 - RNA, 64 nt, Human
ucuuucaacuggguuuucagcauaaaugggaacugauguagaaggcaggauuuagcccuucuag

SEQ ID NO: 19123 - RNA, 64 nt, Human
agacaguuaauacuaauccaucaucccucacagagauguagaggaugagauguaguaacuuaua

SEQ ID NO: 19124 - RNA, 64 nt, Human
aauucaguggacuauaauaauaguggaggguugagauguagaguuuuuaaaaagugaacaguug

SEQ ID NO: 19125 - RNA, 64 nt, Human
gauggauuagaaaaaugccuauuuuucuuguaucgauguagagacucuauuuucucccaaagac

SEQ ID NO: 19126 - RNA, 64 nt, Human
ggcuaggggagggauagcauuaggagaaauaccugauguagaugauggguugaugggugcagca

SEQ ID NO: 19127 - RNA, 64 nt, Human
ucaaugucaaagcgccaauuuauaaaacgcugcagauguagagguuaugugcaacugaucuguc

SEQ ID NO: 19128 - RNA, 64 nt, Human
aaaucugagggagcugaguaacaccaucgaucaugauguagagugugguuaugaacuuuaaagu

SEQ ID NO: 19129 - RNA, 64 nt, Human
uuacaccaccauuuggaaaacuuaccaguuuuuagauguagauguagugaaaaacuucaagaau

SEQ ID NO: 19130 - RNA, 64 nt, Human
cuaaaaagagagaugaaaaaaaaucagcgagguugauguagauaauaauuucuaugggaccaaa

SEQ ID NO: 19131 - RNA, 64 nt, Human
cauugugagcuggcucagaagacaaaccaauuaagauguagauagaaauuaauuuaaggucuuu

SEQ ID NO: 19132 - RNA, 64 nt, Human
cagcaaucgcccccuuucugcccugggggcccaggauguagauauuguacaaagguuucuaaau

SEQ ID NO: 19133 - RNA, 64 nt, Human
caucauuccuuccuuacccccuuucuagcugugugauguagaccaaagucguugccccucccug

SEQ ID NO: 19134 - RNA, 64 nt, Human
guuucucuccuuagaaaaguagguuucuuggcuugauguagacuggcuugcuuugauuuuuagu

SEQ ID NO: 19135 - RNA, 64 nt, Human
gagcgauguuuugaauuuagugagauuuaccagggauguagauuaaggugaugugauucaaaag

SEQ ID NO: 19136 - RNA, 64 nt, Human
aggagugcagucugcugguucaggcucuucaaaagauguagaaaaagagauagaaggaaccacc

SEQ ID NO: 19137 - RNA, 64 nt, Human
cuuggauuuguauaaaagaaucuuuuuuuaccuugauguagaaucaugguggaaaaaguuggaa

SEQ ID NO: 19138 - RNA, 64 nt, Human
cuccggccaagccaucauuugcuaccuggagcuggauguagaagucagcagacagcucccuauc

SEQ ID NO: 19139 - RNA, 64 nt, Human
aucaugacuguagucuuccaugcuugacaaauuggauguagacaacauuacuuaaaacuucuau

SEQ ID NO: 19140 - RNA, 64 nt, Human
uccuugucccuggaguugcgcgcuucgcggggccgauguagaacuuagggcgccuugccguggu

SEQ ID NO: 19141 - RNA, 64 nt, Human
aggaaaaacaugcuuaaggggguguaaugaaaaugauguagacauuuuaagcauuuucuacaca

SEQ ID NO: 19142 - RNA, 64 nt, Human
uucagguagcuagccaaauuaaugcauaauuucagauguagaaguaggguuugcgugugugugu

SEQ ID NO: 19143 - RNA, 64 nt, Human
uuaugguugugaagaacgagagcaagaaaaagaugauguagauguugcccuacuaccuaccauu

SEQ ID NO: 19144 - RNA, 64 nt, Human
uucauuuagauuguaaguuauggacaugauuugagauguagaagccauuuuuuauuaaauaaaa

SEQ ID NO: 19145 - RNA, 64 nt, Human
ccuguccugcaauaugaguuaaucuucucugaucgauguagauuccaggaagggguguccagga

SEQ ID NO: 19146 - RNA, 64 nt, Human
gcccacagcguggcccuagcccuccccuccccgggauguagaacggggacccucgcaggguugg

SEQ ID NO: 19147 - RNA, 64 nt, Human
ugcugagugugugugugcugggagagucagaguggauguagagcgcgguuuuauuuuuguacug

SEQ ID NO: 19148 - RNA, 64 nt, Human
aaggacaugauaugcuuacuuacuaucaguuuaugauguagaaaauauauuuuguaauuauaag

SEQ ID NO: 19149 - RNA, 64 nt, Human
ugucuuaaauuuauuuaaaacuuuuuuuaauccagauguagacuauauucuaaaaaauaaaaaa

SEQ ID NO: 19150 - RNA, 64 nt, Human
auaguaggagccuaaaacuuuguucaaugaguaagauguagauuuggagucaucagcaggggaa

SEQ ID NO: 19151 - RNA, 64 nt, Human
agaguuuuagacaaucucuagguagaggagacaagauguagacccagacagaagaaaucugcuu

SEQ ID NO: 19152 - RNA, 64 nt, Human
uuauaaacagaccuuuauuaaacacaucuugaaagauguagaagucccucuauagucuaguaua

SEQ ID NO: 19153 - RNA, 64 nt, Human
uguuuagaaacuagccuauaaaauaucaccauuggauguagauauggagagaaaagaaauaugu

SEQ ID NO: 19154 - RNA, 64 nt, Human
gaaagagcagcauaagcgggaagggcuuggucuggauguagagagggugaauaaaauugccaag

SEQ ID NO: 19155 - RNA, 64 nt, Human
cguaguguucuuugcauuucugucccauaugggugauguagagauuuaccuguuuuucaguauu

SEQ ID NO: 19156 - RNA, 64 nt, Human
caugcuugcagccaguuaccauuucuuagcuuaugauguagagcuauuaagggaguauuuucac

SEQ ID NO: 19157 - RNA, 64 nt, Human
ugaauaaugcacuuuaaaacaaggaaccguaucaggccagcaugguggcucaugccuguaaucc

SEQ ID NO: 19158 - RNA, 64 nt, Human
cauagguuggggacugugaucuugagaagccaugggccagcaauaccugcuuuucugaagcccc

SEQ ID NO: 19159 - RNA, 64 nt, Human
cucucgagcauccaaacccucacgaccugcaaggggccagcagggacguggccccacgccacac

SEQ ID NO: 19160 - RNA, 54 nt, Human
uccgaccuccugaccucugacccuggccagcacucuagcuccugaccuuugacc

SEQ ID NO: 19161 - RNA, 64 nt, Human
uucuguucucccagagcugcaccugccucgcagaggccagcaccccacucuccugccuccagug

SEQ ID NO: 19162 - RNA, 64 nt, Human
ccuucuauagaggugguguaagaguggggaacagggccagcaagacagaccaccagccagaaau

SEQ ID NO: 19163 - RNA, 64 nt, Human
uuuuuggauacuuuuuuuuucuguuugugaauaaggccagcacucaagaugggcagccaagggu

SEQ ID NO: 19164 - RNA, 64 nt, Human
cagccucauucagcauggguccuugaugccagagggccagcaggcuccuggcugugcccagcag

SEQ ID NO: 19165 - RNA, 64 nt, Human
ggaggcaguaguuaaucugggaaggcaguagaauggccagcauuccugccuguaagucuuccca

SEQ ID NO: 19166 - RNA, 64 nt, Human
aagagauaggaaugaguucuuaucuaguguugcaggccagcaaauacagaggugguuuaaucaa

SEQ ID NO: 19167 - RNA, 64 nt, Human
ccuuucccuuggcuggcuggguccagccaucuccggccagcaacccugucaguguuccacccug

SEQ ID NO: 19168 - RNA, 64 nt, Human
gagcaguccgacuaggccccaggcccgcccuccuggccagcagaguggggcacuggggggcaac

SEQ ID NO: 19169 - RNA, 64 nt, Human
gaugccuacuuuuggccucaucucugccugacaaggccagcacccaaaggguuaauauuuaacc

SEQ ID NO: 19170 - RNA, 64 nt, Human
uucugucuguuuaacagacaguccauaucugugaggccagcaaauauuuucuuaaacucauggg

SEQ ID NO: 19171 - RNA, 64 nt, Human
gucacaugacauccacaugcacauguauucuguuggccagcacguucuccagacucuagauguu

SEQ ID NO: 19172 - RNA, 64 nt, Human
ugcagggucagggcucccgcaggggccugcaucuggccagcaggacacagggaugcgcagggcg

SEQ ID NO: 19173 - RNA, 64 nt, Human
auaauuguguaucuuccagccaggaauccuacacggccagcauguauuucuacaaauaaaguuu

SEQ ID NO: 19174 - RNA, 64 nt, Human
cccuuggcaggcgauacggcagcucugugcccuuggccagcauguggaguggaggagaugcugc

SEQ ID NO: 19175 - RNA, 64 nt, Human
ucugagcccugcacgcugggccuucagaauuaauggccagcagugucagggaugagcccgucag

SEQ ID NO: 19176 - RNA, 64 nt, Human
aacugcaaauagggaggcccugggcuccuggcugggccagcagcugcaccucuccugucugugc

SEQ ID NO: 19177 - RNA, 64 nt, Human
augcguccccugccauccagcccuccccgcuugaggccagcacugagucugggacacucagcgg

SEQ ID NO: 19178 - RNA, 64 nt, Human
ugaugaccacacggggcagagagaaaccaaccaaggccagcaccuccgucggaagcauuuggca

SEQ ID NO: 19179 - RNA, 64 nt, Human
cacacgcaguagaauuuccgcagggcuguggcucggccagcagcgguuccaggagaguggcggu

SEQ ID NO: 19180 - RNA, 64 nt, Human
cacugccugguccagaagggguggugcuguccguggccagcaccccggggcccgggaggggugg

SEQ ID NO: 19181 - RNA, 64 nt, Human
ccucacacacacagcugggcaaagccacaaggcuggccagcaaggcagguuggaugggaguggg

SEQ ID NO: 19182 - RNA, 64 nt, Human
gaaccagaacaaccugcacuucugccaaggccagggccagcaggacggcaggacucuagggagg

SEQ ID NO: 19183 - RNA, 64 nt, Human
gcuccucugcuugggauucuucagacagaagcugggccagcacuguggacuccuccugggacag

SEQ ID NO: 19184 - RNA, 56 nt, Human
ucuuccccaaggggcaguaacaccagggccagcaggcagcgccuguccccucacag

SEQ ID NO: 19185 - RNA, 64 nt, Human
aaugaguguucggugaaacaagugggauuuucugggccagcaagucuuccaaacuguauaugau

SEQ ID NO: 19186 - RNA, 64 nt, Human
gacuucuugugcuuugcaccccuguguagccgauggccagcaccaggagaggagucaggccgcg

SEQ ID NO: 19187 - RNA, 64 nt, Human
aagaauuugucuguguacaacucuagauggagugggccagcaguagcugccagucuuucucccc

SEQ ID NO: 19188 - RNA, 52 nt, Human
cggaccaccucgaccagugacaggccagcagcagagggcggcggaggaaggg

SEQ ID NO: 19189 - RNA, 64 nt, Human
gcauaacuucuaaaggaagcagaauagcuccucuggccagcaucgaauauaaguaagaugcauu

SEQ ID NO: 19190 - RNA, 64 nt, Human
ccugugugucuguccagccuugcagucaugucaaggccagcaagcugaugugacucuugcccca

SEQ ID NO: 19191 - RNA, 64 nt, Human
cuggucagaaacaaagggcuggucaccugauuuaggccagcaaccagggaagcucuuagaaucc

SEQ ID NO: 19192 - RNA, 64 nt, Human
gugagucacugcuaagagacagagcacauuuucaggccagcaacuauccuugccagaguuuuuu

SEQ ID NO: 19193 - RNA, 64 nt, Human
uaucucuggccuuaacccuggcuccugaggcugcggccagcagagcccaggccagggcucuguu

SEQ ID NO: 19194 - RNA, 64 nt, Human
uggcaaggccucugccccuggccuuugaggcaaaggccagcagcagauaacaaccccggacaaa

SEQ ID NO: 19195 - RNA, 64 nt, Human
gccucccaggacaggcuggcaagggaggagggccggccagcauuugguggcccaucagucuggc

SEQ ID NO: 19196 - RNA, 64 nt, Human
aauauggcuaagcacaggucauaagagcaccuaaggccagcauauaagccaacuacaguucacc

SEQ ID NO: 19197 - RNA, 64 nt, Human
uucaggcaaagcuugaaucaggacucaaucuacaggccagcaccuuucucuuggccggaugucc

SEQ ID NO: 19198 - RNA, 64 nt, Human
cauauuaaaauugcaaacaaaaucaucuuuaaugggccagcauucucaugggguagagcagaau

SEQ ID NO: 19199 - RNA, 64 nt, Human
cuugugcgguggggaccggggccggcgggcuccaggccagcacaccuaacccauggauguggaa

SEQ ID NO: 19200 - RNA, 64 nt, Human
guaagggcugccgcgcucuggccuggagggacaaggccagcacacggugccucaaccaacugga

SEQ ID NO: 19201 - RNA, 64 nt, Human
gcuguucuucccgccacgaucuuucugugguagcggccagcagaagacauggccugcuccccac

SEQ ID NO: 19202 - RNA, 64 nt, Human
aggagcugacuguggacuggugggcuccccucugggccagcacaguccccucaccucuggcagg

SEQ ID NO: 19203 - RNA, 64 nt, Human
uaccuuuaccuccuccucugggaguuggcugcauggccagcacugccgacuugaugggagcagu

SEQ ID NO: 19204 - RNA, 64 nt, Human
uucacauccuguguuucuagggaaaugaaagaaaggccagcaaauucgcugcaaccuguugaua

SEQ ID NO: 19205 - RNA, 64 nt, Human
uuauaaaacauguuuaacucagaaugauaugugaggccagcagucagaauaucacuucuccauu

SEQ ID NO: 19206 - RNA, 64 nt, Human
aaccuugcaacgguauccagggacuaugaugagaggccagcacauuaucuucauaugucaccuu

SEQ ID NO: 19207 - RNA, 64 nt, Human
ugcucaaucuucaugagacaaaggggcccgauagggccagcagccacaaggccuugaccugccg

SEQ ID NO: 19208 - RNA, 64 nt, Human
gacagauaacagaacgagcaaaguaaccuauacaggccagcauggaacagcaucuccccugggc

SEQ ID NO: 19209 - RNA, 64 nt, Human
agaaggugggggggggggggcucugggaagcacaggccagcaccuccccagguggcaggaucug

SEQ ID NO: 19210 - RNA, 64 nt, Human
augauguacugguuaauuuugcauggcuucuuaaggccagcaaaaugcuggcaguuuucuuuau

SEQ ID NO: 19211 - RNA, 64 nt, Human
ugaggcagccacuucggccaggucacacgaccggggccagcaccacuuccuuuaaagaugaacu

SEQ ID NO: 19212 - RNA, 64 nt, Human
gcuccugcaccacggacacagaaugucuggagagggccagcaggcccucugaggguucuggaau

SEQ ID NO: 19213 - RNA, 64 nt, Human
cacagcugggcccaccgaggugcuauccugcccaggccagcacuuggcugaguuggguuggagu

SEQ ID NO: 19214 - RNA, 64 nt, Human
gagcgggugccgaagcuacuggacuaugcugaugggccagcaggagccagccaaggccgcugug

SEQ ID NO: 19215 - RNA, 64 nt, Human
uuucccacagggaaagaaaaguuggaucacuaguggccagcauccccagaguuccguuaguaaa

SEQ ID NO: 19216 - RNA, 64 nt, Human
cacaggaugacacccucccauaccccauagcuggggccagcagguucugcugaggguggggcug

SEQ ID NO: 19217 - RNA, 64 nt, Human
aagaccuagcagguucugugaacucucaggccuuggccagcacuaguuaggggaggucaggugg

SEQ ID NO: 19218 - RNA, 64 nt, Human
gggagcacucugggacugugagacaaggaagcagggccagcagugagacuaugagccaagcaaa

SEQ ID NO: 19219 - RNA, 57 nt, Human
ucguccccgacaucuucugagcccucuggccagcacgccuguccucccccggggcca

SEQ ID NO: 19220 - RNA, 64 nt, Human
aguggaagaacagucauaugccauuggaagucuuggccagcaguccugaauccuuccugaagag

SEQ ID NO: 19221 - RNA, 64 nt, Human
ccuggagaggagaugggggacagugcuguuguggggccagcagugaaucuguaugcggagaguu

SEQ ID NO: 19222 - RNA, 64 nt, Human
ggaucaccugagguccggaguucgaggcugguuuggccagcauggcgaaaccccaucucuacua

SEQ ID NO: 19223 - RNA, 64 nt, Human
aagggcacaacgguggccaaacucagggcucacaggccagcaguccaugucagccacaucaggc

SEQ ID NO: 19224 - RNA, 64 nt, Human
ggaugaccagggaagcccccugauaagccaagagggccagcacagcccuugcucccaggcuccu

SEQ ID NO: 19225 - RNA, 64 nt, Human
ggggaagaaaugagagagcaggggcaccccccuaggccagcacagccugagggguacagcaaag

SEQ ID NO: 19226 - RNA, 64 nt, Human
cugccagggccuguggaggacaggccagagaggaggccagcaggcccagaguccccaggggagg

SEQ ID NO: 19227 - RNA, 64 nt, Human
gccugaacccgccggugugggccacaguaggaggggccagcaguccucccugucccaugccugc

SEQ ID NO: 19228 - RNA, 64 nt, Human
uauucuggaauaaggaaugaaucaacugaccuugggccagcagguuuuuaacuaaauuguuacu

SEQ ID NO: 19229 - RNA, 64 nt, Human
agacgaaggcaggggacccauggcgaggaggaauggccagcaccccaggcagucugugugugag

SEQ ID NO: 19230 - RNA, 64 nt, Human
uguccugcuggccaccccacccacaccugucccuggccagcaggccgccugcaagcgucaggca

SEQ ID NO: 19231 - RNA, 64 nt, Human
uccaugguuaagacauccuuuauaaaccaaagauggccagcacacugcuaaccagucaccaaau

SEQ ID NO: 19232 - RNA, 64 nt, Human
aaugaaagaugaaaauaggaagugcccuggagggggccagcaggucacggggcagaaucucuca

SEQ ID NO: 19233 - RNA, 64 nt, Human
ggaucaccugaggucaggaguucaugaccagccuggccagcaugguaaaacccugucuccacua

SEQ ID NO: 19234 - RNA, 64 nt, Human
cucagcccucaggugcaguggcccuacccagccuggccagcagacacacacagggaugcucacg

SEQ ID NO: 19235 - RNA, 64 nt, Human
cuccccacugccugcacagaggacccugacccucggccagcaggguggccccagguccauguug

SEQ ID NO: 19236 - RNA, 64 nt, Human
uggguuagauuuuccaaaaucauaauuugaagaaggccagcauuuaugguagaauauauaauua

SEQ ID NO: 19237 - RNA, 64 nt, Human
guugcuucuguuuuguuuuaagaggaaaugagaaggccagcagaaguagauuaaaacuagagag

SEQ ID NO: 19238 - RNA, 64 nt, Human
gaucuuuuuucugucuaguacuuguuuucauucuggccagcaguucuacauuaaaucaccuugu

SEQ ID NO: 19239 - RNA, 64 nt, Human
agggcaguggaggugcugcauugccugcggucaaggccagcaagguggaguggaugccucagaa

SEQ ID NO: 19240 - RNA, 64 nt, Human
acugcucacaucuuacaggugaguacucauaauuggccagcaucucaccaccagcaaguaguag

SEQ ID NO: 19241 - RNA, 64 nt, Human
aaaccaucuguaaaagacugaggugggggugggaggccagcacgguggugaggcaguugagaaa

SEQ ID NO: 19242 - RNA, 64 nt, Human
aaaccaucuguaaaagacuggggugggggugggaggccagcacgguggugaggcaguugagaaa

SEQ ID NO: 19243 - RNA, 64 nt, Human
cauuccuuuuucccuauuuauauugaaagaaauaggccagcagagacuuagggauuuuaaauug

SEQ ID NO: 19244 - RNA, 64 nt, Human
ggggccugcaagccugggaacuugggcaucguugggccagcaggaugagcagcaaagggucuga

SEQ ID NO: 19245 - RNA, 64 nt, Human
gaagggagaaggcugugcuagaggagccagugagggccagcauggggugggcuucacuaaggaa

SEQ ID NO: 19246 - RNA, 64 nt, Human
accaagccaagagcacccuguccccauuccaaggggccagcagcacuuuggcccaaaguauuuu

SEQ ID NO: 19247 - RNA, 64 nt, Human
aauuguucugcucuaacugauaccucaaccuuggggccagcaucucccacugccuccaaauauu

SEQ ID NO: 19248 - RNA, 64 nt, Human
acaucacacggcugagaguccccuuuccaggcagggccagcauguguagaauaucuuucagaau

SEQ ID NO: 19249 - RNA, 64 nt, Human
uggguccucagagugggggcuccuuaagccuccaggccagcagcaucagcaucaccugggagau

SEQ ID NO: 19250 - RNA, 50 nt, Human
ucgaguccuccaagaucugaggccagcagagcgagcugacagcagcaaca

SEQ ID NO: 19251 - RNA, 64 nt, Human
uggcccugggcagggucuguggcugcgccccucaggccagcaguugagguccaucgggcuggcc

SEQ ID NO: 19252 - RNA, 64 nt, Human
aggcccugucaccgacgggucaccucgcccacacggccagcaccgacucaccacagcccuuccc

SEQ ID NO: 19253 - RNA, 64 nt, Human
ucucuuuuuuuaaaauccauuuuacuggaaaguuggccagcagagggaguagaaauuauuaaaa

SEQ ID NO: 19254 - RNA, 64 nt, Human
aacacuggcucuggaaucuggaauguuaaguccaggccagcagugacaaaaguuauuguaauga

SEQ ID NO: 19255 - RNA, 64 nt, Human
gaaucauuugaggugaggaauucgagaccagccuggccagcauggugaaaccccaucucuacua

SEQ ID NO: 19256 - RNA, 64 nt, Human
ccugcaucuucugaaucaccuggcccagaagccaggccagcagcccgagaccauccuccuugca

SEQ ID NO: 19257 - RNA, 64 nt, Human
cugauggagaugcucaaggccagcaagccccucaggccagcacuucgcuugcagaagccaucca

SEQ ID NO: 19258 - RNA, 64 nt, Human
cuccuagccccgaggugcugauggagaugcucaaggccagcaagccccucaggccagcacuucg

SEQ ID NO: 19259 - RNA, 64 nt, Human
uuuuuaauaccaaguccuuaggagucuuaacauuggccagcaucuguuuaucaaaugacauaaa

SEQ ID NO: 19260 - RNA, 64 nt, Human
cauuuaguucagcauccgcaggugcuggucccggggccagcacuuccaugggaaugucucuuug

SEQ ID NO: 19261 - RNA, 64 nt, Human
cagacuuggcuucauuuuggucuugagauaaaauggccagcauaaaugcuguuuauauucacgu

SEQ ID NO: 19262 - RNA, 64 nt, Human
guggucgagugaagauugaaaauuaaccucugagggccagcacagcagcucaugccuguaaucc

SEQ ID NO: 19263 - RNA, 64 nt, Human
uguggguggacacgcaaggaggggauuuuuauuuggccagcagucucacccacugaucuccacc

SEQ ID NO: 19264 - RNA, 64 nt, Human
ugugccuauagaagcucuuuucaacauucuuuauggccagcagcccuugguuggugcagauggu

SEQ ID NO: 19265 - RNA, 64 nt, Human
ccagucugaauugggucugucuuugagaugcccaggccagcagaaagcagcucagaaguauugu

SEQ ID NO: 19266 - RNA, 64 nt, Human
ggcggcacccaggccucccugcagacuccaauggggccagcacuggaggggcccacccacauga

SEQ ID NO: 19267 - RNA, 64 nt, Human
uuugguauuugguaguggaggguggggggaugggggccagcagcugucauccuccugggaagcc

SEQ ID NO: 19268 - RNA, 64 nt, Human
aaggcaaguccaggacucagaccggggaggcccgggccagcagcucccagugugaccugacaaa

SEQ ID NO: 19269 - RNA, 64 nt, Human
cccuccucccccuuugggguagaccuugagggugggccagcauaggggggagggucuuuuaccc

SEQ ID NO: 19270 - RNA, 64 nt, Human
cugcgaugcuggacacuacagguaucugucccugggccagcagggaccucugaagccuucuuug

SEQ ID NO: 19271 - RNA, 64 nt, Human
ccagucacugccuuaagaacauuugaugcaagauggccagcacugaacuuuugagauaugacgg

SEQ ID NO: 19272 - RNA, 64 nt, Human
ucugaccuaauaauuacgggaaauggaaagucugggccagcaucaauaaaaugacaccaaaaau

SEQ ID NO: 19273 - RNA, 64 nt, Human
acggaguuuagagccagggcugaugcuuugguguggccagcacucugaaacugagaaauguuca

SEQ ID NO: 19274 - RNA, 64 nt, Human
cuggaguacacuggagggggcagcccaaguuagaggccagcauugcugacauucuggaauauuu

SEQ ID NO: 19275 - RNA, 64 nt, Human
ucagaaccucucugaagaccaaacuucccuguguggccagcagaggaagccuugaggauagauc

SEQ ID NO: 19276 - RNA, 64 nt, Human
gcgaaucaugagaucaggaguucgagaccagccuggccagcauggugaaaccccaucucuacua

SEQ ID NO: 19277 - RNA, 64 nt, Human
aaguguuugaaagucacuuugaaaguuaguuuugggccagcacgguagcucacccuuguaaucc

SEQ ID NO: 19278 - RNA, 64 nt, Human
aggaccggaacacguuucugcgacccggggcucuggccagcacuguguucugcguuuggucuca

SEQ ID NO: 19279 - RNA, 64 nt, Human
uccuuccccaccauucccagcccuccuucccacuggccagcaccugaacccagugaacacaggc

SEQ ID NO: 19280 - RNA, 64 nt, Human
cuuuuaauaaacugcaaguucauuuuaaaugaagggccagcauauauacuugcaagauaauuuu

SEQ ID NO: 19281 - RNA, 64 nt, Human
caggggggcccugugacccccucuccacaaccauggccagcaucggcuucuugcugcaccugug

SEQ ID NO: 19282 - RNA, 64 nt, Human
ugccuaagcuuagaguucuuuuauauaccucuacggccagcaaaaugcucaggucugcucuugg

SEQ ID NO: 19283 - RNA, 64 nt, Human
ccagguggcccaagugcucuugguggcccagcuuggccagcacacacuuuccuccugcagcacc

SEQ ID NO: 19284 - RNA, 64 nt, Human
ugggggagccuacuggggacugagcccccaggagggccagcauguggagagucgcugcggcugc

SEQ ID NO: 19285 - RNA, 64 nt, Human
gccacagccugugcuccugguccucaccuggaggggccagcaggcugccgucccaccacacgug

SEQ ID NO: 19286 - RNA, 64 nt, Human
gaacuuccaggccucagcgcagagcccugcuuggggccagcacggugggcagcugccggccgcu

SEQ ID NO: 19287 - RNA, 64 nt, Human
acgcugggaccuacgucgggcuuccugcuggggcggccagcacccucuccacgugcagacccca

SEQ ID NO: 19288 - RNA, 64 nt, Human
uguuuaaacgcaacaaaaggcuacauuuccauggggccagcacugucaugagccucacuaagcu

SEQ ID NO: 19289 - RNA, 64 nt, Human
uuugcucagugucuggcugcagagcagugggccuggccagcagguccccagcuuuggcuaugag

SEQ ID NO: 19290 - RNA, 64 nt, Human
uaucuaccuacaauugaccaaaaaaaauuuuuuaggccagcaauuauuauuuagcuucgcucuu

SEQ ID NO: 19291 - RNA, 64 nt, Human
gggcgccaagacucaggggaucggcugggaacugggccagcagagcauguuggacaccccccac

SEQ ID NO: 19292 - RNA, 64 nt, Human
acacagcagggcagugcacccuggcaccaugcacggccagcaagaaucaaggcccgcagaugcu

SEQ ID NO: 19293 - RNA, 64 nt, Human
gagccugggcccggcccacucagcggcccacauuggccagcauucagcugcacgugugugcugc

SEQ ID NO: 19294 - RNA, 64 nt, Human
acagauucccaccuguauguagcacgccaugcugggccagcagugucauaggaguggaggggga

SEQ ID NO: 19295 - RNA, 64 nt, Human
gggccugggcuugaaugugacucuguugagacauggccagcaauucuggcacuuggcugucauu

SEQ ID NO: 19296 - RNA, 64 nt, Human
gaaggucucacaucugucucugggcacccaugcuggccagcaguuucccagggcucccuggggu

SEQ ID NO: 19297 - RNA, 64 nt, Human
aacagcccuguccccacaggaccugggagcccugggccagcacuucucccagucuccccgaguc

SEQ ID NO: 19298 - RNA, 64 nt, Human
guggucaccaaggcagugagccccgcugaccccgggccagcacuuggcaggcaggaggugcggu

SEQ ID NO: 19299 - RNA, 64 nt, Human
uggguccgcuggugucacuauggccugggugagaggccagcacugcugcugcccugaggggaaa

SEQ ID NO: 19300 - RNA, 64 nt, Human
gguuugaauuuaaucaucucuuuagaucuuauaaggccagcauuaggaaacuuguucacuuuuc

SEQ ID NO: 19301 - RNA, 64 nt, Human
aaguaccuuuguguccuuguucauuuauaucgcuggccagcauuauaagcagguguauacuuuu

SEQ ID NO: 19302 - RNA, 64 nt, Human
uugaauggguaagcagacaggccaugauuuaguuggccagcacuaacuccaccucuguucuccu

SEQ ID NO: 19303 - RNA, 64 nt, Human
gcuguucuaacccccacccccacugccagguaugggccagcaguuuccugccagauauugccca

SEQ ID NO: 19304 - RNA, 64 nt, Human
agaccaaagaacuccuuggaugaaaguccacuggggccagcaauacuccagagcccaguuucug

SEQ ID NO: 19305 - RNA, 64 nt, Human
aguguugggauuacaggcaugagccacugcgccuggccagcaaaugcuuuuugugcagaauaca

SEQ ID NO: 19306 - RNA, 64 nt, Human
aggagucauugacaacaaaaagccgagaacccagggccagcaguggagccucagcagaccaggg

SEQ ID NO: 19307 - RNA, 64 nt, Human
gggagcccaggaaggcauccacgagggagcuccuggccagcagccgucauccucucggaccagc

SEQ ID NO: 19308 - RNA, 64 nt, Human
ucccacaccucccuuccagcaggccagugguuauggccagcacggcuacaguacaggugagggg

SEQ ID NO: 19309 - RNA, 53 nt, Human
caguggagaggaagcagugaccuggccagcacugcucccagcacugcgcacca

SEQ ID NO: 19310 - RNA, 64 nt, Human
gaagccagucccuccccaccugcccagagcuccaggccagcacagaaauuccugaggccaacgu

SEQ ID NO: 19311 - RNA, 64 nt, Human
aguccuacacccagaaggcggcugagggaacugaggccagcauuuuuccuccugccccuggggg

SEQ ID NO: 19312 - RNA, 64 nt, Human
ggaggcugugaggcuggagggaccagauggaggaggccagcagcuagccauugcacacuggggu

SEQ ID NO: 19313 - RNA, 64 nt, Human
cugagcuccugggggaguuaauucagaggggagaggccagcaccucccuccuccaucgcucgcu

SEQ ID NO: 19314 - RNA, 64 nt, Human
aaagaaagcuuuuauaggaaagcccagugacaugggccagcagccacagcauauuguaaacuga

SEQ ID NO: 19315 - RNA, 64 nt, Human
cccaugcagagcgggagccugccuaccugggccuggccagcaggcagggcugccuucugcuuuu

SEQ ID NO: 19316 - RNA, 64 nt, Human
ugacugggcacaggagcucccagcuuuuguccacggccagcaggaugggcugucguguauauag

SEQ ID NO: 19317 - RNA, 64 nt, Human
ggcauucaggucacaugaaagguguguggaaaguggccagcauucugccugcagacccugagca

SEQ ID NO: 19318 - RNA, 64 nt, Human
guccgcuacacuagccugggcugggcccugcaguggccagcagggagcccagcugcuccccagu

SEQ ID NO: 19319 - RNA, 64 nt, Human
ugaucaccugaggucaggaguuugagacuagccuggccagcauggugaaaccucaucucucuaa

SEQ ID NO: 19320 - RNA, 64 nt, Human
ucgaagugcugggauuccaggcgugagccacugcggccagcacauuuccacuuuuagauccuac

SEQ ID NO: 19321 - RNA, 64 nt, Human
uaaggucuuggaacuugccugccuuuccauccauggccagcagcaccugcccuaccugccccac

SEQ ID NO: 19322 - RNA, 56 nt, Human
ccagcugguucgggcugugacgggguggccagcagggacgcgccccaggugggcag

SEQ ID NO: 19323 - RNA, 64 nt, Human
cggcauccccagcugguucgggccgugacggggcggccagcagggacgcgccccaggugggcag

SEQ ID NO: 19324 - RNA, 64 nt, Human
ggauggcccggccccggggcccguacacaggcggggccagcacaguagugaaggcggucuccug

SEQ ID NO: 19325 - RNA, 64 nt, Human
caguccuggggggcugggacgcccaagaucaagaggccagcagauucggacuccgcugagggcu

SEQ ID NO: 19326 - RNA, 64 nt, Human
ucccucggaacagugccucaaauccugacccaagggccagcauggggaagagaugguugcaggc

SEQ ID NO: 19327 - RNA, 64 nt, Human
ccuuauuccuaauggcuauuuuugaagcaaagaaggccagcaacauuggcacaugccaccuggc

SEQ ID NO: 19328 - RNA, 64 nt, Human
guuuuguggggagaggggaaggaucagggggccaggccagcagcucgggggccacaaggagaug

SEQ ID NO: 19329 - RNA, 64 nt, Human
cugccaccagccucaccgccugcgggcagggggaggccagcaggcccgggcccagcaccccuuc

SEQ ID NO: 19330 - RNA, 64 nt, Human
auuccuuccagcagggcccucuucccuagguucgggccagcaggaggugccggcuggagucucc

SEQ ID NO: 19331 - RNA, 64 nt, Human
auggcugagugcugggaagggcugagcucacccaggccagcaggugggguaucaucugcucggu

SEQ ID NO: 19332 - RNA, 64 nt, Human
uccuccaucacacucucccggcuugcgcaggaggggccagcagccccaggagucccagacccgu

SEQ ID NO: 19333 - RNA, 64 nt, Human
gcagcccuucccacagcuugcaaggaccaagggaggccagcagguggacagggggccucagccu

SEQ ID NO: 19334 - RNA, 64 nt, Human
gcggguggagagacacccauguggcuccccuuagggccagcaccaagcaccacgcucucauccu

SEQ ID NO: 19335 - RNA, 64 nt, Human
caguccacagcagcaggguuaagacucagcacagggccagcagcagcacaaccuugaccagagc

SEQ ID NO: 19336 - RNA, 64 nt, Human
gaacucaaauauuucaagggcuccauagccacguggccagcagcuaccacacuggucagcgcag

SEQ ID NO: 19337 - RNA, 64 nt, Human
gaaaggcugcuaauuuucuuuggcagauuguauuggccagcaggaaagcaagcucuccagagaa

SEQ ID NO: 19338 - RNA, 64 nt, Human
cuccauuacccgcccaucacugcuguuccuccagggccagcacucgggcgaggcaggggagcug

SEQ ID NO: 19339 - RNA, 64 nt, Human
uuggaggugguaggaagugguacugaucaaugauggccagcaggacucaucuccugccuaacug

SEQ ID NO: 19340 - RNA, 64 nt, Human
ucccugaaaaagcaccuggcuaagggcugggccuggccagcagggagggcaguugaugagagag

SEQ ID NO: 19341 - RNA, 64 nt, Human
auaguccagaccacccagguaugggcagcucccaggccagcagcagcagcagccuacgcuaaua

SEQ ID NO: 19342 - RNA, 64 nt, Human
ccaggguacccuccaccccagcugccaagcccugggccagcagcacccccuuguggccauccug

SEQ ID NO: 19343 - RNA, 64 nt, Human
ggaucaccugaggccagguguuugagaucagccuggccagcauggcgaaacccugugucuaaua

SEQ ID NO: 19344 - RNA, 64 nt, Human
ucagcccuccuugacugugucccagccagcaccaggccagcagccucaucccugccauucaggg

SEQ ID NO: 19345 - RNA, 64 nt, Human
gucacagggaaagccaggaguggccuucucugcaggccagcaagccugcagcagcaggugcccc

SEQ ID NO: 19346 - RNA, 64 nt, Human
gugguuuugguucucccacuaugguaggaccccuggccagcauuguggcuugucaugucagccc

SEQ ID NO: 19347 - RNA, 64 nt, Human
uacaaagcauggcaggccaagggccucgaccacaggccagcauuagcagaacauauaaugguuu

SEQ ID NO: 19348 - RNA, 64 nt, Human
gcaggcaauaguugaaggacuccuguuccguuggggccagcacaccgggauggauggagggaga

SEQ ID NO: 19349 - RNA, 64 nt, Human
ugaaugcugaaggaaccaacaguccaccucagcgggccagcagcccagggaaccccugcccacc

SEQ ID NO: 19350 - RNA, 64 nt, Human
caccuaaacagaaucagugacccgggugcuuuguggccagcagcacagaaucaaacccgcaucc

SEQ ID NO: 19351 - RNA, 64 nt, Human
ccaccaaauuaccuaggcugagguuagagagauuggccagcaaaaacugugggaagaugaacuu

SEQ ID NO: 19352 - RNA, 64 nt, Human
gugcagcucuugcagccccugcagacgagagucaggccagcacccugcgaccagcuucuccacu

SEQ ID NO: 19353 - RNA, 64 nt, Human
caucccuuuccuggcuuauggccaagcccuacccggccagcagucgcugggccucucccugccc

SEQ ID NO: 19354 - RNA, 64 nt, Human
cuuccuguguggcagcaccuggcacacuggcucuggccagcauuaugcuaaaacccuguuacuc

SEQ ID NO: 19355 - RNA, 64 nt, Human
gacugaggauuaugcaacgugguccaaccggagcggccagcaugaccagcuguccaggggcugc

SEQ ID NO: 19356 - RNA, 64 nt, Human
gcccccagaugacugagcaguucuacaaaagaauggccagcacgagcggggacuagaggguccu

SEQ ID NO: 19357 - RNA, 64 nt, Human
uguccuggguuuuggcucuuuaaugauuacuccaggccagcauuuagucguuugagaauuguag

SEQ ID NO: 19358 - RNA, 64 nt, Human
gcucugggggaugagcuggugcguuuaaggaacaggccagcacuggcauucgcaagcagugggg

SEQ ID NO: 19359 - RNA, 64 nt, Human
cgcgggaugaggacgggccacccuggcaccggaaggccagcagagggcacuguccgccagggcu

SEQ ID NO: 19360 - RNA, 64 nt, Human
gaccaacacccaggggaucagugaaggaagagaaggccagcagaucacugagagugcaacccca

SEQ ID NO: 19361 - RNA, 64 nt, Human
acaagucaccaacugcuucagggauaccuggaggggccagcaaguagaguguugguggcccaag

SEQ ID NO: 19362 - RNA, 64 nt, Human
aauguugugcuuccuuuagcuuuuguauuucgauggccagcauuacccuuuaccugugggcauc

SEQ ID NO: 19363 - RNA, 64 nt, Human
gcuaucucucucaguugguuuuugauagaacagaggccagcaaacuuucuuuguaaaaggcugg

SEQ ID NO: 19364 - RNA, 64 nt, Human
ugucuuugccucugauuuuuacacaguguagaguggccagcagugaacagguugaggaugugcg

SEQ ID NO: 19365 - RNA, 64 nt, Human
aggcaggggcugcaggcucagccugacccaggccggccagcauggcagagagguccugcaugaa

SEQ ID NO: 19366 - RNA, 64 nt, Human
gagcccugugaaaugcaucaagguccucuccgcuggccagcagcauccccaggcuucucucagg

SEQ ID NO: 19367 - RNA, 64 nt, Human
caaacuggauuuuaaaaguucugccauguuaaguggccagcauuucaugaaggauaacauuuuu

SEQ ID NO: 19368 - RNA, 58 nt, Human
acgacaccauccugacaugagaggccugggccagcagcagcauugccgcuccacaucu

SEQ ID NO: 19369 - RNA, 64 nt, Human
cugcuguauuuggaaaccccuucuuuacuucccaggccagcaagcucuucacugaaacugguug

SEQ ID NO: 19370 - RNA, 64 nt, Human
accccagcccauguacguccccacgaacuggccuggccagcaccccacacuggagccaucucuu

SEQ ID NO: 19371 - RNA, 64 nt, Human
acaaauacauaugggaaaaaguacuugagaccaaggccagcaucaauuccagacaucuucaugu

SEQ ID NO: 19372 - RNA, 64 nt, Human
acgccacccccgucuugccugggucggggccugcggccagcaccauuucacacacacuccuugu

SEQ ID NO: 19373 - RNA, 64 nt, Human
gagauuuccacuguggaaaccgccugggaauuccggccagcagcuuccuccuucagccaccugg

SEQ ID NO: 19374 - RNA, 64 nt, Human
cuccggauggaggccagcuaagccacucggggcaggccagcaauaaaaacugucugucuccauc

SEQ ID NO: 19375 - RNA, 64 nt, Human
acaucaacaagcccaugagccccagcguucagaaggccagcauugucuuccaugggagaugacu

SEQ ID NO: 19376 - RNA, 64 nt, Human
caguuaggugcuagauccuaagaggcacucacaaggccagcaggugcuuccuuggcucccauga

SEQ ID NO: 19377 - RNA, 64 nt, Human
gacagaggaaguggagagcgagcucuaucgcaucggccagcagcuggggaugacguucaucagu

SEQ ID NO: 19378 - RNA, 64 nt, Human
gaucugccacgagucacuccuacuccacccugauggccagcagaggaagggccacucuucucau

SEQ ID NO: 19379 - RNA, 64 nt, Human
gaggggcagcgcagggcgcagagcacacccgcugggccagcagcucccaacggcgaugcuacua

SEQ ID NO: 19380 - RNA, 64 nt, Human
gguggcaccagaugcaaccucacuaugguaugcuggccagcacccucuccuggggguggcaggc

SEQ ID NO: 19381 - RNA, 64 nt, Human
guguggcagggggauggcagguuggggguccuggggccagcaaugugguuccugugcacugagc

SEQ ID NO: 19382 - RNA, 62 nt, Human
aggaggcgugucagcagugaccauggguguggggccagcagcugguggggacugguuucaac

SEQ ID NO: 19383 - RNA, 64 nt, Human
ucugacugacacuaagucuagcacacagcacuugggccagcaaauccuggaaggcagacaaaaa

SEQ ID NO: 19384 - RNA, 64 nt, Human
uauccuguuugaagaaaaaggacaaauaaaacauggccagcaaauacagcuccuguuucacucu

SEQ ID NO: 19385 - RNA, 64 nt, Human
ggaagucuggucgcaguggcaaagccagcaccauggccagcagagcggugagcagcacucccac

SEQ ID NO: 19386 - RNA, 64 nt, Human
uggcauugguucuaggaaccugagaguggagugaggccagcaugcaggaaggaguuuggagaga

SEQ ID NO: 19387 - RNA, 64 nt, Human
ccugucccacccccuucccccagcccauccauuaggccagcaacgcuuguagaacucacucugg

SEQ ID NO: 19388 - RNA, 64 nt, Human
cuugucugccacagcgggagcuaagccggcccugggccagcacuccgagagguggaaggggccc

SEQ ID NO: 19389 - RNA, 64 nt, Human
ccuaugaggcucuucuaccccgugccugcaccucggccagcaucuccuaugcucccuggguccc

SEQ ID NO: 19390 - RNA, 64 nt, Human
ggcgaacccugggccauccucacaugugacaaagggccagcagucuaccugcucguugccugcc

SEQ ID NO: 19391 - RNA, 64 nt, Human
cuaccuccuguccucaggccgugcggcacgacauggccagcacgcagaaggagcccucccggga

SEQ ID NO: 19392 - RNA, 64 nt, Human
agcugcugcgaguugacaucggcacucuggaccuggccagcagccgccuggacucagccauggc

SEQ ID NO: 19393 - RNA, 64 nt, Human
accccacaucuggguggccaacuuggcaggacuuggccagcagcugcccaggacacagugcagg

SEQ ID NO: 19394 - RNA, 64 nt, Human
gaagggacagucaggcuucucccugggaagguggggccagcaggagaugaccaacagggggcag

SEQ ID NO: 19395 - RNA, 64 nt, Human
uagcggcuccuucccgacagagcugccucucgguggccagcaggacucugcccagaccacacgu

SEQ ID NO: 19396 - RNA, 64 nt, Human
gcagcuugccugcuucagcaaaaacggagauucaggccagcagcuggauaugggggucucucuu

SEQ ID NO: 19397 - RNA, 64 nt, Human
ggccggccccaggcagugagggccuuagcaccugggccagcagcugcugugcucgauuucucgc

SEQ ID NO: 19398 - RNA, 64 nt, Human
agccugccuugcccaggggugggauggcacugaaggccagcagacaggccuaggcuggggcagg

SEQ ID NO: 19399 - RNA, 64 nt, Human
gcacagggcugaggauggggcuccuauccacccuggccagcacccagcuuagugcugggacuag

SEQ ID NO: 19400 - RNA, 64 nt, Human
guauaacacucugcuguguggcauggcagaaggaggccagcacgcagccccuccagcuccacgu

SEQ ID NO: 19401 - RNA, 64 nt, Human
gggcucugcuuugcgucuaaccuuugugggggagggccagcaaggcaguccccccacgcccgag

SEQ ID NO: 19402 - RNA, 64 nt, Human
caggaccagucugcccacugccuaaaugaugcccggccagcaggaccuggccugcagaucccag

SEQ ID NO: 19403 - RNA, 64 nt, Human
gccuggucugcggguccaucgucagugccugagcggccagcagaaggggggcagcagccuccac

SEQ ID NO: 19404 - RNA, 64 nt, Human
agggcccguguaaauauguacauuucucaggcuaggccagcaggggcugcccgagucuguuuuu

SEQ ID NO: 19405 - RNA, 64 nt, Human
gucagcacugggucagcgacuccaaucuuccaguggccagcacacccuagacaccccgaggagg

SEQ ID NO: 19406 - RNA, 64 nt, Human
gggcuggggaggagcggggagggcggaucucccuggccagcagggaugggagggggccauuugc

SEQ ID NO: 19407 - RNA, 64 nt, Human
ccagcugcccguuuccucccauggcccaguaugaggccagcaggggacauuugggaugcccagg

SEQ ID NO: 19408 - RNA, 64 nt, Human
uuggauuuuccaaaaucauaauuugcagaaggaaggccagcauuuacgaugcaauauguaauua

SEQ ID NO: 19409 - RNA, 64 nt, Human
ucagugaccacgucaugacagaacagcacauccuggccagcaccccuggcuggaguggguuaaa

SEQ ID NO: 19410 - RNA, 64 nt, Human
gccauucaaagcccccauguucucugcacuguuuggccagcauaaccucuagcaucgauucaaa

SEQ ID NO: 19411 - RNA, 64 nt, Human
ugaugcacaccaccaacauucuuggcauuacgcaggccagcaacucccagcucaaugcaauggu

SEQ ID NO: 19412 - RNA, 64 nt, Human
agaagugagagguagaaguacuucaaauucaacaggccagcaagcaaucggcuuaaaauucccu

SEQ ID NO: 19413 - RNA, 64 nt, Human
gcccagggccacacagcagagguagaggguccuuggccagcacacuaucuaccacucuacccca

SEQ ID NO: 19414 - RNA, 64 nt, Human
ugaacugcuuugugacuuggaaagguacgcugcuggccagcauuggagaagaagcugcugagca

SEQ ID NO: 19415 - RNA, 64 nt, Human
cuggggagcaucagggaagagggggccaugagccggccagcaguggagacggcaguccaguuuc

SEQ ID NO: 19416 - RNA, 64 nt, Human
guuggggguucgaguagaucucauggguacaggaggccagcagggaccaggccagucagccaug

SEQ ID NO: 19417 - RNA, 64 nt, Human
ggacuuuuuuaaaaaaccagaucgggaggacuguggccagcaauuaacaccauguagacuuccu

SEQ ID NO: 19418 - RNA, 64 nt, Human
caucaaagcuuuuuuccgugguauucuaaaauuaggccagcagugggggcugggagggcaucug

SEQ ID NO: 19419 - RNA, 64 nt, Human
aacauccgacagagcagcucuggcuuugcagccuggccagcagcucagagugcaccgaggaggg

SEQ ID NO: 19420 - RNA, 64 nt, Human
ugagauggggcccucaccaaaugccuuggccaccggccagcagcccucugugaugugugugcag

SEQ ID NO: 19421 - RNA, 64 nt, Human
guuucccauaugccccuggagccccacuuauugaggccagcagaauaggugcagagaugaagug

SEQ ID NO: 19422 - RNA, 64 nt, Human
cagagacagugggcacuaaggguggagaguugggggccagcacagcugaggacccucagcccca

SEQ ID NO: 19423 - RNA, 64 nt, Human
agggugggcaggcaaccuccccgggcaggguccuggccagcagugugggagcaggaggggaagg

SEQ ID NO: 19424 - RNA, 64 nt, Human
cagcccagcuucgcgaaggcuguaggcacaccgcggccagcaggcaccuggcacccaccuuccc

SEQ ID NO: 19425 - RNA, 64 nt, Human
ugucucagcguagggcaggaggcccuccuggccaggccagcagugaagcaguauggcuggcugg

SEQ ID NO: 19426 - RNA, 64 nt, Human
agcccugugccacucaccgaagccacuuucuacaggccagcaggggcuuguugcaggcuguggg

SEQ ID NO: 19427 - RNA, 64 nt, Human
uggagguuuguuuagaagaagugugucacccuuaggccagcaccaucucuuuaccuccuaauuc

SEQ ID NO: 19428 - RNA, 64 nt, Human
ucuucaacgccaucuccacucuuguggucaucauggccagcacgccgcucuucacuguggucau

SEQ ID NO: 19429 - RNA, 64 nt, Human
aaauaucacuacccacauaaccuauaauuuguguggccagcaauuuauugaacacuaaaauguu

SEQ ID NO: 19430 - RNA, 64 nt, Human
ugggcuggaugagcucccacaagccugagggaaaggccagcacucgcuagcaguggcaggcaga

SEQ ID NO: 19431 - RNA, 64 nt, Human
cucuguugccaucagcuugauuggcuuccccgagggccagcagggcugggggcuccggagagca

SEQ ID NO: 19432 - RNA, 64 nt, Human
gaagaacaaaugaggcucacccacgaggcuggguggccagcagucugggcacacacgagcaggu

SEQ ID NO: 19433 - RNA, 64 nt, Human
cuucagggauggaaacaaaccagcucgucucagaggccagcaagcuggggccuguccgccacgg

SEQ ID NO: 19434 - RNA, 64 nt, Human
ugccucuccugcccugaaaaggaggaaugauuggggccagcaacuuugcucucccugccgugcc

SEQ ID NO: 19435 - RNA, 64 nt, Human
gucagccugauuucaacccaggugccccuggccuggccagcagugaauguaggagaugaauugu

SEQ ID NO: 19436 - RNA, 64 nt, Human
guggagcugaguccccuccccguaaccucugcaaggccagcacccaccaucacuaccugcaccu

SEQ ID NO: 19437 - RNA, 64 nt, Human
gucugauagcucuuuggauuuaccaacaguuaguggccagcauccuccugcugcaggugaggaa

SEQ ID NO: 19438 - RNA, 59 nt, Human
gcaacaccuuuggguacuagauacccuggggccagcagaaguauagcaugaagacagaa

SEQ ID NO: 19439 - RNA, 64 nt, Human
gugaguuucacacagaagaauuucaugugaauggggccagcaagagcugcccuguguccauggu

SEQ ID NO: 19440 - RNA, 64 nt, Human
aaacucacccccaaggggcagucuggaggggcauggccagcagcuugcguuagaaugaggagga

SEQ ID NO: 19441 - RNA, 64 nt, Human
ucacuggugcuauagaaauugagaugcccccccaggccagcaaauguuccuuuuuguucaaagu

SEQ ID NO: 19442 - RNA, 64 nt, Human
cugccugguccaguggggaacaggucccacgccaggccagcaggcgggcuccuuuguacaguuc

SEQ ID NO: 19443 - RNA, 64 nt, Human
agcauuuugguggccuagugacucagggcagaguggccagcacaccucucauccgccccuccug

SEQ ID NO: 19444 - RNA, 64 nt, Human
agaaggagggagaaaaccgugagaggauguguguggccagcagcucuucagcuuugagauggug

SEQ ID NO: 19445 - RNA, 64 nt, Human
ucaccuccugaguuuauuuuuccagagauuccagggccagcaaagccggcguucagaaggaggg

SEQ ID NO: 19446 - RNA, 64 nt, Human
ggcuggggccgcucuuggccccaagguugccccgggccagcagcccagccagcagcacagucuc

SEQ ID NO: 19447 - RNA, 64 nt, Human
gagagccuugagcuaaguucaggcagcagcauguggccagcagcagugugcugggagcagaggu

SEQ ID NO: 19448 - RNA, 64 nt, Human
uuagggaauaaaccagccccguuucuaucagcccggccagcaugcaggucuccacaucaccauc

SEQ ID NO: 19449 - RNA, 64 nt, Human
gggacucucagggcagcuccugccacuccgccagggccagcaugccaguccaggcagagcaggu

SEQ ID NO: 19450 - RNA, 64 nt, Human
uggaagacaagucuguggcuuggugagucuguguggccagcagccucugaucugugcaggguau

SEQ ID NO: 19451 - RNA, 64 nt, Human
gccgccucccuggagaagccgcgcgucgcccaugggccagcacgugccccacccgugggccagg

SEQ ID NO: 19452 - RNA, 64 nt, Human
ccgggguccuacaggcaggugcugggaaaggccuggccagcagguagccuguguguuugacaaa

SEQ ID NO: 19453 - RNA, 64 nt, Human
acggacccauggcagcugcucccagugcaucccaggccagcaggagcuuugugagcugcaggca

SEQ ID NO: 19454 - RNA, 64 nt, Human
cagaugcugagaccaucguacaggcagaagcuuuggccagcaccgucacucucacugccauugc

SEQ ID NO: 19455 - RNA, 64 nt, Human
cagggaagcacagugaagcuugcuuaaaggcacuggccagcagugugugacuuuggcuuuuggg

SEQ ID NO: 19456 - RNA, 64 nt, Human
cugcucccauccuguguguuaagcucugcuauuaggccagcaagcggggaugucccugggaggg

SEQ ID NO: 19457 - RNA, 64 nt, Human
cggccugcaggaaccugcuccagguggacacacgggccagcagccgcgaaccuugaagcugggg

SEQ ID NO: 19458 - RNA, 64 nt, Human
accccccagugcagacuucggggucuccaccccaggccagcagcgcccacugggcuacagcaag

SEQ ID NO: 19459 - RNA, 64 nt, Human
gaccagggggucucacuuuggccaccaguucuucggccagcaccucugcccuccagaaccugca

SEQ ID NO: 19460 - RNA, 64 nt, Human
ugcuagccagcaggcuccugucugggugccacggggccagcauuuuggagggagcuuccuuccu

SEQ ID NO: 19461 - RNA, 64 nt, Human
cccccaugccugcuggguggcuggguccuguggaggccagcagcgguguggcccccgcccccag

SEQ ID NO: 19462 - RNA, 64 nt, Human
ugcgauugccggaagguugcauggcuggucccagggccagcacaggcccgaggccgggcugccu

SEQ ID NO: 19463 - RNA, 64 nt, Human
ccucgcacauuuucccccuuccuguacaccucggggccagcauccucaccuucuucaacugacc

SEQ ID NO: 19464 - RNA, 64 nt, Human
ugaucucauucugagguccacauggcaccuucugggccagcagcuguggccgguguaucaaggg

SEQ ID NO: 19465 - RNA, 64 nt, Human
caggggcgucgaccuggcccagcuggguccccagggccagcacauggaauaaaauagccagggc

SEQ ID NO: 19466 - RNA, 64 nt, Human
ggcaucugccacgaaggaagcgccagccucgccaggccagcaggggcgucguuuuguugccauu

SEQ ID NO: 19467 - RNA, 64 nt, Human
cacgucgugcugcugcuggaagccaacagccuccggccagcagcccuacccggggcucaacaca

SEQ ID NO: 19468 - RNA, 64 nt, Human
gaaaagagggaauccucccuaacucauuuuaugaggccagcaucuuccuguuaccaaagcuggg

SEQ ID NO: 19469 - RNA, 64 nt, Human
ugccuuguccaggaacugccugggccaugcgaggggccagcagagggcgccaccaccaccugac

SEQ ID NO: 19470 - RNA, 64 nt, Human
cagcuccuaacugggacucugugucuaugcagggggccagcaccccuggguuaucuggggcuaa

SEQ ID NO: 19471 - RNA, 64 nt, Human
caggucagccuguggaacuugcgcaggugcgaguggccagcagaggucacgaauaaacugcauc

SEQ ID NO: 19472 - RNA, 64 nt, Human
ggaucaccugaggucaagaguuccagaccaggcuggccagcauggugaaaccccgucuguacua

SEQ ID NO: 19473 - RNA, 64 nt, Human
cacagggauguggggucagugcuugggagccuguggccagcagcccccacugcaccccugcccc

SEQ ID NO: 19474 - RNA, 64 nt, Human
uuaaauaaauaaaugugaagcacuuagaacugauggccagcacaugagggcucaccaaguguaa

SEQ ID NO: 19475 - RNA, 64 nt, Human
augcagagggacuccucccuaucugauucuaugaggccagcaucauucuaauaccaaaaccuga

SEQ ID NO: 19476 - RNA, 64 nt, Human
cccuggagagcaagaauaaucugauuuuccugggggccagcacccaaauaagccuggcaugcag

SEQ ID NO: 19477 - RNA, 64 nt, Human
cgggaacuccucaggcagccacgcagcgggugugggccagcauggggauggcguggcccccagg

SEQ ID NO: 19478 - RNA, 64 nt, Human
ggcagaggucagaaggggugucugggaccuggauggccagcagggacaggggcauugucaucuc

SEQ ID NO: 19479 - RNA, 64 nt, Human
ccggugaagcugaaggggccugugucccugaaagggccagcacaucacugguuuucuaggaggg

SEQ ID NO: 19480 - RNA, 64 nt, Human
uuuccuggaaaaagaagccuuucagguuucccugggccagcaucuucugauggaaggugggagc

SEQ ID NO: 19481 - RNA, 64 nt, Human
uccaugagggucacgcccccugaggaccucaggaggccagcagaacccgcaggcuccugaagac

SEQ ID NO: 19482 - RNA, 64 nt, Human
cugagcugggacccccacagccauccgcuggcuuggccagcagaaccagccccaagccagcacc

SEQ ID NO: 19483 - RNA, 64 nt, Human
cugugccccugacugagcagaagcccccacagcuggccagcagccccgccugacauggaacaga

SEQ ID NO: 19484 - RNA, 64 nt, Human
uguauuuuuacuagagacaggguuucaccauguuggccagcauggucuugaacgccugaccuca

SEQ ID NO: 19485 - RNA, 64 nt, Human
aagcagaucaccugaagucaggagagaccagccuggccagcauagugaaaccccaucucuacua

SEQ ID NO: 19486 - RNA, 64 nt, Human
ccagaucacaagguuaggaguucaagaccagccuggccagcauggugaaaccccaucucuacca

SEQ ID NO: 19487 - RNA, 64 nt, Human
gagacuggaguguguuccugaagagcagccaggaggccagcauggcuggagaggcaggcauagg

SEQ ID NO: 19488 - RNA, 64 nt, Human
ggucugaggggcagcucuggccagugcucaccagggccagcagggcccuaggcuggggucguac

SEQ ID NO: 19489 - RNA, 64 nt, Human
ggcggccguaucaucaggugcuccugugcaucucggccagcacgggagccagugccgcgcagga

SEQ ID NO: 19490 - RNA, 64 nt, Human
uuccugcuucucaagggacacaguggccugcaugggccagcauggacccugggcugaucaugug

SEQ ID NO: 19491 - RNA, 64 nt, Human
uccugcuucucuggggacacagugggcccacaugggccagcauggacccugggcuagagcaagc

SEQ ID NO: 19492 - RNA, 64 nt, Human
uugguuaagaugugacugccaucaucuucgugguggccagcagcagcuacaacauggucauccg

SEQ ID NO: 19493 - RNA, 64 nt, Human
cagugcccaagggccaccaaccccagggaaacagggccagcacagaggggccuuccucccccac

SEQ ID NO: 19494 - RNA, 64 nt, Human
aauccacacguggaccauugugggucccuugggaggccagcagccagacuacggaauccacaug

SEQ ID NO: 19495 - RNA, 64 nt, Human
cugcaaugcuggacacuacagguaucugucccugggccagcagggaccucugaagccuucuuug

SEQ ID NO: 19496 - RNA, 64 nt, Human
cacuuugggaagccgggguaggaggaucaccagaggccagcagguccacaccagccugggcaac

SEQ ID NO: 19497 - RNA, 64 nt, Human
cugcaccuucucuuggccacccuggcccugaccgggccagcacgugcacacuggccucuuuuca

SEQ ID NO: 19498 - RNA, 64 nt, Human
agaugcccuuccgcccccucugaaaguggggcccggccagcacugcucguuacugucugccuuc

SEQ ID NO: 19499 - RNA, 64 nt, Human
ccccaaacacgcuccauguauauauucuucugauggccagcaaaugaaauucugccuagaaauu

SEQ ID NO: 19500 - RNA, 64 nt, Human
gaccccaaaugguggucguugucccuucugugcaggccagcagggccccaucucuaguuuuucc

SEQ ID NO: 19501 - RNA, 64 nt, Human
gcuguauacgcuucaguuuuuccacauuguccacggccagcacaugaaagcaucacuucuuuuu

SEQ ID NO: 19502 - RNA, 64 nt, Human
gggagccugcguggccuggggcugccgugcacggggccagcauccaugcggccggccuggggcc

SEQ ID NO: 19503 - RNA, 64 nt, Human
caggucagggcagguccucugagccggcgccccuggccagcaggcgaggcuacaguaccugcug

SEQ ID NO: 19504 - RNA, 64 nt, Human
gcagcccugccuuucauagcagggauuaccugaaggccagcaggagccgggggcaggcccagga

SEQ ID NO: 19505 - RNA, 64 nt, Human
aaaaacaggacaccagagcccaccagacagugccggccagcagagaagcagagagccagcgcca

SEQ ID NO: 19506 - RNA, 64 nt, Human
agggcggcacuggagagaugggcccaucauuaggggccagcaucccaggaacuggaccuuuccc

SEQ ID NO: 19507 - RNA, 64 nt, Human
accugccagggagaugggacccuugugccaccugggccagcaaagaggagggguccagagaaca

SEQ ID NO: 19508 - RNA, 64 nt, Human
agagagugaaauuuaggucagggaaaagaccaagggccagcauugcuacuuuugugugugugug

SEQ ID NO: 19509 - RNA, 64 nt, Human
gcgccucccuauguugccugccacucugggcaccggccagcacccucuggugagaagagguccc

SEQ ID NO: 19510 - RNA, 64 nt, Human
ucuccagccccaguccagaguugggcaccacaccggccagcaucuuccgcacaccccugcagcu

SEQ ID NO: 19511 - RNA, 64 nt, Human
caugcagcgaagcagcccagcccggcggaucccaggccagcacgccugccggcuucucaucguc

SEQ ID NO: 19512 - RNA, 64 nt, Human
ccuggcugucugagugggcacuugucuggcugcuggccagcagugaagggccacuuggugacuu

SEQ ID NO: 19513 - RNA, 64 nt, Human
guugggcacccguugugagaguuucagaaccuuuggccagcaggagagaggugguagggagcag

SEQ ID NO: 19514 - RNA, 64 nt, Human
ggucuccgccuccaggguucugcucuuccaggcaggccagcaaguggcgcugggccacacuggc

SEQ ID NO: 19515 - RNA, 64 nt, Human
ccagccuuuuccuaacaucugccugugccacaacggccagcaggugccccauccucugcccaca

SEQ ID NO: 19516 - RNA, 64 nt, Human
uuccucuucccugccccacccccuggccgcagcaggccagcacugcagaguuugggugcuggug

SEQ ID NO: 19517 - RNA, 64 nt, Human
aaaaaaaaaaaaagaugcaaucaaaggggcuguuggccagcaauggcagcagcagcggcgggca

SEQ ID NO: 19518 - RNA, 64 nt, Human
ucccagugcuggagagggugggcugagggacuggggccagcacggaccacccaaggccucugcu

SEQ ID NO: 19519 - RNA, 64 nt, Human
gagcuagggcuggagcucugcccaggugcccuggggccagcaaggcagucccaggccugccguc

SEQ ID NO: 19520 - RNA, 64 nt, Human
ggcauuuuugguuuuuagcuuguucaaaaacagaggccagcacagaugacauuuuagauacacu

SEQ ID NO: 19521 - RNA, 64 nt, Human
ccacgcccuccaaacagagcaacaacaaguacgcggccagcagcuaccugagccugacgcccga

SEQ ID NO: 19522 - RNA, 64 nt, Human
uacuucucuugcugagagccgaugcccguccccgggccagcagggaugggguuggggagguucu

SEQ ID NO: 19523 - RNA, 64 nt, Human
ugccacagcaaggcugucggggucaagcuggaaaggccagcagccuuccaguggcuucucccaa

SEQ ID NO: 19524 - RNA, 64 nt, Human
gaccccaggcugaacagaccacugcaucucacugggccagcagcccccccagcccccagccuug

SEQ ID NO: 19525 - RNA, 64 nt, Human
agagucaggguaacacacaccaagaguggagugcggccagcaaguuugagaccugcccgcccuc

SEQ ID NO: 19526 - RNA, 64 nt, Human
cguuuugaagacguggacuccucuugguggguguggccagcacaccaaguggcugggugcccuc

SEQ ID NO: 19527 - RNA, 64 nt, Human
aguaggcaacuguuauggcaguggguccagcccaggccagcacugccagccuccucucccugca

SEQ ID NO: 19528 - RNA, 64 nt, Human
ucuggggccagcauuuggccaagcucggaggcuuggccagcacugcuggauggcucagagcaag

SEQ ID NO: 19529 - RNA, 64 nt, Human
gaggugaggggcgggagaagguugucuccucuggggccagcauuuggccaagcucggaggcuug

SEQ ID NO: 19530 - RNA, 64 nt, Human
aaggccacaggcaugagggaggcguggaccacugggccagcaccgcugaguccuaagacugcag

SEQ ID NO: 19531 - RNA, 64 nt, Human
gugauguggugcgugugaaucugugggcgcccaaggccagcagccauaucuggcaagaagcugg

SEQ ID NO: 19532 - RNA, 64 nt, Human
auuaggagugcugauaagaaugaauauagaugcuggccagcauuuucauucauuuuaaggaaag

SEQ ID NO: 19533 - RNA, 64 nt, Human
cccaaguggacguuaggccaggccuuaucugaaaggccagcagcugaugcuguacuaacccagu

SEQ ID NO: 19534 - RNA, 64 nt, Human
ggugcuguggacauguggguggagaagggaggguggccagcacuaguaaaggaggaauagugcu

SEQ ID NO: 19535 - RNA, 64 nt, Human
auugcucucacuccccuuggcuguugugcuucauggccagcacucuugaugagggucuuggucu

SEQ ID NO: 19536 - RNA, 64 nt, Human
aggccuugcuauggaugcgcuuaaucaccauggaggccagcaauacccaucucagcauggcuuu

SEQ ID NO: 19537 - RNA, 64 nt, Human
aaguaaucaaaaccacaaaugcauuugguuuuugggccagcaauuccacuucuaggaauguaca

SEQ ID NO: 19538 - RNA, 64 nt, Human
gaguggcagcuauaggaaauuaucaacauaccuuggccagcaaguuagagaaucuggcaaugga

SEQ ID NO: 19539 - RNA, 64 nt, Human
agacugggccccacauggcuuagagaggcuugaaggccagcagcuggguuggggguggugguca

SEQ ID NO: 19540 - RNA, 64 nt, Human
caaucauuuggcuaguaaaggagcccagccaacuggccagcagcuucagcucaucacagcuuug

SEQ ID NO: 19541 - RNA, 64 nt, Human
ucuggucaccaugugucuaucugaagguugcacuggccagcaugggccugucccaagcgagagg

SEQ ID NO: 19542 - RNA, 64 nt, Human
cuuccuucugcccaaguaaagugaccaugccaguggccagcacugggggcacaccugugauggg

SEQ ID NO: 19543 - RNA, 64 nt, Human
auggguaugagguuugaacacugaggacugacagggccagcaacguggagguuuaggggcuccc

SEQ ID NO: 19544 - RNA, 64 nt, Human
gcggcacugcaaagagacgcuucaaguggggagaagcggcgauaccauagaguccagaucuugc

SEQ ID NO: 19545 - RNA, 64 nt, Human
cgcugcucggaggcaucugugcgaaggugcagcuagcggcgacccaguguacgucccgccccgg

SEQ ID NO: 19546 - RNA, 64 nt, Human
acaaaaccaaacacccggacgacccucuccggugagcggcgaagacagcccgguaggcugcguc

SEQ ID NO: 19547 - RNA, 57 nt, Human
ugacgggacgacacaucugaggaagacagcggcgaguuuucugaagagaugagugcu

SEQ ID NO: 19548 - RNA, 64 nt, Human
gaaugguaaccauggcaauaguuacagcauugccagcggcgaauaccugagcaacugugugcaa

SEQ ID NO: 19549 - RNA, 64 nt, Human
agccacuccugaagccccgggaggagaggaaggcagcggcgaacgccaggcucugggcuccggc

SEQ ID NO: 19550 - RNA, 64 nt, Human
guguuuuggaaaagcaguauggugugucaugucuagcggcgaacacuucccucccuguccuuga

SEQ ID NO: 19551 - RNA, 64 nt, Human
cucagauugcacagagcuagacucgggcagccagagcggcgagcugaguaacagggguaacacc

SEQ ID NO: 19552 - RNA, 64 nt, Human
ccagccuacugccucuccagcacuucucucuucaagcggcgacccccuacccucccagcgaguu

SEQ ID NO: 19553 - RNA, 64 nt, Human
aggugcauacuguucugcuuuuccaauaaauacgagcggcgauuucaaccacaacagugagaug

SEQ ID NO: 19554 - RNA, 64 nt, Human
cugcugccugccacagccucugugacugcaguggagcggcgaauucccuguggccugccaugcc

SEQ ID NO: 19555 - RNA, 64 nt, Human
cacccuggacguggauggcgccagugacuccggcagcggcgaugagggcgagggcgcggggagg

SEQ ID NO: 19556 - RNA, 64 nt, Human
cccccuccccggcacccucuggccgccuaggcucagcggcgaccgcccuccgcgaaaauaguuu

SEQ ID NO: 19557 - RNA, 64 nt, Human
cagggcaggcggggucccuggagcccugguguggagcggcgagucccggggcggugccugucuc

SEQ ID NO: 19558 - RNA, 64 nt, Human
uucuggucugcaugacacuaagacgcuuguccacagcggcgacccaggccuccaagcuugcaca

SEQ ID NO: 19559 - RNA, 58 nt, Human
ugcgcccgccguuuucgugagcccgagcagcggcgagcccagggcgccgggcggccgg

SEQ ID NO: 19560 - RNA, 64 nt, Human
cccuccucggacagccagcugcacccgcccacccagcggcgacauuguacagacuccucucacc

SEQ ID NO: 19561 - RNA, 64 nt, Human
agggagcggagcaaggacaaggaccgggaccggaagcggcgaagcagccggagucgggagcggg

SEQ ID NO: 19562 - RNA, 64 nt, Human
cucugcgauguacauaacuauuuaaugcagcggcagcggcgacagccuucccugagaggacuua

SEQ ID NO: 19563 - RNA, 64 nt, Human
auguucuuuaaaauucaacacccaccaggcucuaagcggcgaucugugcuaagaggucaggacc

SEQ ID NO: 19564 - RNA, 64 nt, Human
ccccaaacccacgcguguucugaaggugcccaggagcggcgaugcacucgcacugcaaaugccg

SEQ ID NO: 19565 - RNA, 64 nt, Human
gaagggcccuucaggucaccaaacauccaccuggagcggcgagcuagaggccuguuggcuugug

SEQ ID NO: 19566 - RNA, 64 nt, Human
cacucguuuccccagugucauucaauaugcucuaaacgacgagguaaugcugaggcuauugcug

SEQ ID NO: 19567 - RNA, 64 nt, Human
ucucuugcccaucucuccggccaccccgccaggaaacgacgagaaggccgaggaauccucagag

SEQ ID NO: 19568 - RNA, 64 nt, Human
cagccgaccaagauugacuaguuuguuggacuuaaacgacgauuugcugcugugaacccagcag

SEQ ID NO: 19569 - RNA, 64 nt, Human
gcugggcacucccugagacccaaagacccaccucaacgacgaguggcguugagccacuucccuu

SEQ ID NO: 19570 - RNA, 64 nt, Human
gaccgagcuccuuccccaucauuucuccuuggccaacgacgaggccagccagaauggcaauaag

SEQ ID NO: 19571 - RNA, 64 nt, Human
gcgggcucugcgugcgcaccgcgccuacacgcccaacgacgagugcuucuucaucuuccuggac

SEQ ID NO: 19572 - RNA, 64 nt, Human
gaguugauuauuucaacaguauugguuaagucacaacgacgaagugcugagaagguuaugggua

SEQ ID NO: 19573 - RNA, 64 nt, Human
aguuuaguauaauuccucucacuuacugaaauacaacgacgacgacugcaaaguguaugcacac

SEQ ID NO: 19574 - RNA, 62 nt, Human
cugauuuucuugacuguagguuuaagacgcuaaacgacgaaaacuccagucaccuccucuac

SEQ ID NO: 19575 - RNA, 64 nt, Human
cuuguauuuuucuuccuuuuuuuguaauauugaaaacgacgauauaauuauuauaaguagacua

SEQ ID NO: 19576 - RNA, 64 nt, Human
gagagaauacacguggcuauaacaucuauaacaaaacgacgauuccucuacaagaggcuguuuc

SEQ ID NO: 19577 - RNA, 64 nt, Human
ucagagcauccugaagccccauucuccgacuuacaacgacgagggacuuugaugggcugggccc

SEQ ID NO: 19578 - RNA, 64 nt, Human
gcucagccucggccgucugcccugcacuaccaaggccgaccacuagaggucagcgucgcgccgc

SEQ ID NO: 19579 - RNA, 64 nt, Human
gaagaauuacacuggccuuuguuuuucuggaaaugccgaccauggagaugcuuuagagucuucu

SEQ ID NO: 19580 - RNA, 64 nt, Human
aagggaauauugaggaaucaucuagaacaauuaagccgaccaggaaaccucauuccuaccuaca

SEQ ID NO: 19581 - RNA, 62 nt, Human
uuugcacguuucgaucccaaaggcccuuuuuagggccgaccacuugcucaucugaggaguug

SEQ ID NO: 19582 - RNA, 64 nt, Human
agcgugaaauuagagcuggacuuaagacucauuggccgaccauccuguguccuggccuggcccu

SEQ ID NO: 19583 - RNA, 64 nt, Human
gcggcuccagauagauggggaugccgggcuccaggccgaccagcacuugggaucugaugggaca

SEQ ID NO: 19584 - RNA, 64 nt, Human
ugacagagccaaaugagggcugcaguugcugagggccgaccacccaugccaagggaauccaccc

SEQ ID NO: 19585 - RNA, 64 nt, Human
guuugcuaaugcugcuuugcaaauaaaacuugcugccgaccacccacgggcauaaaaucaagug

SEQ ID NO: 19586 - RNA, 64 nt, Human
gguuucgcgcugcuccugaccgcggugaggccgcgccgaccaucucugcacugaagggcccucu

SEQ ID NO: 19587 - RNA, 64 nt, Human
cccucuaggcccugugccuggaggugccuccacagccgaccagcagccaccccgccugcuucau

SEQ ID NO: 19588 - RNA, 64 nt, Human
uccuccuuccucugaguugaccagcagcaggucugccgaccaccagcaccauccucuccuccca

SEQ ID NO: 19589 - RNA, 64 nt, Human
caaagugcugggauuccaggugugagccgcugcggccgaccacauuugauguuugaaguuguaa

SEQ ID NO: 19590 - RNA, 64 nt, Human
ccugcugugauuaacgaguaacuccaaguacaaggccgaccacaauggaugcugcaaaaacguu

SEQ ID NO: 19591 - RNA, 64 nt, Human
ccccagcacauacucccauaguguccuagguccagccgaccauuccuuauucucuucuaucucc

SEQ ID NO: 19592 - RNA, 64 nt, Human
ggcagcguacuucuaacucauuguuucccucauggccgaccagggcggggauagcaugcccaau

SEQ ID NO: 19593 - RNA, 64 nt, Human
cccagaaggcagggaaaggcucugaaagccagcugccgaccagagccccacacggaggcaucug

SEQ ID NO: 19594 - RNA, 64 nt, Human
uucucaugacagcuccaucaagaaugugggaugugccgaccaaggauuugagaaaguuguacag

SEQ ID NO: 19595 - RNA, 64 nt, Human
gucugucuugcccgccugcccgccugccccuccugccgaccacacggaguucagugccugggug

SEQ ID NO: 19596 - RNA, 64 nt, Human
cccguggaaugcucaccacauguuggucgaagcggccgaccacugacuuugugacuuaggcggc

SEQ ID NO: 19597 - RNA, 64 nt, Human
gggacccagagcgagauggguuuguucggugccagccgaccaagauugacuaguuuguuggacu

SEQ ID NO: 19598 - RNA, 64 nt, Human
uaucucccaccuaaaauagagaauguugucuuuugccgaccaggagcacuacagauugagcuuu

SEQ ID NO: 19599 - RNA, 64 nt, Human
ucacgauugcugaagccugagcaggucucugugggccgaccagaggggggcuucgagguggucc

SEQ ID NO: 19600 - RNA, 64 nt, Human
uucgggcgucugugugcgcucuguggaugccagggccgaccagaggagccuuuuuaaaacacau

SEQ ID NO: 19601 - RNA, 64 nt, Human
acccuucgcccagcaccgcgguuccgcuuugggagccgaccauccucgcaguugcaugugacag

SEQ ID NO: 19602 - RNA, 64 nt, Human
uuccuugccccugacauuuggacucuucccuugggccgaccacucuguucucauucuccuuccc

SEQ ID NO: 19603 - RNA, 64 nt, Human
gccaacgcccccucuguccuucccuggcccugcugccgaccaggagcugcccagccugugggcg

SEQ ID NO: 19604 - RNA, 64 nt, Human
ugaagaagaaagacaugguauuuguucagcagacgccgaccacucagacggaggggccccuggg

SEQ ID NO: 19605 - RNA, 64 nt, Human
aaaugaggaggcuguuuuccucugauucuccucggccgaccaccuguccaaugcugcugguuuc

SEQ ID NO: 19606 - RNA, 64 nt, Human
gcugcacuacagcccuggccuccacccccaccccgccgaccauccaagggagagugagaccugg

SEQ ID NO: 19607 - RNA, 64 nt, Human
cuauuaugcagcuuauuuuaccugaaacuguuaagccgaccaagaucccucccugcaagacaga

SEQ ID NO: 19608 - RNA, 64 nt, Human
gagccuguuggcaagagcugguauucccugcccagccgaccaaaugaccucugcauucuucagg

SEQ ID NO: 19609 - RNA, 64 nt, Human
augcggcuucucugccauuagcagcccugggcgggccgaccacacucgaggcugcggugcuacg

SEQ ID NO: 19610 - RNA, 64 nt, Human
ucccagccacgcagggccauccacugugacgucggccgaccaggcuggacacccucugccgagu

SEQ ID NO: 19611 - RNA, 64 nt, Human
cugccagacacugcgccccgccugaccugggggagccgaccaauuagucacugcugcuacugcc

SEQ ID NO: 19612 - RNA, 64 nt, Human
cucugcagugcaggagucacugauugaugggugugccgaccagcagcuucacaaaugucugcug

SEQ ID NO: 19613 - RNA, 64 nt, Human
aaaaaaagacaaaaaaaaaaaagccaagccgugagccgaccagaaggccguccucuuugauauc

SEQ ID NO: 19614 - RNA, 64 nt, Human
cacacccagcaggcgcaaccagagucucgugugugccgaccacaggagccaagccuuuuccacu

SEQ ID NO: 19615 - RNA, 64 nt, Human
cgcccucccggagagguggccgccaugcuucugugccgaccacgccccaggaccuccggagcgc

SEQ ID NO: 19616 - RNA, 64 nt, Human
ucgcauugcuguugaauggugagcacgugaccaugccgaccacaaaggugucugcggaaacucg

SEQ ID NO: 19617 - RNA, 64 nt, Human
ucugguccccugcuuuuugagguuggguuaaaaugccgaccauggcagaggggucacagcucag

SEQ ID NO: 19618 - RNA, 64 nt, Human
gguucaggagaccggccuguuccugaguuugagugccgaccaacccccaggauggcggaagcuc

SEQ ID NO: 19619 - RNA, 64 nt, Human
aaugccugcuauaaaaauuugaaauauuagaauggccgaccauggcagugaccaggccucacua

SEQ ID NO: 19620 - RNA, 64 nt, Human
gcuggcugaggugcaugggccccacacaggacagcuggagaaugggccguccacuuggccucgu

SEQ ID NO: 19621 - RNA, 64 nt, Human
ccggccccccagagaaaugagcuccugcuggcaucuggagaacaccccugugccugggacaggg

SEQ ID NO: 19622 - RNA, 64 nt, Human
ggugauccaccuugugaugguuaauauuaggugucuggagaagguugcuucauuggcccuggga

SEQ ID NO: 19623 - RNA, 64 nt, Human
cagccagagaaugcccacugccuguaacagccaccuggagaacuucauaaagaugucucacagc

SEQ ID NO: 19624 - RNA, 64 nt, Human
ccccuggcagcaguauuggaggggcuacaggcagcuggagaaaggggcccagccgcugacccac

SEQ ID NO: 19625 - RNA, 64 nt, Human
uguuuuuucuacaaaaguccauaaaaugugaaaacuggagaagaucuuagagguugaagcccac

SEQ ID NO: 19626 - RNA, 64 nt, Human
ggaccugauucuggccacaccccccuucagccgccuggagaaguuguauagcacuauggugcgc

SEQ ID NO: 19627 - RNA, 64 nt, Human
gcgcuuguaaucccagcuacuugggaggcugaggcuggagaaucgcuugaacccaggaggugaa

SEQ ID NO: 19628 - RNA, 64 nt, Human
cagagcuggggauuuccugccuggaacaagggaccuggagaauguuuuugcgugggaugaugug

SEQ ID NO: 19629 - RNA, 64 nt, Human
gucuugagacaugggguuuggcugucuugcaggacuggagaagguggugguucuagcuuggucu

SEQ ID NO: 19630 - RNA, 64 nt, Human
gugagguccucauucuccagccagccucucugcccuggagaaucaugugcuauguucuaagaau

SEQ ID NO: 19631 - RNA, 64 nt, Human
cgccgucugcccuguccaucuguccguccguucccuggagaagacacaaggguauccaugcucu

SEQ ID NO: 19632 - RNA, 64 nt, Human
cuccauccuguccccaaggacucacauacagugccuggagaaagccaaagaccuuuauuucuuc

SEQ ID NO: 19633 - RNA, 56 nt, Human
caguugaguuuggcucuuagagaaaucuggagaacuauaccugcuucagugaaaua

SEQ ID NO: 19634 - RNA, 64 nt, Human
ucaucagcuccccacaccagucaaggcuucucagcuggagaaccggggagcagcuggacaccca

SEQ ID NO: 19635 - RNA, 64 nt, Human
gaauuuagaucuuauauugguuugcacaaguucccuggagaaaaaaauugcucuguguauaucu

SEQ ID NO: 19636 - RNA, 64 nt, Human
agaaugucauucaucaauaaaccaaagccaauagcuggagaauugagaucugguugaaaguggu

SEQ ID NO: 19637 - RNA, 64 nt, Human
gcugagagguuccagcaaaagcuugaagucuugccuggagaaucccucugcucuggugucagga

SEQ ID NO: 19638 - RNA, 64 nt, Human
uuaccugaaauuggcuucuuuuuauugggcuucucuggagaauuucucccacuccccaccucug

SEQ ID NO: 19639 - RNA, 64 nt, Human
ggaaaguugguuuuguaaaauuccauggaucuugcuggagaagcauccaaggaacuucaugcuu

SEQ ID NO: 19640 - RNA, 64 nt, Human
aaaccuguaaauaugaaagaacaaagguuauuuccuggagaaaagacaauuuauucaacaccaa

SEQ ID NO: 19641 - RNA, 64 nt, Human
auccuuucucugacuuaggaaccagcgcccccugcuggagaaguuuuuucauuuuguuagccga

SEQ ID NO: 19642 - RNA, 64 nt, Human
caucagcccugaaaagccaaauucaaccacauggcuggagaaucauuugucauggccccgccuu

SEQ ID NO: 19643 - RNA, 64 nt, Human
uuaauugaagcaugauugugguaauucgagccaucuggagaaugcucuggggaguacaccaggc

SEQ ID NO: 19644 - RNA, 64 nt, Human
gggccggcccccuuccuggccccucauggcgggacuggagaaaugguccgcuuuccuggagcca

SEQ ID NO: 19645 - RNA, 64 nt, Human
uccuucaagguggcagcuguuagggcugaaucuucuggagaaaaaggugccaucucaggagaau

SEQ ID NO: 19646 - RNA, 64 nt, Human
auauccuucugcauccuuuggccaauaaaaguugcuggagaaccaaaccauggugguucuuaau

SEQ ID NO: 19647 - RNA, 64 nt, Human
ugugggggauggaggcgcguuugcucccaacauccuggagaauaaagaaggccuggagcugcug

SEQ ID NO: 19648 - RNA, 64 nt, Human
uagaguaauauauauucagaauaauaaacucaagcuggagaaaugaguccugauagacugaaaa

SEQ ID NO: 19649 - RNA, 64 nt, Human
gcucacuggcaggugugggaucuggggagagcggcuggagaaagaugcaguccucaggaagggg

SEQ ID NO: 19650 - RNA, 64 nt, Human
ggaagaagaaagaggaagcgcugaauuaucugaacuggagaagcaauaaaaauuaaagugaagg

SEQ ID NO: 19651 - RNA, 64 nt, Human
cagggaguccagcccuaccuucuucccuuggcagcuggagaaaucugguuucaauauaacucau

SEQ ID NO: 19652 - RNA, 64 nt, Human
uggccccugguggcuugcaaaauuguuggaagagcuggagaagcagacucugcugaauuuccag

SEQ ID NO: 19653 - RNA, 64 nt, Human
cuucuugggccugccucuuaaaggccugagcuagcuggagaagaggggaggguccauaagccca

SEQ ID NO: 19654 - RNA, 64 nt, Human
cagcaucugagaccaaacugcagaggggagccuucuggagaagcugcugggaucggaccagcca

SEQ ID NO: 19655 - RNA, 64 nt, Human
cuguccagggccucacagggaggcauucauggagcuggagaaaccagggauccugaccgcaggg

SEQ ID NO: 19656 - RNA, 64 nt, Human
ccaccacugaguccacucggagugcccuguguuccuggagaaggcauuccaggguugaaucuug

SEQ ID NO: 19657 - RNA, 64 nt, Human
cuuuugcuucuuucugucuuuccuucucuuuugucuggagaaaucacuuagacucugugugccu

SEQ ID NO: 19658 - RNA, 64 nt, Human
gagaccaugggaaaugggguggauuaggauugagcuggagaagacuuaaacucucuggguugaa

SEQ ID NO: 19659 - RNA, 64 nt, Human
cugugccuucacucauagugugccuucuuagcugcuggagaauuuggggagaggauguacacag

SEQ ID NO: 19660 - RNA, 64 nt, Human
ugauggacaggucccccuccuccauucuugcccucuggagaagugguuccugcaguguagagau

SEQ ID NO: 19661 - RNA, 64 nt, Human
gugccaucucaauugugcuuuguaucagucagugcuggagaaaucuugaauagcuuauguacaa

SEQ ID NO: 19662 - RNA, 64 nt, Human
aguauaucagugagaggugacuccacagugcucucuggagaagcaauaugagugacugaagagu

SEQ ID NO: 19663 - RNA, 64 nt, Human
caagacccuuuuggguuucugcccugcccacccucuggagaaggugggcacuggauuaguuaac

SEQ ID NO: 19664 - RNA, 64 nt, Human
uguuauuuauuauuguaauuucaguuugccucuacuggagaaucucagcagggguuucagccug

SEQ ID NO: 19665 - RNA, 64 nt, Human
ccagcucucuguggaaacccccgaggaguuggaucuggagaacagcugggccuccucacucagg

SEQ ID NO: 19666 - RNA, 64 nt, Human
cagaaacuccccguuuugcugacucauuccauaacuggagaaagaagcuccauugaccgaagcc

SEQ ID NO: 19667 - RNA, 64 nt, Human
ugacucauuuaaacuuugaugcuuaguuauguugcuggagaaaagauacuuauguuuugcucau

SEQ ID NO: 19668 - RNA, 64 nt, Human
uuuggguaaacgugugacgggggaaagccaaggucuggagaagcucccaggaacaaucgauggc

SEQ ID NO: 19669 - RNA, 64 nt, Human
uaacuugauuaaucaaccagaccaauuuugacgucuggagaacuuauaaacucaauauguuaua

SEQ ID NO: 19670 - RNA, 64 nt, Human
cauuguaaagauugccuuuguucugucuaaaagucuggagaaaucccaaagacuuuuccuaugu

SEQ ID NO: 19671 - RNA, 64 nt, Human
ccaacugaaacauauaacguuuucaucuccuuuccuggagaaagcagcugcagagguucuguau

SEQ ID NO: 19672 - RNA, 64 nt, Human
cugcaccgcagcuugccaucccugcccuucuguccuggagaagagacuggugcuucuccgcaca

SEQ ID NO: 19673 - RNA, 64 nt, Human
uggccuggcccugcaguaagaagcgugucugggucuggagaagggugcuuccgagagugugcag

SEQ ID NO: 19674 - RNA, 64 nt, Human
gauuugaggagguuugcacauguagagaagcauacuggagaagcauauccagagggcgaaagau

SEQ ID NO: 19675 - RNA, 64 nt, Human
augccugaaaucccacuacuuugggaggcugaggcuggagaauugcuugaggcuagugagcugu

SEQ ID NO: 19676 - RNA, 64 nt, Human
caguuuauacucuuaauuuaauuuucuuucugagcuggagaacuggcuuugcacuuugguuaca

SEQ ID NO: 19677 - RNA, 64 nt, Human
aaacaauaaagacuuuaccugucuaauggaaaaccuggagaagucgucaggaaccagacuacag

SEQ ID NO: 19678 - RNA, 64 nt, Human
ggagaagucgucaggaaccagacuacaguggacccuggagaaccuugaagaacauuuuuccuuu

SEQ ID NO: 19679 - RNA, 53 nt, Human
agaaacgugaagaauuaugaucucuggagaaggacaggaaaucaccccauuug

SEQ ID NO: 19680 - RNA, 64 nt, Human
guuucucuuaugauuuaauucaacuaaaauucuacuggagaagugggacugcuuuauauuuucc

SEQ ID NO: 19681 - RNA, 64 nt, Human
uuaaaaagaguugccuauugaaaugaucauguuucuggagaaauuaagcuuauagacagcaugu

SEQ ID NO: 19682 - RNA, 64 nt, Human
gagaccucuggucagcaaacuggaacucaguaaacuggagaaauaguaucgaugggagguuucu

SEQ ID NO: 19683 - RNA, 64 nt, Human
ucacguuaaugguauaauuuuuuuuuuuuaauaucuggagaacauuaauaacaaguuaaauuau

SEQ ID NO: 19684 - RNA, 64 nt, Human
cuggugccuuuuuaaauaaauugcugaaauuuggcuggagaacuuuuagaagaaacagggaaau

SEQ ID NO: 19685 - RNA, 64 nt, Human
ucuugaaaugaaaguauaacugaguuaaauuauacuggagaagucuuagacuugaaauacuacu

SEQ ID NO: 19686 - RNA, 64 nt, Human
uuggaauguacccaucugaaucaaaugcaaacuucuggagaaaacagagugccucuucccagau

SEQ ID NO: 19687 - RNA, 64 nt, Human
uaccagaauuauacuugaaaauacaguuggugcacuggagaaucuauuauuuaaaaccacucug

SEQ ID NO: 19688 - RNA, 64 nt, Human
uacucugaaacaugguggccugagagaagaagagcuggagaaaaugaaagaagagcgugaaagg

SEQ ID NO: 19689 - RNA, 64 nt, Human
ugaguucuccaaggcccaugaggauaugacugcccuggagaaggauuacaaggaggugggcaug

SEQ ID NO: 19690 - RNA, 64 nt, Human
aggagauugagaaggagagaaagugggugagaugcuggagaagagaggagaggagagaggcaga

SEQ ID NO: 19691 - RNA, 64 nt, Human
ugugggacuugaggacucgggaucuucaggacgccuggagaagggugguuuccugccacccugc

SEQ ID NO: 19692 - RNA, 64 nt, Human
ggacgcggccaccccaggccuuuccagagcaaaccuggagaagauucacaauagacaggccaag

SEQ ID NO: 19693 - RNA, 64 nt, Human
gacagcaccagcgggacagcccacaaggcuggggcuggagaaugagagacugcgcucucuuggg

SEQ ID NO: 19694 - RNA, 64 nt, Human
gaucguucucugccucacauagcuuacaagccagcuggagaaauaugguacucauuaaaaaaaa

SEQ ID NO: 19695 - RNA, 64 nt, Human
aagaugcagaacaaaauggauaaaagguauuucacuggagaaguuuuaauuucuaaguaaaauu

SEQ ID NO: 19696 - RNA, 64 nt, Human
ggauugauggaagaaaagagaaccucauccaugccuggagaacaucuagaaaaccuucagccag

SEQ ID NO: 19697 - RNA, 64 nt, Human
uuuggcuggucuuucaauuuucuuaagaggggaacuggagaaaccuugcuaaagguuuuagcuu

SEQ ID NO: 19698 - RNA, 64 nt, Human
aaaguauucuguugggaucugggcuuccucacuucuggagaaguggccaucccaugcccaccug

SEQ ID NO: 19699 - RNA, 64 nt, Human
auuaaaaccagcccagggauguguaaaccugcaucuggagaauaagacauuucuuuuugguuaa

SEQ ID NO: 19700 - RNA, 64 nt, Human
augccugaaaucccacuacuuugggaggcugaggcuggagaaucgcuugaggcuagugagcugu

SEQ ID NO: 19701 - RNA, 64 nt, Human
gagcggaguuguuaaggacugaagaaaaacuucucuggagaaaaauaaaauugcaauucuacuu

SEQ ID NO: 19702 - RNA, 64 nt, Human
acaaaaacagaaacuucucaggaaauuagaucgacuggagaagaaaaaaaagaaaaaagauaga

SEQ ID NO: 19703 - RNA, 64 nt, Human
aaagaaccaaauguaaauuuccuuagagaccauccuggagaagacaguucuaaaucggggcuug

SEQ ID NO: 19704 - RNA, 64 nt, Human
agccaccugcacaccuggaagccaaugaagggaacuggagaacucagccuucaucuucccccac

SEQ ID NO: 19705 - RNA, 64 nt, Human
aagcugcauuguuggguaaaagccccguggagugcuggagaaaugcacuagcagagugcaggau

SEQ ID NO: 19706 - RNA, 64 nt, Human
ugaggguccagaagggccagggccuggcacccaccuggagaagcccccgcacccgagggaaccc

SEQ ID NO: 19707 - RNA, 64 nt, Human
uugacaacugaagagacacguggcuaggguuccacuggagaauugaaaaggacucuugagcccu

SEQ ID NO: 19708 - RNA, 64 nt, Human
cccugauagaccaaucagcugugucgcacuuaaacuggagaaguuacacugaaguauaaucaca

SEQ ID NO: 19709 - RNA, 64 nt, Human
ugcuccuuucuguaccagguuuaaauguagucuucuggagaaguauuuuugacauugagcucug

SEQ ID NO: 19710 - RNA, 64 nt, Human
aggcuccgccccagcccucagccccaggccccagcuggagaaaaaacauugcccagggauuagg

SEQ ID NO: 19711 - RNA, 64 nt, Human
aaacaggacagcagcucugcuagcuuggcuagugcuggagaaaguaccgggaagaaggaggugg

SEQ ID NO: 19712 - RNA, 64 nt, Human
uuauuagaaacagaguuucaccauguuggccaggcuggagaauugcuguaauaguuuuccaacu

SEQ ID NO: 19713 - RNA, 64 nt, Human
uccuagcaacagauuucucugguugucaguuucccuggagaaggcgccagauaggaaucuccaa

SEQ ID NO: 19714 - RNA, 64 nt, Human
cggcaaaucuauguuuaaauggaaaaucgucuaacuggagaagggcgguauccaccccacauuc

SEQ ID NO: 19715 - RNA, 64 nt, Human
gcaccagccaggguaugauggcuacuacccuuuucuggagaaccauagacuucccuuacuacag

SEQ ID NO: 19716 - RNA, 64 nt, Human
gccaagauucugaguuuuacuaccaggcugaaugcuggagaaaacuggcuaucaucuuucagaa

SEQ ID NO: 19717 - RNA, 64 nt, Human
gcagagucugagggucccggggcccgguuggcagcuggagaaagaggcaaaaagcccguagccg

SEQ ID NO: 19718 - RNA, 64 nt, Human
cccaucuucagcaguugcuaguccauucuccauucuggagaaucugcuccaaaaagcuggccac

SEQ ID NO: 19719 - RNA, 64 nt, Human
auaacaucucaagaaaaggagaaggaaaguguuucuggagaauguucuuucacaucacuggaau

SEQ ID NO: 19720 - RNA, 64 nt, Human
aacuagaauauccucagcagguggccuggccacucuggagaaagaaacccaaggaaagugagca

SEQ ID NO: 19721 - RNA, 64 nt, Human
accucggcaagaucaccagcacugaggggcccagcuggagaaugauucugcuacaaaaggagac

SEQ ID NO: 19722 - RNA, 64 nt, Human
cauauaaauuuuuguucauuuagaacugaguauucuggagaaaaccaauggucagcacuuuugg

SEQ ID NO: 19723 - RNA, 64 nt, Human
aauuagaaauaaagcuguucaacuugaaaaugagcuggagaauuuuacuaagcaguuucuaccu

SEQ ID NO: 19724 - RNA, 64 nt, Human
uccccaaagaagguuuaaaauguacuaauaaaaacuggagaaauaggaauuugugaacuccuaa

SEQ ID NO: 19725 - RNA, 64 nt, Human
auugaaugaggaccagugagcggagugaggugcccuggagaagcaggcuuugaaggcacagcga

SEQ ID NO: 19726 - RNA, 64 nt, Human
uccagcagccccagagaccagaacugauccagagcuggagaaagaagccgaaggcucuuaggga

SEQ ID NO: 19727 - RNA, 64 nt, Human
uuggaguuguuagcaauuucauucaaaaugccaacuggagaagucuguuuuuaaauacauuuug

SEQ ID NO: 19728 - RNA, 64 nt, Human
ucagggcugggccaugugguugauuuuucuaaagcuggagaaaggaagaauugugccuugcaua

SEQ ID NO: 19729 - RNA, 64 nt, Human
ggccaggauagccaagcccugggugagcgagaggcuggagaacacaggagcucacccagggcug

SEQ ID NO: 19730 - RNA, 64 nt, Human
uccgcuggcuuugaaucuuccucugggcucuacucuggagaacauaagggcugcugugguugag

SEQ ID NO: 19731 - RNA, 64 nt, Human
uggccgaugugcauaucaacauuuauacauggaacuggagaacauugugccaauaaucauuuaa

SEQ ID NO: 19732 - RNA, 64 nt, Human
acuuccccuucucccauccugaacauuuguaccccuggagaaguuccuuagcagggaggaggaa

SEQ ID NO: 19733 - RNA, 64 nt, Human
gagcaccaggucucaucuugcaucucauccuggccuggagaacauucaguuuccuuccaacccu

SEQ ID NO: 19734 - RNA, 64 nt, Human
aaaugucaaauacaugaguaucucccuccauggacuggagaauugaaaaauugguuuguauauu

SEQ ID NO: 19735 - RNA, 64 nt, Human
guagggagaggguggauuugugcagggugcagcucuggagaagaagcuggaucacucuuggucc

SEQ ID NO: 19736 - RNA, 64 nt, Human
aaggcaggagacuacuuuccaacuccuuuugcuucuggagaaggcccugaaaucacauugauau

SEQ ID NO: 19737 - RNA, 64 nt, Human
ggcucugcgagggacggugugugacaugucaugccuggagaaggaacaaggcuauuugaaaaca

SEQ ID NO: 19738 - RNA, 64 nt, Human
cagaaugggcaugaccuucagcucacgagcacaccuggagaaauucagaaccagguucugaauc

SEQ ID NO: 19739 - RNA, 64 nt, Human
ucaaaaccuccaccugcccaugcugcuugcaucccuggagaaucuucuguggacaucgaccucu

SEQ ID NO: 19740 - RNA, 64 nt, Human
aaccaaaacuccuguucugaaacugauuagaagccuggagaagauggagauuacuuguuacuua

SEQ ID NO: 19741 - RNA, 64 nt, Human
aacacauacuccuuaauuuaccuguuguuggaaacuggagaaaugauugucgggcaaccguuua

SEQ ID NO: 19742 - RNA, 64 nt, Human
ggccacgaugaaacagauuucaacugauaaagagcuggagaacuccauguacuuuggaaucucc

SEQ ID NO: 19743 - RNA, 64 nt, Human
gaucaagcucaucgacuuuggucuggccaggaggcuggagaaugcggggucucugaagguccuc

SEQ ID NO: 19744 - RNA, 64 nt, Human
accgggaaagcgcccccucucgagaggcuggucccuggagaacugcgaacgagcugcagaaaac

SEQ ID NO: 19745 - RNA, 64 nt, Human
cagugucauacauauuuguucuccauugauauaucuggagaaaucaaugcuacagccuauagcu

SEQ ID NO: 19746 - RNA, 64 nt, Human
augagcucacuggaaauucauucuaauccccaagcuggagaaacagguuaagagauccuguuuc

SEQ ID NO: 19747 - RNA, 64 nt, Human
gaguuggaaaaaaaauaagauaucaacugccagccuggagaaggugacaguccaagugugcaac

SEQ ID NO: 19748 - RNA, 64 nt, Human
ugguuguuccuaaagcuugcccuuugaguauuaucuggagaacccaagcugucucuggauuggc

SEQ ID NO: 19749 - RNA, 64 nt, Human
cuuugcaaagcacccucaaaagcugcaccacagccuggagaauaaaauauccucagcccugaug

SEQ ID NO: 19750 - RNA, 64 nt, Human
uccuugugcuuugauaacaaagacuccaaauauucuggagaaccuggauaaaaguuugaagggc

SEQ ID NO: 19751 - RNA, 64 nt, Human
gggagaaaccaacaugacgaaaagacaaagaauacuggagaagagagagggugggcagagccac

SEQ ID NO: 19752 - RNA, 64 nt, Human
gauucuggucaacugguggagauuggcugacacccuggagaagccgaaaccagagagccuuuug

SEQ ID NO: 19753 - RNA, 64 nt, Human
uguggaugggccgaccuggcugggacucgugaaucuggagaagagcuggagaauggauaguauu

SEQ ID NO: 19754 - RNA, 64 nt, Human
cgaccuggcugggacucgugaaucuggagaagagcuggagaauggauaguauugucuguauuug

SEQ ID NO: 19755 - RNA, 64 nt, Human
uauuuuuguauuuuuguaauauuuguccacuaagcuggagaagcagccucauacaguugauuuu

SEQ ID NO: 19756 - RNA, 64 nt, Human
aagauauguagaagaaaacauccaucagaaucuucuggagaauauggucagagucuuaaacagg

SEQ ID NO: 19757 - RNA, 64 nt, Human
auuaauaaaauuaugucuaugguauuuucaguuucuggagaaaaauacuuauagacaguuuaac

SEQ ID NO: 19758 - RNA, 64 nt, Human
ugucugacugcaaguuuuuuaaagaaaagaggaacuggagaaacgacuuccauugauguggacu

SEQ ID NO: 19759 - RNA, 64 nt, Human
aucuuuucugauaucucuaaaaugcuguuaaguucuggagaagaacuucaggagaagaagaucu

SEQ ID NO: 19760 - RNA, 64 nt, Human
aggaacaaggcaaggcugucaauuacaggaaguacuggagaaaauggacguguuaugacuccag

SEQ ID NO: 19761 - RNA, 64 nt, Human
uaccaauuguuuauaagauucaucacauaaauuucuggagaaccaccagguuuagcuuggaaau

SEQ ID NO: 19762 - RNA, 64 nt, Human
gguugucuucacccauguauuuugcgaugucacccuggagaauguccaccuuguguucagaugc

SEQ ID NO: 19763 - RNA, 64 nt, Human
gcuggcugcucugggcagcgccuucacucugacccuggagaaccauuucauuucauccugguca

SEQ ID NO: 19764 - RNA, 64 nt, Human
uguuuaugcuugaagugaaauguuuuacuuuucacuggagaagacaaaacagggugaucuucau

SEQ ID NO: 19765 - RNA, 64 nt, Human
caaagcaaaagcuagagaagcaaguggagaaaugcuggagaaagcugcacccuacaggcaacca

SEQ ID NO: 19766 - RNA, 64 nt, Human
caaggaaaggcaggaaugaggguuucagaauucacuggagaaggugugguugcagcccacugga

SEQ ID NO: 19767 - RNA, 64 nt, Human
uucacuggaucagcaaugacgagccuacacaguacuggagaacuuggcauuuucugauauagaa

SEQ ID NO: 19768 - RNA, 64 nt, Human
acgccuguuaucacagcuacuugggaagcagcggcuggagaauugcuugaaccugggaagucga

SEQ ID NO: 19769 - RNA, 64 nt, Human
uacaugauaugcuuuaugcucauaacugauguggcuggagaauugguauugaauuuauagcauc

SEQ ID NO: 19770 - RNA, 64 nt, Human
auauuaauuauuuuccaaaaucuaaaagcuguagcuggagaagcccauggccacgaggaagcag

SEQ ID NO: 19771 - RNA, 64 nt, Human
uccuugcaacaaucaaugagaaucuucauguauucuggagaacaccauuccugauuucccacaa

SEQ ID NO: 19772 - RNA, 64 nt, Human
guguucccuuuaaaaauaagaacaacuguccuggcuggagaaucucacaagcggaccagagauc

SEQ ID NO: 19773 - RNA, 64 nt, Human
uaaaaaucauauauuuuacagauuuauuuuguuucuggagaaggcagcaaacuuuuacuucccu

SEQ ID NO: 19774 - RNA, 64 nt, Human
guccuggcacaguuuuuguaaagcccuugcacagcuggagaaauggcaucauuauaagcuauga

SEQ ID NO: 19775 - RNA, 64 nt, Human
uuaauucccuacaguuuuauggguguuaucagugcuggagaaucauguaguuaaucccauugcu

SEQ ID NO: 19776 - RNA, 64 nt, Human
ugguaagcaaccugggcaucuuaggaagcagucccuggagaaggcauguucccagaaaggucuc

SEQ ID NO: 19777 - RNA, 64 nt, Human
auucuuuccgaccaugaaauagugcauaguuugccuggagaauccacucacguucauaaagaga

SEQ ID NO: 19778 - RNA, 64 nt, Human
ggccaguugugugcaugcucuagacaccaccucgcuggagaagcuggaagggcuguugucuucc

SEQ ID NO: 19779 - RNA, 64 nt, Human
cagcagcccuguaacaagugccuugugagaaaagcuggagaagugagggcagccagguuauucu

SEQ ID NO: 19780 - RNA, 64 nt, Human
gcagcuggaggcugcuguggggaccacacugauccuggagaaaagggauggagcugaaaaagau

SEQ ID NO: 19781 - RNA, 64 nt, Human
agagcaagagcucugggggggccggaaagucucccuggagaaggccguaauaucugggccuugg

SEQ ID NO: 19782 - RNA, 64 nt, Human
ucuggugugggaaugcaggccuaaugacagaaaucuggagaagccagaaauacagauuuguaug

SEQ ID NO: 19783 - RNA, 64 nt, Human
gaagacauugcuaaaagaguuaaaagucauugcucuggagaauuaggagggauggggcagggga

SEQ ID NO: 19784 - RNA, 64 nt, Human
agcaaggucuucaagcucucauuauggacugaaacuggagaaaauucuauggaacuauuaucag

SEQ ID NO: 19785 - RNA, 64 nt, Human
guauuauccuagauccucaggaguagcauggcaacuggagaaaaugggaggaaagacaagaaga

SEQ ID NO: 19786 - RNA, 64 nt, Human
ccaguuaguuggaguuuuuaaaggcucuguuugccuggagaagcaaggagguuagaauguaauu

SEQ ID NO: 19787 - RNA, 64 nt, Human
gaaauuucuggcauaagcaggggaagucuugugucuggagaauagucucauaccuugcagucug

SEQ ID NO: 19788 - RNA, 64 nt, Human
acuccaugcaggggucagugcagcagaggacagucuggagaagguauuagcaaagcaaaaggcu

SEQ ID NO: 19789 - RNA, 64 nt, Human
caacauuaaccugcccaccccacccccgucaucccuggagaauuccagcuuugucguaucucag

SEQ ID NO: 19790 - RNA, 64 nt, Human
aaagaaagcauuguuuuaauugagaggggcagggcuggagaaggagcaaguuguggggagccag

SEQ ID NO: 19791 - RNA, 64 nt, Human
gcgccuguagucccagcagcuugggaggcugaggcuggagaauggugugaacccaggaggcgga

SEQ ID NO: 19792 - RNA, 64 nt, Human
gacgccugaagucacagcuccuuccaagguuuuucuggagaagacagcaggagccucucaguuc

SEQ ID NO: 19793 - RNA, 64 nt, Human
gaacagacccauuucugggagcugcccgagaucacuggagaaggcagccagcagcagcugcacu

SEQ ID NO: 19794 - RNA, 64 nt, Human
ugucugcagaaauuuuguuuccuguacuucauagcuggagaauggggaaagaaaucugcagcaa

SEQ ID NO: 19795 - RNA, 64 nt, Human
ucuuggcaauaaugucaacaccagaaagccuccucuggagaaucuuacagagugauuguaguuu

SEQ ID NO: 19796 - RNA, 64 nt, Human
aagacacacacugcccuaaccucacuccaaaugucuggagaaauguguguagugcuuuuguuaa

SEQ ID NO: 19797 - RNA, 64 nt, Human
auaucuauaucuauaucauauugauuuugucucucuggagaacccugacuaauaaaaugaggca

SEQ ID NO: 19798 - RNA, 64 nt, Human
gagaauuuauuuccuucuccacucucuccaugcccuggagaaaaaaaaguccagaagaaaucau

SEQ ID NO: 19799 - RNA, 64 nt, Human
caaggucccuguaucucugagacaccccgauuggcuggagaauugacuugggagagauaaggag

SEQ ID NO: 19800 - RNA, 64 nt, Human
cucugauccuaacaggccacguuaaacugcccaucuggagaaucgccugcagguggggcccuuu

SEQ ID NO: 19801 - RNA, 64 nt, Human
gaucucucccuucaggcugggauuucacuaagggcuggagaaggggggaauaugggaggauuau

SEQ ID NO: 19802 - RNA, 64 nt, Human
ugucacugcagagaaucugccucgcuguggugcacuggagaacuugguaaaugaugucucugau

SEQ ID NO: 19803 - RNA, 64 nt, Human
uguguagcaucuugucuaucauguuuuguaaauacuggagaagcuuugaccaauuugacuuaga

SEQ ID NO: 19804 - RNA, 64 nt, Human
uaggcuauaagauguaacaacgaaaugaugacaucuggagaagaaacaucuuuuccuuauaaaa

SEQ ID NO: 19805 - RNA, 64 nt, Human
aaaguaauuuuggcaaaauauaagugauuuuuuucuggagaauuguaaaauaaaguuuucuauu

SEQ ID NO: 19806 - RNA, 64 nt, Human
ccauggaggaaggaucccgcuaggcuggucccgacuggagaagcugcucugccaggugugcucu

SEQ ID NO: 19807 - RNA, 64 nt, Human
gggcccuaccauuaggcauacuuucagaagcaaccuggagaacagcuaucaaucauauucaaaa

SEQ ID NO: 19808 - RNA, 64 nt, Human
auugauuuauaaagauuugaaaaucuuuaaugaacuggagaacacuaagauuuaaacucgaaaa

SEQ ID NO: 19809 - RNA, 64 nt, Human
uggagggaaagccagccugggggcugggaggauccuggagaaguggguggggacagaccagccc

SEQ ID NO: 19810 - RNA, 64 nt, Human
agaccugaaucuaaguuaccaucccuuggaaauucuggagaaggagucucaugcaccaccuauc

SEQ ID NO: 19811 - RNA, 64 nt, Human
ccaaaaaauaaaagggggcauaaacuuuauuccacuggagaagcccuggggguggcuggagcca

SEQ ID NO: 19812 - RNA, 64 nt, Human
uccagagcacuggcuuggcguccagcaaugaaggcuggagaaugcagccuggauuccccuacac

SEQ ID NO: 19813 - RNA, 64 nt, Human
uacuuguacucuucuuaugcuaauaugcucugggcuggagaaaugaaauccucaagccaucagg

SEQ ID NO: 19814 - RNA, 53 nt, Human
caaauaacuucauaagaugaacacuggagaagaauaucaaauaauaaaguagc

SEQ ID NO: 19815 - RNA, 64 nt, Human
uuucuacuuuuaguagagagucagaaucucuggacuggagaauaaugaagaaguucacugacug

SEQ ID NO: 19816 - RNA, 64 nt, Human
uaaaaguaguuaaauaacaucagaaacugaguuccuggagaacuacaguuuagcauuccucagg

SEQ ID NO: 19817 - RNA, 64 nt, Human
uuugcuguucuggggggugaaaauagacuaacuacuggagaaacaaagagagaaagaaaaccca

SEQ ID NO: 19818 - RNA, 64 nt, Human
gcuugaaaaaccaagaggauaugaaaaucugucucuggagaaacaaagacgcaggcauacucag

SEQ ID NO: 19819 - RNA, 64 nt, Human
ucaggauuuguaauggagugggaaauguguuucucuggagaagggcacauuuaucuaggggcau

SEQ ID NO: 19820 - RNA, 64 nt, Human
ccccauugucuuauguagaauguggcaaugccaacuggagaaagggaagaaggacauauuaccu

SEQ ID NO: 19821 - RNA, 64 nt, Human
gcugcaaacaacccagaagcccauccucagaagacuggagaaaugauugaggaaugcaugggca

SEQ ID NO: 19822 - RNA, 64 nt, Human
uccucaacuuuuacuaaacauaagguaauucauacuggagaaaagccauacaaaugagaagaau

SEQ ID NO: 19823 - RNA, 64 nt, Human
uccgcaaagcucacugaacauaaguuaauucauacuggagaaaaacccuacaaauguaaagaau

SEQ ID NO: 19824 - RNA, 64 nt, Human
uugucacacuugauuguauauaagauaauucauacuggagaaaacucccagaaguggaguuuuc

SEQ ID NO: 19825 - RNA, 64 nt, Human
cgggaccucuacuugaacaguucuacuggggaggcuggagaacuaaggaaacaccuguacauag

SEQ ID NO: 19826 - RNA, 64 nt, Human
agccagggccacucagcugccccuguccccaccucuggagaauccacccccaccagauuccucc

SEQ ID NO: 19827 - RNA, 64 nt, Human
uuccauccauucuguuacacuuuguauuuucuaacuggagaaaagagugaggaacagaauguuu

SEQ ID NO: 19828 - RNA, 64 nt, Human
agggaccuuggaggaugaaggcgaguaugugacacuggagaaaaguggaccaggcaugucuuuu

SEQ ID NO: 19829 - RNA, 64 nt, Human
gcugcaagugcucacagcucuuguucuccagaaacuggagaauugcccucaggagaugagagcc

SEQ ID NO: 19830 - RNA, 64 nt, Human
uguugggacauguggaccgugagucgcaaacacucuggagaaggcugagaugccaccauuccca

SEQ ID NO: 19831 - RNA, 64 nt, Human
agaaguauagcucuuuuccuaccugaacucuucccuggagaaaagauguuggcauugcugauug

SEQ ID NO: 19832 - RNA, 64 nt, Human
gagaaguuucuggcccuggcugaccccaaagagccuggagaagcugaugcuuugcuucaaaucc

SEQ ID NO: 19833 - RNA, 64 nt, Human
cugcuucaugcucagcccugacuggugcuauaggcuggagaagcucacccaauaaacauuaaga

SEQ ID NO: 19834 - RNA, 64 nt, Human
auuacaguucagagcauugauccuggaaugugugcuggagaaauuuaaaauacugggguuuuuu

SEQ ID NO: 19835 - RNA, 64 nt, Human
agccuacaagccccgagagaaugaugaauuggcacuggagaaagccgacguggugauggugacu

SEQ ID NO: 19836 - RNA, 64 nt, Human
uguaaaauauaucugaaccuaaugguuuguacaacuggagaaucguucuagauuaguuaccaau

SEQ ID NO: 19837 - RNA, 64 nt, Human
gcgcaccaacuucacuaccaagcagcucacggaacuggagaaggaguuccacuucaacaaguac

SEQ ID NO: 19838 - RNA, 64 nt, Human
gcggugccccuauacaaaacaccagacccuggaacuggagaaagaguuucuguucaacauguac

SEQ ID NO: 19839 - RNA, 64 nt, Human
gaauuggcauuucccaauauuugcuaaacauuugcuggagaaaucauuuuucuuuuuucuuuuu

SEQ ID NO: 19840 - RNA, 64 nt, Human
cuccuucuucuccuucuuccacaaagacccauaucuggagaagguguacaacuuucaaacacaa

SEQ ID NO: 19841 - RNA, 64 nt, Human
aagguggcuuuucugcgaguucuucugccuccugcuggagaacagagacccuucaagaggugag

SEQ ID NO: 19842 - RNA, 64 nt, Human
aucaacaggaacuuucucagugagccauucacuccuggagaaugguauaggaauuuggagaggu

SEQ ID NO: 19843 - RNA, 62 nt, Human
aggaaauggugcauucuuaaaagccccagucucuggagaaaagagagaaagggauaaucacc

SEQ ID NO: 19844 - RNA, 64 nt, Human
ucgacaugaguuaacuuugaaauacguaugaauucuggagaauccugaaaaagacggugcuuca

SEQ ID NO: 19845 - RNA, 64 nt, Human
acagcuaccacccuuagggguaauugguaauuaccuggagaagaauggcuuucaauacccuuuu

SEQ ID NO: 19846 - RNA, 64 nt, Human
uuagagugaggcuggagguggcagcuucacagaacuggagaaccaggccaaguccccuccccaa

SEQ ID NO: 19847 - RNA, 55 nt, Human
gugacauccugaaaacuuaagaaaucuggagaauuuucugaagauguaaccagau

SEQ ID NO: 19848 - RNA, 64 nt, Human
ccacuucuugagcuuuaucuuuuuugacaauauacuggagaaacuuugaagaacaaguucaaac

SEQ ID NO: 19849 - RNA, 64 nt, Human
caacaauaaucacaauauauucaucccuucaguucuggagaaagccugauaccaggcacagccu

SEQ ID NO: 19850 - RNA, 64 nt, Human
gaagcugcuucugcccacaccgcagggacaagcccuggagaaaugggagcuuggggagaggaug

SEQ ID NO: 19851 - RNA, 64 nt, Human
gggcauuuccacacgaagccuacucacacccucacuggagaagucaggguagaaauugagccuu

SEQ ID NO: 19852 - RNA, 64 nt, Human
gacucagcagccgcaucugcuaccugauuuuauccuggagaauacagugcaauauuucucuuug

SEQ ID NO: 19853 - RNA, 64 nt, Human
aagaugugaagaccacagucuuggguuuucauaucuggagaagacuauuugccaugacguuuug

SEQ ID NO: 19854 - RNA, 64 nt, Human
aauauuagacacuaauauuuucauagaaauuaggcuggagaaagaaggaagaaaugguuuucuu

SEQ ID NO: 19855 - RNA, 64 nt, Human
acauuccagaaguuaaucauuugaauucugaacacuggagaaaaaccgaaaaauggacggggca

SEQ ID NO: 19856 - RNA, 64 nt, Human
ggccaaaaacaaaauuguaaaggaaauuuaaauucuggagaauucuacaggguugcucuaagaa

SEQ ID NO: 19857 - RNA, 64 nt, Human
gaucgagggccuggccucgcuguugguggcccugcuggagaagaccacgugggucgaccgugug

SEQ ID NO: 19858 - RNA, 64 nt, Human
cuaggagcucaagggcuguuugaaacucaaauggcuggagaagcuacuugaaggcugauuaugu

SEQ ID NO: 19859 - RNA, 64 nt, Human
gcuuuccacggagcaggcuguucugcaagagucgcuggagaaggagucgaaagucaacaagcga

SEQ ID NO: 19860 - RNA, 64 nt, Human
ugucgcugaaccugucuccucccagguuucuucucuggagaaguuuuuguaaaccaaacagaca

SEQ ID NO: 19861 - RNA, 64 nt, Human
cucagccucuguaguuggcagcugggcuggacuucuggagaacuuccccuuuccucugguuucc

SEQ ID NO: 19862 - RNA, 64 nt, Human
uggaaaggccucuucucaacuuuuuucccuugggcuggagaauuuagaaucagaaguuuccugg

SEQ ID NO: 19863 - RNA, 64 nt, Human
ugagcuggugugagugcugccgcuacaccgagaccuggagaagaccucuugccucauggauguc

SEQ ID NO: 19864 - RNA, 64 nt, Human
cagaugcugacaggcccugggaggcugcugugcucuggagaagcuggagcagcucauuucuugg

SEQ ID NO: 19865 - RNA, 64 nt, Human
cugagccauuaggagacauuagugaauuggagcacuggagaauccuacaaauggccuaugucuc

SEQ ID NO: 19866 - RNA, 64 nt, Human
acuuucuauaaugcuguacccagauucuaagaaccuggagaaggauuagcaguucuuaguaagu

SEQ ID NO: 19867 - RNA, 64 nt, Human
gcuggaaauagcuucuauauagucagcaguucaccuggagaaagaucuuaauuccuuguuguuu

SEQ ID NO: 19868 - RNA, 64 nt, Human
uuucucucccccagcuccagugauucacgcccgccuggagaagaaucagagcucagcucaugac

SEQ ID NO: 19869 - RNA, 64 nt, Human
cgaguguuggguccucugcuuccugagcuguccccuggagaaggucccgaggaugcugucagga

SEQ ID NO: 19870 - RNA, 64 nt, Human
ggcccccauggggagcuggagccugcccugcagccuggagaagaggguggcuguggugggcgug

SEQ ID NO: 19871 - RNA, 64 nt, Human
ugacugggcuuccuccgugcaguuuucugcaacucuggagaaguggaggcauacuugugugucu

SEQ ID NO: 19872 - RNA, 64 nt, Human
caucuucauucguggagacuguggcccugcaacccuggagaaggacuugcugguacuuaaaaaa

SEQ ID NO: 19873 - RNA, 64 nt, Human
uggacucugcucauuauucuuugacccagaaagacuggagaagguaugugcuuuaagugcugcu

SEQ ID NO: 19874 - RNA, 64 nt, Human
auggacuuugaucugccauacggagguucggaaccuggagaacggcugugauaaguagguuuug

SEQ ID NO: 19875 - RNA, 64 nt, Human
ugugagucuuggguugaguacccaaaugcuaccacuggagaaggaaugagagauaaagaaagag

SEQ ID NO: 19876 - RNA, 64 nt, Human
ucccacaggagcaccucaagccaugaagugucagcuggagaacaguggugggcauggagaggau

SEQ ID NO: 19877 - RNA, 64 nt, Human
guggcagggaccgucuugcccugcuggccacacucuggagaagcacuucucagccaaggcaccc

SEQ ID NO: 19878 - RNA, 64 nt, Human
uuugaaagggaaggaaaauagcuggcauuucuugcuggagaaaguuaucacaaguggaaagguu

SEQ ID NO: 19879 - RNA, 64 nt, Human
aagacguuuuuaguuuauuuguuguuaaguuaaacuggagaaaguuugucauccucauuuucaa

SEQ ID NO: 19880 - RNA, 64 nt, Human
aaacaaugcaucauagcgagcacuuuuccuuucccuggagaaugggaugugaagcaguagaccg

SEQ ID NO: 19881 - RNA, 64 nt, Human
agguggacaggugacuggguggauguuguggucucuggagaagcacugccauucagccuccugc

SEQ ID NO: 19882 - RNA, 64 nt, Human
ccggggcccccuggucaccgagacucagccucugcuggagaaagccacgcccucccugcuagca

SEQ ID NO: 19883 - RNA, 64 nt, Human
gggagccacugagcacagcaaggcaccaaagccccuggagaaaccgccagggcgaggugcgacc

SEQ ID NO: 19884 - RNA, 64 nt, Human
cuggggauucuagcuccacaaccaggccgugaggcuggagaaacuggcaguuauugcugucaaa

SEQ ID NO: 19885 - RNA, 64 nt, Human
augguaggacguguaccucuguguguucauggagcuggagaaaccaaaacugggucucucucca

SEQ ID NO: 19886 - RNA, 64 nt, Human
caggugggccuaauuccaaggggcccuuccuggccuggagaaggccuuuuacacacacacaaca

SEQ ID NO: 19887 - RNA, 64 nt, Human
uugugagauuaaccuugggacacaguggguuagccuggagaaaaugagaggcccugccuggacc

SEQ ID NO: 19888 - RNA, 64 nt, Human
caugucucuagaaugcuguugccacuuacgggggcuggagaaggccuggauaaagacagaaggg

SEQ ID NO: 19889 - RNA, 64 nt, Human
auuuggucagucacaaauucuuuuuuagccuucccuggagaaaaacaaguccccaagaaaaaau

SEQ ID NO: 19890 - RNA, 64 nt, Human
ugcagaggggacaacagacuuucugaccugagaacuggagaauuuuuaaaacaaaaucucucau

SEQ ID NO: 19891 - RNA, 64 nt, Human
uagaguccgcaucucaucuccaaacuacacuucccuggagaacaagugccacaaaaaugaaaac

SEQ ID NO: 19892 - RNA, 64 nt, Human
ugccugccgaggcgggacagaguguucgcucgcgcuggagaaggcucugcucagcccugagagu

SEQ ID NO: 19893 - RNA, 64 nt, Human
gugauugaaagccauugaggagcagguguccgggcuggagaagaguccugcuuucucuggaguc

SEQ ID NO: 19894 - RNA, 64 nt, Human
aaaauuuuaaaaagcaggccacugucagcaaagccuggagaaguggggccggaggcuccgcccc

SEQ ID NO: 19895 - RNA, 64 nt, Human
gggcagaaggcagcggaggccaggucugucccggcuggagaacagcguccacgcaguccugccu

SEQ ID NO: 19896 - RNA, 64 nt, Human
uggagaguuguucccccagggggcucugccccaccuggagaaggaagcugccugguguggagug

SEQ ID NO: 19897 - RNA, 64 nt, Human
accacaggacucacgccagucggauaggccgagucuggagaagggaggcgccuggcuguauccc

SEQ ID NO: 19898 - RNA, 64 nt, Human
ggucggcagacaugccaaccuugggcuauuugagcuggagaagcuaugugaugcuagccggugg

SEQ ID NO: 19899 - RNA, 64 nt, Human
ggcucugccagccccagauugggaagucuccccgcuggagaaggguggggcuccucugagccug

SEQ ID NO: 19900 - RNA, 64 nt, Human
gagggggauguaagagccaccuucucugacaaaucuggagaauugaguguguucuaagugaagg

SEQ ID NO: 19901 - RNA, 64 nt, Human
aucagcaggaggacgacugaugagcguacuggaacuggagaagaggaggccccgccccaccgcu

SEQ ID NO: 19902 - RNA, 64 nt, Human
uuuaaacagcaacaauuuaaagcuaugaagucaccuggagaaaaggaacguugcucuuggacag

SEQ ID NO: 19903 - RNA, 64 nt, Human
ccgguaaugugaugccucaggucugccuuuuuuucuggagaauaaaugcaguaauccucuccca

SEQ ID NO: 19904 - RNA, 64 nt, Human
uauggugaacuuuuaacucaauguguaaauagaucuggagaauauucagcauaaugcuggcucu

SEQ ID NO: 19905 - RNA, 64 nt, Human
uuucucuuccaagggcagugcuccaaggcagggacuggagaagccaaggggagagucuaaaagg

SEQ ID NO: 19906 - RNA, 64 nt, Human
uuaauagacuuaauacaugcaacagaagugacuucuggagaaagcucauggcuguguccacugc

SEQ ID NO: 19907 - RNA, 64 nt, Human
uugggcacagagucugaccucuggaccacucuaacuggagaaggaacuuuauguucccucuccu

SEQ ID NO: 19908 - RNA, 64 nt, Human
cucacccugacccacacaaagguucuggagauuacuggagaauauauauaaauauauauaugua

SEQ ID NO: 19909 - RNA, 64 nt, Human
uggccaacuugaugaaaccccaucucuacccauucuggagaacaggucacgccuguccuggaga

SEQ ID NO: 19910 - RNA, 64 nt, Human
guucuacaucaugcauaguagcuugaaaucuagucuggagaaaacuggaucaagauucuagccc

SEQ ID NO: 19911 - RNA, 64 nt, Human
augaacaaagaauuuguacuuaauggcauggacucuggagaaucuaugcgaaucaaccuuucua

SEQ ID NO: 19912 - RNA, 64 nt, Human
gagacuuuugagaauaugaagaggaggguugaggcuggagaagagccagaaucaagcuggcaug

SEQ ID NO: 19913 - RNA, 64 nt, Human
aggcccuugaugcuggagucacaucuguugauagcuggagaacuuuaguuucaaguacuacauu

SEQ ID NO: 19914 - RNA, 64 nt, Human
auagggcagcucuuugugaaagugguuuauuccacuggagaaaggggauugaaaaucaguuaga

SEQ ID NO: 19915 - RNA, 64 nt, Human
cuguugccacucuccuccccagacuaugaaaucccuggagaauuuuuggugacaugcacugagc

SEQ ID NO: 19916 - RNA, 64 nt, Human
cuucccagagaguuuuaccguaugaagccuggagcuggagaacgaaagaaucuucacuauaaac

SEQ ID NO: 19917 - RNA, 64 nt, Human
aaauuaucaaucuuugauaugaucaucaaggucucuggagaagcauggauguaauagugauuuc

SEQ ID NO: 19918 - RNA, 64 nt, Human
ccucccaaaaggacagagaacuaaaaaauugcugcuggagaaggugaaagucgcuuugggacgg

SEQ ID NO: 19919 - RNA, 64 nt, Human
gguucugucccagcugauggauggcuucuccaugcuggagaagaagcugaaggaagggccggag

SEQ ID NO: 19920 - RNA, 64 nt, Human
agggagggguguuggagagccagugcccuuaagacuggagaaagcugcaauuuaccaaguugcc

SEQ ID NO: 19921 - RNA, 64 nt, Human
acgguucuuaaccucaucuguuaaguucccaugccuggagaagcuaaugccaacucaucaugug

SEQ ID NO: 19922 - RNA, 64 nt, Human
cccaggcuggcgucucugggguuuuuaaggcuggcuggagaagacagugggagggugccccguc

SEQ ID NO: 19923 - RNA, 64 nt, Human
aauccuacagggaaaucagaauuaggaaaaaaaucuggagaacaauaugguugaaauagaaaca

SEQ ID NO: 19924 - RNA, 64 nt, Human
aaucuggaaggaaacuucacggacaggaagacugcuggagaagagaagcguguuagcccauuug

SEQ ID NO: 19925 - RNA, 64 nt, Human
ccaccuaagaugccacuuugaauucucuaagacccuggagaauugcauuucuuucacugugcua

SEQ ID NO: 19926 - RNA, 57 nt, Human
agaauccccugacuggauaacucagggcuggagaaacaaagauuauaaagcacgaga

SEQ ID NO: 19927 - RNA, 64 nt, Human
ugggacggucagaggaagagacuucuucuguucucuggagaaggcaggaggaaagcaaagaccu

SEQ ID NO: 19928 - RNA, 64 nt, Human
cacccucauccuuaccuccuccuacucaagcugccuggagaagaccugcucucagcugcccacc

SEQ ID NO: 19929 - RNA, 64 nt, Human
cccagccucuggauccuggggaagguuccagucccuggagaauacccagggccucaaacuugaa

SEQ ID NO: 19930 - RNA, 64 nt, Human
uggagugcuugggcagaaaguuguaaaguuugugcuggagaaagguuuauuuggacuuugauua

SEQ ID NO: 19931 - RNA, 64 nt, Human
ucuuauuccuauaagcuauguguucagacugaaacuggagaaauuaugacuauuuuauuuauag

SEQ ID NO: 19932 - RNA, 64 nt, Human
accuuaugaaugaauuguguuucucuguccugagcuggagaagggaaugagcaggcugacacgu

SEQ ID NO: 19933 - RNA, 64 nt, Human
aaaaguauauucucacaguuuuuccccaggaagucuggagaaaaaguccucaugucaccaauuu

SEQ ID NO: 19934 - RNA, 64 nt, Human
agguuuaaaauaagugugcacuuggacauaaagacuggagaaauaaacacugaggacuccaaaa

SEQ ID NO: 19935 - RNA, 54 nt, Human
ugaaucagagacgcaucugacccucuggagaacacugccucccgcuggcccagg

SEQ ID NO: 19936 - RNA, 64 nt, Human
aaugucuguguuucucucccaccugccacuggaacuggagaaugcacuuuauucugggcggggg

SEQ ID NO: 19937 - RNA, 64 nt, Human
acuugagcuugccacucuguauaauucuaacauccuggagaaaaauggcaguuugaccgaaccu

SEQ ID NO: 19938 - RNA, 64 nt, Human
aggagcugcugagaaggagcacuccacugugugccuggagaauggcucucacuacucaccuugu

SEQ ID NO: 19939 - RNA, 64 nt, Human
uagagagccaggcagagcuggggccacagcgugucuggagaagccaggucugagcagagcagcu

SEQ ID NO: 19940 - RNA, 64 nt, Human
cuguucauguauguaggaguuaaaauaggccaaacuggagaaauaaacgcauucuguccaccau

SEQ ID NO: 19941 - RNA, 64 nt, Human
uaaauuuauuuauuuuuuccuuccugugggauuucuggagaaugagaauuauccaaaugcucag

SEQ ID NO: 19942 - RNA, 64 nt, Human
gccaccacuaauccagacggcggcucacccuaaccuggagaagcuggguuauacccaggacaug

SEQ ID NO: 19943 - RNA, 64 nt, Human
ucugcccugccuacuuuuaguugacucacaggcccuggagaagcagcuaacaaugucugguuag

SEQ ID NO: 19944 - RNA, 64 nt, Human
uauagcuugcccucacuugcucaaaaacaacuaccuggagaaaacagugccuuuccuugcccug

SEQ ID NO: 19945 - RNA, 64 nt, Human
cugggcucuccagagcugggcuuggcucuuccagcuggagaaggacugagccccaguaaccccu

SEQ ID NO: 19946 - RNA, 64 nt, Human
uuagauguuuuccauuugggcacauuuuacuuagcuggagaacuagguuuaaaacagccugggu

SEQ ID NO: 19947 - RNA, 64 nt, Human
caugagaacacugccuggaugcaucucaugaucucuggagaauuuccccaucuuucucuucuuu

SEQ ID NO: 19948 - RNA, 64 nt, Human
uuuucucaaugaguuuguuuucaaaggcuuugcacuggagaagauauguguagaauuuuuguuu

SEQ ID NO: 19949 - RNA, 64 nt, Human
uugccaaguugucuuugcucuuagguggguuauccuggagaaaauggacucaggagcuaauacu

SEQ ID NO: 19950 - RNA, 64 nt, Human
uguugcugaacuggcaacuuacuugggccugaaacuggagaaggggugacauuuuuuuaauuuc

SEQ ID NO: 19951 - RNA, 64 nt, Human
aacagaaagcaucagcucugcuucgugacagucucuggagaaaucccuuaggaagacuaugaga

SEQ ID NO: 19952 - RNA, 50 nt, Human
cccacucugcugucuuguagcuggagaagauggcgcacccaucccccacc

SEQ ID NO: 19953 - RNA, 64 nt, Human
gaaguaccauuagguuuaauuuuaauuuguuuugcuggagaaacaucagguuuguaggagacug

SEQ ID NO: 19954 - RNA, 64 nt, Human
gcucuaacauuacugccuucaguaucaaggcugccuggagaaaggauggcagccucagggcuuc

SEQ ID NO: 19955 - RNA, 64 nt, Human
gcuuccuuuggaggugggagugggcuggaggccucuggagaagaccuggggugggggcugaugg

SEQ ID NO: 19956 - RNA, 64 nt, Human
auugccaugggccacuuuauuuacaugaagacaacuggagaacgacuaagaccaaauuauggaa

SEQ ID NO: 19957 - RNA, 64 nt, Human
agcccaccucauguccagcuguccacuuuccauccuggagaaagaacagugugccucaaacucc

SEQ ID NO: 19958 - RNA, 64 nt, Human
acucuuugugcaagugccuuccugagcagaagaacuggagaaagggaaccacagagccaggagg

SEQ ID NO: 19959 - RNA, 55 nt, Human
uccucaaaaucuggaacugaggaggcuggagaaagggaaguggaaggcagugaac

SEQ ID NO: 19960 - RNA, 64 nt, Human
guuucuuuuuuuuuuuuuuuccuauuggaucuuccuggagaaaauacuuuuuuuuuuuuuuuuu

SEQ ID NO: 19961 - RNA, 64 nt, Human
uuacacaucauagguguucuaauggaagcaaggacuggagaagcaaagaguggaaugugaggag

SEQ ID NO: 19962 - RNA, 64 nt, Human
aaaaagauaagagauagcaagugucagcaagggucuggagaaaagggaauuuuuguauacuguu

SEQ ID NO: 19963 - RNA, 64 nt, Human
gaaccugauguaccugaagcagauccuguauuugcuggagaaauucguggcugugcuagggggu

SEQ ID NO: 19964 - RNA, 64 nt, Human
cuucuagggcacugaggagugaaagcgccuagggcuggagaauagcgcugaguuggguuuguga

SEQ ID NO: 19965 - RNA, 64 nt, Human
gcaugcugcugcagccuuuaaaguauugaaguaacuggagaauugccaauacagccagagagaa

SEQ ID NO: 19966 - RNA, 64 nt, Human
gccaagcuaacuauugacuauagguuugccuuuccuggagaauuaauugagcaauugaggagug

SEQ ID NO: 19967 - RNA, 64 nt, Human
gcugaguucuuaaagacugaagacaggcuauucucuggagaaaaauaaaauggaaauuguacuu

SEQ ID NO: 19968 - RNA, 64 nt, Human
cucccacauacuuacccacauguacacagaguaucuggagaauaaaacccaaauucaaaaaaaa

SEQ ID NO: 19969 - RNA, 64 nt, Human
guaguaagcuaaacugaaaauaaggugggcuucacuggagaaauggacuuacugcaaaugcugu

SEQ ID NO: 19970 - RNA, 64 nt, Human
ugugcaaccaccagaaaaacacuacuguggcaaacuggagaagugccaauuuaauucuaacugc

SEQ ID NO: 19971 - RNA, 64 nt, Human
agcaugaggugagagaaagccacaaagucagugccuggagaaggguucagcccaacauggggcc

SEQ ID NO: 19972 - RNA, 64 nt, Human
auguccaacuaaaaacaaacccuuuucauccuggcuggagaauguggagaacuaaagguggcca

SEQ ID NO: 19973 - RNA, 64 nt, Human
uguccauugauugacaugagcaccccuguuuucucuggagaaauaccuccccucucuggggugc

SEQ ID NO: 19974 - RNA, 64 nt, Human
gugaaguaauauggcccacacuuuauucaccacccuggagaaaaaaaaacccaggaauaugugg

SEQ ID NO: 19975 - RNA, 64 nt, Human
aacuacuuuuuggucaugaaauuguucaucgcugcuggagaaugaacgucauugcgauuuaucu

SEQ ID NO: 19976 - RNA, 64 nt, Human
gcacagcacuccuguaacugucucagaaccacuccuggagaaagacuuccuugcaggagugacu

SEQ ID NO: 19977 - RNA, 64 nt, Human
ugggcuccuccuugccuaaugcagggggucaccgcuggagaagaaccaccacuguccucgaugu

SEQ ID NO: 19978 - RNA, 64 nt, Human
gggaucuuacaacuuuacuuuguucuccagaggccuggagaacacuuagggauugugaaaauag

SEQ ID NO: 19979 - RNA, 64 nt, Human
agcugagaacuucggaaaaggcucaucugucacccuggagaagggaaacuguacuuuucccugu

SEQ ID NO: 19980 - RNA, 64 nt, Human
aacaggcuacagugucccugauucuuggaaaagccuggagaagcuggggagaugcgguucacaa

SEQ ID NO: 19981 - RNA, 64 nt, Human
gcuucccuuucuacuccagcagcaggaagauagccuggagaaggugauuaaagauacggagucc

SEQ ID NO: 19982 - RNA, 64 nt, Human
cuaugacuuuaaagaucagaugccaucuuucuuccuggagaagaggagauuuucucuuuugaga

SEQ ID NO: 19983 - RNA, 64 nt, Human
cucuugugugcugugggcacuggaguagagauuucuggagaaaaaaaaacaguuuauuucaucu

SEQ ID NO: 19984 - RNA, 64 nt, Human
agcuucagaagcuagugaccaucuucauaauuugcuggagaaguguguuucuuccccuuacucu

SEQ ID NO: 19985 - RNA, 64 nt, Human
ccugcucccccacccccuccccaggggagagggucuggagaagcagugagccgcaucuucucca

SEQ ID NO: 19986 - RNA, 64 nt, Human
ggucuucucugcaccaaccacucucugcagauggcuggagaaagggugugccaacucuucaccu

SEQ ID NO: 19987 - RNA, 64 nt, Human
cuugcagacuggauaugcaagcaaacgggcaacucuggagaaaaauaaggaaaggaaugcugac

SEQ ID NO: 19988 - RNA, 64 nt, Human
gcauaagggucaaccacauuuuuccucaaguucccuggagaagaagcugaacuccugguuucuc

SEQ ID NO: 19989 - RNA, 64 nt, Human
aagugggaauggcuauauacauggcuuuaguagucuggagaaaucuacuccccuuggccaggac

SEQ ID NO: 19990 - RNA, 63 nt, Human
ugaagaagcugggaaagugagcacauuugggagcuggagaacagggguuaucccuaccccugu

SEQ ID NO: 19991 - RNA, 64 nt, Human
cccacacggugcaaaucuuugggucagugagcuccuggagaagagaggagacaugucaggaaua

SEQ ID NO: 19992 - RNA, 64 nt, Human
acugcaacccuaacucacucuagugggaccuugacuggagaaacuccacgaucuuccugaagaa

SEQ ID NO: 19993 - RNA, 64 nt, Human
auuucuuucugcuuccacuauuugguguugggcacuggagaaaaacgaagccaagagaauauga

SEQ ID NO: 19994 - RNA, 64 nt, Human
cuauuucuguugauacuauguauaauuuauuaaucuggagaauguuuaaaauuuuauauaauuu

SEQ ID NO: 19995 - RNA, 64 nt, Human
gagcaguugagcaauguucaguccaguugugaagcuggagaagagaaauggguuuuaaaaauua

SEQ ID NO: 19996 - RNA, 64 nt, Human
cuucugccaacuggaagcagauggugaccaggcucuggagaaggcaaggccugaagaugggaga

SEQ ID NO: 19997 - RNA, 64 nt, Human
gcuggggcggccaguuuugacacgccccagugcccuggagaacaaccagggucaucugcacuug

SEQ ID NO: 19998 - RNA, 64 nt, Human
cugcgguuggcaugaggaugccugacaacaaaggcuggagaagggcccugaguuccagccucuc

SEQ ID NO: 19999 - RNA, 64 nt, Human
caagaagggacauugucaccaagaaccaggaucucuggagaaacaguugggcuguugcaucgag

SEQ ID NO: 20000 - RNA, 64 nt, Human
cucgggcagugggaagagcuccugugucaacauccuggagaacuucuacccccuggaggggggc

SEQ ID NO: 20001 - RNA, 64 nt, Human
agggaaugguucauuuacucuuaaucuuuaugcccuggagaagaccuacuugaacagggcauau

SEQ ID NO: 20002 - RNA, 64 nt, Human
uagagcccugauuaacuucaaggacaaacacuggcuggagaaagccagacugaugggaaugaga

SEQ ID NO: 20003 - RNA, 64 nt, Human
cuugagacucuugaagaaaauucagaaugaaguucuggagaaagguauguuacuguaguaauua

SEQ ID NO: 20004 - RNA, 64 nt, Human
aguccacaugacagaaggacuggaaugccaugaacuggagaaggugagcgcugaagaaccagga

SEQ ID NO: 20005 - RNA, 59 nt, Human
auaaagaagaaaaacuguagguuguguagcuggagaagugacagucaggggcccugauu

SEQ ID NO: 20006 - RNA, 64 nt, Human
cacugacuccugacaaaaugcagccugcaacuuccuggagaacaacucagugucacauuaaagu

SEQ ID NO: 20007 - RNA, 64 nt, Human
gguaagggacaaaagccuuuuaccuuuaauuuuccuggagaauuauauaaagguuuucuuagaa

SEQ ID NO: 20008 - RNA, 64 nt, Human
ggccaaaagucggaaaaugagaaugaggguaauccuggagaaauugugacaacaauuugaaaau

SEQ ID NO: 20009 - RNA, 64 nt, Human
uauccugcuuuaaguugauaacucccucugggagcuggagaaucgcucugguggauggguguac

SEQ ID NO: 20010 - RNA, 64 nt, Human
cgaugccucccuugaggguuugagagcccgcgugcuggagaauugacugaagcacagcaccggg

SEQ ID NO: 20011 - RNA, 51 nt, Human
accccaccacgccucugugaccuggagaagauccagaacuugcgugcagcu

SEQ ID NO: 20012 - RNA, 64 nt, Human
ccagcacaggcacuuucuagauauuucccccuugcuggagaagaaagagccccugguuuuauuu

SEQ ID NO: 20013 - RNA, 64 nt, Human
agagauuagagauaauugucuaguuagggggcagcuggagaaaauaagcuaaguuugcaauaac

SEQ ID NO: 20014 - RNA, 64 nt, Human
aucuccuucaguugggaguccuuccacuucaacacuggagaacugagccuugcaucucuccagg

SEQ ID NO: 20015 - RNA, 64 nt, Human
acgccuguaaucccagcuacucaggaggcugaggcuggagaaucauuugaaccugggaggggga

SEQ ID NO: 20016 - RNA, 64 nt, Human
aggccuggggcuaugcauacgcauuaagggccugcuggagaaaccuucacuccagacagacagg

SEQ ID NO: 20017 - RNA, 64 nt, Human
guagccucagaagcagagcuguuuggcagacuggcuggagaaauucccucuaggagacuugccu

SEQ ID NO: 20018 - RNA, 64 nt, Human
cugguuggagagcuagaaccuggagagcuagaaccuggagaacuagaaccuggagggcuagaac

SEQ ID NO: 20019 - RNA, 64 nt, Human
gaaccuggagggaaugaaccuggagggcuagaaccuggagaaugagaaaaauuuacauggcaaa

SEQ ID NO: 20020 - RNA, 64 nt, Human
uccagauguucuuaauccagggcuguugggguuucuggagaauuaucacaaccuaaugacauua

SEQ ID NO: 20021 - RNA, 64 nt, Human
ccaucugucaugacuguuuggcaaauggaaaccgcuggagaaacaaaauugcuauuuaccagga

SEQ ID NO: 20022 - RNA, 64 nt, Human
cagaagcagaugccagugcuaugcuuccuauagccuggagaacugugagccaauuauaccucuu

SEQ ID NO: 20023 - RNA, 64 nt, Human
aucuagugaauaaaaaaauuaguuugaaagauaucuggagaaaucgcauucauaaaacaauugg

SEQ ID NO: 20024 - RNA, 64 nt, Human
aaaaggaaaugcaaguaaccaccugguccgugcacuggagaaggcgaggucaagugcccaacug

SEQ ID NO: 20025 - RNA, 64 nt, Human
ccucccuccuaccagaugacacagacaagaguuccuggagaaugggaguguuaagacuuuugac

SEQ ID NO: 20026 - RNA, 64 nt, Human
cccccuaagagacacauacagagugggccccgggcuggagaaagagcugccuggaugagaaaca

SEQ ID NO: 20027 - RNA, 64 nt, Human
cccccucuucuucugaagaucagaacauucagcucuggagaacagugguugccugggggcuuuu

SEQ ID NO: 20028 - RNA, 64 nt, Human
cuuugagugcucagguucuguuuucuggaaguugcuggagaagggcugucagggugcuucuaug

SEQ ID NO: 20029 - RNA, 64 nt, Human
ucugggugccagaucccagcacuacuuuuuauuacuggagaaaugggggggauagaaaauucua

SEQ ID NO: 20030 - RNA, 64 nt, Human
uuuuuagagacagggccuugcucuguugccugggcuggagaacaguggcaccaucauagcucac

SEQ ID NO: 20031 - RNA, 64 nt, Human
accaucagccugccucccaguagaggcccuucaccuggagaagucagaaaucugacccaauucc

SEQ ID NO: 20032 - RNA, 64 nt, Human
guccaaccaccgcaaugaguucuggagugcucugcuggagaaggcuuaugcuaaguaagcaaca

SEQ ID NO: 20033 - RNA, 64 nt, Human
gaaagagaauuacgccgcggaguacgcgaacgcacuggagaaggggcugccggacccagugcuc

SEQ ID NO: 20034 - RNA, 64 nt, Human
cucagggacccccaggaccaggaugugucucagccuggagaaauggugggggggcagugucuag

SEQ ID NO: 20035 - RNA, 64 nt, Human
ucccuuacuugugaguaagggaucaugcucaccacuggagaagcuuacaccgggacuuuuuuuc

SEQ ID NO: 20036 - RNA, 64 nt, Human
gcaucaaaguugauuagagaggggggcacuuuuucuggagaauucucuuaguaaacacaaaaga

SEQ ID NO: 20037 - RNA, 64 nt, Human
caggacagacagcguuguccaaucagggauuguccuggagaacugggugggggucugugggugu

SEQ ID NO: 20038 - RNA, 64 nt, Human
ucucccuuaauaaaggagaaaaauauacugauggcuggagaaauuuuucucugccuuucaguuu

SEQ ID NO: 20039 - RNA, 64 nt, Human
uauaauccacaguaaaguucauccuuugacugugcuggagaauuccaguuguauuugaagacug

SEQ ID NO: 20040 - RNA, 64 nt, Human
gaacuggauggagacuuuccaaauauggaacuaacuggagaaggugcacgaaggagacaccacu

SEQ ID NO: 20041 - RNA, 64 nt, Human
caaggaguccuuccacccugccuucagguucucucuggagaaagguuagagaccccaggacaau

SEQ ID NO: 20042 - RNA, 64 nt, Human
caaggccaagcugcgcagcaugaaggagcgaaagcuggagaagaagcagcagaaggagcaggag

SEQ ID NO: 20043 - RNA, 64 nt, Human
aagagaaauuguccaaagaguccucagaaccugccuggagaaaugcgcaugggggugggccugg

SEQ ID NO: 20044 - RNA, 64 nt, Human
caaucaucuaaaagccagccacugucagcaaagccuggagaaaugggaccagagagucugcccc

SEQ ID NO: 20045 - RNA, 64 nt, Human
gcuacaagcagaggcugaacaccugcggaaggagcuggagaaucugacaggacagcuuuaagcc

SEQ ID NO: 20046 - RNA, 64 nt, Human
gcuacaagcagaggcugaacaccugcggaaggagcuggagaaucuggcaggacagcuuuaagcc

SEQ ID NO: 20047 - RNA, 64 nt, Human
uucacuagccucucugaagguguccuggccagcccuggagaagcacuggugucugcagcacccc

SEQ ID NO: 20048 - RNA, 64 nt, Human
gccaagaagguaggaggaaaauggcagaccugggcuggagaagaaccuucuccguaucccaggu

SEQ ID NO: 20049 - RNA, 64 nt, Human
aagcuaaacuucuucaccccugagagcaugucagcuggagaaaagcaguucuuccuugcccacu

SEQ ID NO: 20050 - RNA, 64 nt, Human
cacccacuuggcuaugggagagccagcagggguucuggagaaagaaacugguggguuagggccu

SEQ ID NO: 20051 - RNA, 64 nt, Human
cuuugacuggauggagaugcauuuacaaaacagacuggagaaggacuuaauacucagauggauu

SEQ ID NO: 20052 - RNA, 64 nt, Human
caagagcuggaaccucccucagcucacuccgagccuggagaacugcaggggccaagguggaggc

SEQ ID NO: 20053 - RNA, 64 nt, Human
uggagggacagugauggccuuugacucaugaggccuggagaaaaguaucaaaggucucaccaug

SEQ ID NO: 20054 - RNA, 64 nt, Human
gcugugagagacuuaaaaucucuugaggagcgcucuggagaauggcugaaggagaggaaacagg

SEQ ID NO: 20055 - RNA, 64 nt, Human
ccuaccccggcaggggcuuccggggccuuuucaccuggagaaacauucccacuccccuuuggcc

SEQ ID NO: 20056 - RNA, 64 nt, Human
uuuccuuggggcugcaguuuugugguugaggggccuggagaaaaucauuuucuccccuuggcag

SEQ ID NO: 20057 - RNA, 64 nt, Human
ccguuugugaauaaacuguucuucaucauugacacuggagaaagguguccuccaugcccucagg

SEQ ID NO: 20058 - RNA, 64 nt, Human
auccugccaauaaauccugucuuauuuguucauccuggagaauugaagggaggucaaguuguuu

SEQ ID NO: 20059 - RNA, 64 nt, Human
augaaccagcuguaaaaacacauuucuggaacaacuggagaaaccggaguaugcccuggacugg

SEQ ID NO: 20060 - RNA, 64 nt, Human
gaggaucucuugaagucaagaguuugagaucagccuggagaacaaagugagacccccaucuauu

SEQ ID NO: 20061 - RNA, 64 nt, Human
acaacuaggauguguugggugagauguuucagaucuggagaaaugagcaggugucgggaaaugu

SEQ ID NO: 20062 - RNA, 64 nt, Human
cucugugccuggucuguaacaguuuccaggccagcuggagaauguucacugguucggggcugac

SEQ ID NO: 20063 - RNA, 64 nt, Human
gcccuuccucuccacugccuucgauacaccgggccuggagaacuagagaaggacccggaggggc

SEQ ID NO: 20064 - RNA, 64 nt, Human
uccacaaugagcgccugauaaccaggguugguuccuggagaauucacucauugauucauuuguu

SEQ ID NO: 20065 - RNA, 64 nt, Human
auaggaacaugcacaaagcaguuaauuaggcagccuggagaaaaccagagauccaguacagaaa

SEQ ID NO: 20066 - RNA, 64 nt, Human
ccaccuccccuugggcccacaccuccuucccucucuggagaaagggcccugggccugccucacc

SEQ ID NO: 20067 - RNA, 64 nt, Human
cacagggugagggccaccuccacacccacccccucuggagaaggccuggaagagcugagaccuu

SEQ ID NO: 20068 - RNA, 64 nt, Human
aaaaaccugcuugguguguagguuccguaucucccuggagaagcaccagcaauucucuuucuuu

SEQ ID NO: 20069 - RNA, 64 nt, Human
uauauauacacgguauuuauagagagagacuauccuggagaagccucguuuugaugccauucuu

SEQ ID NO: 20070 - RNA, 64 nt, Human
aauuuauaauuuugaucgaguuucuuaaaagacccuggagaaagaguggcauuucuucuguuuc

SEQ ID NO: 20071 - RNA, 64 nt, Human
uuugaagacgcggcccugccccgacacaggcagccuggagaagcugggcaggacaaguaggaca

SEQ ID NO: 20072 - RNA, 64 nt, Human
cuggggcacgagggccugggcuggcccugcuaggcuggagaagcccugucaccugugcacaucu

SEQ ID NO: 20073 - RNA, 64 nt, Human
uugcugcccaucuggccugugugcccaucuuuuucuggagaaagucagauucacagcaugacag

SEQ ID NO: 20074 - RNA, 64 nt, Human
uugugacauggucauuacauauggauuagaccaacuggagaauugccagacuugugguaccgau

SEQ ID NO: 20075 - RNA, 64 nt, Human
cugaaaaggaccaguggagggaagagcuauacuucuggagaaguaggccuggaguuacuacagu

SEQ ID NO: 20076 - RNA, 64 nt, Human; identical to SEQ ID NO: 20074

SEQ ID NO: 20077 - RNA, 64 nt, Human
cguggacagccucagggggcugucggccaagagccuggagaaagggagcaagcugcccccuccu

SEQ ID NO: 20078 - RNA, 64 nt, Human
gaucucauaagaaagaauccagucugacuucccucuggagaaugacuauggacagaaggccacc

SEQ ID NO: 20079 - RNA, 64 nt, Human
ccuuacccagccaugaacauguugagugagcaugcuggagaaugagagaccacaugaagcagaa

SEQ ID NO: 20080 - RNA, 64 nt, Human
aacugaagaaagagaagucacaacaaaaggaagacuggagaaaugcuuacuucuagagggagaa

SEQ ID NO: 20081 - RNA, 64 nt, Human
ugaaaauucugauuaagccucugggcccuacagccuggagaaccuggagaauccuacacccaca

SEQ ID NO: 20082 - RNA, 64 nt, Human
ugauuaagccucugggcccuacagccuggagaaccuggagaauccuacacccacagaacccggc

SEQ ID NO: 20083 - RNA, 64 nt, Human
caacccagcugaggucgugccagggagacagagucuggagaagggcagaggaauuuuggaagga

SEQ ID NO: 20084 - RNA, 64 nt, Human
uugcaagccuugcugaugauaaaauggugagguucuggagaauugaugaggauuauccagugca

SEQ ID NO: 20085 - RNA, 64 nt, Human
uuuggauuucauguggggaacccucaaggccugucuggagaagugacacaggauuuacuggggu

SEQ ID NO: 20086 - RNA, 64 nt, Human
agcugagcuuguaaaagcccacagauguugggggcuggagaaggggcaggagagcaucacacuc

SEQ ID NO: 20087 - RNA, 64 nt, Human
uaacuuuccaaggccugccuuccccucccucccacuggagaagccgccagccccuuucucccuc

SEQ ID NO: 20088 - RNA, 64 nt, Human
gaaaaaccagcuuuacugaccgguucuuggaaaccuggagaacagccaacaagaggcccuugaa

SEQ ID NO: 20089 - RNA, 64 nt, Human
ucccuaauaccccacacccaaccugucguaauuucuggagaacuccagguuugugugugcagga

SEQ ID NO: 20090 - RNA, 64 nt, Human
gaugggaugucuuugcauaucucucucauccucucuggagaagugggcgcugcaggacugugga

SEQ ID NO: 20091 - RNA, 64 nt, Human
gcggauaccugaaggugacuccgaguccagcccccuggagaaggggucggggguggggguaaag

SEQ ID NO: 20092 - RNA, 64 nt, Human
ggagacauuggcuuaucauggggaaaaagaggaucuggagaaccucauccagcuccccuucuga

SEQ ID NO: 20093 - RNA, 64 nt, Human
gcccagggccucuggcuucccugcccaauccucccuggagaagggacaugggaaugaauugaaa

SEQ ID NO: 20094 - RNA, 64 nt, Human
uuaccuggugcugcgucuugcuuuugguuuccagcuggagaaaagaagacaagaaagucuuggg

SEQ ID NO: 20095 - RNA, 64 nt, Human
ccacuguggacgcccuggggcuuggcacccaccucuggagaaacucggggccaccuccacucca

SEQ ID NO: 20096 - RNA, 64 nt, Human
gcaggcggcucuggagccuaagcuggaccugcuacuggagaagaccaaggagcugcagaagcug

SEQ ID NO: 20097 - RNA, 64 nt, Human
gaagaaggggguuugaagcccaccaagaccgaaacuggagaagggcuggaccuggaccuggacc

SEQ ID NO: 20098 - RNA, 64 nt, Human
ugcuacaaaaccucaugccuacugucugccacugcuggagaaggaaucaugguuucuagaagug

SEQ ID NO: 20099 - RNA, 64 nt, Human
gggguaguaaaggacugagagaggagggagguggcuggagaaggaaaaggaacauugcucgaug

SEQ ID NO: 20100 - RNA, 64 nt, Human
guuuaaacaaauguaauauuuuguacaagauacacuggagaacaaagggaacucaagauucuuc

SEQ ID NO: 20101 - RNA, 64 nt, Human
caucgaccugagggggcccaucccugcccaccuccuggagaacacguuggcucaguccuggguc

SEQ ID NO: 20102 - RNA, 64 nt, Human
agaggaugaggucaauuuccugaugcauauugcccuggagaagaucgccuucauccccuuuggc

SEQ ID NO: 20103 - RNA, 64 nt, Human
auaaauuaggccucaggccucuaccaccagagagcuggagaauggguccacgucauucaaggac

SEQ ID NO: 20104 - RNA, 64 nt, Human
gcgaacacugaaaugcagguagacaauucaaagucuggagaagagggaucaugccuggauauga

SEQ ID NO: 20105 - RNA, 64 nt, Human
guccacagcuccuguggggguggaggagacuccucuggagaagggugagaagguggaggcuaug

SEQ ID NO: 20106 - RNA, 64 nt, Human
ucugacuuggaaaguuggagaagaggcauuccuacuggagaaaaaugucaguguuuuccuauaa

SEQ ID NO: 20107 - RNA, 64 nt, Human
aucguuccgagaggucuggagggccccgugguuccuggagaaagcaggacgcagagaagaacaa

SEQ ID NO: 20108 - RNA, 64 nt, Human
gcccgggugguuuggggguguugguguuuccucccuggagaagaugggggaggcugucccacuc

SEQ ID NO: 20109 - RNA, 64 nt, Human
acucucucccuugaugaugccccuagagcugaggcuggagaagacaccagggcugacuuugacc

SEQ ID NO: 20110 - RNA, 64 nt, Human
gggagagcuugaccuccaucuagguuucuuuuaucuggagaaaaagaacacuuuugaacuaugu

SEQ ID NO: 20111 - RNA, 64 nt, Human
gguacugaaaguguaauuucuuagagccaaaaaacuggagaaacaaauauccugccaccucuaa

SEQ ID NO: 20112 - RNA, 64 nt, Human
gccugcugcucacagcccccgagagccccuccuccuggagaauaaaaccuuuggcagcugcccu

SEQ ID NO: 20113 - RNA, 64 nt, Human
cauggguccccuacccuuccccguaggauauacccuggagaauggcaaaaugauuuaaagagaa

SEQ ID NO: 20114 - RNA, 64 nt, Human
agucuugauaaacugcuugaugcuggucucuauacuggagaagugacugaaauuguaggaggcc

SEQ ID NO: 20115 - RNA, 64 nt, Human
ccagcuggcccaaauucagugucugaucgauaaccuggagaaccagcuggccgagauccgcugc

SEQ ID NO: 20116 - RNA, 64 nt, Human
auggucccuacacaaagaggccuugugggcaaaccuggagaacccuccuaaauccauagaguuu

SEQ ID NO: 20117 - RNA, 64 nt, Human
ggccguagguuuguaacuguuucauagaagagcccuggagaagacaguagaaugagccuaucua

SEQ ID NO: 20118 - RNA, 64 nt, Human
ccgccagacauacacacguuaccagacgcuggagcuggagaaggaguuucacuacaaucgcuac

SEQ ID NO: 20119 - RNA, 64 nt, Human
cuuuccgguggccuuggaaacagauugcuccgagcuggagaaugucgggugagguguaugggag

SEQ ID NO: 20120 - RNA, 64 nt, Human
agugaaaauaagaugugcguauguguguguaugccuggagaauugguguuucacuucagugaga

SEQ ID NO: 20121 - RNA, 64 nt, Human
uaguuuucuucuaaccccuguuggaguccaggggcuggagaaaaggacagauuuaugcagcuau

SEQ ID NO: 20122 - RNA, 64 nt, Human
auaaaaacacuaauuuguggguauuuaagaaaaccuggagaauaaacucauacuuuaaaagauc

SEQ ID NO: 20123 - RNA, 64 nt, Human
uaaccuggaagaauacagccuuucucagugcacacuggagaagguauucuuagagcuuucuaaa

SEQ ID NO: 20124 - RNA, 64 nt, Human
cugaaaugcagacagcugugagugacaugggccucuggagaaugcaagucuuugccauggcacg

SEQ ID NO: 20125 - RNA, 64 nt, Human
cuuugguuuaaaaaguuuuuuauuggaaugguaacuggagaaccaagaacgcacuugaaauuuu

SEQ ID NO: 20126 - RNA, 64 nt, Human
aggccugggguggguaaguccugcgauguggacacuggagaaaguggauccucuaaacugcaga

SEQ ID NO: 20127 - RNA, 64 nt, Human
gcauucugcccuggcugcgcuggggagcuucucccuggagaagagcaccuggggcugcggccaa

SEQ ID NO: 20128 - RNA, 64 nt, Human
uugcccgcccgcccccgcgcccagggccgccucccuggagaagccgcgcgucgcccaugggcca

SEQ ID NO: 20129 - RNA, 64 nt, Human
uuuucaguggauccaaagaaucuacuccuuaaaccuggagaagaacaugagguuauuguuucau

SEQ ID NO: 20130 - RNA, 64 nt, Human
aaccuggucugauuccuuccaacgugcacuucagcuggagaaagaaaccaagaagggaagcggc

SEQ ID NO: 20131 - RNA, 64 nt, Human
uccagggugacucuccaaagaaauuggccuucagcuggagaaaacauuggguggagacucucac

SEQ ID NO: 20132 - RNA, 64 nt, Human
cuugacacuuccauugugugugggaacguuucuucuggagaauuggaacauguguggccccaag

SEQ ID NO: 20133 - RNA, 64 nt, Human
gagacaaugaaaaaaaaucaacaaaauaugcuuucuggagaacuguaccuuuuaugguuugcuu

SEQ ID NO: 20134 - RNA, 64 nt, Human
ccugaauuugcaaccucugguauacuguuauguucuggagaaaauauucaaagaucugccaaau

SEQ ID NO: 20135 - RNA, 64 nt, Human
acuugucuaugaaggagauaaacaggguacuguacuggagaauaacagaugggaugcuucaggu

SEQ ID NO: 20136 - RNA, 64 nt, Human
ccuacuauuuaguuauucuaaaauagaaaguuugcuggagaaagcguccacucacagauuguuc

SEQ ID NO: 20137 - RNA, 64 nt, Human
uugugcccuugaaaaugcuguuugcucaaucuuucuggagaaaguuugccacauauucggacuu

SEQ ID NO: 20138 - RNA, 64 nt, Human
gcccuggacucaggcuggcagaggggcuggugcccuggagaaaauaaagagaaggcuggagaga

SEQ ID NO: 20139 - RNA, 64 nt, Human
guucuccugcguggcaguccugauuuccaugcuucuggagaauccauuucguuaacacugaaag

SEQ ID NO: 20140 - RNA, 64 nt, Human
cagccuuuguauggaggcccaaccgcgcucccgucuggagaagcggcuuccgggguguggcugc

SEQ ID NO: 20141 - RNA, 64 nt, Human
aagcgucuuaauguucaaaacgccucucuuuggucuggagaaaaaaaaaaaaaaaaaaaaacaa

SEQ ID NO: 20142 - RNA, 64 nt, Human
gaggcucaccacaagccuggcauuucagccagggcuggagaaggcagggacgccugggugagag

SEQ ID NO: 20143 - RNA, 64 nt, Human
ucuggaaacuuguggacagagaagaagaccacgacuggagaagcccccuuucugagugcagggg

SEQ ID NO: 20144 - RNA, 64 nt, Human
ccuagcggaagcugccuccucacccuagguguugcuggagaacccugagggcagggcccgagcc

SEQ ID NO: 20145 - RNA, 64 nt, Human
ccgccgcccccgccgggcggcuuucccccuuguacuggagaagcucgaacacccggucacagcu

SEQ ID NO: 20146 - RNA, 64 nt, Human
gccucgcaccuucaaaugcauggaaggacucacacuggagaaaaacccuaugaauguaagcagu

SEQ ID NO: 20147 - RNA, 64 nt, Human
caugaaaggacacaaacacacauaagaauacacucuggagaaagaccuuauaaauguaagacau

SEQ ID NO: 20148 - RNA, 64 nt, Human
aggcccccuccccagucuggccuuggccuccagccuggagaagggcuaacaucagcucauuguc

SEQ ID NO: 20149 - RNA, 64 nt, Human
gcccaaggccaacaggcauaugccucacuacugccuggagaagggagagauucagguccuccag

SEQ ID NO: 20150 - RNA, 64 nt, Human
agcuuccagaaacaguuuaaacaagccagcgcuacuggagaagaggagcaacaccugugccgcg

SEQ ID NO: 20151 - RNA, 64 nt, Human
uugucacacuucauuguagguaagauaauucauacuggagaaaacgccuacaugugugaacaau

SEQ ID NO: 20152 - RNA, 64 nt, Human
uuuucaaaccuuacuaaacauaagauaacucauacuggagaaaaaucuuacaaaugugaagaau

SEQ ID NO: 20153 - RNA, 64 nt, Human
uugucacacuugauuguagguaagauaauucauacuggagaaaacuaccagugugaacaacgug

SEQ ID NO: 20154 - RNA, 64 nt, Human
ccaguccugucuguguggacuggcaccugggcugcuggagaagucuccucccguucggaccagc

SEQ ID NO: 20155 - RNA, 64 nt, Human
aguucaaaccuuacuguacaucagagaauucauacuggagaaaagccauauaaauguagugagu

SEQ ID NO: 20156 - RNA, 64 nt, Human
gggcucugggaaggggucagggugagaggcugcucuggagaacaaugagguccucauagcagca

SEQ ID NO: 20157 - RNA, 64 nt, Human
gggggauuggguugugggcaguccccauggccgccuggagaagccgcuggggcccgggggugug

SEQ ID NO: 20158 - RNA, 64 nt, Human
uuaugcguaugugcacggggccgcccgccuggaccuggagaagggaccuacggacgccuggaag

SEQ ID NO: 20159 - RNA, 64 nt, Human
gggcaggggcagggagagcugcugagccuaaagacuggagaaucugggggacugggaguggggg

SEQ ID NO: 20160 - RNA, 64 nt, Human
ccgaaagaggugaaagagaucacuuuggggagagcuggagaacaggauucuaggcggaagcgau

SEQ ID NO: 20161 - RNA, 64 nt, Human
acgaugacuccuggauucuccuuccugggugggccuggagaaagaggcugguguuaccugagau

SEQ ID NO: 20162 - RNA, 64 nt, Human
cccagccccgcgcauccagggcuuccugagucgccuggagaacuucacgggacugucgcugguu

SEQ ID NO: 20163 - RNA, 64 nt, Human
ucuucccuuagccucucccacccggccacagcugcuggagaauaaauuugggaugcugaugcug

SEQ ID NO: 20164 - RNA, 64 nt, Human
cuugcuuacaaaugucuaagguccccacugccugcuggagaaaaaacacacuccuuugcuuaac

SEQ ID NO: 20165 - RNA, 64 nt, Human
caacauauuguggcuggacagcaggcaguacacacuggagaaagacugaaugccgugaacgugg

SEQ ID NO: 20166 - RNA, 64 nt, Human
agcuguacacugaagagucaucagagaguucacacuggagaaagaccuuuugaaugcagcauuu

SEQ ID NO: 20167 - RNA, 64 nt, Human
agcuccacacucauuagucaugagagaguucauacuggagaaaagccuuaugagugcagugaau

SEQ ID NO: 20168 - RNA, 64 nt, Human
aggccuaacccuauucaacaccagaaaguuuacacuggagaaaggccuuagggugacagguuau

SEQ ID NO: 20169 - RNA, 64 nt, Human
auuggggaaggcaggguuuuguauuguccagucccuggagaaaaucaugaaaugccugaguuca

SEQ ID NO: 20170 - RNA, 64 nt, Human
agguccaaccucauucaccaucagcgaguucauacuggagaaaggcaugagugcgggcagugug

SEQ ID NO: 20171 - RNA, 64 nt, Human
aaaucuagccuuauuauacaucugagaguucacacuggagaaaggccuuaugagugcagugacu

SEQ ID NO: 20172 - RNA, 64 nt, Human
aacuccagccuuauuaaacacuugagaguucacacuggagaaaggccauaugaaugcauugauu

SEQ ID NO: 20173 - RNA, 64 nt, Human
cgguugugacucauugaacaucagaggacauauccuggagaaaagcccuacgaaugcauugauu

SEQ ID NO: 20174 - RNA, 64 nt, Human
ggaacccugaugagcacaaggugauucaggccagcuggagaagcuuccagaagggcccugcacu

SEQ ID NO: 20175 - RNA, 64 nt, Human
acccuguguaugugauuauucugagcuuuuuggccuggagaagggagggcgggcuagaaggcca

SEQ ID NO: 20176 - RNA, 64 nt, Human
ggccacugagacacaaaccuauuuauuucuaggccuggagaaaggagaucggacugggguuccc

SEQ ID NO: 20177 - RNA, 64 nt, Human
ucuguagguuuucaagcacaugaaagaacucacacuggagaaaaacccuaugaauguaaaaaau

SEQ ID NO: 20178 - RNA, 64 nt, Human
acuguggugguuauucccgaggagccagagaaaccuggagaagagaucagaacaccuggggucc

SEQ ID NO: 20179 - RNA, 64 nt, Human
auucuguauuugucucccaugucuugcucuucuccuggagaauucugucuucucuuuggccauc

SEQ ID NO: 20180 - RNA, 64 nt, Human
uugucacacuugauuguagguaagguaaguuauacuggagaaaacuucuacaugugugaacagu

SEQ ID NO: 20181 - RNA, 64 nt, Human
ggcugucacacuugauuguagguaagauaauauacuggagaaaacuacuagaauaaacaaugug

SEQ ID NO: 20182 - RNA, 64 nt, Human
ggaaaccccacacaggaauucccaucccuggaaacuggagaauuucaaugccccgaguccaugg

SEQ ID NO: 20183 - RNA, 64 nt, Human
gagauccucaagucacugguggcucgcuuugaugcuggagaacuaaucacccagagggagcugg

SEQ ID NO: 20184 - RNA, 64 nt, Human
gaaacccacaagugagcaugggggaaugcccauccuggagaagaauucuugcccuccccucucu

SEQ ID NO: 20185 - RNA, 64 nt, Human
uuggggacugaggguggggggaguagaggggccgcuggagaauguauucaaaacaauaaaacuu

SEQ ID NO: 20186 - RNA, 64 nt, Human
ccagcaguacguggcuucagaggccuggcaucuucuggagaagcuugugguguuccugaagcaa

SEQ ID NO: 20187 - RNA, 64 nt, Human
ccaaaacaaauaaagaaacacaaaacccucagugcuggagaagagucagugagaccagcacucu

SEQ ID NO: 20188 - RNA, 64 nt, Human
aaaauaaaacuucaacagauugagagaguucacacuggagaaauacuuuccucuggcaaacccc

SEQ ID NO: 20189 - RNA, 64 nt, Human
cauuaaagccuuguaagacauacaauaauuuauacuggagaaaaacuuugcaaguauaaugaau

SEQ ID NO: 20190 - RNA, 64 nt, Human
acaaaucacagcuugaaagacaggagaauucauacuggagaaaaaacauacaaauguaagguuu

SEQ ID NO: 20191 - RNA, 64 nt, Human
caaauccagcuucaaauacauaggagaauucacacuggagaaaagccauagaaauguaagguuu

SEQ ID NO: 20192 - RNA, 64 nt, Human
auaaguuuuauagguacaacugucaaagacgacacuggagaagagccaagcuggaucuauaagg

SEQ ID NO: 20193 - RNA, 64 nt, Human
gaagccagcuggacuuccuggguugaauggggaccuggagaacuuuucugucuuacaagaggau

SEQ ID NO: 20194 - RNA, 64 nt, Human
aagccuaggucacaacaucuguaaacuaggagaacuggagaagacuccacgcccuuccagcuuu

SEQ ID NO: 20195 - RNA, 64 nt, Human
uucccugagagccaucauuccuaacgaccuugaucuggagaauguggagggagcaugucccuga

SEQ ID NO: 20196 - RNA, 64 nt, Human
uggaaggcauuccaucaacaucagagaacucaugcuggagaaagacauuccaaauauaacuauu

SEQ ID NO: 20197 - RNA, 64 nt, Human
uaugaguggcaaauguggaaaaucuguuagcacccuggagaaaguccuugaguacacagugaau

SEQ ID NO: 20198 - RNA, 64 nt, Human
acaucccgucucauuaaacacaggagaguucauacuggagaaaggccuuaugagugcugucaau

SEQ ID NO: 20199 - RNA, 64 nt, Human
ccuguugcagcacaaggccggggucucuggggggcuggagaagccucccucauuccucccagga

SEQ ID NO: 20200 - RNA, 64 nt, Human
ggauacuugcaggaagcugcuaccacccuuagggcuggagaacccagggaagcuaagaggaggg

SEQ ID NO: 20201 - RNA, 64 nt, Human
ucccagggguucagacuuuggcugagaacagccccuggagaacauggggugacugcuaccauag

SEQ ID NO: 20202 - RNA, 64 nt, Human
ggguaggagggccugccugagucccagcucccagcuggagaauccaccagcacaagaagaggag

SEQ ID NO: 20203 - RNA, 64 nt, Human
ggaagauguauagcuuuagcuuuagccuggcaaccuggagaauccacauaccuuguguauugaa

SEQ ID NO: 20204 - RNA, 64 nt, Human
agccucccauugucaggcagaagcugcccaaagccuggagaaggacuuguuugcccucuuuccc

SEQ ID NO: 20205 - RNA, 64 nt, Human
uuuucagaaagcacgaaaaauuauuuauaauagucuggagaaaaaacacacuguaauauuucaa

SEQ ID NO: 20206 - RNA, 64 nt, Human
augcaacccccaauagacccccuuuuacucugaucuggagaauguaucuggcuucauauuuuca

SEQ ID NO: 20207 - RNA, 64 nt, Human
accuauuuuugaaggcauaaaagcaguugaguuucuggagaauuuuuggauggugauuaaugac

SEQ ID NO: 20208 - RNA, 64 nt, Human
uuggguugucagccauggacauggauuucaaccccuggagaaaacgaugucauuguucagcagc

SEQ ID NO: 20209 - RNA, 64 nt, Human
gucuggucauguggaggugggguuuauugggaugcuggagaagagcugccaggaaguguuuuuu

SEQ ID NO: 20210 - RNA, 64 nt, Human
cuggcucugucaagcugggucaggggccuugaaacuggagaaguggaagucuaugguuggucug

SEQ ID NO: 20211 - RNA, 64 nt, Human
guccagauucuccuuguuuucauggauucaggugcuggagaaucugguaaaagcaccauuguga

SEQ ID NO: 20212 - RNA, 64 nt, Human
cuggguuugucuggacaccgagagcgaccacauccuggagaagccaggagaaaagcucaggaag

SEQ ID NO: 20213 - RNA, 59 nt, Human
uucgagggccacggagaugagccuggacccuggagaaggaggccaggagccagccacug

SEQ ID NO: 20214 - RNA, 64 nt, Human
aggaacccagagccacauuagaaguuccugagggcuggagaacacugcugggcacacucuccag

SEQ ID NO: 20215 - RNA, 64 nt, Human
cuuugcuaccaaagcaccuuagcuggcauuacagcuggagaagacccuccccgcaccccccaag

SEQ ID NO: 20216 - RNA, 64 nt, Human
aaacacuaaguuccuuaucucagaugcuguucuacuggagaaguucuagauucccacuguccaa

SEQ ID NO: 20217 - RNA, 64 nt, Human
acagaggguguuagaaaacaaagggcagagaguccuggagaagguggaguagucagaaaacuuu

SEQ ID NO: 20218 - RNA, 64 nt, Human
cagaccuggggacagaggugaaaugcacaagcugcuggagaaggggucagagccauaucaaguu

SEQ ID NO: 20219 - RNA, 64 nt, Human
uccuuucagaugaucaugggcuggccgcugcccucuggagaaccuucuucaaccggaaauguga

SEQ ID NO: 20220 - RNA, 64 nt, Human
uaauuuguuuucuugaaaauuguuaauuucaagacuggagaaauaaacucaccuucuauuuacu

SEQ ID NO: 20221 - RNA, 64 nt, Human
cacauaucacauccauucucaagguaguuauaugcuggagaagaaaaauccucuagacacauga

SEQ ID NO: 20222 - RNA, 64 nt, Human
uaggagcaagaaagucucuucggccucgggcuuccuggagaaggggacguccauuccugcuggg

SEQ ID NO: 20223 - RNA, 64 nt, Human
cauaggucggggugccaagucagugcgcgaguuccuggagaagaacuauacugacgaagccauu

SEQ ID NO: 20224 - RNA, 64 nt, Human
ccaguuccgucucagcuaccuggacuccaggacccuggagaagggagaccuggcaguggaggga

SEQ ID NO: 20225 - RNA, 64 nt, Human
gcaggggcuccaagccccagcguggggaagggcccuggagaagcccucauccucaugggaacca

SEQ ID NO: 20226 - RNA, 64 nt, Human
accccucagcucggaggcugugggcuccucaaagcuggagaaagaggccaagauuuuucugcac

SEQ ID NO: 20227 - RNA, 64 nt, Human
uucaauuuuacuccacuuaauuaccgaaaacuuacuggagaacauguuccaaaucuucaguauc

SEQ ID NO: 20228 - RNA, 64 nt, Human
cuguuugaggaagugucugaccugggccugagagcuggagaaggugcagauucaaagugagcgg

SEQ ID NO: 20229 - RNA, 64 nt, Human
uccggccaagaggcacaagcagcucaagaacaagcuggagaagaacgaggaggcggcccugcua

SEQ ID NO: 20230 - RNA, 64 nt, Human
cacuagauugacugaggaauguaugucuaaauuccuggagaagaugauauggauuggaaacuga

SEQ ID NO: 20231 - RNA, 64 nt, Human
ggaaucuucucugaaaacuaauccauaaaguucccuggagaaauuggucagaaugaucugucag

SEQ ID NO: 20232 - RNA, 64 nt, Human
cagcacauguuaccaugucugaccugcaaaaaugcuggagaaaaaugaaggaaaaaauuauguu

SEQ ID NO: 20233 - RNA, 64 nt, Human
gggcaggccgcugaccugaggucuggagaaaccccuggagaaggguguccccaccagcccauac

SEQ ID NO: 20234 - RNA, 64 nt, Human
agccggaggaacgggcaggccgcugaccugaggucuggagaaaccccuggagaagggugucccc

SEQ ID NO: 20235 - RNA, 64 nt, Human
cccccuccccagcccucaggcccucccugccaaacuggagaaccccaccccaaggcaugccacg

SEQ ID NO: 20236 - RNA, 64 nt, Human
ucugauucccuccuugcccgaccucugcuaggggcuggagaacagagcucagagcacccagugu

SEQ ID NO: 20237 - RNA, 64 nt, Human
ccaggaagggguguccaggacaauuaccuuccuucuggagaaacuucccuuaaucaaauaagag

SEQ ID NO: 20238 - RNA, 64 nt, Human
gagaggacccucaggccucugagggcaccaggcccuggagaagaggugcaauucagggugugug

SEQ ID NO: 20239 - RNA, 64 nt, Human
ugccuggcaccccugaaccaugaucugagccucccuggagaagguauuuuauaugucugcugcc

SEQ ID NO: 20240 - RNA, 64 nt, Human
cugggccagaagcuguugaccauaccaggagucacuggagaaaggggcugugcuggggccagac

SEQ ID NO: 20241 - RNA, 64 nt, Human
gucuuauuagugucuauucuuaaaauuaagugggcuggagaagaauggagcuccacaugccagc

SEQ ID NO: 20242 - RNA, 64 nt, Human
caaggaauccgccaucuuggcuguagacauaggucuggagaaaucucucccuuuuuccuugauu

SEQ ID NO: 20243 - RNA, 64 nt, Human
uuugcuuuguucacugcuuauuaaaauggaaauccuggagaauaguaguucuggaauauugccg

SEQ ID NO: 20244 - RNA, 64 nt, Human
cacuugcuggacagucugagccaagucccuccugcuggagaaaagccuggaacugccaaaacaa

SEQ ID NO: 20245 - RNA, 64 nt, Human
cuagaccucagguggucucuugguguuagugaugcuggagaagagaauauuacugguuucuacu

SEQ ID NO: 20246 - RNA, 64 nt, Human
uggcccucuaaugacaccauucuucuggaaaaugcuggagaagcaauaaagguuguaccaguca

SEQ ID NO: 20247 - RNA, 64 nt, Human
gcuggagggagaagcugucagggacccagggcgccuggagaaagaggcccuguuacuauuccuu

SEQ ID NO: 20248 - RNA, 64 nt, Human
acuccauggcuaagaccacagacgggcacacagacuggagaaaaccccucccacggugcccaaa

SEQ ID NO: 20249 - RNA, 64 nt, Human
cgguucuuaauacugaagucaugauguguauuuccuggagaaauuccucuuuaaaugaacaagu

SEQ ID NO: 20250 - RNA, 64 nt, Human
ugucuugaaaauaaacugcuagaauaaagaaaugcuggagaaauugauuauaagagacuauagc

SEQ ID NO: 20251 - RNA, 64 nt, Human
cacgaacaggggcacucggcaugcugccccagcacuggagaagcagcgcugugggggcaaucug

SEQ ID NO: 20252 - RNA, 64 nt, Human
gacagcuggcggaggcugcucggcuacugguuaccuggagaaguaguauuugccuauuuccccc

SEQ ID NO: 20253 - RNA, 64 nt, Human
acagucuuuuuauuguggauugugaaaucaaaaucuggagaaaugcuuauaaaauauacuacua

SEQ ID NO: 20254 - RNA, 64 nt, Human
guuuauuacuuauuugggguugcaucagaaaugucuggagaauaauucuuugauuaugacuguu

SEQ ID NO: 20255 - RNA, 64 nt, Human
aaccccugcauucugcucugcucuaauacacuaccuggagaaagucuuuuccuuauuuucaaua

SEQ ID NO: 20256 - RNA, 64 nt, Human
ggugaaagcguuccguagcucgcucuaugaaggccuggagaaaccagaauccaagaccuccauu

SEQ ID NO: 20257 - RNA, 64 nt, Human
ugcauauacaugaauauaccuugagcaugaaucccuggagaaaucguuuucguagcucaccaau

SEQ ID NO: 20258 - RNA, 64 nt, Human
uaugaaaaucaacucauuuuauucucggcaacaucuggagaagcauaagcuaauuaagggcgau

SEQ ID NO: 20259 - RNA, 64 nt, Human
aaccgcccagugcagguauuucagaaggagaaggcuggagaaggacaugagaucagggccugcc

SEQ ID NO: 20260 - RNA, 64 nt, Human
uggauccuaggccccugggaucuguacccaggaccuggagaauaccaccccacccccagcccau

SEQ ID NO: 20261 - RNA, 64 nt, Human
uaggguccccccugugaauuagaaaguugcuuggcuggagaacugacaacacuacuuacugaua

SEQ ID NO: 20262 - RNA, 64 nt, Human
uuugguauccuuaucuaguguuugauugucaaugcuggagaaaaauaucuguaagaguguuuau

SEQ ID NO: 20263 - RNA, 64 nt, Human
guuauuugaauggauucccaucuuugucucuagccuggagaagagcaaaauggagggggagggg

SEQ ID NO: 20264 - RNA, 64 nt, Human
ugcuguuuuguauaguuacuauccugugcagcagcuggagaaagcacucaccucaggcuuacaa

SEQ ID NO: 20265 - RNA, 64 nt, Human
ugaaugggagaaacauaguaucgggugaggccagcuggagaacugcaacgccuacgcccccagu

SEQ ID NO: 20266 - RNA, 64 nt, Human
ggccucuccaaggcugcccgugcguccugggacccuggagaaggguaaacccccgccuggcugc

SEQ ID NO: 20267 - RNA, 64 nt, Human
aucauccagaagcacugugauauuguguaagcaucuggagaaaauucaguuaaaagaauaaaag

SEQ ID NO: 20268 - RNA, 64 nt, Human
guauccccagcccuuggcaacacuggagugcacacgccgccacgguugcccagaaaaagugccc

SEQ ID NO: 20269 - RNA, 64 nt, Human
aggaaggugcagcuuuuccauaucagcucaaccacgccgccaguccauucuuaaggaacugccg

SEQ ID NO: 20270 - RNA, 64 nt, Human
aaggcauugccaagccccccgagugaggacgcaccgccgccaccagcccgcaacucuccagccg

SEQ ID NO: 20271 - RNA, 64 nt, Human
cagcccaggcagcaccagcgcggccacgugcacgcgccgccacuacgagagguacggcggggcg

SEQ ID NO: 20272 - RNA, 64 nt, Human
cucagccugccgagugccugcgauuacaggcgcgcgccgccacaccugacugguuuucguauuu

SEQ ID NO: 20273 - RNA, 54 nt, Human
ccaaacugacgcaucuguagcggccgccgccagcccgaacucgcggcaaaauua

SEQ ID NO: 20274 - RNA, 64 nt, Human
acugcccaggccuuuguuaggaaaacccaugggccgccgccacacucagugccauggggaagcg

SEQ ID NO: 20275 - RNA, 59 nt, Human
agauacagguggacgauugaagacaaagccgccgccaauccugggcucuggggcccugg

SEQ ID NO: 20276 - RNA, 64 nt, Human
ccugguccucucgcaggaaugcugcugcugccuccgccgccacugcugcugccaccucuuauau

SEQ ID NO: 20277 - RNA, 64 nt, Human
ggcaggcucaccugggacucaacguuccuucccccgccgccacugugccccccgucccuccacc

SEQ ID NO: 20278 - RNA, 64 nt, Human
gcgcgacgccggccccggucgcagccgacgacgccgccgccagccugaccucacacccucuggg

SEQ ID NO: 20279 - RNA, 64 nt, Human
cccgcgggcgggggcugcagggccgugccgccgccgccgccaggcacuccggagcuguccgcuu

SEQ ID NO: 20280 - RNA, 64 nt, Human
ggcuucauucgagagcugcugccaaaacgccuggcgccgccaccgucgggggcuggcuucgagg

SEQ ID NO: 20281 - RNA, 64 nt, Human
cgcugccccggguggugagcgggcaggaaccuggcgccgccaccgagacugagccuccugcaga

SEQ ID NO: 20282 - RNA, 59 nt, Human
agcaagcaggcgaaucguaaugaggcgugcgccgccaauaugcacuguacauuccacaa

SEQ ID NO: 20283 - RNA, 64 nt, Human
cucagccucccaaguagcugugacuaaaggugcacgccgccaugcccagcuaauuuuuuguauu

SEQ ID NO: 20284 - RNA, 64 nt, Human
gugcuggacgugucccggagacccaccgggagggcgccgccaugccuuguacccccaccgugca

SEQ ID NO: 20285 - RNA, 64 nt, Human
gcauuaaucccaggaaccacuagcaguaguggggcgccgccaaucuaacaugagcacaggugcu

SEQ ID NO: 20286 - RNA, 64 nt, Human
agcccagugacagaaagaacagccucugucaccccgccgccacugccuugguuacucagagcac

SEQ ID NO: 20287 - RNA, 64 nt, Human
gcaggaguagggaggaaaaggaguucuggagaggcgccgccauccuguuuucuggaaaggcugc

SEQ ID NO: 20288 - RNA, 64 nt, Human
cucagccugcugaguagcugguauacaggcacaucgccgccacacccagcucauuuuuguauua

SEQ ID NO: 20289 - RNA, 64 nt, Human
agggaacucuccccauuggcaaaccggacccggccgccgccaggacuguguuuccaaagguucc

SEQ ID NO: 20290 - RNA, 64 nt, Human
gaccccgugccucucgugguccuuugagggaucccgccgccaccacccuuguauuuuaucacgu

SEQ ID NO: 20291 - RNA, 64 nt, Human
ugcaagugcuggagucuccugaggacacgcgcgucgccgccaccgcgggugugggaaagcgcgg

SEQ ID NO: 20292 - RNA, 64 nt, Human
gcaggcucaggcggccccacucacccacagcauccgccgccaccccuucgggugugagcgcuca

SEQ ID NO: 20293 - RNA, 64 nt, Human
uuuuuacaaaggggaaugguucuccagugcagcccgccgccacuggagugcccuguauggaagu

SEQ ID NO: 20294 - RNA, 64 nt, Human
ggccgcuccagaagggugcccagucaggccgcaccgccgccagccuccuccggcccuggaggga

SEQ ID NO: 20295 - RNA, 64 nt, Human
gcuuucacugcggucccgcuuagcgacccgccgccgccgccaagcgaggcugaggacuccgauc

SEQ ID NO: 20296 - RNA, 64 nt, Human
gagccgcggguugacgacgguguccucgcagugucgccgccaccccagcguaguccaagucaga

SEQ ID NO: 20297 - RNA, 64 nt, Human
cccacacccggugcccacaucccgccgccgccgccgccgccaugcccaagagaaagacugaagg

SEQ ID NO: 20298 - RNA, 64 nt, Human
cuggcccaguccugggccucggcccuucccgcaccgccgccagcgcccgcagacacccuggcau

SEQ ID NO: 20299 - RNA, 64 nt, Human
ugguggugcugggggaggcaccccacagacucagcgccgccagagauaggguuuuuggagggcu

SEQ ID NO: 20300 - RNA, 64 nt, Human
ugaaguauguagggugggcagaagccacagucgccgccgccaggggcuugcuccuggcucuguc

SEQ ID NO: 20301 - RNA, 64 nt, Human
agcauaccugcugguguguaaguguggacuaacccgccgccaccacccucuguuccagcaggcu

SEQ ID NO: 20302 - RNA, 64 nt, Human
ggcucucacucagcucccacgggacucagaagugcgccgccaugcugccuaggguacugucccc

SEQ ID NO: 20303 - RNA, 64 nt, Human
ugcacgccgcccuccgccacgccacagccacagccgccgccaucacucgcucgcccucccgcuu

SEQ ID NO: 20304 - RNA, 64 nt, Human
aaggcugcuggcuucagggaggguuagccugcaccgccgccacccugccccuaaguuauuaccu

SEQ ID NO: 20305 - RNA, 64 nt, Human
cucagccugccgagugccugcaauugcaggcgagcgccgccacgccugacugccucggccuccc

SEQ ID NO: 20306 - RNA, 64 nt, Human
cguucugucugccaccugaagggaauuugaggaccgccgccagggcaccccguacauacacaca

SEQ ID NO: 20307 - RNA, 64 nt, Human
accagcccacccagccaguggucgagcacugccccgccgccaaagucugcagaaugugagauga

SEQ ID NO: 20308 - RNA, 64 nt, Human
ugccuccuccgggaagccuucccugcccagcccacgccgccaccgggaggaagccugacugucc

SEQ ID NO: 20309 - RNA, 55 nt, Human
gcgcccuggcccuggccugagcccacgccgccaggaggcagggagggcuccgccg

SEQ ID NO: 20310 - RNA, 60 nt, Human
aggccacaagaggaagcugaaugaagaggacgccgccagcgaguccagcagggaguccag

SEQ ID NO: 20311 - RNA, 64 nt, Human
agacccggcucugagcgccccgcagcccggccgccgccgccaagcaucuguccccuccuccccc

SEQ ID NO: 20312 - RNA, 64 nt, Human
ggcacccacccagcugggguguuuuugggggagucgccgccaagcccaggcugcuggagccagg

SEQ ID NO: 20313 - RNA, 57 nt, Human
ugccugugcccgucauguaaucucacccgccgccacuagguguccccaacguccccu

SEQ ID NO: 20314 - RNA, 64 nt, Human
ccugaagugccagcaccaccagcaccagauccuccgccgccacaccgcacugaggacacgccgg

SEQ ID NO: 20315 - RNA, 64 nt, Human
cucagccuccugaguagcugggauuacaggugugcgccgccacacccagcuaauuuuguauuuu

SEQ ID NO: 20316 - RNA, 64 nt, Human
cagcagguccgcauccaggagaugcugcuucaggcgccgccacugggccccgggacccccacgg

SEQ ID NO: 20317 - RNA, 64 nt, Human
gcgcggcacccggagccacagcuggcggggucuccgccgccagcccugcagcgggccggccaga

SEQ ID NO: 20318 - RNA, 64 nt, Human
aagaaucuggcucucaggguggcuucugcguccccgccgccaggccccagacuauggucacagg

SEQ ID NO: 20319 - RNA, 64 nt, Human
cucaacaucugguaccagcacuccgcggcggggccgccgccagcucccccagacccccuccacc

SEQ ID NO: 20320 - RNA, 64 nt, Human
cccuccacccccuccaacucugcuccucuagggccgccgccaccuccccugggaccccgccccc

SEQ ID NO: 20321 - RNA, 64 nt, Human
ggccuugguccccagaagauggcggcuagggccucgccgccaggacagagaagggacggggugg

SEQ ID NO: 20322 - RNA, 64 nt, Human
ccagcuuugguaucuggagauuuccagggccccucgccgccacguccugacucucgggugaucu

SEQ ID NO: 20323 - RNA, 64 nt, Human
gggagcccugucccuguugcuguggccccucucacgccgccaucucucugccccgccccgcccc

SEQ ID NO: 20324 - RNA, 64 nt, Human
uuuucugcucagugugauccugagauggcuuccccgccgccacccagagugugguccuuggccg

SEQ ID NO: 20325 - RNA, 64 nt, Human
gcugcccacagagggccgagggucacccgucggccgccgccaccccaggcgaggccggaggaag

SEQ ID NO: 20326 - RNA, 64 nt, Human
ccguugcagcccagagccacuggucccuacagggcgccgccacaccagcaggaaggaggauggc

SEQ ID NO: 20327 - RNA, 64 nt, Human
ccaauccggagaaggggcucuguccacagucccccgccgccagguggcccacaugggaccagca

SEQ ID NO: 20328 - RNA, 64 nt, Human
ggcugcccagggcuggaggggacgcuguuccucccgccgccacugcccaaccuuuccugauaau

SEQ ID NO: 20329 - RNA, 64 nt, Human
gggccagcacggaccacccaaggccucugcuucccgccgccacccuccucgcugccauucucug

SEQ ID NO: 20330 - RNA, 64 nt, Human
cgccaucccugcaggccagggcacacggugcgcccgccgccagcuccucggaggccagacccag

SEQ ID NO: 20331 - RNA, 64 nt, Human
agccagguguguguacauacggggucucucuccacgccgccaagccagccgggcggccgacccg

SEQ ID NO: 20332 - RNA, 59 nt, Human; identical to SEQ ID NO: 20282

SEQ ID NO: 20333 - RNA, 64 nt, Human
ccucaccagaggaugccaccuccgcccccacccccgccgccagaggaguacaagagccagaggc

SEQ ID NO: 20334 - RNA, 64 nt, Human
ucgacccucgggccucgggggggagggcccugcacgccgccacccccuccccgcagcccucacc

SEQ ID NO: 20335 - RNA, 64 nt, Human
uagaggaugaggggcccugacccugugucuccaacugcugcaccccaucccgacccugucuccg

SEQ ID NO: 20336 - RNA, 64 nt, Human
ucgagggauggggcgucgucagcuggcacugucucugcugcagcggccacacuguacucugcac

SEQ ID NO: 20337 - RNA, 64 nt, Human
uguuggccuuuggucagcguuuccacauccugcucugcugcaggagagggggcuaaggggcugg

SEQ ID NO: 20338 - RNA, 64 nt, Human
uaagcuugggcgugugcaggaguuugacaguggccugcugcacuggcggauuggugggggggac

SEQ ID NO: 20339 - RNA, 64 nt, Human
cccagggcugcugcucauccugggcaagcugauccugcugcaccacaagcacccagaacggaag

SEQ ID NO: 20340 - RNA, 64 nt, Human
acuguuuuuggagaucaugaauguuucuacaacacugcugcauucauuugaccauuugaguuug

SEQ ID NO: 20341 - RNA, 64 nt, Human
auuggucuguccugggccaacuggugggugaucucugcugcauccaacaugggagcagagacug

SEQ ID NO: 20342 - RNA, 64 nt, Human
accccgguacaaggaggcagcuaaccacugugcccugcugcaggagcaugcacagcggugcuau

SEQ ID NO: 20343 - RNA, 64 nt, Human
aauggaugccccaguguccgggauguguggccagcugcugcaggcaggacuccagcgucaggau

SEQ ID NO: 20344 - RNA, 64 nt, Human
ugauguccuuggacuccaucgcuaaagggaccaucugcugcaguuaccacagcaacugaccuga

SEQ ID NO: 20345 - RNA, 64 nt, Human
aagcccuuauauuaauuuaugagcuuuuccaucucugcugcagaccugugcuaaugcuuagugu

SEQ ID NO: 20346 - RNA, 64 nt, Human
gguguacuauauuugugagccuaggguaggggcacugcugcaacuucugcuuucaucccaugcc

SEQ ID NO: 20347 - RNA, 64 nt, Human
acucugaaggacaaaaacaagcaaacaaaaaccccugcugcagcauuucaggugcaguaugaua

SEQ ID NO: 20348 - RNA, 64 nt, Human
uaaaggagauauuuuuaaaacaggguacaacccccugcugcacacgcuagcauaucuggaaccu

SEQ ID NO: 20349 - RNA, 64 nt, Human
gagaacuagaccacuuucuucauucuuuucuaaacugcugcagauugccgugaacucuaucaau

SEQ ID NO: 20350 - RNA, 64 nt, Human
aaaucucugggcuucgacugcugccagggaggagcugcugcaagccagagggaggaagggggag

SEQ ID NO: 20351 - RNA, 64 nt, Human
aagauggcgagaccccaagagggaucucauagcacugcugcauuugccguugacgcaguccuga

SEQ ID NO: 20352 - RNA, 64 nt, Human
uccucaucuccaugcucuuucacccugccacccucugcugcacaguaguguuggguggaggaug

SEQ ID NO: 20353 - RNA, 64 nt, Human
uagcccagccuagcgugcccugccccucuggccacugcugcagacaccugccuuaacacacaca

SEQ ID NO: 20354 - RNA, 64 nt, Human
aggacugccaggcugcuggaggaccugccccuaccugcugcaucgucaggcucccacgcuuugu

SEQ ID NO: 20355 - RNA, 64 nt, Human
aucuguauuuuauguaauguaauugacaggauggcugcugcagaaugcugguugacacagggau

SEQ ID NO: 20356 - RNA, 64 nt, Human
uuccugggauccaccacccucuacucucagcugacugcugcauuuaggccaggucuccaauugc

SEQ ID NO: 20357 - RNA, 64 nt, Human
ugcaugucucuaacauuaauagaaggcauggcuccugcugcaaccgcugugaaugcugcugaga

SEQ ID NO: 20358 - RNA, 64 nt, Human
guauauuuuucccuuuuauaaugugcuuuucacacugcugcaaaccuuaguuacauccuaggaa

SEQ ID NO: 20359 - RNA, 64 nt, Human
gaaaaaugucucuuuuuccugugccauuugccuucugcugcaacgaaaauauuuccugauucaa

SEQ ID NO: 20360 - RNA, 64 nt, Human
uuugguaccucuaguagauaguguguucauuucccugcugcaaauuuugaaguauuugggcagg

SEQ ID NO: 20361 - RNA, 64 nt, Human
cguguucaaagagcaauauuccaguaaaugcagacugcugcaaagcuuuugccugcaagagaau

SEQ ID NO: 20362 - RNA, 64 nt, Human
cugucaugcugggaagugccuacucucugggccacugcugcagaggccguggcacuugucaugg

SEQ ID NO: 20363 - RNA, 64 nt, Human
caguccccagcccuucugccuuucucccccgacacugcugcaccagagugaaagggcuauggca

SEQ ID NO: 20364 - RNA, 64 nt, Human
acagacugcaagaggcuccuguccccuggggucucugcugcauuugugucaucuuguugccaug

SEQ ID NO: 20365 - RNA, 64 nt, Human
uuuugugacauauugucaugcugaggugugacaccugcugcacucaucugauguaaaaccaucc

SEQ ID NO: 20366 - RNA, 64 nt, Human
cuugucagacuuggcaucuaucucaguuaggauccugcugcagaaaacaagagccacuuguagc

SEQ ID NO: 20367 - RNA, 64 nt, Human
cugccuuauaagcacagucaucugaaagucaggccugcugcaggacaggaucccccagagaccc

SEQ ID NO: 20368 - RNA, 64 nt, Human
uacauagucuucgugucuuucuggaccccuuguccugcugcaugccuguuggcuacugggcuca

SEQ ID NO: 20369 - RNA, 64 nt, Human
ccuggggcugcccagagacuguggguggagcugccugcugcacucagcagugcggucagagaag

SEQ ID NO: 20370 - RNA, 64 nt, Human
accccagcucugccugugccuuuaucccugacagcugcugcacuagccuuccugcuucccuaag

SEQ ID NO: 20371 - RNA, 64 nt, Human
auauugauuucuuguuuuuuuuccguaacauugucugcugcaauuuaaauaaaaauuacgacau

SEQ ID NO: 20372 - RNA, 64 nt, Human
ucagcccuuaaguucacuaagaaggucugaguuucugcugcagauagugguguuaacugcucca

SEQ ID NO: 20373 - RNA, 64 nt, Human
ggguacacaaucagguuggaguccuguccuuacucugcugcaccagcugcagaaccaacugcuc

SEQ ID NO: 20374 - RNA, 64 nt, Human
gaguagcagggucaggguucgugugcuccuccuccugcugcaggggcugcacaucccauugccc

SEQ ID NO: 20375 - RNA, 64 nt, Human
acagaagcccucugcccucugguggccucugggccugcugcauguacauauuuucuguaaauau

SEQ ID NO: 20376 - RNA, 64 nt, Human
uuccaaacccuccugggaaggccaccucccacuccugcugcacaggcccuggggagcuuuugcc

SEQ ID NO: 20377 - RNA, 64 nt, Human
ugccgucuacucacauuccuauccuggaaacauacugcugcacugacuuuucuccgugugaccc

SEQ ID NO: 20378 - RNA, 64 nt, Human
cgcugcaugggccccgcuugcgguucauucaggccugcugcaggagcucugagaacaagaaaga

SEQ ID NO: 20379 - RNA, 64 nt, Human
agaggucagggcacuuucaaucccucaccuaguccugcugcacagggcaggaggccucacagaa

SEQ ID NO: 20380 - RNA, 64 nt, Human
augugcaugaauucaccgcaacacaugcagacaacugcugcaauggagaguaugaagaaaccug

SEQ ID NO: 20381 - RNA, 64 nt, Human
ccugccaaggcugaaucccugggcccagucagcccugcugcacauggcacaggcauugcacacg

SEQ ID NO: 20382 - RNA, 64 nt, Human
ccugcaagggcugaguucccaggcccugccagcccugcugcacagggugcaggcauugcacacg

SEQ ID NO: 20383 - RNA, 64 nt, Human
ucauggagggcgacgaggaggacagaggcugcugcugcugcaaaccaggccacuugccucaccu

SEQ ID NO: 20384 - RNA, 64 nt, Human
gugcuccgugcuggugauuuuauguggcagcccucugcugcaguuccgaaacuuguuggcaacg

SEQ ID NO: 20385 - RNA, 64 nt, Human
guugguauuucccaguggcugaaaaccugauuuucugcugcacguggcaucugauuaccugugg

SEQ ID NO: 20386 - RNA, 64 nt, Human
ugauaacugagcaggguggauccugucccuggagcugcugcacccauuaauucucccuuguugc

SEQ ID NO: 20387 - RNA, 64 nt, Human
guuuggaaaggaguagaacaugcagcauaagaaacugcugcagaguggugcgaggaguacauuu

SEQ ID NO: 20388 - RNA, 64 nt, Human
uguggaauuaauucguugcauauagagguaucaacugcugcauguucaggcauauuauaaaacu

SEQ ID NO: 20389 - RNA, 64 nt, Human
gagugcuuuaacuuaaaacaggcguuuggaauagcugcugcaauguagucuugugugugauuuu

SEQ ID NO: 20390 - RNA, 64 nt, Human
agcugguuggcgacuguucuuuccagaccugcuccugcugcacagagccgcagggcugagacca

SEQ ID NO: 20391 - RNA, 64 nt, Human
accugcgcccuccguggucccgauccuguugcugcugcugcaccgcccgccuuugccucgucuu

SEQ ID NO: 20392 - RNA, 64 nt, Human
gcauuuccucuguaauguggcgcuuucaacuguacugcugcagcuuuaaguaccuuaaagcuuc

SEQ ID NO: 20393 - RNA, 64 nt, Human
caucacucccaaugccucccuuuccuggaggagccugcugcauucuccugcugagggaucccag

SEQ ID NO: 20394 - RNA, 64 nt, Human
guagaagacacaccaguaaagcuacuguuggaaucugcugcaggggccuuugugugcccuaaaa

SEQ ID NO: 20395 - RNA, 64 nt, Human
cccuggcgccucuucccuggggcugaaucaggcccugcugcaaaacuccaggcuucccaggguu

SEQ ID NO: 20396 - RNA, 64 nt, Human
ggaaaaaaaaaaauuuuuuuuucacugacuaaaccugcugcagcucucuuuuacuacagacuug

SEQ ID NO: 20397 - RNA, 64 nt, Human
uugcuccaugucuccucauuccuacaccuauuuucugcugcaggaugaggcuaggguuagcauu

SEQ ID NO: 20398 - RNA, 64 nt, Human
acaugccuuugcacaggccaccccccucuucaggcugcugcaggaggccaggcccaggccagag

SEQ ID NO: 20399 - RNA, 64 nt, Human
gguuuauucacugaacucuagugcgguuuacucacugcugcaaauacuguauauucaggacuug

SEQ ID NO: 20400 - RNA, 64 nt, Human
cuccgaggcugaacggggacugugagcgaucccccugcugcagggcgaguggccuguccagacc

SEQ ID NO: 20401 - RNA, 64 nt, Human
gaggggcgcccaccuccccacgcccuccccuccccugcugcaggggcucuggagagaaacaaua

SEQ ID NO: 20402 - RNA, 64 nt, Human
cgagagugguugggggugggccguggcuaguguccugcugcagucagcacacacgugggauugg

SEQ ID NO: 20403 - RNA, 64 nt, Human
agaggguggaaggagccaggacgcacccccacugcugcugcaggagccgcugcugagcugcgug

SEQ ID NO: 20404 - RNA, 64 nt, Human
acuuuaguaaugcaaaauaacucauuuccaacuacugcugcagcauuuugguaaaaaccuguag

SEQ ID NO: 20405 - RNA, 64 nt, Human
aagcaaaauugguuaaucuacaccuuaacucuggcugcugcaauugaaaacuuucuuucuaaua

SEQ ID NO: 20406 - RNA, 64 nt, Human
accuuuccuuaucaaauagaauaucacugauauacugcugcaugaauaagaaccauuauguggg

SEQ ID NO: 20407 - RNA, 64 nt, Human
cuggauuggccuccaugacccccaccggaucagucugcugcaucuucuaccuccugauuaucag

SEQ ID NO: 20408 - RNA, 64 nt, Human
gaccagaggaagcagguuaaaugagaccuguccucugcugcacucagaaaaaauaggcaguccc

SEQ ID NO: 20409 - RNA, 64 nt, Human
ucagucauagauguuaauagaggaagcaguuuuccugcugcagauuccugaauagaguugcuga

SEQ ID NO: 20410 - RNA, 64 nt, Human
acucccagugccaaagccagaccacugggguuuccugcugcaggaauugggggcugggaacagc

SEQ ID NO: 20411 - RNA, 64 nt, Human
gaguucaauggcugcugaagcugccugcuuuucacugcugcaaggccuuucugugugugaugug

SEQ ID NO: 20412 - RNA, 64 nt, Human
agacucugcugauacuggacuucuccauaaaguccugcugcaccguuagagaugacuuuaaucu

SEQ ID NO: 20413 - RNA, 64 nt, Human
uuacguaugcagacuagucuuauuuuuuuaauuccugcugcacuaaagcuauuacaaauauaac

SEQ ID NO: 20414 - RNA, 64 nt, Human
cuaaaguauugcuuuagaauaguuguuccacuuucugcugcaguauugcuuugccaucuucugc

SEQ ID NO: 20415 - RNA, 64 nt, Human
uucaaagggucuacuugagagauagugguguuuacugcugcagcauguaucacaagauaagaaa

SEQ ID NO: 20416 - RNA, 64 nt, Human
gucguguuuacaaaaggcagcccuuuggguacuacugcugcaaagugcaaauacuccaagcuuc

SEQ ID NO: 20417 - RNA, 64 nt, Human
uggcguaauuaacucagcuguucuagcugcaguacugcugcagugauccacccacauuuaggau

SEQ ID NO: 20418 - RNA, 64 nt, Human
ggaugaagggcgaugccucgcccgaggcuuugggcugcugcacugcaugcugggacugcuccua

SEQ ID NO: 20419 - RNA, 64 nt, Human
uauauguauuuccauauuucauuccugugugucacugcugcauugguguggcagcaagugacca

SEQ ID NO: 20420 - RNA, 64 nt, Human
ucagccaggacucaguucauggaggaaacuuguccugcugcagucccugagucuuguccuccug

SEQ ID NO: 20421 - RNA, 64 nt, Human
cuuugauuuacacucgaacucgggagggaacauccugcugcaugaccuaucaguauggugcuaa

SEQ ID NO: 20422 - RNA, 64 nt, Human
cccagaaguccugugacugugacgagaccucugucugcugcaccagcuggggacucuggcuucc

SEQ ID NO: 20423 - RNA, 64 nt, Human
ccugguggggcugaugucacagguguuuacugugcugcugcacugguccuaugccagccucacc

SEQ ID NO: 20424 - RNA, 64 nt, Human
ggcuuggugguuauugucuucaaggagcucuucgcugcugcaucugcggugucccuuuguucuu

SEQ ID NO: 20425 - RNA, 64 nt, Human
ucuguuuguucuaucuccagucauuaaaucagugcugcugcaugacacucuuaacuccugacuu

SEQ ID NO: 20426 - RNA, 64 nt, Human
aacaguauagcuuuugacugcuuucccaaaggcccugcugcaaaaaagaaguaugucaguuaua

SEQ ID NO: 20427 - RNA, 64 nt, Human
cacugcaaccuccgccucuuggguucaagcaauucugcugcaucagccucccgaguaccuggga

SEQ ID NO: 20428 - RNA, 64 nt, Human
uaauuaccacuauuuuaaauaauucaguuaaacacugcugcaauauuucaguguugugcuugaa

SEQ ID NO: 20429 - RNA, 64 nt, Human
gacauaaagaacuaaaggccgaaagaaucucuugcugcugcaaagaacagauuuuauauuucuu

SEQ ID NO: 20430 - RNA, 64 nt, Human
gaguccaaucccaccuccugguguagaauuuacacugcugcaccugaggucgauguuucaaagu

SEQ ID NO: 20431 - RNA, 64 nt, Human
acaguggggagcuaacugugaaugaggagaguaccugcugcaggaccuggaggucaggugugaa

SEQ ID NO: 20432 - RNA, 64 nt, Human
ugcccaagaucagggguccggcuguccuucuguccugcugcagacuaaaggucuggccaauguc

SEQ ID NO: 20433 - RNA, 64 nt, Human
cugaugggcaguaugguccaauaggcagcauccucugcugcagcugggagagcugaguuccagg

SEQ ID NO: 20434 - RNA, 64 nt, Human
uacacgaaugcccuacgucauccuuccagcaccacugcugcaugggucacucucggccucucaa

SEQ ID NO: 20435 - RNA, 64 nt, Human
cacauucuuaguucucagguugggacuucaauuacugcugcagagcaguagugguuaaaaauaa

SEQ ID NO: 20436 - RNA, 64 nt, Human
uggaagacaaaagccccccaaaucuguguaaaaucugcugcaaaggugucaucccucuuguguc

SEQ ID NO: 20437 - RNA, 64 nt, Human
cuggggacuguuuuuguguuuaggggaaaaaauucugcugcacucugcuugggccuugaggucu

SEQ ID NO: 20438 - RNA, 64 nt, Human
gugacacaggacuuucagagaccaaggccagggucugcugcacugcuguucugauaauagguuc

SEQ ID NO: 20439 - RNA, 64 nt, Human
caucagagcuaucugagccugccugucugggcaccugcugcaaccaugcagcuacccugccagg

SEQ ID NO: 20440 - RNA, 64 nt, Human
uggucuggggagaauguaaucauuccuuccacaacugcugcaugucccugugggugaaacagaa

SEQ ID NO: 20441 - RNA, 64 nt, Human
cugcccugggcugggugcccgaggggcucauaugcugcugcagaaugagcucuuccugaacgug

SEQ ID NO: 20442 - RNA, 64 nt, Human
ccugugcccagccugugcgugucaaccccaccgacugcugcaaacaguguccaggugagagagg

SEQ ID NO: 20443 - RNA, 64 nt, Human
uuugaggaggcuguuccgaccuggaagcguuaaacugcugcaugucaucuggcgucagcuguga

SEQ ID NO: 20444 - RNA, 64 nt, Human
gccgagccucgugcacccccaagauggaacaucccugcugcauucacacuggaacaagccccuc

SEQ ID NO: 20445 - RNA, 64 nt, Human
cuggguguuuaauagucacugaaaacucccagcccugcugcacacuagaggcagguccucucgg

SEQ ID NO: 20446 - RNA, 64 nt, Human
cuuuaaagaaaugcaaauagcaauugaagaaccacugcugcaggugguagcccuggcuagacug

SEQ ID NO: 20447 - RNA, 64 nt, Human
uccuagaagccuagcgugucucucaacacuggggcugcugcaacaccagaccagugaucuuucc

SEQ ID NO: 20448 - RNA, 64 nt, Human
gcccugccucauagguagccauggugagggcuaucugcugcaggggggucuuggggagaguggu

SEQ ID NO: 20449 - RNA, 64 nt, Human
cuuucucaagucguuauugauacagcaagugaaccugcugcagacagaagcagaggaaagccaa

SEQ ID NO: 20450 - RNA, 64 nt, Human
agaaaaaaaaauguuguuuaaaaaauguuuucuccugcugcaguaaauauuuugcaugaugaaa

SEQ ID NO: 20451 - RNA, 64 nt, Human
agcauguauuaaugcuguggcuaugagaggccuccugcugcagaaacacacuucccuacaucaa

SEQ ID NO: 20452 - RNA, 64 nt, Human
ucaacacucuaucacccguauucucucucuggcucugcugcaggucucugcacuccugauuuug

SEQ ID NO: 20453 - RNA, 64 nt, Human
ccaaaguggcucugccuccacccccucccuauuccugcugcaaaugucuaaccagaugagguuc

SEQ ID NO: 20454 - RNA, 64 nt, Human
cgugccuucgugccuucccgcgguggccaggccucugcugcagccgcugguugcaggcagaguu

SEQ ID NO: 20455 - RNA, 64 nt, Human
ccagguaacaaauaaagcuaacacucguuugcugcugcugcaguguggaaauggacauuuccug

SEQ ID NO: 20456 - RNA, 64 nt, Human
uuuuuaacuugccuaaaucccuguauuccaaaaccugcugcaucauaauaaauauaucuauaua

SEQ ID NO: 20457 - RNA, 64 nt, Human
gguuugauccaucaagcuuggcucaugggaucugcugcugcauuaaaucgggaaagaaaaugug

SEQ ID NO: 20458 - RNA, 64 nt, Human
uguuuaguuccacacgggcccagugcugccccugcugcugcaggagcccccaggcgagguucgg

SEQ ID NO: 20459 - RNA, 64 nt, Human
uacugcacuuagaaugauguaauauuccaggaugcugcugcagguggcguaucaucguacacac

SEQ ID NO: 20460 - RNA, 64 nt, Human
caguucugcugccucaggucaggccagggcagugcugcugcagagcuagaaggcccugcagcua

SEQ ID NO: 20461 - RNA, 64 nt, Human
aucccacugauuggccagccgagcgagaaccaggcugcugcauggcacugaccgccgcuuccag

SEQ ID NO: 20462 - RNA, 64 nt, Human
aggacugacgagagauguauauuuaauuuuuuaacugcugcaaacauuguacauccaaauuaaa

SEQ ID NO: 20463 - RNA, 64 nt, Human
augagcugcugcggaccacagccagccacugcaucugcugcacaguugaacgaugggcaguggc

SEQ ID NO: 20464 - RNA, 64 nt, Human
gugagcuugguaaccauuuucauaucaggugauacugcugcaguaaucauagcuguuugaauca

SEQ ID NO: 20465 - RNA, 64 nt, Human
cacugaaaugccuuuauaaauacuggaacaaauccugcugcaaaaaugaaagcgaucagacugu

SEQ ID NO: 20466 - RNA, 64 nt, Human
accauaucuaguauauaauauuuuugucacgcaccugcugcauugcucuaacuuacacagaaug

SEQ ID NO: 20467 - RNA, 64 nt, Human
acauuuuuuaaaaaaacaucaguacuuccuaccacugcugcaugaguauaaugcuccggaauua

SEQ ID NO: 20468 - RNA, 64 nt, Human
cgagacugagccuccugcagacgggcgaagccgccugcugcagcccaggaagccagcccucugc

SEQ ID NO: 20469 - RNA, 64 nt, Human
gaagccagcccucugcucggccucgccggccucccugcugcaggccucccucucuucaccgccu

SEQ ID NO: 20470 - RNA, 64 nt, Human
gaggccuguggacugcagccugcugugcugagcccugcugcaguccagcguccagauggaugca

SEQ ID NO: 20471 - RNA, 64 nt, Human
guaaauuuauacaggacugaaaaccgccugaaaccugcugcaacuauuguuauuaacucuguau

SEQ ID NO: 20472 - RNA, 61 nt, Human
cagggucgacucauggaugauaccucuauugcugcugcaugauguucaagaccggcccuug

SEQ ID NO: 20473 - RNA, 64 nt, Human
cugguuuggccucaggaguguggccuggcccagccugcugcagccuccuggggggcccuugaug

SEQ ID NO: 20474 - RNA, 64 nt, Human
gcaggucucacugcgucucaugaggccgcugccgcugcugcaggggcacccagaccuccagagc

SEQ ID NO: 20475 - RNA, 64 nt, Human
ggagacccccacccugcaauccacaccccauccucugcugcagaagcuauggucugugugguga

SEQ ID NO: 20476 - RNA, 64 nt, Human
aauaguauaaacacugaucaauagaguaaaauaucugcugcauaaaaaacuaagacaaagacca

SEQ ID NO: 20477 - RNA, 64 nt, Human
ugaauucagguccuuugaguaaaaaaaaaaucuucugcugcacauuuuguuuaaguguuacugu

SEQ ID NO: 20478 - RNA, 64 nt, Human
cugucagggcgagcugguagacccccugcaaccgcugcugcaagacacuggacagacccagcuu

SEQ ID NO: 20479 - RNA, 64 nt, Human
guguauuggcuugggaguagaagaagggucgucccugcugcagaagcuguauacugauaauuga

SEQ ID NO: 20480 - RNA, 64 nt, Human
uguugaaauggagauuuuuaagaguuuuaaccagcugcugcagauauauaacucaaaacagaua

SEQ ID NO: 20481 - RNA, 64 nt, Human
ugauauuccuuuugcuugguaguguuuuaugacucugcugcaguuuguggaaaugcuggacuug

SEQ ID NO: 20482 - RNA, 64 nt, Human
acccgaggcuggcagaucugaccccaaggagguccugcugcaaacccccugagccuuugccauu

SEQ ID NO: 20483 - RNA, 64 nt, Human
uaggcuuuuagacuuaguuaaagaccugugugcucugcugcauuuauaggguuuugggcugcug

SEQ ID NO: 20484 - RNA, 64 nt, Human
ggacauacugcauguaagccaagucauggagaaucugcugcauagcucuauuuuaaaguaaaag

SEQ ID NO: 20485 - RNA, 64 nt, Human
agcacccacccugugaaaaguauuauggaaaucacugcugcacaggaaaaguaauucagauguu

SEQ ID NO: 20486 - RNA, 64 nt, Human
uuuugauuaggaucuaaauauucagguuuuaagccugcugcaaacuuuuaaaauauuaugauag

SEQ ID NO: 20487 - RNA, 64 nt, Human
ugcccgcugugcccugcaugauucuguguugccgcugcugcauaguucccagccccauccuguc

SEQ ID NO: 20488 - RNA, 64 nt, Human
aauuuuaaugcauuguuauaauuacuaauguacgcugcugcaggacauuaauaaaguugcuuuu

SEQ ID NO: 20489 - RNA, 64 nt, Human
ucuuuuccuaaaacuuuuuacuuguuaaaauagucugcugcauguaauaugugcuuuuacuauu

SEQ ID NO: 20490 - RNA, 64 nt, Human
aauggcuaguacguuuaaacaaaacagcaguucucugcugcaauauucccauugaccacuuaaa

SEQ ID NO: 20491 - RNA, 64 nt, Human
cuuucuuaagguuucgaguguugcugggagaaaucugcugcauguuguggguuaaagggagucu

SEQ ID NO: 20492 - RNA, 64 nt, Human
cuucucacgugggaaucagugaaguguuuagaaacugcugcaagacaaacaagacuccaguggg

SEQ ID NO: 20493 - RNA, 64 nt, Human
auuauuauuauaauacaauauuuuuuuuaaaagacugcugcauccuuaggaaggaucagaaacc

SEQ ID NO: 20494 - RNA, 64 nt, Human
ccagacggugugcaccaacaucuacaagauccuccugcugcaggcguacaggugagccgccacc

SEQ ID NO: 20495 - RNA, 64 nt, Human
ggacacagaggacagcuuccccaucgccuucuggcugcugcagucagcacagagagcggcuucc

SEQ ID NO: 20496 - RNA, 64 nt, Human
gagggccugacuguccugcucacccacagccgaucugcugcaggucagcaacugugucgugagc

SEQ ID NO: 20497 - RNA, 64 nt, Human
cuggaguccaccagccugccccauggccccggcucugcugcacuugguauuucccugacagaga

SEQ ID NO: 20498 - RNA, 63 nt, Human
cuccugacucagcaccauguaaucauuaaacucucugcugcaaacucugcugucucaauguau

SEQ ID NO: 20499 - RNA, 64 nt, Human
aaaaggaaaagaaguugcaagacucgaauaaaaucugcugcaccuuguaaaugcucuaacugga

SEQ ID NO: 20500 - RNA, 64 nt, Human
acaugucaaauguucuugauagacucugaagagucugcugcagaagaaccagguuaaaaaaaca

SEQ ID NO: 20501 - RNA, 64 nt, Human
gucugacuugauaacuccagugccaguauaguggcugcugcauagacacuauucaguaaauguc

SEQ ID NO: 20502 - RNA, 64 nt, Human
gucugaaggauggugacugcgccauggccuggaucugcugcaguguccuuuccuguggaggcuc

SEQ ID NO: 20503 - RNA, 64 nt, Human
ggacugacugcagcccccuauagucauggggucccugcugcaaaggacagugggcaggaggccc

SEQ ID NO: 20504 - RNA, 64 nt, Human
gcaguuuucucuagaaagcucugagaagcuuucucugcugcagcuguguauaaaauauuuaaaa

SEQ ID NO: 20505 - RNA, 64 nt, Human
uugguuagaaucucuaacugagcaccuuuuaaaccugcugcacauuggacucaaaaggaaaacu

SEQ ID NO: 20506 - RNA, 64 nt, Human
ggcaagauagaugguguauuauuuauggaucaggcugcugcauacaaaccuugcauacuauuau

SEQ ID NO: 20507 - RNA, 64 nt, Human
cuucuucugccccaagcacaccccacacuaauuucugcugcagcaucacgaucagggcaaauca

SEQ ID NO: 20508 - RNA, 64 nt, Human
gagcucccuggcucccacacgguucagauaaucccugcugcauuuuacccucaucaugcaccac

SEQ ID NO: 20509 - RNA, 64 nt, Human
gcaaguggugguauaucuuauccauaucuuuaggcugcugcagaauuuuaagguuauagauaaa

SEQ ID NO: 20510 - RNA, 64 nt, Human
gucccgugcaugcuccuuuucccagaacuccucucugcugcacccacagcaucuguucccgagg

SEQ ID NO: 20511 - RNA, 64 nt, Human
ugucuguauuaaacauggcguuauuuaaguaguccugcugcaagaaaggcacuucagugaauau

SEQ ID NO: 20512 - RNA, 64 nt, Human
uucccuccucuccuccggggggcaaggauggagucugcugcagacccauuggauuugcugcugg

SEQ ID NO: 20513 - RNA, 64 nt, Human
uugugugagguucaguugugggguggguggugagcugcugcauauuuuuuauuuuguuucucua

SEQ ID NO: 20514 - RNA, 64 nt, Human
caguggacaugaccccacccagcccccugcagcccugcugcaccaucucaccagacacaagggg

SEQ ID NO: 20515 - RNA, 64 nt, Human
cauuucuggaaauuccuucaggugcucucaagcccugcugcagagauccuuuucagagcacaca

SEQ ID NO: 20516 - RNA, 64 nt, Human
gucccacguccaggagacaaggaagguagggcaccugcugcacacgauucuguccagagugagc

SEQ ID NO: 20517 - RNA, 64 nt, Human
ggccccaccgggguggagauggaggcccugaccucugcugcaguggccgcccucacccuguaug

SEQ ID NO: 20518 - RNA, 64 nt, Human
acauauuuggucauauugccugccuaccccaugccugcugcagaaauauucauccagguuaacc

SEQ ID NO: 20519 - RNA, 64 nt, Human
gcuccaccucuccaucuggaagccggagccauaacugcugcaguuugggcccaggcuaugugcu

SEQ ID NO: 20520 - RNA, 58 nt, Human
acaaagggccugacccuugaaaggcuuacugcugcauggcugucugcaugaaccacgc

SEQ ID NO: 20521 - RNA, 64 nt, Human
uuuccaugggguguaccuauacuuuaagccaauccugcugcauucacugcuaaguuaaauaaaa

SEQ ID NO: 20522 - RNA, 64 nt, Human
gacccuauuucaaaaaaaggcugcuuucacuguacugcugcagcagucucuucagguagcuaaa

SEQ ID NO: 20523 - RNA, 64 nt, Human
guuugguggaggcaaccugaccagaaacacuucgcugcugcaagccagacaggaaaaagauucc

SEQ ID NO: 20524 - RNA, 60 nt, Human
uacauccacagaucauauaaacucucagcccugcugcaaagccuuuccagaaaaauaaaa

SEQ ID NO: 20525 - RNA, 64 nt, Human
uguggcaggagggcagugguggagcuggaccugccugcugcagucacguguaaacaggauuauu

SEQ ID NO: 20526 - RNA, 63 nt, Human
acuuucugcagccucugucuuccaagcugagcuucugcugcaguguggcugucacugcaccug

SEQ ID NO: 20527 - RNA, 64 nt, Human
uggugugaggugcagugacugcgucaagagaagccugcugcacacaggggcccuuuccaugcag

SEQ ID NO: 20528 - RNA, 64 nt, Human
uuuucucccuucacugauacugaaaucaugguaucugcugcaaacaugaguagauccaugaugg

SEQ ID NO: 20529 - RNA, 64 nt, Human
gaggggucacacccacccccugccugguucuaggcugcugcacaccaaggcccugcaucugucu

SEQ ID NO: 20530 - RNA, 64 nt, Human
gcccagggcagagcaggcuuuguucgcaccucaucugcugcagaaccacauccugaggagucuc

SEQ ID NO: 20531 - RNA, 64 nt, Human
cggcagcccuugccaccucccucugccaagccugcugcugcagaacgguuuuugcugaggugcc

SEQ ID NO: 20532 - RNA, 64 nt, Human
aggccagagcuugugugcugggcacagaaaucaccugcugcauccugugcuccgcaggcugggc

SEQ ID NO: 20533 - RNA, 64 nt, Human
gacaccugccccaaguggguggauaucugccuuccugcugcaaguggaggcagguccagcagcc

SEQ ID NO: 20534 - RNA, 64 nt, Human
gugugagugacaguuaccccauuucagucauuuccugcugcaacuaagucagcaacacaguuuc

SEQ ID NO: 20535 - RNA, 64 nt, Human
guggcugguguuggugucccagccuaagagccaccugcugcaguuaccauggcaugcugaguug

SEQ ID NO: 20536 - RNA, 64 nt, Human
gcaccaaaaggcaaaugguacuguccacagugcacugcugcaaugaagagaagaggcagcagac

SEQ ID NO: 20537 - RNA, 64 nt, Human
uuaaggaaaguauuuuauauucaacagguauauucugcugcauguacuguacuccagagcuguu

SEQ ID NO: 20538 - RNA, 64 nt, Human
uuugcguuuccuuuuuguugaugaggacccagagcugcugcacacacucaccucuaacccccuc

SEQ ID NO: 20539 - RNA, 64 nt, Human
gaggggggcaccagguuuagugcugcugcuuucacugcugcacccgcgcccucggccggccccc

SEQ ID NO: 20540 - RNA, 64 nt, Human
ggccgcgacucucugcuucucuccagcucucaaucugcugcauuuuccucuagugcuuccggau

SEQ ID NO: 20541 - RNA, 64 nt, Human
ccaagcguuugguguuaccuucuccugggagguccugcugcaacucaaguuccacaggaugguc

SEQ ID NO: 20542 - RNA, 64 nt, Human
ucaucaccugcugucugcuuagaagaacggcuuucugcugcaauggagagaaaucauaacagac

SEQ ID NO: 20543 - RNA, 64 nt, Human
agacaauuguucaaaagaugcaaaugauacacuacugcugcagcucacaaacaccucugcauau

SEQ ID NO: 20544 - RNA, 64 nt, Human
gcucccuuucagguuuacuauguuuaaaacuaaacugcugcaaaaguucucaauguucuuuucc

SEQ ID NO: 20545 - RNA, 64 nt, Human
ggucuggcaaagucaggcucagggagacucugcccugcugcagaccucgguguggacacacgcu

SEQ ID NO: 20546 - RNA, 64 nt, Human
agccuguucuagaacgaucacugccuuaccccugcugcugcaguggugugagucguuucacggc

SEQ ID NO: 20547 - RNA, 64 nt, Human
cuggagacggugguacccugaaggcagaggccagcugcugcaagacagcaaugacaguccaccu

SEQ ID NO: 20548 - RNA, 64 nt, Human
guugguauuuucagagaacaucccgcuucugaagcugcugcagcucccuccucagggaucacac

SEQ ID NO: 20549 - RNA, 64 nt, Human
gcucagcgggccggagcugaucgcucucacuggccugcugcagaugagccagggggagccuagg

SEQ ID NO: 20550 - RNA, 64 nt, Human
ccaauucccacuccucaugcucaccuccccuacccugcugcauggacaccugcucaccccugcc

SEQ ID NO: 20551 - RNA, 64 nt, Human
auacuagccagcguuguuguagccauauucccugcugcugcacgccgaauugaaaauccaucuc

SEQ ID NO: 20552 - RNA, 64 nt, Human
cuaaugacacacauuuaaaucaguuaugguguagcugcugcaauuccugugaauacccgaaacc

SEQ ID NO: 20553 - RNA, 64 nt, Human
gcuuuugucacggucacuagcugaucccucaggucugcugcaaacacagcauggaggacacaga

SEQ ID NO: 20554 - RNA, 64 nt, Human
gggcagaagugagagaaugagccaacccauguaccugcugcaacugaaccagacuggguuuuca

SEQ ID NO: 20555 - RNA, 52 nt, Human
cuucaugcucggugaugugauucugcugcaaagccugaggacacugggaaua

SEQ ID NO: 20556 - RNA, 64 nt, Human
ccugcacacccugggccacgccggccacaccccucugcugcaacaagcucaucccuggacuucu

SEQ ID NO: 20557 - RNA, 64 nt, Human
uuaauaggcuuucuguguauauaauuaaauuuagcugcugcaaccauuguucugacacgacuuc

SEQ ID NO: 20558 - RNA, 64 nt, Human
uugcucaaacuucagccaacaggggugucugcuucugcugcacuacacaggccaggaguggcau

SEQ ID NO: 20559 - RNA, 64 nt, Human
cuuaaguuccauuguagggugcgccuucagaaaccugcugcacuuuucugauauaguucaccac

SEQ ID NO: 20560 - RNA, 64 nt, Human
caugagcacagaagagccucaguagagucaaguccugcugcagcugccccaccccaaguuucua

SEQ ID NO: 20561 - RNA, 64 nt, Human
gggcugccuggccgcggcucucacauggugguuccugcugcacugauggcccaggggucucugg

SEQ ID NO: 20562 - RNA, 64 nt, Human
uagaaaaaggaaagaaaaaagaaaacuuuuccaacugcugcauuaagauaggguggauuuuaug

SEQ ID NO: 20563 - RNA, 64 nt, Human
ucugcuuguuuuuaguuuuugcucuuaacaaacacugcugcagucagcauccuugcacagauuu

SEQ ID NO: 20564 - RNA, 64 nt, Human
cuucucuuuacagcuuuguuucugcaucaguucacugcugcauguuguuuggaauuuaucaccu

SEQ ID NO: 20565 - RNA, 64 nt, Human
uuaggaaugugaagccagaaugggucaguuguagcugcugcaaaguucuguagcugauggucau

SEQ ID NO: 20566 - RNA, 64 nt, Human
gggguccccaggguguccucuggcagggcugugacugcugcaagcucugccuucaccaguagcu

SEQ ID NO: 20567 - RNA, 64 nt, Human
ggugugugaccaggccagcccagugaccuuucuccugcugcacuuggagggaggggacauacac

SEQ ID NO: 20568 - RNA, 64 nt, Human
cacaugcaccugucccaggccagagcucaagaagcugcugcacgggcugggccuucaggaccca

SEQ ID NO: 20569 - RNA, 64 nt, Human
ugugcccauagcacacguauauaugugugugucccugcugcaaagucuugccagagauauacaa

SEQ ID NO: 20570 - RNA, 53 nt, Human
ccucagacguggacagcuagggucugcugcaucugcccccuucuuaccucgug

SEQ ID NO: 20571 - RNA, 64 nt, Human
ccuaugucucagaagagcugggaccuccuuccagcugcugcagaugcugacaggcccugggagg

SEQ ID NO: 20572 - RNA, 64 nt, Human
ccgccucgauccugcaccuuccucucccaggucgcugcugcagccaacccaguagcccccuuag

SEQ ID NO: 20573 - RNA, 64 nt, Human
ugccagauggacagguacacccaagcacaucucccugcugcacccucaccacccacaaaagauc

SEQ ID NO: 20574 - RNA, 64 nt, Human
uucaccugggccuccagucccacgcuggccccaacugcugcagcucucggcuuccgcccaacag

SEQ ID NO: 20575 - RNA, 64 nt, Human
caagccgguggccucuguaggaccugguccugcccugcugcaggagugacggugaugacccagc

SEQ ID NO: 20576 - RNA, 64 nt, Human
gcagccccagcacccuggcauugcgggaggugcucugcugcacagcuguuccaucaggcccuau

SEQ ID NO: 20577 - RNA, 64 nt, Human
gauguacuaagcugcugacaucauccacugccuucugcugcauccuagacacccucccuguugu

SEQ ID NO: 20578 - RNA, 64 nt, Human
ccaguucaggcuucuuggccuucuucuccgcguacugcugcagccgcuccuccugcagcugugc

SEQ ID NO: 20579 - RNA, 64 nt, Human
cucucuaagcagggagcacuuguccuucucuccucugcugcagcuacugauaucuggccccugg

SEQ ID NO: 20580 - RNA, 64 nt, Human
gaagguggacacucuugggcucauuguaaagugccugcugcaucaauaaagcucuuggcuuauu

SEQ ID NO: 20581 - RNA, 64 nt, Human
ccguggaagccucugccucagcggggacggccuccugcugcagguccugggcagcccacaguag

SEQ ID NO: 20582 - RNA, 64 nt, Human
gcuccugaugucacuccaucacccaccaucaccgcugcugcaaagaggcaauaauaaaggaacu

SEQ ID NO: 20583 - RNA, 64 nt, Human
ggaaggcguguuugugcccagaagagaggccgggcugcugcagaaccccgccguguaaagaggc

SEQ ID NO: 20584 - RNA, 64 nt, Human
gagccucagcagaccagggccugguccuugcuaacugcugcaggguggaguuugaucuggcaga

SEQ ID NO: 20585 - RNA, 64 nt, Human
ccuuccagaugaagaccaagcgccccuccuggggcugcugcagcuucuggggccuccacagacc

SEQ ID NO: 20586 - RNA, 64 nt, Human
cgaugacguggucaucugugucgccauccccuuccugcugcacaccugcaccacggccaugggg

SEQ ID NO: 20587 - RNA, 64 nt, Human
ugcgcugcacuccucugcccuggggccaccucggcugcugcagccugcccagcagcacauucca

SEQ ID NO: 20588 - RNA, 64 nt, Human
caucuugccagcccaccagcagccccacucacagcugcugcaccaccaccuuccgcaggaugca

SEQ ID NO: 20589 - RNA, 64 nt, Human
agcacccccaaacuuaccucagggggugccuccccugcugcacaaccaguaccucguagguccc

SEQ ID NO: 20590 - RNA, 64 nt, Human
cacacacacacauaucacaguuuucacacagccccugcugcauucucuguccaucugucuguuu

SEQ ID NO: 20591 - RNA, 64 nt, Human
cuaauaaccggagaacuaacauguaguauuugugcugcugcauuucugagugaagugcacgucu

SEQ ID NO: 20592 - RNA, 64 nt, Human
agccacauaucaacacagguuuuuaggugguucccugcugcacagcgugaccucguggucgcgc

SEQ ID NO: 20593 - RNA, 64 nt, Human
ucccccgugacagaaccacacugggcagaggggucugcugcagaaacacugucggcucuggcug

SEQ ID NO: 20594 - RNA, 64 nt, Human
cuguguaugugacugcuguagcauuccacugcaccugcugcauacagcuuacauuggagaugug

SEQ ID NO: 20595 - RNA, 64 nt, Human
guuuuuuaucuuccaaggccuggcucaaaugccacugcugcaaagcuuucuuugacccucuggc

SEQ ID NO: 20596 - RNA, 64 nt, Human
aaagguaccaaacaaggaagccaaaguuuucaaacugcugcauacuuugacaaggaaaaucuau

SEQ ID NO: 20597 - RNA, 64 nt, Human
ccagggagcccccucuaugucugagaggcugccacugcugcacaugcucagugaggcuuggcgg

SEQ ID NO: 20598 - RNA, 64 nt, Human
uugagaagacuugagaaaugucuuaauacucacacugcugcauguagcucuugcuuauuuacug

SEQ ID NO: 20599 - RNA, 64 nt, Human
gugcagacugaguucuaggccagugggucccugacugcugcacauggcacaggccguucccuuc

SEQ ID NO: 20600 - RNA, 64 nt, Human
ccugguguggagugacucaaaucaguauaccuaucugcugcaccuucacucuccaggguacaug

SEQ ID NO: 20601 - RNA, 64 nt, Human
ggagcaggugcgugccagccauggcugccagacacugcugcaacugaccagcugccggaagauu

SEQ ID NO: 20602 - RNA, 64 nt, Human
gucgucugcucuucacccagcaccacagaggcaccugcugcacacacaagcaucucacucggcc

SEQ ID NO: 20603 - RNA, 64 nt, Human
gcugugucgucuucuaaugugagcucauccacugcugcugcagcguggugaucaggagucacag

SEQ ID NO: 20604 - RNA, 64 nt, Human
gucccggcagcccaggauggccuggugcccccaccugcugcagcaggagccccaaggagugcua

SEQ ID NO: 20605 - RNA, 64 nt, Human
gucucccuggccacccuuggccuguccaccugugcugcugcaccaaccucacugcccucccucg

SEQ ID NO: 20606 - RNA, 64 nt, Human
cuuuugcccacugucugcuaccagggcucacccacugcugcaccucucuucugcacagcuccuc

SEQ ID NO: 20607 - RNA, 64 nt, Human
cugcuucagcugugcuugaaguggcaugccuccucugcugcagggcucccccacccccacacgg

SEQ ID NO: 20608 - RNA, 64 nt, Human
acaaugcagggcuccucauugcucccaucugccucugcugcacacacaggcaccagcagggaug

SEQ ID NO: 20609 - RNA, 64 nt, Human
acucucucuugcucgggaccugccugagggcucccugcugcaguucgccguacuuccaucugcu

SEQ ID NO: 20610 - RNA, 64 nt, Human
aacuucucaaugccuaaauucuguaguugaagcucugcugcagagaguugggauaauuuucuuu

SEQ ID NO: 20611 - RNA, 64 nt, Human
gugguguugcagcccccagauguguggccaaccucugcugcaaaggaaucucuugcugagucca

SEQ ID NO: 20612 - RNA, 64 nt, Human
acacuaaaaugaaacaaauaccaagguauuccuucugcugcagccuggagaccaccgagagucg

SEQ ID NO: 20613 - RNA, 64 nt, Human
aaaaacauacuuugaaaagaugcuugagauuuuccugcugcaucgcacucuaguuuugaaggau

SEQ ID NO: 20614 - RNA, 64 nt, Human
uuucaauggcuaauuagaauguguuauuugauuucugcugcagaaggcagugugauuguaacaa

SEQ ID NO: 20615 - RNA, 64 nt, Human
agcuugauuuuaaaaaaaaacaaaucuuuaaaaucugcugcaaauuuaaauaauucccaaaaug

SEQ ID NO: 20616 - RNA, 64 nt, Human
ccugggagagcuguggugggaauaugggcuggcacugcugcagggcaagaacauucauguagga

SEQ ID NO: 20617 - RNA, 64 nt, Human
cauggccuauggaagccucacuggaguuuggggccugcugcaauggggaugagaugguuuuuug

SEQ ID NO: 20618 - RNA, 64 nt, Human
gcaacacugugucccuucgccccaccguucuucucugcugcauuuggacaucagccaaauuuga

SEQ ID NO: 20619 - RNA, 64 nt, Human
ccagcagaucugaccacuguucuccagcaggccucugcugcagcuuuuucucucaguguucugg

SEQ ID NO: 20620 - RNA, 64 nt, Human
guagcacugaacgaagccagggguucagaugacacugcugcauccuggucacauucucugucuc

SEQ ID NO: 20621 - RNA, 64 nt, Human
gcccccugcugcgggcucugccuuggugucaugccugcugcacccccguuuccacugacgugcc

SEQ ID NO: 20622 - RNA, 64 nt, Human
uggagcacuacugacccugccuugggccuugcugcugcugcacccaacuacugagcugagacca

SEQ ID NO: 20623 - RNA, 64 nt, Human
agggcuacucagcaguaagcaggccuuaguacggcugcugcacacuucucggucuaggugggag

SEQ ID NO: 20624 - RNA, 64 nt, Human
aggcuaaagaaucccgaaggcaucgaggccauuucugcugcaacaagguuuccugucucuucac

SEQ ID NO: 20625 - RNA, 64 nt, Human
gcccccuucugagaugcagccagaagcucugugccugcugcaaagauucagguggacccuccuc

SEQ ID NO: 20626 - RNA, 64 nt, Human
accuccuccgggcuuccucccggaaacucagcgccugcugcacuugccugcccugccuugcuug

SEQ ID NO: 20627 - RNA, 64 nt, Human
aaaccugacucaauuauuugcauauuuugagaaacugcugcagauuaguucuuuuugccaguuu

SEQ ID NO: 20628 - RNA, 64 nt, Human
uuccguugggcugaauuaagaguggccuaagaggcugcugcacugaaauguaaguaaacgagug

SEQ ID NO: 20629 - RNA, 64 nt, Human
cucuggggccuuggcacacacacauucgugugcucugcugcaugugagcuuguggguuagagga

SEQ ID NO: 20630 - RNA, 64 nt, Human
cugcgaggggcagaacuggacccccaugccagugcugcugcaggagggcccauauacuaggguc

SEQ ID NO: 20631 - RNA, 64 nt, Human
cgcugcugccccgaguggcaggccagcucacacucugcugcacaacagcucggccgccccucca

SEQ ID NO: 20632 - RNA, 64 nt, Human
uggcuccuacccaccucgcccuugaaggaugggccugcugcacgucucccuccuccaccccaua

SEQ ID NO: 20633 - RNA, 64 nt, Human
agguguauauaaacguccucugugcuggguguuucugcugcagguggcagguggccccaggccu

SEQ ID NO: 20634 - RNA, 64 nt, Human
gaucaccaggugcaggcccccacccucggagaugcugcugcagugagugguuccacugccugga

SEQ ID NO: 20635 - RNA, 64 nt, Human
gcugcccuggcguggccauguggcuuugcccagccugcugcaauccaagagagcaaggaagaga

SEQ ID NO: 20636 - RNA, 64 nt, Human
cacugccacgucccucaugcacaucacucaucuccugcugcaggccaaggccaaaauugggcua

SEQ ID NO: 20637 - RNA, 64 nt, Human
agcucccccgggaggggcccgcuugccucggcuccugcugcaccaacccagccgcugcccggcg

SEQ ID NO: 20638 - RNA, 64 nt, Human
ggauccgacuugaauuuucccacugcacccccuccugcugcagaggggcaggcccugcacuguc

SEQ ID NO: 20639 - RNA, 64 nt, Human
ggagcacuuggcccugccuuaccugccaagcccacugcugcagcugccagccccccugcccgug

SEQ ID NO: 20640 - RNA, 64 nt, Human
cuggaggggucagcuggagcccaccaagcugucacugcugcacucacucugcaagggaucagga

SEQ ID NO: 20641 - RNA, 64 nt, Human
agguaaugcuuguuaucuuccaucuaauaaaaaucugcugcagauguguauauguaugugugug

SEQ ID NO: 20642 - RNA, 64 nt, Human
cuacccgccacagccucagggugugcaggggagccugcugcacagauaugauacaaggguggga

SEQ ID NO: 20643 - RNA, 64 nt, Human
ccaccuuuccacucaacaaccucccaccccuguccugcugcaugguccggagucugggaccuac

SEQ ID NO: 20644 - RNA, 64 nt, Human
ugacccgcaaugggcagagggugggugggacccccugcugcagggcagaguucagguccacugg

SEQ ID NO: 20645 - RNA, 64 nt, Human
agcaugacaaacucaugaaauggugggagagagucugcugcaagggugagaccaggcagccugc

SEQ ID NO: 20646 - RNA, 64 nt, Human
augcaacuaccauccucugggccaacuguggaagcugcugcacuugugaagaauccugagcuuu

SEQ ID NO: 20647 - RNA, 62 nt, Human
cugcccauguagcuaccuagcacaccaucucccugcugcagguuuagaggaccagugaguug

SEQ ID NO: 20648 - RNA, 64 nt, Human
aagacgugagggcaugaaugguucauucaggcagcugcugcagauguggucaccuggugccauc

SEQ ID NO: 20649 - RNA, 64 nt, Human
aaugcuccagcaguggcucagugcucccuggugucugcugcauggcauccuggaugcuuagcau

SEQ ID NO: 20650 - RNA, 64 nt, Human
ugagguccuguccuggcucccaggguccugggggcugcugcacugcccuccgcccuucccugac

SEQ ID NO: 20651 - RNA, 64 nt, Human
gagcacauggguuauaaugagaaacugaacuguacugcugcauuuccugucuuccuuccuaggu

SEQ ID NO: 20652 - RNA, 64 nt, Human
ggcccugugagggcugggacuaagucacagggaucugcugcagccacagcuccuccagaaaggg

SEQ ID NO: 20653 - RNA, 64 nt, Human
cuguuggaagcccugcugaacccucaacuauugacugcugcagacagcuuaucucccuaacccu

SEQ ID NO: 20654 - RNA, 64 nt, Human
cacuuccggcugccucuuugcuacuguguagcaccugcugcaacguugccugcuguccacgugg

SEQ ID NO: 20655 - RNA, 64 nt, Human
gcugcuuuuauuuuugugaaauucuagagcugcucugcugcaaggauuuccugccuucagacug

SEQ ID NO: 20656 - RNA, 64 nt, Human
ugauccagaauguuuccgugcuacacuuuguguccugcugcaauguguucugucuguccaucca

SEQ ID NO: 20657 - RNA, 64 nt, Human
uggcacuuaugccuggggcaaaacuauuucagagcugcugcaagacugcuccucucgucucaaa

SEQ ID NO: 20658 - RNA, 64 nt, Human
ucuacccuuuuccucuccccgauuccuuguagagcugcugcaauucuuagaggggcaguucuac

SEQ ID NO: 20659 - RNA, 64 nt, Human
agacuccguccaaggagaugcucuccccggucuucugcugcaauuuagauuccuuucccuucuc

SEQ ID NO: 20660 - RNA, 64 nt, Human
ccuugcacagggcccacgcuggagucuuaccacucugcugcagggguggaagguggccccucuu

SEQ ID NO: 20661 - RNA, 64 nt, Human
gguagaugagguguuugcacugccgcuggcccaccugcugcagacgcagaaucagggcuauacc

SEQ ID NO: 20662 - RNA, 64 nt, Human
agugagcagagauguacugcaaagucgccagucacugcugcaagguggccucugccuggggccu

SEQ ID NO: 20663 - RNA, 64 nt, Human
cccccauucugcucccucgagguugcuggacaagcugcugcacugucucaguucugcuugaaua

SEQ ID NO: 20664 - RNA, 64 nt, Human
agaaaggggcuuucaugucguuuccuuccugcuccugcugcacagcugccaggagugcucugcc

SEQ ID NO: 20665 - RNA, 64 nt, Human
ucccagaacuuuaagacuuucuccccacugccuucugcugcagcccaagcagggaguguccccc

SEQ ID NO: 20666 - RNA, 64 nt, Human
ccaaauuacagcccaggacaccuuucucugccgccugcugcaucagugggugacccccuucccg

SEQ ID NO: 20667 - RNA, 64 nt, Human
acaggcuuuaugcagagcacugcgcauggcuguucugcugcaacugugcuccacgaaacagaag

SEQ ID NO: 20668 - RNA, 64 nt, Human
acugagcacggggaccucacccgcuagccagcgucugcugcacuugaucagguggggccuuggu

SEQ ID NO: 20669 - RNA, 64 nt, Human
uccccagccaguauagagacuugguuggcaucuucugcugcagggacuaaaaguauuugacugg

SEQ ID NO: 20670 - RNA, 64 nt, Human
ccccucccagcugguggugcugcccuaucagaugcugcugcaugcggccacucggcaggccgcg

SEQ ID NO: 20671 - RNA, 64 nt, Human
guucuuuccccagcucugccaggcccauucccagcugcugcaguacguggagcgauacggguga

SEQ ID NO: 20672 - RNA, 64 nt, Human
uuuuuaaaaacaaaaaaugaaauuauuuugcaugcugcugcagccuuuaaaguauugaaguaac

SEQ ID NO: 20673 - RNA, 64 nt, Human
gacucuucacugccugaggacauuccgguuuuuacugcugcagcagcugcuaccccaguuccau

SEQ ID NO: 20674 - RNA, 64 nt, Human
ccccccaaaacccgggaaccuccccagccugcgccugcugcaugcccucucaggccggcagccc

SEQ ID NO: 20675 - RNA, 64 nt, Human
cucugcccaugcaaauuagcucacaucuuuccuccugcugcaauccaucccuuccucccauugg

SEQ ID NO: 20676 - RNA, 64 nt, Human
cugaguugaauuucugggaggaugacgcagaugucugcugcagagcugggcugagaguucugca

SEQ ID NO: 20677 - RNA, 64 nt, Human
aacgcaguugauuccuugaguuucauauauaagacugcugcagucacaucacaauauucagugg

SEQ ID NO: 20678 - RNA, 64 nt, Human
gccaauuucugccuucuugacggcgaccagguggcugcugcaggagcuggugcugugagugggg

SEQ ID NO: 20679 - RNA, 52 nt, Human
ccaggaagugcagcaagugaggcugcugcagcugcaugggugccugcugcug

SEQ ID NO: 20680 - RNA, 64 nt, Human
gggcucugcuguccucugcgcuggguguggaaugcugcugcaccugucccuucugcuggcucag

SEQ ID NO: 20681 - RNA, 64 nt, Human
ggagcuagaacacuuaauguuuaaucuguuaaaccugcugcaagagccauaacuuugaggcauu

SEQ ID NO: 20682 - RNA, 54 nt, Human
ggaagagcuucaagagcuaagaaccugcugcaagucacugccuuccaagugcag

SEQ ID NO: 20683 - RNA, 64 nt, Human
ccauguggcccuccaguguaugagagggcccugccugcugcaucuuuucuguugccccauccac

SEQ ID NO: 20684 - RNA, 64 nt, Human
gaccaaagcccaggauggcuuggugggagugucccugcugcaucugcaugaagccccugcuuuu

SEQ ID NO: 20685 - RNA, 64 nt, Human
ggcacacaccuuucugaaauccuucuccagccagcugcugcagacaaaagaucacauuucuggg

SEQ ID NO: 20686 - RNA, 64 nt, Human
acuuagaaagugcccuucaaaaggacccuguucacugcugcacuuuucaaugaauuaaaauuua

SEQ ID NO: 20687 - RNA, 64 nt, Human
cacugcagaguugaggccucauaucucaccugcacugcugcaacagcuuacuggucccuugcuc

SEQ ID NO: 20688 - RNA, 64 nt, Human
gauacucauccuguucccccuagagcugcucuuccugcugcauucucucucucaauuacuggga

SEQ ID NO: 20689 - RNA, 64 nt, Human
gugggcucccaagugccuaggccaugccuuacgacugcugcacuuaccauuugucauaugaugg

SEQ ID NO: 20690 - RNA, 64 nt, Human
gcuguugagccccuugucccaccacucccgccaucugcugcaggcaggaaggcaugugagugua

SEQ ID NO: 20691 - RNA, 64 nt, Human
ugaaugcaucuguuucuccucacgaauuguuuuacugcugcauuuuuuguuuuuaaaauuaaac

SEQ ID NO: 20692 - RNA, 64 nt, Human
ccggaagaagacgucuccacggagcccucgggaccugcugcaccaggaaagccacuccaccagu

SEQ ID NO: 20693 - RNA, 64 nt, Human
agacacaauauccgcagccuuacaccuuaacuagcugcugcauuauuuuauuuuauuuuauuuu

SEQ ID NO: 20694 - RNA, 64 nt, Human
guccugcucuggcuuuugccuucuugaugccagccugcugcaacagacccuccccgcgccccuc

SEQ ID NO: 20695 - RNA, 64 nt, Human
ucaggaugagcagagcugccugaccucuugauuucugcugcaaaagacauauacacuguacugg

SEQ ID NO: 20696 - RNA, 64 nt, Human
uguguccugagagccuggcccugugcuguggucucugcugcaagcccagauuucugggaguaac

SEQ ID NO: 20697 - RNA, 64 nt, Human
gaccucgcaugcgcgccgcgucgccucuggggggcugcugcaccgcguuuccauagcagcaugu

SEQ ID NO: 20698 - RNA, 64 nt, Human
agaguugcucuggagagguagggccagaggaaugcugcugcacugccaacucaggcacaugcuu

SEQ ID NO: 20699 - RNA, 64 nt, Human
aaauuauaacaaauacaaaguucuuugugcuuuucugcugcauaugucaguggcucuggagauu

SEQ ID NO: 20700 - RNA, 64 nt, Human
gcugaagccaccccugcugaugaugagcaagugccugcugcagguccaaacacagcauccaggg

SEQ ID NO: 20701 - RNA, 64 nt, Human
aauccacugcuuuucaggcaaggagggagaaauccugcugcacacuggcuuugucccggagucg

SEQ ID NO: 20702 - RNA, 64 nt, Human
ugccgccguguccaggcgccccucacccccacaccugcugcauggcuggccacaccacucagug

SEQ ID NO: 20703 - RNA, 64 nt, Human
caggaaguggagguugcagugagccgagauugugcugcugcacuccagccugggugaaaaagac

SEQ ID NO: 20704 - RNA, 64 nt, Human
aaaaguucuuucuuuuauuauuuucaccuauuggcugcugcauuuuacgaaguggacuucccgg

SEQ ID NO: 20705 - RNA, 64 nt, Human
cugccacagaccgucucagacacgcacagugggccugcugcaugauucacacccagucccugcc

SEQ ID NO: 20706 - RNA, 64 nt, Human; identical to SEQ ID NO: 20705

SEQ ID NO: 20707 - RNA, 64 nt, Human
cugccacagaccgucucagacacgcacagugggccugcugcaugcguguuaccuggcuuuuggc

SEQ ID NO: 20708 - RNA, 64 nt, Human
aagugcugggauuauaggcgugagccaucgcgcccugcugcauuucauuuuuuuguauaaaauu

SEQ ID NO: 20709 - RNA, 64 nt, Human
uauugcccuguguucacagcaauaaaaccacuuccugcugcauucuaaugaguguguguuugag

SEQ ID NO: 20710 - RNA, 64 nt, Human
uucacuccagaugcaugcccugagccagaccucacugcugcacuuuccaaggugcuaagauugc

SEQ ID NO: 20711 - RNA, 64 nt, Human
ccccagcuggggccgggcagagcuggcacugucacugcugcaggagacacccaggaacuaugag

SEQ ID NO: 20712 - RNA, 64 nt, Human
uaagcuucuuauagacagggauguugacuuuguucugcugcagccugauaaacugggaccacug

SEQ ID NO: 20713 - RNA, 64 nt, Human
uaucugacaaucucaggacuccaaggugcaaagccugcugcauuugcgugaucucaagaccucc

SEQ ID NO: 20714 - RNA, 64 nt, Human
auaaacaucaaaauauuacccagcugaauaguuacugcugcacuuucacuaagauguauuugaa

SEQ ID NO: 20715 - RNA, 64 nt, Human
ccaaacugcuuaggucuucucugucccuuuacugcugcugcacagagaugauauaaaagaggcu

SEQ ID NO: 20716 - RNA, 64 nt, Human
ucauucugcagggauuuacuggaaucuauuggugcugcugcaugagucugcugacaaccugacu

SEQ ID NO: 20717 - RNA, 64 nt, Human
aaugaaaaacaucucuaggaaugugcuuuaaccacugcugcaaaagagacaagucugcauuuau

SEQ ID NO: 20718 - RNA, 64 nt, Human
gagaggcacgugccugucucauucgccucuggaucugcugcauccaggacugugccagcacaaa

SEQ ID NO: 20719 - RNA, 64 nt, Human
cauugaccucuauguguuaccagucauuaaugagcugcugcagaggugacuauuuguuuuacuu

SEQ ID NO: 20720 - RNA, 64 nt, Human
uuugcugugggcccugcaaccuucccagccacuccugcugcacuaaggacuuaggauccuuuua

SEQ ID NO: 20721 - RNA, 64 nt, Human
ccccaagacaaucucgccaaaggcaccuccuauccugcugcaguuucccagcugcagccuaggc

SEQ ID NO: 20722 - RNA, 64 nt, Human
cucacaagcacagagcugccuguugugaaugucccugcugcaaaguuggugggugagagaaugg

SEQ ID NO: 20723 - RNA, 64 nt, Human
ggaggggcuagcguucuuguccaaagcacucauccugcugcagggaagggagcuguacggaggc

SEQ ID NO: 20724 - RNA, 64 nt, Human
cagcacuucugcugggaacucccugacuauuccgcugcugcaggaacccagcuagcuggccagg

SEQ ID NO: 20725 - RNA, 64 nt, Human
gggaacaugguccuggaggugcccuaccugcauccugcugcacccccacccacgacacucgagu

SEQ ID NO: 20726 - RNA, 64 nt, Human
uggaagguggaaguugcagugagucgagauugcacugcugcauuccagccagggugacagagug

SEQ ID NO: 20727 - RNA, 64 nt, Human
gaggaaagguuuuucugggcccuacugcuccccucugcugcagguaagucagagcagcuuuacc

SEQ ID NO: 20728 - RNA, 64 nt, Human
gccuuucugcucuguuccccaaccccacugaggccugcugcacaggucaaugccuucguuaucg

SEQ ID NO: 20729 - RNA, 64 nt, Human
ugggcagcaguuuccgagggccugcaugauccaccugcugcacgauccuaugagggcuuccugu

SEQ ID NO: 20730 - RNA, 64 nt, Human
ugacccugcccagcgcaucacacuggccgaggcccugcugcaccccuucuuugcuggccugacc

SEQ ID NO: 20731 - RNA, 64 nt, Human
ucagcuuacuaggugacccggaugcugacaucugcugcugcagaaaggaagacuuuucauugua

SEQ ID NO: 20732 - RNA, 64 nt, Human
uccuuucccuuccugucuuccucucccuucuccucugcugcagcaugauuuucuuaaucuucag

SEQ ID NO: 20733 - RNA, 64 nt, Human
cacugacucccauaugguagaaaagguaccguggcugcugcagggcacauggagggaccuaccc

SEQ ID NO: 20734 - RNA, 64 nt, Human
ucaaaggcccuuuuaguucugagauuccagaaaucugcugcauuucacaugguaccuggaaccc

SEQ ID NO: 20735 - RNA, 64 nt, Human
cugucaagugagacuuggccacuguagccugggccugcugcaggagcucuucagaaaggcacau

SEQ ID NO: 20736 - RNA, 64 nt, Human
ggaggagagguccacuucccuuagaacaccugagcugcugcaugaguggacgucagaagaaucu

SEQ ID NO: 20737 - RNA, 64 nt, Human
uaugaagaaaacagcugcauggcacauaccaaagcugcugcacagcuggccaccauggcacccu

SEQ ID NO: 20738 - RNA, 64 nt, Human
cuucucagaccccgccugccccgaggccccgauccugcugcacuucccgcuggucaaugccucc

SEQ ID NO: 20739 - RNA, 64 nt, Human
gaagugcuuuuuugaucaacugguuuguguuuugcugcugcauuuaucccaagaaaaacagcuu

SEQ ID NO: 20740 - RNA, 64 nt, Human
ggaaucuguaccuucugaaccucuacaccaauaacugcugcaggugugauuuuggucugucaca

SEQ ID NO: 20741 - RNA, 64 nt, Human
gugagucucagcagccgcccacacgcuccuaacucugcugcauggcagaugccuagguggaaau

SEQ ID NO: 20742 - RNA, 64 nt, Human
guuggcuuuucagccagggccaaaggaaaaagcccugcugcauuuaaaaacaaaguguccaagc

SEQ ID NO: 20743 - RNA, 64 nt, Human
acaaaaggauugaagaaaguagugcaugagacaccugcugcaagcaagacuguuuuuuucuuuu

SEQ ID NO: 20744 - RNA, 64 nt, Human
cggagcagcccucggugaagcugugcugucagcucugcugcagcgucuucaaagaccccgugau

SEQ ID NO: 20745 - RNA, 64 nt, Human
ccuaacauuuugauuccugucuugaaaaaagcaccugcugcaccguaagcccagggauguggca

SEQ ID NO: 20746 - RNA, 64 nt, Human
gugaagauuuuaggcuuugcaggccauauagccucugcugcaaaugcucagcccugcuguugua

SEQ ID NO: 20747 - RNA, 64 nt, Human
cucaaccaggccucuuuguuggcuuccuuuccuccugcugcacaugagccuucgccgugcauuu

SEQ ID NO: 20748 - RNA, 64 nt, Human
ccgggucaggcagggcggcccccugcuccacacacugcugcaucuugggucucagggacccaga

SEQ ID NO: 20749 - RNA, 64 nt, Human
gaaaucuguguuuuaagaagccuuccagguaauucugcugcacacucaaguucaggaaccaccg

SEQ ID NO: 20750 - RNA, 64 nt, Human
cccacucccugcaaccugauugugucucuugguccugcugcaguugccagucaccccggccacc

SEQ ID NO: 20751 - RNA, 64 nt, Human
cuuccacagcccggguucuccugcugccuccugccugcugcagcugcaggcauucugaggggca

SEQ ID NO: 20752 - RNA, 64 nt, Human
cccaaggcugcaaagcaaaacagacuguguuuaacugcugcagggucuuuuucuagggucccug

SEQ ID NO: 20753 - RNA, 64 nt, Human
cacaggacaugaaaaccagcagaaaggcccugagcugcugcauagccccaucugauuucugcag

SEQ ID NO: 20754 - RNA, 64 nt, Human
cuugcucaucccuucucccuuucacuucuguucucugcugcagaaagcagacuugcauaucccu

SEQ ID NO: 20755 - RNA, 64 nt, Human
caaagaagaguccuacccaggagggagagcgcagcugcugcaggauucucgccuggaagagugg

SEQ ID NO: 20756 - RNA, 64 nt, Human
ccuagauggcacuuggugacacacacuccccucucugcugcagcggauuucggccuggcccggg

SEQ ID NO: 20757 - RNA, 64 nt, Human
caaguucccauggcugucggaggccgggcugcgccugcugcacuuccuguucauguacgacccu

SEQ ID NO: 20758 - RNA, 64 nt, Human
acgcccaucccucagauccacugugagcaccaaccugcugcagucucuugggccccugcuggca

SEQ ID NO: 20759 - RNA, 64 nt, Human
gucugggugcacaugaauuugagggaccccucgucugcugcagggagcccugcuguaccccagc

SEQ ID NO: 20760 - RNA, 64 nt, Human
gaagcgcaaauagaguuccggagcuggguugcuucugcugcaguacagaauccacauucagaua

SEQ ID NO: 20761 - RNA, 64 nt, Human
aagguacuaguuaaacaauuggauaauaucuuggcugcugcacaugaugugcuuaaugaaaggu

SEQ ID NO: 20762 - RNA, 64 nt, Human
auacagggcagagucagaacuaaacccgggucuccugcugcacagagcugaacuuuguaucuug

SEQ ID NO: 20763 - RNA, 64 nt, Human
uucucagccuccuccaguacuagccucaguguggcugcugcauaaguaucuguagccugucuac

SEQ ID NO: 20764 - RNA, 64 nt, Human
ccauuuccuccuccccacauggugcugaggcucccugcugcaaugcaauuaaagcaauugauuu

SEQ ID NO: 20765 - RNA, 64 nt, Human
cugggccugaagcugggcccucacuggccugucccugcugcagcgccaggacccccggagguag

SEQ ID NO: 20766 - RNA, 64 nt, Human
ggacaaaaaucaauuaucucauuaauguuuuagucugcugcacacaucuaaaaaagcaaaaugg

SEQ ID NO: 20767 - RNA, 64 nt, Human
accgcauagucacugucucaacuacucagcucuccugcugcagcaugaaggcagccacagacaa

SEQ ID NO: 20768 - RNA, 64 nt, Human
ucuaggcggaagggaguggagauggggcugguuccugcugcagugaggggaacagaugggacaa

SEQ ID NO: 20769 - RNA, 64 nt, Human
gagucccuccuagacuccugggccccaugaccuccugcugcaugucccuucccuuccccagccc

SEQ ID NO: 20770 - RNA, 64 nt, Human
cggagggagccggcgucugaaaggcccccgggaccugcugcagugccagaggggccucuggagc

SEQ ID NO: 20771 - RNA, 64 nt, Human
uuauuauuuagcuguuaaguaacuauaaugaaaucugcugcaaaaucucucuuggaauccaugu

SEQ ID NO: 20772 - RNA, 64 nt, Human
agaaccaggggaggccugaggcuucaguuuuacucugcugcaaaaugaaggcgggccugcaagc

SEQ ID NO: 20773 - RNA, 64 nt, Human
gguucauuuuaugcgugcgagaagucagugguaacugcugcagggcuuaauacauuagugguaa

SEQ ID NO: 20774 - RNA, 64 nt, Human
agggguccuggggagagagaauuuauccagaggccugcugcagauggggaagagcuggaaacca

SEQ ID NO: 20775 - RNA, 64 nt, Human
cagaggaccccuacuccaugcaggacagggucuccugcugcaagucccaacuuugaauaaaaca

SEQ ID NO: 20776 - RNA, 64 nt, Human
uggacaggugucugagaugggcccguacccagcccugcugcagcgcaacggcuccuuugccaac

SEQ ID NO: 20777 - RNA, 64 nt, Human
uggcauccaggcugcccguguguugcaccaggcacugcugcacaacaagauacgcucgccacag

SEQ ID NO: 20778 - RNA, 64 nt, Human
cuaccaaggcauguuuuguuaugcugaaacugggcugcugcauacugcuaaauggcaccucugg

SEQ ID NO: 20779 - RNA, 64 nt, Human
ggaagaggcugcugagaaagagaaugagaagaggcugcugcagacaaguggacagggaaggccu

SEQ ID NO: 20780 - RNA, 64 nt, Human
gugggaggggacgggcgggacgagcuuggcuguucugcugcaccugaaugcuuucuguuauccu

SEQ ID NO: 20781 - RNA, 64 nt, Human
ugacuuggcucgaugcugugggggacuggcugggcugcugcaggccgugugucugucagcccaa

SEQ ID NO: 20782 - RNA, 64 nt, Human
acucccacucauacccgccucccuggacaguucccugcugcagaguucuuucugcuuucagccc

SEQ ID NO: 20783 - RNA, 64 nt, Human
auguauggagugugggugacucugagccucacugcugcugcaagguggggaaacuguaagugaa

SEQ ID NO: 20784 - RNA, 64 nt, Human
ugaugggugugccgaccagcagcuucacaaaugucugcugcaaggggaaucgucagaguccaau

SEQ ID NO: 20785 - RNA, 64 nt, Human
caaagacucugagccaagggagggaagggccacccugcugcacuaggacuugguaagaugacuc

SEQ ID NO: 20786 - RNA, 64 nt, Human
ucugguggguuugggcagucccuggcucuagucucugcugcagauucucaggaccaaaaugugg

SEQ ID NO: 20787 - RNA, 64 nt, Human
agcaauaagaauguuuggggauauuucaguguugcugcugcagggggacuucaugaauuugcug

SEQ ID NO: 20788 - RNA, 64 nt, Human
uuggauuuaccaacaguuaguggccagcauccuccugcugcaggaaguggaucccccucagcca

SEQ ID NO: 20789 - RNA, 64 nt, Human
uagccuccugaguaacugagauuacaggcacaagcugcugcacccagcucuguaggugacuuuu

SEQ ID NO: 20790 - RNA, 64 nt, Human
uggaugccagauuggagaggucagacaccucgcccugcugcauuugcucuugucuggauuaacu

SEQ ID NO: 20791 - RNA, 64 nt, Human
auaugacacagguuaacuaaagucaagauuggggcugcugcauuccagguucccuagacucaca

SEQ ID NO: 20792 - RNA, 64 nt, Human
ccuccugcuguggcuucagcugcugcaggcucuccugcugcaucuccaguugcugccgccccaa

SEQ ID NO: 20793 - RNA, 64 nt, Human
cuagcagcaguagcuccuccugcuguggcuucagcugcugcaggcucuccugcugcaucuccag

SEQ ID NO: 20794 - RNA, 64 nt, Human
agugccugagcuggggaagccgggguguaacuuccugcugcacccugcgccuccagagguccuc

SEQ ID NO: 20795 - RNA, 64 nt, Human
aucagaaugaggagagucaaggacagcaacucagcugcugcaagccagaaacacaucccugucu

SEQ ID NO: 20796 - RNA, 64 nt, Human
ccgugcgcuccucaccccucuacagacaggggcgcugcugcagaugcuccaggcccaccuuggu

SEQ ID NO: 20797 - RNA, 64 nt, Human
ccccgugguguccccuggcccuccccccaccccucugcugcaggaggcguggccaccaccagau

SEQ ID NO: 20798 - RNA, 64 nt, Human
uacugagcgccaucuggguccgcccucgccagcgcugcugcaagaaggaccccggagacccgga

SEQ ID NO: 20799 - RNA, 64 nt, Human
accuuccaacuuccuguggccugaagaagcacuucugcugcaucgcuguucugggcauggcagg

SEQ ID NO: 20800 - RNA, 64 nt, Human
auucccugcaucuagugacaacugucuggauugccugcugcaaagcuuugauuuggcaaaggag

SEQ ID NO: 20801 - RNA, 64 nt, Human
aucauguuauuuugggcauuugcaguuuucuucccugcugcauguaaugucucagaaucaacau

SEQ ID NO: 20802 - RNA, 64 nt, Human
uaaggaauaaauccaagagcuuuccagagacuggcugcugcagcccugggaaugucuguggaau

SEQ ID NO: 20803 - RNA, 64 nt, Human
cgcccauccacaucuggaaagucggagccgcagccugcugcaccguuuccgcucugggaucuug

SEQ ID NO: 20804 - RNA, 64 nt, Human
uuuagacagaaagcugaaaggaaucugcagucuccugcugcaguucaacucugcuguuuuucag

SEQ ID NO: 20805 - RNA, 64 nt, Human
uggcggcggcaugccucccuuccacaagcccaugcugcugcagagggagccuguguuugcaaaa

SEQ ID NO: 20806 - RNA, 64 nt, Human
acggaaaaugccacuagagagagagugaugcaagcugcugcaaagcugaugggcuuccucuggc

SEQ ID NO: 20807 - RNA, 64 nt, Human
gguuaucuggaagauuggguguauuuuuuggugacugcugcauucaucagcaaugaacaguuuc

SEQ ID NO: 20808 - RNA, 64 nt, Human
augagggaagaggaucuccagcugguucugugggcugcugcagugaaaagcaggaagaagaugg

SEQ ID NO: 20809 - RNA, 64 nt, Human
augcugcaccaaagcucgggcgccgcgggcacggcugcugcagucucuucccagccuggcccug

SEQ ID NO: 20810 - RNA, 60 nt, Human
cggaagagcggcucaucugaacgcuggggccugcugcagccaccaacacugcccaggacu

SEQ ID NO: 20811 - RNA, 64 nt, Human
acccaccacgagggauggauuccacccgcccgcccugcugcagauacaugcggcacagcaggca

SEQ ID NO: 20812 - RNA, 64 nt, Human
ucuugagaggagagugacauggaagcaacuccgucugcugcagcugacccccucacacugaguu

SEQ ID NO: 20813 - RNA, 64 nt, Human
caggaguuugaggcugcagugaguuaugauggcacugcugcacuccagccugcgggacagagug

SEQ ID NO: 20814 - RNA, 64 nt, Human
gcugggaaagugggccuccccuugcaacucagagcugcugcacucaggagggccccauccaauc

SEQ ID NO: 20815 - RNA, 64 nt, Human
ucauccuuuggccugcccccaggugcauggcggccugcugcagaucuucccugagggccggccc

SEQ ID NO: 20816 - RNA, 64 nt, Human
cuagaaucuaagcuccaugcaggaacauuguuuacugcugcaugaucgugaccuugaacaagua

SEQ ID NO: 20817 - RNA, 64 nt, Human
gacaacgucagugggccaccaugugccaugauggcugcugcagccccguguuggccaugucguc

SEQ ID NO: 20818 - RNA, 64 nt, Human
guuaguccuccccagggucuagcuuuccuucuuccugcugcagggugcugccugagggguccug

SEQ ID NO: 20819 - RNA, 64 nt, Human
ucucuugcuuaccaaugucuaagguccccacugccugcugcagagaaaacacacuccuuugcuu

SEQ ID NO: 20820 - RNA, 64 nt, Human
ucucuugcuuacaaaugccuaaggucgccacugccugcugcagagaaaacacacuccuuugcuu

SEQ ID NO: 20821 - RNA, 64 nt, Human
ugccugguggugcuagcuccucccaccucagcaccugcugcaucuggagcagcccaagccucag

SEQ ID NO: 20822 - RNA, 64 nt, Human
agccccacgaaggccuugggcugugcguccgacccugcugcagaaccagcaggguguccccucg

SEQ ID NO: 20823 - RNA, 64 nt, Human
uguccuuccugggaagaagaagcuccagccaguucugcugcaagucaaccagcaugcagggggc

SEQ ID NO: 20824 - RNA, 64 nt, Human
augugaccccagaaaugccagcagggaacggaggcugcugcagagacgcagccccaggcagccg

SEQ ID NO: 20825 - RNA, 64 nt, Human
gaguuaaguggcuucuccguggaaacacagccuucugcugcagcagaggcucacccagcgugaa

SEQ ID NO: 20826 - RNA, 64 nt, Human
aucugcucucuggccaacggcuucacaccuuccccugcugcaugugggggccgaugggcagggg

SEQ ID NO: 20827 - RNA, 64 nt, Human
gcaaugcuagcaugggaccccgaaaauagacgcucugcugcacugagacuucuugucaaugccc

SEQ ID NO: 20828 - RNA, 64 nt, Human
uccaguccugcccaggcccugggucaccaggucacugcugcagcccccgccccugggcccuggu

SEQ ID NO: 20829 - RNA, 64 nt, Human
agcccuggacaggucucgcacccacaaguacuaucugcugcagagauccucucaucuguggcca

SEQ ID NO: 20830 - RNA, 64 nt, Human
aagaaacacuuucucuucuuguuucuccugcccacugcugcaguaggggaggagcacaguuugu

SEQ ID NO: 20831 - RNA, 64 nt, Human
cucccgguguuguuauuaaacgucuguggagcuucugcugcaaggaacaaaaaagaaaaaaauc

SEQ ID NO: 20832 - RNA, 64 nt, Human
cgcgcuucgagggaauaugcgaagcugccgcgugcugcugcacaugcgcuuuuucccuuccgcu

SEQ ID NO: 20833 - RNA, 64 nt, Human
ccaggagaacagggauuucuaucaaugucauucacugcugcauccccagugccuagaacagggc

SEQ ID NO: 20834 - RNA, 64 nt, Human
agggcagcauccacccugcagcgccaaugaggaucugcugcaccugcucacggugagccccccu

SEQ ID NO: 20835 - RNA, 64 nt, Human
uagcauaagugaucugugccuuaacgacauguuccugcugcagauaacuagccagacccauccc

SEQ ID NO: 20836 - RNA, 64 nt, Human
ggcaucccaaaggggcaacgggaggaaggggaggcugcugcauugugggugaugacguaggaca

SEQ ID NO: 20837 - RNA, 64 nt, Human
gucaucccaggacucagcacaccggcauccccaccugcugcagggacagcccugacacuccuuu

SEQ ID NO: 20838 - RNA, 64 nt, Human
aggcaccuuaccagucugucuggggacaggaucccugcugcaccuuccccacccccuccuggga

SEQ ID NO: 20839 - RNA, 64 nt, Human
auagccuccccaccccuuaucagagccaagacaccugcugcagcucuccaccuagcugcagaua

SEQ ID NO: 20840 - RNA, 64 nt, Human
gccaugacacuucagccccgccacccaugccugucugcugcagccauccuugcacucuccagcg

SEQ ID NO: 20841 - RNA, 64 nt, Human
gggugagaguaacugugcuuggaauagaaaagcccugcugcaucgagacacaaugcuggcagcu

SEQ ID NO: 20842 - RNA, 64 nt, Human
ccagucuccuccucaguucugugccugagaaccacugcugcauauauuuguuuuuaaauuuugu

SEQ ID NO: 20843 - RNA, 64 nt, Human
guugcccgaugcccuguugggucaccggcuggaccugcugcagccugcagagccacagucagcc

SEQ ID NO: 20844 - RNA, 64 nt, Human
ggugcugagcgcaugagugacagaggcagagaugcugcugcaacuggaagaagcuggaaccagu

SEQ ID NO: 20845 - RNA, 64 nt, Human
cccagcccugucagugagcccaggucuggugcaacugcugcaggaugccuguaguagggaacuc

SEQ ID NO: 20846 - RNA, 64 nt, Human
gcaucccaugucccacgucccgugguucugcuuccugcugcaucgucugccaucugacacaagg

SEQ ID NO: 20847 - RNA, 64 nt, Human
ccacacuccagguucccucaggcuuguguccccacugcugcaucguggcggggugucacagacc

SEQ ID NO: 20848 - RNA, 64 nt, Human
uccuucauuguugagaauuuaaggaccuuugauacugcugcacaauagagauugaguucuggga

SEQ ID NO: 20849 - RNA, 64 nt, Human
aggagugcccgucggcgucuugguccuccugucccugcugcaggggcuggggccuccggagcug

SEQ ID NO: 20850 - RNA, 64 nt, Human
uuuccaggacaucuccaucaagaggcugcagcggcugcugcaggcccucgaggccccggagggc

SEQ ID NO: 20851 - RNA, 64 nt, Human
ccugggggcgcaggacggggcgcugcuggugcggcugcugcaggcgcugcgcguggccaggaug

SEQ ID NO: 20852 - RNA, 64 nt, Human
caaaagaacaaagauaaaccagccucaaucccggcugcugcauuuagguggagacuucuuccca

SEQ ID NO: 20853 - RNA, 64 nt, Human
ucgcuggacgccagcugugcacacccagccacaccugcugcacgccgcguuagugugcggcucc

SEQ ID NO: 20854 - RNA, 64 nt, Human
cugcuuuagacuugaaaagagacaggcaggugaucugcugcagagcaguaagggaacaaguuga

SEQ ID NO: 20855 - RNA, 64 nt, Human
cccuaccucaggcaggaagggcaggaaggagagccugcugcauggggugggguagggcugacua

SEQ ID NO: 20856 - RNA, 64 nt, Human
uccccaaccugugcgucucuguguccgggccggccugcugcagccaccuggugccuuaguccuu

SEQ ID NO: 20857 - RNA, 64 nt, Human
ugauuaguucuuuucuucugacucguggggcucccugcugcagagagcacagcccuugccugga

SEQ ID NO: 20858 - RNA, 64 nt, Human
gacucucuggggcugaucacuuaguuuuuggccucugcugcagccgucauacuguuccaaaugu

SEQ ID NO: 20859 - RNA, 64 nt, Human
guuccucaaggaagcaguaccuuugaagagaucucugcugcauuaagugaugaccggcuacguu

SEQ ID NO: 20860 - RNA, 64 nt, Human
cgcauugaaaugcccaguucagacugaauaauuccugcugcagcaaggaaaguaccuacuauaa

SEQ ID NO: 20861 - RNA, 64 nt, Human
cuucaccacccuccaaguccucugaccuaauuuucugcugcaagguccccuggcaguggcccau

SEQ ID NO: 20862 - RNA, 64 nt, Human
ggagaaagagcacaaaagaggucugggaacuucucugcugcaaugaaagaucugucaggugaga

SEQ ID NO: 20863 - RNA, 64 nt, Human
uuagagacugugccuucagcaggacucuuaauaucugcugcaacuuggagaaccucccugcccu

SEQ ID NO: 20864 - RNA, 64 nt, Human
uaauagaguggccucuuucgcucuucgauuaugacugcugcaguuuuaccccagcagucagcug

SEQ ID NO: 20865 - RNA, 64 nt, Human
gguugauuuguguggcccauggauuugaaagaagcugcugcacccgaaacugccagugugcggu

SEQ ID NO: 20866 - RNA, 64 nt, Human
gcagacccuggacugcauccgguuccccaaagcccugcugcauucgagugucccccaaccccgg

SEQ ID NO: 20867 - RNA, 64 nt, Human
gguggacccagugccccucacggcugccgcaagucugcugcagaugaccucaugaacuggaagg

SEQ ID NO: 20868 - RNA, 64 nt, Human
uauagaauaaaccuuuuauuuaaguugugauuaccugcugcaugaaaagugcaugggggacccu

SEQ ID NO: 20869 - RNA, 64 nt, Human
aucaguaagguagcauucauuaccuguuuauucucugcugcaucuuacagaagaguaaacuggu

SEQ ID NO: 20870 - RNA, 64 nt, Human
cugcgugcccuugcggaagcccagaagcuucuuccugcugcaccucccguuuccgcugcugcug

SEQ ID NO: 20871 - RNA, 64 nt, Human
cugcuucuucccugcagacaugguggagcugcugcugcugcagaacgcacaggugcaccaguug

SEQ ID NO: 20872 - RNA, 64 nt, Human
acuguggacagugguggacccugcuucugugcaccugcugcaggcucuuuuuaugaaggcuuuc

SEQ ID NO: 20873 - RNA, 64 nt, Human
gccaacugguauauacgugugguucauccaucaucugcugcacauagcagacuagaauucuggg

SEQ ID NO: 20874 - RNA, 64 nt, Human
augaccacuagagguaugucugccccucgucacccugcugcacaccaaucuguggcccuucauc

SEQ ID NO: 20875 - RNA, 64 nt, Human
ggcugaacgcacgagggaugaguuggagaggaggcugcugcagaugaaagaagaagcaacaaug

SEQ ID NO: 20876 - RNA, 64 nt, Human
gaaauucugccgagccucuugucccuucccugcucugcugcauggggccccauggcuuuggcug

SEQ ID NO: 20877 - RNA, 64 nt, Human
ucuccggcaccugcguccccucucccgggcuccccugcugcaugguggaugugcuccuuccugg

SEQ ID NO: 20878 - RNA, 64 nt, Human
ggaccgccugcccccagcucaucccagagcgucccugcugcaacccugacagccgucucccagg

SEQ ID NO: 20879 - RNA, 64 nt, Human
cuuggggcccucagccccuugagacacccugauucugcugcaugccaagggccuguucugcccc

SEQ ID NO: 20880 - RNA, 64 nt, Human
acuuaugacucgucgugggcgcauggcggcgcaccugcugcaggagcggccacgucucagcuuc

SEQ ID NO: 20881 - RNA, 64 nt, Human
cgggagguggagguugcagugagcccagauggcgcugcugcacucaagcuuggaugacagagca

SEQ ID NO: 20882 - RNA, 64 nt, Human
ugcaccaccauccagaaugcccccuuugcaaggccugcugcaguccccagucugaccagcaagu

SEQ ID NO: 20883 - RNA, 64 nt, Human
uccagcacggccccaagguggacacuagccccugcugcugcaggcaccaugcugcuucagcagu

SEQ ID NO: 20884 - RNA, 64 nt, Human
uguuggccccuuuuguuuuuuggccuuaacgcuccugcugcacagggugaggugccuccuuggc

SEQ ID NO: 20885 - RNA, 64 nt, Human
cccuccagguguuguugagggcauuuggcuuccucugcugcauccccuuccagcucccuccccu

SEQ ID NO: 20886 - RNA, 64 nt, Human
aguaagggcacagauccccccacaaaguggaugccugcugcaucuucccacaguggcuucacag

SEQ ID NO: 20887 - RNA, 64 nt, Human
gguucaaccagccccugccauuucuuaagacuuucugcugcacucacaggauccugagcugcac

SEQ ID NO: 20888 - RNA, 64 nt, Human
ugguggguggccccuuccuccccccaacaucagucugcugcagcugccagaaaacaugccuacu

SEQ ID NO: 20889 - RNA, 64 nt, Human
uagaugccagggccccuccucuggcccaggacgccugcugcaagcccacccagauggggccaga

SEQ ID NO: 20890 - RNA, 64 nt, Human
cugcgugagcaaguacagcggcgucuucuccuuccugcugcagcugaagcucaugaugugggcg

SEQ ID NO: 20891 - RNA, 64 nt, Human
aggcuucucugggacagugugcuuucugauugaccugcugcagcccaaucaggcugaauuccca

SEQ ID NO: 20892 - RNA, 64 nt, Human
uuuugcaccugcuucugccuggagauugaggggucugcugcaggccuccucccugcugccccaa

SEQ ID NO: 20893 - RNA, 64 nt, Human
ucugugguuuucucucuuuuugugguauuagcagcugcugcagauaaaugcauuaauucaugau

SEQ ID NO: 20894 - RNA, 64 nt, Human
gucuuaauuggcuguugccuggggaacaggagagcugcugcaggcagaugaccucauggggggu

SEQ ID NO: 20895 - RNA, 64 nt, Human
uucugugggccuugcagcuuuaacuauagcucagcugcugcaagauuucagacuuuugaggaug

SEQ ID NO: 20896 - RNA, 64 nt, Human
cagcuuguguuauauggcuacagcaagucuucagcugcugcaaugaggaaaugggcaucuggaa

SEQ ID NO: 20897 - RNA, 64 nt, Human
ccaucucccucaugaguaagacugaaauaaaacucugcugcaggaaagauggaagaaaagacag

SEQ ID NO: 20898 - RNA, 64 nt, Human
aucaaauuugagacguugaaauuggagcugcgugcugcugcacucaccggcuucuucucacucu

SEQ ID NO: 20899 - RNA, 64 nt, Human
cacuaccccauugaagacgcaucaccuaguuaaccugcugcaguuuuuacaugauagacuuugu

SEQ ID NO: 20900 - RNA, 64 nt, Human
ccagguuggagugcaguggugugaucuuggcucacugcugcaaccucccccuccuggguucaag

SEQ ID NO: 20901 - RNA, 64 nt, Human
ccucgugccauaauucccaaguucaugucucagacugcugcauugcagcaugaggcagggcaaa

SEQ ID NO: 20902 - RNA, 64 nt, Human
gggccagccucugaaugcggccacggaugccuugcugcugcaacccuuuccccagcuguccacu

SEQ ID NO: 20903 - RNA, 64 nt, Human
gggcuggagcugcucccaccucccugaccuaccccugcugcaccauucccccagcugggcugga

SEQ ID NO: 20904 - RNA, 64 nt, Human
aaaaguuuuugagacuggcucaaauccucccaagcugcugcacgugcugaguccagaggcaguc

SEQ ID NO: 20905 - RNA, 64 nt, Human
uggacuggauggaggcuuucaaacuggugccauacugcugcaggaccuaaagggagccccaucu

SEQ ID NO: 20906 - RNA, 64 nt, Human
ccugugcagaccucccugcaggccgcacugccaacugcugcauuuguuguguuuuuuagguugc

SEQ ID NO: 20907 - RNA, 64 nt, Human
gacagccagcccuggaaccccccgacccccgcagcugcugcagccagugugccagugugcguuc

SEQ ID NO: 20908 - RNA, 58 nt, Human
ucucugccccucacauuuagccgacugacugcugcagaccaccgccaacugcagcucu

SEQ ID NO: 20909 - RNA, 64 nt, Human
auugcacagaccgacagucgugaggauggcagagcugcugcauucccccacacggggauuucug

SEQ ID NO: 20910 - RNA, 64 nt, Human
cgaguacuggcgaguauguucuauguugggccuccugcugcaaaacaauaaacagaggacgcag

SEQ ID NO: 20911 - RNA, 64 nt, Human
guuuauacuccguaaagaacauacaaggacauucacugcugauuuuuuuuuuuguuuguuugag

SEQ ID NO: 20912 - RNA, 64 nt, Human
ccugccugaguguugcaagcucaggccuuuaaggacugcugaugcccccucaggccucccccaa

SEQ ID NO: 20913 - RNA, 64 nt, Human
gaaucgggcuaaggucccugggggugcagaugguacugcugaggucccgggcuuagugugagca

SEQ ID NO: 20914 - RNA, 64 nt, Human
aaacacccaaaccaguaauaugcuaaccugaugcacugcugaaagaaaaugugaauuuuucgua

SEQ ID NO: 20915 - RNA, 64 nt, Human
auacaaaaaaaaauucugaaggacaaaaaaggugacugcugaacugugugugguuuauuguugu

SEQ ID NO: 20916 - RNA, 64 nt, Human
cucagggccuggugaagucugcuacucuguccuuacugcugaacauccugcuuguaucaggaaa

SEQ ID NO: 20917 - RNA, 64 nt, Human
uggaggagcagcuggucagcaccuuggugccccuacugcugaccaugcaggagggcaacuccaa

SEQ ID NO: 20918 - RNA, 64 nt, Human
ccauaugaauuuuaagauauuuuagugcuucaagacugcugaaagcaauccaguugcuccugug

SEQ ID NO: 20919 - RNA, 64 nt, Human
caggcugcccucgguggugaggacuggaugcuagacugcugagcuguggucugggcucaguuga

SEQ ID NO: 20920 - RNA, 64 nt, Human
gaagguuaaccuuguuugugcagauuaccaaauuacugcugauguaguaugauaaagucagcuu

SEQ ID NO: 20921 - RNA, 64 nt, Human
cauuuuacccauuuauuuuuuuaaacauucaagaacugcugacguacuguggauguagaguaua

SEQ ID NO: 20922 - RNA, 64 nt, Human
uuccaggcuguaagaaaaaagggccaauaaccagacugcugagguugcccacaggaggaucaca

SEQ ID NO: 20923 - RNA, 64 nt, Human
uggcaagaauguguuuaaacuugguuuuuaaaaaacugcugacuguuuucucuugagagggugg

SEQ ID NO: 20924 - RNA, 64 nt, Human
gcuucuuuagauuuaagaguucauaauuccauccacugcugagaaaucuccucaaacccagaag

SEQ ID NO: 20925 - RNA, 64 nt, Human
cuggaccagcuguccuuuacaccaccuucucaacacugcugaaaagaacccaagagaauuguca

SEQ ID NO: 20926 - RNA, 64 nt, Human
uagaaagacgggcaacacagcggguuacauccacacugcugaucacaccaacgacaggagcuga

SEQ ID NO: 20927 - RNA, 64 nt, Human
agaguuggcaugguuaaaucugaaugguuaccucacugcugaaaacccagaggggcguggcaca

SEQ ID NO: 20928 - RNA, 64 nt, Human
uucaaggcuguuugucuacccagaggaaggaggcacugcugaauggcuauggccuggcuaagaa

SEQ ID NO: 20929 - RNA, 64 nt, Human
aaauuuuaacuucuauaugggacccgaauuagacacugcugaauccuguacagccuuacucaua

SEQ ID NO: 20930 - RNA, 64 nt, Human
cucuuaacaguuaaacaagcuguuuacaguuuaaacugcugaauauuauuugagcuauuuaaag

SEQ ID NO: 20931 - RNA, 64 nt, Human
uagauccgugagggcgugagcuuggacuggacccacugcugauucccugcaccuagcacagugc

SEQ ID NO: 20932 - RNA, 64 nt, Human
ugggaaaggacccacccaucuuccugcugcuguaacugcugagccacucgcagucgcaggaucc

SEQ ID NO: 20933 - RNA, 64 nt, Human
aaccagggguaccaggcacauggcugggggagggacugcugacccaccaaggucucacacuccu

SEQ ID NO: 20934 - RNA, 64 nt, Human
auagugcucaggaguuucucuucuuaaaauguuuacugcugaaagaugagcaggaccagggcgu

SEQ ID NO: 20935 - RNA, 64 nt, Human
guagucagggucagggaccuuggacuugucucuuacugcugaccagucugugcuuuaugggcag

SEQ ID NO: 20936 - RNA, 64 nt, Human
uccagccuugcacaacugcuuugagguacuguagacugcugaaguuuccacccucuuccccugg

SEQ ID NO: 20937 - RNA, 64 nt, Human
guugcacuacccaugaggaauucguggaauggcuacugcugacuaacaugaugcacauaaccaa

SEQ ID NO: 20938 - RNA, 64 nt, Human
ugccacccaccuccugagcuguuuuuguaaaaugacugcugacagcaaguucuugcugcucucc

SEQ ID NO: 20939 - RNA, 64 nt, Human
cagaaaaaauaaacugaguuuaagggggacuuaaacugcugaauucaccuguggauguuuuuga

SEQ ID NO: 20940 - RNA, 64 nt, Human
cuacuggagcuuuagucuucugagacggaggaaaacugcugaauacucuggauucaucuauguc

SEQ ID NO: 20941 - RNA, 64 nt, Human
ggugcugacucauucagcacugucccuuuucuauacugcugauacaucccaugguucugagaag

SEQ ID NO: 20942 - RNA, 64 nt, Human
agaagcaguugucccccaaauacucugcucccucacugcugaaucccuguagggagaagccugc

SEQ ID NO: 20943 - RNA, 64 nt, Human
gcugagccagcacccucagaugauuucccuccaaacugcugacuaggucauccucugucuggua

SEQ ID NO: 20944 - RNA, 64 nt, Human
gcuccuccguagugcucccaauccuauggccaugacugcugaaccugacaggcguguggggagu

SEQ ID NO: 20945 - RNA, 64 nt, Human
ggaggaguggaagcuauuuuguaugcaacuagucacugcugaggggugucaaaguuucuauuuu

SEQ ID NO: 20946 - RNA, 64 nt, Human
cauccuccuucaugcccucccucccuuuccuaccacugcugaguggccuggaacuuguuuaaag

SEQ ID NO: 20947 - RNA, 53 nt, Human
cucaaguaaccacuucauaauauacugcugaagggcuucuucuuauagcaaga

SEQ ID NO: 20948 - RNA, 64 nt, Human
ugauagaugcuuuaauugaguuuaaguagcugaaacugcugagacacuaaacuuuaaccuucug

SEQ ID NO: 20949 - RNA, 64 nt, Human
acuuguaauuuuguaucuugaugucuuuguuaagacugcugaagaauuauuuuuuuucuuuuau

SEQ ID NO: 20950 - RNA, 64 nt, Human
cgggguuucgcuauguuggccagacuggucuugaacugcugaccucgugauccgcccgccucgg

SEQ ID NO: 20951 - RNA, 64 nt, Human
cuucuuccucuuuaagaaaaaggacaauuuuuaaacugcugaaauaaaaugacuguuacauuuu

SEQ ID NO: 20952 - RNA, 64 nt, Human
guucgaggguaccaggagagcuggcgaugacugaacugcugauggacaaaugcucugugcucuc

SEQ ID NO: 20953 - RNA, 64 nt, Human
ucacuguuucaggauacuugaggaucuuuaguguacugcugacucuuuuucuuguuuugucugc

SEQ ID NO: 20954 - RNA, 64 nt, Human
acacagcagcuuuugcacgccccaggcagccccgacugcugaaauccaacuugagcuggcuggu

SEQ ID NO: 20955 - RNA, 64 nt, Human
uuuaaugaaauauuaguuggaagacuucacgaagacugcugauaacuaucugugauugauagga

SEQ ID NO: 20956 - RNA, 64 nt, Human
uucuggacacaaaaucuguacuggagaggaaaugacugcugaaauaaggcgauuguaugaauau

SEQ ID NO: 20957 - RNA, 64 nt, Human
cccuggucggaccuguccuggacuuccaaccuugacugcugagcuccuggcuuagcuucuuggg

SEQ ID NO: 20958 - RNA, 64 nt, Human
cugggcugagguuggagaaggggcagccgggggcacugcugaggguuugccgugcacgccucgg

SEQ ID NO: 20959 - RNA, 64 nt, Human
gucauggucauuucauuccuacucuucaggagacacugcugaacagaggaaugauucuguuccu

SEQ ID NO: 20960 - RNA, 64 nt, Human
gcaggaggaaauggcggggaggaggcauucuugaacugcugaggaugggggguguccccucagc

SEQ ID NO: 20961 - RNA, 64 nt, Human
aauaaaugcuaguuuuuucugaucugucuauacaacugcugauaagccggcugggcaggagugc

SEQ ID NO: 20962 - RNA, 64 nt, Human
gccaguuccugccuguugccucuugugagcucggacugcugaugccccggugcugcugagcgcc

SEQ ID NO: 20963 - RNA, 64 nt, Human
acuuucuucaugaggaguaaaaauccaaggcuuuacugcugauagugcuaauuggcauuaacca

SEQ ID NO: 20964 - RNA, 64 nt, Human
accccgauggcuccauucccaaguaccccaacucacugcugauccuauuaaaggaaugaguccu

SEQ ID NO: 20965 - RNA, 64 nt, Human
cccucccugguggguugcaugaaugugucucauuacugcugaaauguccucacaucucuuucac

SEQ ID NO: 20966 - RNA, 64 nt, Human
ccagcgucugcagggugacgccugagacagcaccacugcugaggagucugaggacuguccuccc

SEQ ID NO: 20967 - RNA, 64 nt, Human
cuucaugccuuggugauggaugccagcauguuaaacugcugaaguuugauuuucugaugcaaaa

SEQ ID NO: 20968 - RNA, 64 nt, Human
cgccucuuccaguucaaaggagucugcaauuggaacugcugauuuucgguggguuuuguaguug

SEQ ID NO: 20969 - RNA, 64 nt, Human
uuccuuguaucuguagucuuuuauuuuuuaaaugacugcugaaugacauauuuuaucuuguucu

SEQ ID NO: 20970 - RNA, 64 nt, Human
gccaggcuagugaucacaccagggguuagaguucacugcugaacucccugauggcaggucugug

SEQ ID NO: 20971 - RNA, 64 nt, Human
uucauucuuuugcuuguggaucuccacuugucccacugcugauuauugagaaaaauauccuuuc

SEQ ID NO: 20972 - RNA, 64 nt, Human
agcacagaagauaaagaagaagucuuucaucuuuacugcugagauccuugggaacacuguuguc

SEQ ID NO: 20973 - RNA, 64 nt, Human
ucaagucaacaugaaauuggaaugcaaaauuaauacugcugaggauuuccuucauaucccaugc

SEQ ID NO: 20974 - RNA, 64 nt, Human
ugacaagagguugcuguuuuuauuaccagcugacacugcugaggagaaacccaauggcuaccua

SEQ ID NO: 20975 - RNA, 64 nt, Human
ccucagagggaaacagcaggaggagggaucccugacugcugaggacucacacugaccagacgcc

SEQ ID NO: 20976 - RNA, 64 nt, Human
aaauugccuuuuucagaguuuauuucucaugugcacugcugaagaugaauaucccuaauccuuc

SEQ ID NO: 20977 - RNA, 64 nt, Human
cacaccagaaccucuggcaagccgcccgacugcaacugcugacccugcagagcuggcugcugga

SEQ ID NO: 20978 - RNA, 64 nt, Human
cgccugcugaggagcucuccaucgccagagcaggacugcugaccccaggccuggugauucuggg

SEQ ID NO: 20979 - RNA, 64 nt, Human
caucugugauccugaagggcggccguuagucauuacugcugaguccugggucaccagcagacac

SEQ ID NO: 20980 - RNA, 64 nt, Human
aaacuuuguauuucaguuucuuuugaauuaugccacugcugaacuuuuaacaaacacuacaaca

SEQ ID NO: 20981 - RNA, 64 nt, Human
uauuaugcaggggcaaacaccugcugauguggcaacugcugaugcucaugguccccauggcaug

SEQ ID NO: 20982 - RNA, 64 nt, Human
cuuaagaauuuugagcaggugguauguuugggagacugcugagucaacccaauaguuguugauu

SEQ ID NO: 20983 - RNA, 64 nt, Human
cucugaguaggcugucaucagaacaaagggcuccacugcugacaagguuugagaacugcuggcu

SEQ ID NO: 20984 - RNA, 64 nt, Human
aucuaaaggaaaccugcucaucucccugaagcagacugcugaggaauuacauuugcucaagaau

SEQ ID NO: 20985 - RNA, 64 nt, Human
ucuucccugaacgcgggucgguguggagucagugacugcugacucagggagcuccuuggccccg

SEQ ID NO: 20986 - RNA, 64 nt, Human
guaggcuguuguuauauuagacuuccuggaacacacugcugaaaagaacugauguguucagauc

SEQ ID NO: 20987 - RNA, 51 nt, Human
uugucaagcauuuaucaugauacugcugaccagaagugacugcuguguagc

SEQ ID NO: 20988 - RNA, 64 nt, Human
auucuccuuucagguaaagauaggcuaucucaacacugcugagugauucauaaacauaucaacc

SEQ ID NO: 20989 - RNA, 64 nt, Human
aacuuuauguguuaugccagaacucugagggcaaacugcugaaaaacaaaggguuuaaggauga

SEQ ID NO: 20990 - RNA, 64 nt, Human
ugcuguucuguaagaguguggauucuuucuaucaacugcugauaucaucuucaggaagcaaguc

SEQ ID NO: 20991 - RNA, 64 nt, Human
aauuaauuauuaauaaguguuguucauuuacugcacugcugagaacuaauuaaaauuauauauu

SEQ ID NO: 20992 - RNA, 64 nt, Human
cuacacugcugccagaggccuuuuugccaaaagcacugcugauugucacucuuuuacuuuccug

SEQ ID NO: 20993 - RNA, 64 nt, Human
ugucuguggagagaauggggugcuuucgucagggacugcugacggcugguccugaggaaggaca

SEQ ID NO: 20994 - RNA, 64 nt, Human
guuuucugcagaugcugcugcugucacaacaugaacugcugacacaguccuuuaccuugcucca

SEQ ID NO: 20995 - RNA, 64 nt, Human
auauauuaugggauaaaaggccacaggaaauaagacugcugaaugucugagagaaccagaguug

SEQ ID NO: 20996 - RNA, 64 nt, Human
cucccaccauucauuacuccuccuccagauaccaacugcugauguugcucuagaaaaaccacca

SEQ ID NO: 20997 - RNA, 64 nt, Human
gagggcaguccuguggcugaggggcacagauugaacugcugaacuaguuggaggucuagaugag

SEQ ID NO: 20998 - RNA, 64 nt, Human
ugcugguauuaaacuaaauggacuccuuucacuaacugcugauuucagaguuuaaauguuagca

SEQ ID NO: 20999 - RNA, 64 nt, Human
cccagggcagagcccagagaaguguuccguacccacugcugaugguuucccagagcccacacug

SEQ ID NO: 21000 - RNA, 64 nt, Human
accauguagucagguauuguuauuaguaccuaucacugcugagcuguauuuaaaauuuugguac

SEQ ID NO: 21001 - RNA, 64 nt, Human
uucucugagaaauuauuauggcaaaacugucuggacugcugacaguaaauuccgguuugcaugu

SEQ ID NO: 21002 - RNA, 64 nt, Human
uggaaacuucuaaaauggaauuuggugcauauguacugcugaauaaagaccgaugaagagguuu

SEQ ID NO: 21003 - RNA, 64 nt, Human
uuuaucuuuaaaacaaauauaagguuuuaauuauacugcugaagcaaaugugaaugccaaagac

SEQ ID NO: 21004 - RNA, 64 nt, Human
uagcauggcucuuucauauaggacuauuuacaagacugcugagcagaaugccuuauaaaccugc

SEQ ID NO: 21005 - RNA, 64 nt, Human
guuuugcauguauuuuuuuacagucuaaauuuugacugcugagaaguuucuauuguacaaaacu

SEQ ID NO: 21006 - RNA, 64 nt, Human
aggcaucaucaauaaaacaguuggcaugcaucccacugcugacuauaaugccucuccuuaaaug

SEQ ID NO: 21007 - RNA, 64 nt, Human
ggauuguuuguaaccagcuuuuguuacaauuguuacugcugauuaauaucuugcuaaucauagg

SEQ ID NO: 21008 - RNA, 64 nt, Human
uuuugauuuuuugaaugagauauauaaucaaaguacugcugaacugugagugcaguauucuaaa

SEQ ID NO: 21009 - RNA, 64 nt, Human
aauaaauauuaccugucuaccucaaaauacacauacugcugaagcauucuguacaaccgugugu

SEQ ID NO: 21010 - RNA, 64 nt, Human
uuuuuaacuguguuaaaguacuugaaauguauugacugcugacuauauuuuaaaaacaaaauga

SEQ ID NO: 21011 - RNA, 64 nt, Human
uuaaucuuaguuuaauggucucucccuggugcuaacugcugacaguggccaccucuuuuuuggg

SEQ ID NO: 21012 - RNA, 64 nt, Human
ggcuuuuccugaguccccagacagcagaguaugaacugcugacacccagauuccauuaaaaauu

SEQ ID NO: 21013 - RNA, 64 nt, Human
ugcccacauauucuucuugcacaccccuuccauuacugcugaauaggacauugcaugggaagag

SEQ ID NO: 21014 - RNA, 64 nt, Human
ccuccuggggacccacagcagacgucugcaagccacugcugagacccuucccagggaggagcca

SEQ ID NO: 21015 - RNA, 64 nt, Human
cugcugcuuucugagcccgcaccugugcgccuaaacugcugauuggccucaacugcccaggcgg

SEQ ID NO: 21016 - RNA, 64 nt, Human
uguaccuaugugacagacauuuucaauaaugugaacugcugauuugauggagcuacuuuaagau

SEQ ID NO: 21017 - RNA, 64 nt, Human
ggcagacagaaaaauguaaaaccacacaaaacggacugcugauaauauuuuaaaauauacuuau

SEQ ID NO: 21018 - RNA, 64 nt, Human
acauuaaaaaguccagacacacuguauugugaaaacugcugaacauguggcagcaauuuugugu

SEQ ID NO: 21019 - RNA, 64 nt, Human
uauacucacuuucccaaauugaaucacugcucacacugcugaugauuuagagugcuguccggug

SEQ ID NO: 21020 - RNA, 64 nt, Human
aaaucccauugacaaauguugaugcacuguagucacugcugaguuaauagcgcuuuuuaaagac

SEQ ID NO: 21021 - RNA, 64 nt, Human
uaaauagaaaggaaaauauauucuaguagguaagacugcugacucuuugaaaaucugagguauu

SEQ ID NO: 21022 - RNA, 64 nt, Human
auagggcuauauuggcaaaaugccgcccgaacagacugcugacaguaaaccaaauauuaguuuc

SEQ ID NO: 21023 - RNA, 64 nt, Human
cucugugcuguuuuaauuaccuaacgucuguguaacugcugauuugaguagugauuagcauuua

SEQ ID NO: 21024 - RNA, 64 nt, Human
augcucuggcacaagcgagucccugcaaacuaccacugcugaggacaguaguaaaccccuugac

SEQ ID NO: 21025 - RNA, 64 nt, Human
uguaacaggucagaauuucaagcucuggguaauaacugcugauauuuuuucuaauuucaaauuu

SEQ ID NO: 21026 - RNA, 64 nt, Human
acccuagaccuuggaaccaguuuccugguagggaacugcugacaguuucaaugcugacaguugg

SEQ ID NO: 21027 - RNA, 64 nt, Human
uugugacugaucaugauuuauuugaagauggagcacugcugauuuaugaaggaaaaaagaagaa

SEQ ID NO: 21028 - RNA, 64 nt, Human
aagguggaagccuaaagaaaucucaccgaaacuuacugcugaaugauuacauucucccuuaagc

SEQ ID NO: 21029 - RNA, 64 nt, Human
gaaccuuaaaauguucccagcaggcuggucucaaacugcugacuucaggugauccacccgccuc

SEQ ID NO: 21030 - RNA, 64 nt, Human
uaaaauuuuggcauauuuccugcugauuuuuucuacugcugauuuuugcacaggugagauaauu

SEQ ID NO: 21031 - RNA, 64 nt, Human
guguaaaccaaaugcuauuuuucaaugcauuuggacugcugaccauuuaaaagcagccuaugau

SEQ ID NO: 21032 - RNA, 64 nt, Human
acguggaguuccucuaaccgugggccccagcagaacugcugagcuuuacaugguauccaugaca

SEQ ID NO: 21033 - RNA, 64 nt, Human
cagaacugcugagcuuuacaugguauccaugacaacugcugauuccagugucgaggccauuucu

SEQ ID NO: 21034 - RNA, 64 nt, Human
cuguuccgcaguuacugguacaugaacaguuggaacugcugacuuuccuaaccaaaacaacuuc

SEQ ID NO: 21035 - RNA, 64 nt, Human
uguuuuuuuaaaaugaagggacaaagucaacuggacugcugagugagagggcaggggcaguuga

SEQ ID NO: 21036 - RNA, 64 nt, Human
uccaaucauucagaaauaaaagauucagcuaaaaacugcugaaucaauaauuugucuuggggca

SEQ ID NO: 21037 - RNA, 64 nt, Human
uuguaaucugaauaauuucucaggauauuuuugcacugcugagaagcagugccauuaccaauua

SEQ ID NO: 21038 - RNA, 64 nt, Human
cagcgagcagguucucauugauaacaagcuccauacugcugagauacagggaaauggagggggg

SEQ ID NO: 21039 - RNA, 64 nt, Human
caucuguggcauuuauguagaguugcaguuguguacugcugaaaaugcaggcuuuuguaacagu

SEQ ID NO: 21040 - RNA, 64 nt, Human
aacagaccugugugugccuccagcauuuaaaaggacugcugauuuguuuacuacagcaaggcuu

SEQ ID NO: 21041 - RNA, 64 nt, Human
ucaggugaacacuuagugaucauuuaaaaagcucacugcugaucguagaaaauuugcuuuaauu

SEQ ID NO: 21042 - RNA, 64 nt, Human
gcagaacccugggguuuugggauucuguguggugacugcugaggaagguuuauggauuugacag

SEQ ID NO: 21043 - RNA, 64 nt, Human
aaagaagggcaaaaauaaucucacagagcuuggaacugcugauagcccuuacugagggcaaaag

SEQ ID NO: 21044 - RNA, 64 nt, Human
gaaaauaccaguuuugcucucugugggacaaagcacugcugaugaaguccccgugggcucaucc

SEQ ID NO: 21045 - RNA, 64 nt, Human
aggaaaugcugaccuuuuacauaaaaucaaggagacugcugaaaaucucuaagggacaggauuu

SEQ ID NO: 21046 - RNA, 64 nt, Human
cuuagauuuaauugcauuuuccauagguucaacuacugcugaaagucuggauuucagaauaaag

SEQ ID NO: 21047 - RNA, 64 nt, Human
uugccuccuggaucuucuuucccgucaucaaaugacugcugaacaggaaaccucuuuggugcug

SEQ ID NO: 21048 - RNA, 64 nt, Human
gaagcuuuggguucugacugacccacccuacaggacugcugaacagagagcccagugugacuag

SEQ ID NO: 21049 - RNA, 64 nt, Human
gucccaucucuucacaggcauggauucuaaucccacugcugacagagauguaaaaauucauccu

SEQ ID NO: 21050 - RNA, 64 nt, Human
cuggguuuguggagaaucagagcaucuugacaugacugcugaccuaaagaucccuggcauuggc

SEQ ID NO: 21051 - RNA, 64 nt, Human
cugcugaaaccaacagguuuuacuggucaaaaugacugcugaaaauaauuuucaaguugaaaga

SEQ ID NO: 21052 - RNA, 64 nt, Human
ccuaaguccggagcguuugagcguuugcuaucugacugcugaucugcgugacagaaacaccagc

SEQ ID NO: 21053 - RNA, 64 nt, Human
caggugcuggugaggacccugaucuggguugcagacugcugacuucuuauuguguccucguggu

SEQ ID NO: 21054 - RNA, 64 nt, Human
cuguagaccagccgcaugcacuugccccacauucacugcugacuggcuucacuggaauagguuc

SEQ ID NO: 21055 - RNA, 64 nt, Human
uguaaauucuuuuuaaagaauaauaauguuaccaacugcugagauuuuuauguauuuugugacu

SEQ ID NO: 21056 - RNA, 64 nt, Human
uugaagagccuauuuaguuccauaaaauuggagaacugcugaaggucaguaauuccgacuuucu

SEQ ID NO: 21057 - RNA, 64 nt, Human
ucuaaauccuuguuaagcaacguuaguagaacuuacugcugaccuuuuuaucuugaguguuaug

SEQ ID NO: 21058 - RNA, 64 nt, Human
gucuggggaggagagagacuggaaacguuccuggacugcugaagaggagacccaguuggcuuca

SEQ ID NO: 21059 - RNA, 64 nt, Human
uuuuguccauggaauauuugacagaugaaguaggacugcugagaagauucugauaacagaaaca

SEQ ID NO: 21060 - RNA, 64 nt, Human
aaucuuaaauguuuuaccaagugcugucuugaugacugcugauuuucuggaauggaaaauuaag

SEQ ID NO: 21061 - RNA, 64 nt, Human
auauuuucuaauacugaaagauuuucuaaaugucacugcugacauaacucccuuggucuucaau

SEQ ID NO: 21062 - RNA, 64 nt, Human
uuuuagccuucccacaacaguuaagcacucuuugacugcugaaggaaccccauggaugaggugc

SEQ ID NO: 21063 - RNA, 64 nt, Human
augguccuugggagcucugcucugagcuugccacacugcugagagcacccacuguccugaccag

SEQ ID NO: 21064 - RNA, 64 nt, Human
gaccucagcugaugcgccugccuuggccucccaaacugcugagauuacagaugugagccaccgc

SEQ ID NO: 21065 - RNA, 64 nt, Human
uggaagcugugacuggaauaaacccccgcguggcacugcugaguccucucuggcugggaagggg

SEQ ID NO: 21066 - RNA, 64 nt, Human
ucuagaaaaucuaaaguucagaagagaauguaucacugcugacuuuuauuccaauauuuggaug

SEQ ID NO: 21067 - RNA, 64 nt, Human
caggggaagaaacgacagccucacuucuguauggacugcugauguggccugccauccuguucag

SEQ ID NO: 21068 - RNA, 64 nt, Human
ggacacagaugguccauacgcugagccacgugaaacugcugauguuuuguuuagaugcacacac

SEQ ID NO: 21069 - RNA, 64 nt, Human
agcagaaaaggagguucccucucucugcuccuucacugcugacccagaggggcugcaggauggu

SEQ ID NO: 21070 - RNA, 64 nt, Human
cauaacugaaaaccaaguuuaagcccaccaaugcacugcugaugcaugccauauaauuaauggg

SEQ ID NO: 21071 - RNA, 64 nt, Human
acauuucugcuuuuuucuagucauucaauuuaucacugcugaauugcaucagaucauggaugca

SEQ ID NO: 21072 - RNA, 64 nt, Human
ugaaaaaaagaaggaaaaaagaauaagaaugaaaacugcugacguauuacaaaacagaaaaaua

SEQ ID NO: 21073 - RNA, 64 nt, Human
uugcuuuuguacaaagagaccugcuuaaacaaguacugcugagauaagugucugaucaagcuac

SEQ ID NO: 21074 - RNA, 64 nt, Human
uucacaacugggcaagaaaacaucauugguaagaacugcugagugugcccuuagaaagcccuag

SEQ ID NO: 21075 - RNA, 64 nt, Human
gagcugggguuugaauaggaaccagaugauguucacugcugaaauuccauaaugcuucccauug

SEQ ID NO: 21076 - RNA, 64 nt, Human
cuaauuacuugaaggauuuagauagaguauuugcacugcugaagagucacuaugagcaaaauaa

SEQ ID NO: 21077 - RNA, 64 nt, Human
ggauuucuuuuucucuucuuucugcucuuccuccacugcugaacuggucccuaacugaaacagc

SEQ ID NO: 21078 - RNA, 64 nt, Human
uuuaauuaaccuuaguaacaucucaugaccacugacugcugaaaguucugaaaagaauuuuugu

SEQ ID NO: 21079 - RNA, 51 nt, Human
uccuacagaaauauugcugacacugcugaagccaguugcuucuucagcuga

SEQ ID NO: 21080 - RNA, 64 nt, Human
cuccacugacugucgggcuuuaaaaagggaagaaacugcugagcuugcugugcuucaaacuacu

SEQ ID NO: 21081 - RNA, 60 nt, Human
aaaugauggacacuguauaauuugguuaagacugcugaggccaagugcuauuuuguuaca

SEQ ID NO: 21082 - RNA, 64 nt, Human
ggugguguuggaggccccaugaagagcgcccuggacugcugagggugggccaacagcccagagc

SEQ ID NO: 21083 - RNA, 64 nt, Human
aaaugauuucauugauucaugauggauggcagaaacugcugagaccuauuucccuuucuugggg

SEQ ID NO: 21084 - RNA, 64 nt, Human
gauggugugucuggacuuaacucacguaguaaauacugcugaucaauaccuaaucauuccacau

SEQ ID NO: 21085 - RNA, 64 nt, Human
ugccccguugacaguguuuaaauuccagacuaggacugcugaucugcacaauuuaauuaugugg

SEQ ID NO: 21086 - RNA, 64 nt, Human
guuccucagguggggcccagagcccuuccccgagacugcugaugucuguaaccacuggggagca

SEQ ID NO: 21087 - RNA, 64 nt, Human
ccuuggacaacauuuaucauaauuugucauaaccacugcugaguggccuugaggacgaaccccg

SEQ ID NO: 21088 - RNA, 64 nt, Human
ggaugugggagggcccuggacauggcccggccccacugcugagugcccguguccccacagcccc

SEQ ID NO: 21089 - RNA, 64 nt, Human
aguccuugauuuaguuuuuuaguauuguaaagauacugcugaccugugcuucauuucuaacugu

SEQ ID NO: 21090 - RNA, 64 nt, Human
uugagaaguuuguaaugguuuucauuugaaauagacugcugaaaguuuuaaauuuuuauaagca

SEQ ID NO: 21091 - RNA, 64 nt, Human
ugguggggaggggaaacagaaauaaaauuuuugcacugcugaacugugagauuuuccuguguaa

SEQ ID NO: 21092 - RNA, 64 nt, Human
uuuaaaacaauaucggcuccucauccaaagaacaacugcugauugaaacaccucauuagcugag

SEQ ID NO: 21093 - RNA, 64 nt, Human
auauuuuuuaaauuuacagaauauuauauaacccacugcugaaaaagaaaaaaaugauuguuuu

SEQ ID NO: 21094 - RNA, 64 nt, Human
uggggcuugguuucccugcccugggcucaguggcacugcugagcugcagcaguccuagaguuuu

SEQ ID NO: 21095 - RNA, 64 nt, Human
gacggccaugggcacgccuggccacgcuuuaccgacugcugacccccugggccaggugagguug

SEQ ID NO: 21096 - RNA, 64 nt, Human
ugccgcuuuugcaguggcucgcacugcuguggccacugcugaccacugaggcucccagcggagg

SEQ ID NO: 21097 - RNA, 64 nt, Human
gugccagcccccgcccgcccgugucccagaaugcacugcugaggagcaugcccacccccacccc

SEQ ID NO: 21098 - RNA, 64 nt, Human
ugugguggggacgccucucagugccagucccgccacugcugagugagccugguguucuugccuu

SEQ ID NO: 21099 - RNA, 64 nt, Human
guuugaaagcguuaagcugauaauguaauuaacaacugcugagagaucaaagauucaacuugcc

SEQ ID NO: 21100 - RNA, 64 nt, Human
uaguuaugccuuggguucuaaaauguuauaggaaacugcugaauugaauccuagcuuuuagaau

SEQ ID NO: 21101 - RNA, 64 nt, Human
uuugcuucuuuuccagauggaccuagaugaagacacugcugaaaaauuuuaucaaaaguuacug

SEQ ID NO: 21102 - RNA, 64 nt, Human
gauucugguccauucagugggcacaggucacagcacugcugaacaauguggccugggugggguu

SEQ ID NO: 21103 - RNA, 64 nt, Human
uuguauugaccaccacauaugcuaauaccuaucuacugcugaguugucaguauguuaucacuag

SEQ ID NO: 21104 - RNA, 64 nt, Human
gaccagcaugccuugcugcacguguguguauuucacugcugagaacauccuuuaacuuggugug

SEQ ID NO: 21105 - RNA, 64 nt, Human
cuguuagcaguuuacuguauuagucuguuuucacacugcugauaaagacauuccucaagauugu

SEQ ID NO: 21106 - RNA, 64 nt, Human
cgccauccucaccagcugcaugccugggcugcacacugcugaacgugcuccucucuccuucucu

SEQ ID NO: 21107 - RNA, 64 nt, Human
accugggagccuuuggaagcuuagaguccuuugaacugcugagucacuucuaggugggauuuuu

SEQ ID NO: 21108 - RNA, 64 nt, Human
auugucugcgugguuccuuucucagccgcuucugacugcugauucucccguucacguugccuaa

SEQ ID NO: 21109 - RNA, 64 nt, Human
cugcaauaaauuauggcucuucaccugggcgccaacugcugaucaaugaaaugcuuguugaauc

SEQ ID NO: 21110 - RNA, 64 nt, Human
auuauuuuggcacacuuucauguagguucuguucacugcugaaauauucuaaauaaaaugguuu

SEQ ID NO: 21111 - RNA, 64 nt, Human
gugccaucccugaacacggcuggccacuggguauacugcugacaaccgcaacaacaaaaacaca

SEQ ID NO: 21112 - RNA, 64 nt, Human
uguucaagugcuuggauuuccgucuguagauuuaacugcugaaauuguaucucucaguaauuuu

SEQ ID NO: 21113 - RNA, 64 nt, Human
ccuacagagcagcaagaguaggccaagcagaaagacugcugagguaacacggaccccagccccu

SEQ ID NO: 21114 - RNA, 64 nt, Human
aacacuggcgagcaggugccccagcucggacuauacugcugaguucuggucuguugcugccacu

SEQ ID NO: 21115 - RNA, 64 nt, Human
ugcauggacaucuacccagauaaacaaauuguugacugcugaauuaaugugauuuuggucucua

SEQ ID NO: 21116 - RNA, 64 nt, Human
uucuuuaaaauguaaagccaugcuggaaaauaauacugcugagauacauacagaauuacuguaa

SEQ ID NO: 21117 - RNA, 64 nt, Human
ccaccaggaaggcgcaucuuagcagaugggaggaacugcugagagaagaugggcagaaagcugg

SEQ ID NO: 21118 - RNA, 64 nt, Human
ugcacagugagcucugcggaaggggucaggcucaacugcugaugugucucacacguagcagaca

SEQ ID NO: 21119 - RNA, 52 nt, Human
uuccuucaacuuccuggugaaaacugcugacuuaauuugcuuuuguuugcuu

SEQ ID NO: 21120 - RNA, 64 nt, Human
cugaguugaaucauggcuaucauuagccacagguacugcugauuauaaggccaguaaaauuuua

SEQ ID NO: 21121 - RNA, 64 nt, Human
uaaaugguaucauuuggaaaucagcaucgugggcacugcugaggaaugauccuagugguagguc

SEQ ID NO: 21122 - RNA, 64 nt, Human
ugauuccgagagggugugguggcacugccagccgacugcugacagcuugggagcugcugugccc

SEQ ID NO: 21123 - RNA, 64 nt, Human
uggggccccucccaguucccccgccccaggaaacacugcugaccuuugcaaaggcugccgagcu

SEQ ID NO: 21124 - RNA, 64 nt, Human
ugggcguuaggggcaggcagagggccuuugcuacacugcugacagcuauagggagccccaggua

SEQ ID NO: 21125 - RNA, 64 nt, Human
agaacacacacacuuacuuuuucuggucucuaccacugcugauauuuucucuaggaaauauacu

SEQ ID NO: 21126 - RNA, 64 nt, Human
ccuuuugugcugccaaauugguuuugcuagaacgacugcugaaggggaaauauuuaaacuugca

SEQ ID NO: 21127 - RNA, 64 nt, Human
gcuuuuuguuaguauuuuuuguuuuuguuccuuaacugcugagccucagccagcguggguccug

SEQ ID NO: 21128 - RNA, 64 nt, Human
uuaagauuucauauauauauauuuuuuugcauugacugcugagagcuccuguuuacuaagcaag

SEQ ID NO: 21129 - RNA, 64 nt, Human
cauggggaaguucuucagacccagugguccugugacugcugaggaccaagguggcauccuaggg

SEQ ID NO: 21130 - RNA, 64 nt, Human
ucuguggggcagcugcugccuuacagcccuuccuacugcugagcaucccuaagggagaccuaaa

SEQ ID NO: 21131 - RNA, 64 nt, Human
aagggcaccauccucucuuuccuccccagggucuacugcugauuucuagauggaucaugcagcu

SEQ ID NO: 21132 - RNA, 64 nt, Human
aagaauugcacguaugagaaaccuauauuucaauacugcugaaacagacaugaaauaaagaauu

SEQ ID NO: 21133 - RNA, 64 nt, Human
acuucuccaaccccggaaaacauugcuuuugaaaacugcugauaaaauaugagccgguuauuac

SEQ ID NO: 21134 - RNA, 64 nt, Human
ucucccaacauaacaaucgugguaacagaaugcgacugcugauuuaccgauguauuuaauguaa

SEQ ID NO: 21135 - RNA, 64 nt, Human
gguccacacuguguaaacaugcaucugauaagauacugcugauauucuaaacaaguugaaauaa

SEQ ID NO: 21136 - RNA, 63 nt, Human
aaucccuuccugaguaauaaagauacaaaauguuacugcugauaauugugauuuguugagcca

SEQ ID NO: 21137 - RNA, 64 nt, Human
gaaucggauuaacuggaaaauauaucugaauucaacugcugacuauaaaugguauucuaauaaa

SEQ ID NO: 21138 - RNA, 64 nt, Human
ggagauaaucaucugaaaguuauagggcacugccacugcugaaucagagcaugcccaauauuug

SEQ ID NO: 21139 - RNA, 64 nt, Human
cacaaaacgcucacggaccuugaacgaggagagcacugcugaucagacuaggccccacucagcc

SEQ ID NO: 21140 - RNA, 64 nt, Human
gaggccacagacugagcuggcccagagggguggaacugcugaugggauuuccuucauucccuuc

SEQ ID NO: 21141 - RNA, 64 nt, Human
cccaaacccucuugggaacuccucagggacaacuacugcugaguuugggugcacccuaagaugg

SEQ ID NO: 21142 - RNA, 64 nt, Human
uacaguguuguacagaauuuaucauggauuauugacugcugagaaagggacaguggaauuuagc

SEQ ID NO: 21143 - RNA, 64 nt, Human
cugaauauccuucuucauaaaucauggaaaacucacugcugagauaguaaaccaugaaaucgcc

SEQ ID NO: 21144 - RNA, 64 nt, Human
aagugcuugguuuaggaauugugauuauuauaaaacugcugaugaaaaaaaugcaugucuuuga

SEQ ID NO: 21145 - RNA, 64 nt, Human
acuugacaagggugcccaggacaggaagacguguacugcugaguguuccuucuugcccuuuuca

SEQ ID NO: 21146 - RNA, 64 nt, Human
acgugucaagacuuuuaacccgacagccccaagcacugcugaguaaagucaucagaugaguagu

SEQ ID NO: 21147 - RNA, 64 nt, Human
cagccggcugcaaguuuuguaagcgcggacagacacugcugaaccuuuccucugggacccccug

SEQ ID NO: 21148 - RNA, 64 nt, Human
aaaagaaaaaggggcugcuuuccaaaggcaagaaacugcugaaaaagcugggugcagugaaaug

SEQ ID NO: 21149 - RNA, 64 nt, Human
uuuacuagaagguugcuuuuaugagcauauuuauacugcugaaggaugaguguuaauuuuaauu

SEQ ID NO: 21150 - RNA, 64 nt, Human
gaggcugaauaaagccuuugaugcacaaaaugggacugcugaagaguggacaguuggaccuuac

SEQ ID NO: 21151 - RNA, 64 nt, Human
gaacaucugaagugcccacaaguauguucuuuccacugcugauuucuuuuucagagauaacaau

SEQ ID NO: 21152 - RNA, 64 nt, Human
uuauucuuaauuucugauauuaacaaccguacauacugcugaauuuaacucaaaauauuucagg

SEQ ID NO: 21153 - RNA, 64 nt, Human
cauguauaguauacucuugccuuccuaaauuaugacugcugaaucaucauaucuacuauauaug

SEQ ID NO: 21154 - RNA, 64 nt, Human
caguguguggcaguucucgcagauguuaccuaaaacugcugaacuugaccggcagaauguucug

SEQ ID NO: 21155 - RNA, 64 nt, Human
auauacuguggaaggggggagaaucccauaacuaacugcugaggagggaccugcuuuggggagu

SEQ ID NO: 21156 - RNA, 64 nt, Human
cugguuacaauuuacaguguacuuuguuaaaaacacugcugaggcuucauaaucauggcucuua

SEQ ID NO: 21157 - RNA, 64 nt, Human
auucaacaauaaugcaacuuuagaaguauuccacacugcugagaaauguugcuuugaguuugcu

SEQ ID NO: 21158 - RNA, 64 nt, Human
gcugaggaaucuaauucagacagagacuuuaaucacugcugaagaugccccugcucccucuggg

SEQ ID NO: 21159 - RNA, 64 nt, Human
acacauuucauuauuugccaauggugcaauaaccacugcugaccaacccacuaugugugaacuc

SEQ ID NO: 21160 - RNA, 64 nt, Human
ugaauggcaucugaguauuacggcauccagagccacugcugacucccacuugcacgccaccauu

SEQ ID NO: 21161 - RNA, 64 nt, Human
caguaaaagaugaugaaagccacuaucaauccucacugcugaguggcagggagaagcagcacca

SEQ ID NO: 21162 - RNA, 64 nt, Human
gcauccugcuuuagccugagacuugccauaagaaacugcugaguacuuggcaaacccuuucaua

SEQ ID NO: 21163 - RNA, 64 nt, Human
aagauggcgacaaaagugaucucugguuguccucacugcugauuauucacuaauuauaaaauua

SEQ ID NO: 21164 - RNA, 64 nt, Human
uuucccccgcuuguuuugggugcacaggagccccacugcugaugacgaacuaucucuaacuggu

SEQ ID NO: 21165 - RNA, 64 nt, Human
uaugggauucccagaaaaccugccuaacggugccacugcugacaauggugaugauggauuaauu

SEQ ID NO: 21166 - RNA, 64 nt, Human
caucauuuuugauagaauuggugaauguuccuaaacugcugaagcuacauguuuuuuguuuugu

SEQ ID NO: 21167 - RNA, 64 nt, Human
aaguuuagccuuuuaagaaaaacaguaagcgaugacugcugaaaggcucauuguguaaucuccc

SEQ ID NO: 21168 - RNA, 64 nt, Human
acaacgcugcuuagauauggaguggaggugauuuacugcugaauuaaaacucaagugacacaag

SEQ ID NO: 21169 - RNA, 64 nt, Human
ccuugguagaguuuauuuuuuugauggcuaagauacugcugaugcugaaauaaacuaggguuuu

SEQ ID NO: 21170 - RNA, 64 nt, Human
ggggacaggcccgcuugcuggguaccugguccccacugcugagcuggcccuuggggagagguga

SEQ ID NO: 21171 - RNA, 64 nt, Human
gugacauuuucuaaaugccucccuuaaaaaaaaaacugcugaaaaucugugcuauuuugaaauu

SEQ ID NO: 21172 - RNA, 64 nt, Human
augacuucgcuuuguuccucgugccucugaacagacugcugagauacccaaucaagagccaauc

SEQ ID NO: 21173 - RNA, 64 nt, Human
ucucgccuacaucccgaaucauugcaguggcaagacugcugaccuugacuucuuccgucgagug

SEQ ID NO: 21174 - RNA, 64 nt, Human
ggauccacucccccagcuccuuuagagaauggcuacugcugaguccuuugggguugagggagau

SEQ ID NO: 21175 - RNA, 64 nt, Human
ucuccacgccggccccgcucuacggaggccuggcacugcugaccaccggagccuucgcgcucuu

SEQ ID NO: 21176 - RNA, 64 nt, Human
gcacaauacuuguggcccacaaaauuucacaaugacugcugaggaaucauucuuuuugccugua

SEQ ID NO: 21177 - RNA, 64 nt, Human
ucucauguccuuugucuuccuucuguagccauuaacugcugaauccaugugaggaagacaggcu

SEQ ID NO: 21178 - RNA, 64 nt, Human
cgggagaaugggccuccacccucagccagcccucacugcugacaggcaccccucugucaccucc

SEQ ID NO: 21179 - RNA, 64 nt, Human
cuggagcagaguucucugaauaccccaucccccaacugcugauuuuacagccccagggaagaca

SEQ ID NO: 21180 - RNA, 64 nt, Human
uacugaaagacuuuugcuuaaaguggcauuauugacugcugaugugaugcuacuguaaugcaau

SEQ ID NO: 21181 - RNA, 64 nt, Human
cuguugcgacugacucaaaaaguuaaauguugccacugcugaagaugauuaugagcaucgcaaa

SEQ ID NO: 21182 - RNA, 64 nt, Human
gaugagaaaacugcucuuuuuccaaaaauuaccaacugcugauuacagcugaaauggaaccaaa

SEQ ID NO: 21183 - RNA, 64 nt, Human
ugcaccacuauaccugucucucugugugggggacacugcugaugauucccaagauugagaugau

SEQ ID NO: 21184 - RNA, 64 nt, Human
cccugagcuccaagauaagaauggccccgagagaacugcugaacauuuguucauugcugucacc

SEQ ID NO: 21185 - RNA, 64 nt, Human
cguguguccuggcacccuguccaagaaccuuucuacugcugagcuguggccaaggucaagccug

SEQ ID NO: 21186 - RNA, 64 nt, Human
uauauuucuuccaguauaauaaauuauugauaucacugcugacuuuuauauuaugggagggaaa

SEQ ID NO: 21187 - RNA, 64 nt, Human
aguaggauuugggcuccuaugauaaucuaaugccacugcugaucugacaggaggcagagcucag

SEQ ID NO: 21188 - RNA, 64 nt, Human
uccacugcuugggccugcuuucucagauagacugacugcugaggaggcucuagguucuuggaau

SEQ ID NO: 21189 - RNA, 64 nt, Human
uguacugaguuugauuuguuaauccuuucuauauacugcugaucuugcaugucuacaaucugcu

SEQ ID NO: 21190 - RNA, 64 nt, Human
uuaauuacaugaaaaugcucuaguguugugaugcacugcugauguuuccaauucagguacaagu

SEQ ID NO: 21191 - RNA, 64 nt, Human
aacccuacauauuucugaucaugugcugccuuuuacugcugaauuaaaacagauauuucacgaa

SEQ ID NO: 21192 - RNA, 64 nt, Human
ccuuuuguguuuuuauagucuauagcauuuuaaaacugcugauguuguuugcauuauuuacagg

SEQ ID NO: 21193 - RNA, 64 nt, Human
aggaacucugaagagcaaaaagggacaaacacuaacugcugagcugggccauuugaucuccuuu

SEQ ID NO: 21194 - RNA, 64 nt, Human
aacgggcugugugagaaaacggcccugacuguaaacugcugaaggucccugacuccuaagagaa

SEQ ID NO: 21195 - RNA, 64 nt, Human
ggcaggcccugggcacccugucuccccuggucucacugcugaccugggcuggucccagccugga

SEQ ID NO: 21196 - RNA, 64 nt, Human
caggcuggcaggcaucucggcuugcaggaggccaacugcugagaccucuucuccaucccccuua

SEQ ID NO: 21197 - RNA, 64 nt, Human
uguacaauuaugucucuugagcaucaaucuuguuacugcugauucuuguaaaucuuuuugcuuc

SEQ ID NO: 21198 - RNA, 64 nt, Human
gaagagaacugcugaggaggauuuuccuaaaguuacugcugaccuugaagcauuguuaaagacu

SEQ ID NO: 21199 - RNA, 64 nt, Human
ccaacuguaccacgggcaugaggagcugaagagaacugcugaggaggauuuuccuaaaguuacu

SEQ ID NO: 21200 - RNA, 64 nt, Human
uacucuguaccccauccgaaucagggcuucuaccacugcugaugcaaaaccacaaagggaccua

SEQ ID NO: 21201 - RNA, 64 nt, Human
agaugaaagaucucuacaacaaaaauuacaaaacacugcugaaagaaaucagagaugacacaaa

SEQ ID NO: 21202 - RNA, 64 nt, Human
ugcgugcuguaagcugggaccagcuuuguccauaacugcugagagaacuugcugaagcucuagg

SEQ ID NO: 21203 - RNA, 64 nt, Human
uagcuuccucccuugaaaaaaaauguaaacuaugacugcugagugauaaaacacugugguguga

SEQ ID NO: 21204 - RNA, 64 nt, Human
uauguuauuguggaaagaugaaugcaauaguaggacugcugacauuuugcagaaaauacauuuu

SEQ ID NO: 21205 - RNA, 64 nt, Human
uuuagcuucugguacuacauguaucuauccacacacugcugaagggaacuugacccuacgcauu

SEQ ID NO: 21206 - RNA, 64 nt, Human
ugggcccccuucugcucccugcccccucccugcuacugcugaugcacucuccucucccugcagc

SEQ ID NO: 21207 - RNA, 64 nt, Human
uacauccucaugcagccgugaucaagggaauguaacugcugaaaacuagcucgugauuggcaua

SEQ ID NO: 21208 - RNA, 64 nt, Human
acagacggcagggaagguggacacaguaugaacuacugcugaugucucuguuggggaucagagg

SEQ ID NO: 21209 - RNA, 64 nt, Human
cugcagcguuggaaggugcagaggauaaggaggcacugcugauugaagacacacucagcaacca

SEQ ID NO: 21210 - RNA, 64 nt, Human
cccaaguucaaggcccuauuugcaccugagcuucacugcugaggaguggccaguuggguccuug

SEQ ID NO: 21211 - RNA, 64 nt, Human
uugaaccaguucuuccacuuacugacuuguuaccacugcugacuuucugaaaaguuuuccaguu

SEQ ID NO: 21212 - RNA, 58 nt, Human
aaaucauaagugaagaguaauuuaucuaacugcugaaaggugaccaaagaaaugcaca

SEQ ID NO: 21213 - RNA, 64 nt, Human
auuugcauuuuagggugauuugggggcagaaauaacugcugaugguagcuggcuuuugaaaucc

SEQ ID NO: 21214 - RNA, 64 nt, Human
acccucuucccaggccucaggagugaccauagccacugcugaaaagucacgcagcugcucccuc

SEQ ID NO: 21215 - RNA, 64 nt, Human
caggaagugguggggcaccggucucccccacccgacugcugaucugcaugggaaacacccugac

SEQ ID NO: 21216 - RNA, 64 nt, Human
ucugcuuuauugcuucucauaccugcccugcuugacugcugaagcagaaacaaucaggcacgcu

SEQ ID NO: 21217 - RNA, 64 nt, Human
ggcucuuuucuuuggaucuuguuucuagcccucaacugcugaaagccucagaauuuagauuaau

SEQ ID NO: 21218 - RNA, 64 nt, Human
guuggcaagugggcugaugggguccgcccuccucacugcugagcuccucaccuggacagucucc

SEQ ID NO: 21219 - RNA, 64 nt, Human
uugugcugagugcuguacauguauuaguuccuuuacugcugaccacauuguacccauuucacag

SEQ ID NO: 21220 - RNA, 64 nt, Human
auuggguagaaaggacauucuuccaggaaaguugacugcugacugauugggaaagaaaauccug

SEQ ID NO: 21221 - RNA, 64 nt, Human
uccuccugccugccugaaggucucccaugaaaacacugcugaacuguguugacacucaugaccc

SEQ ID NO: 21222 - RNA, 64 nt, Human
cagcacaccucucauccgccccuccugcuccaucacugcugagccucuccccaucuagaauguu

SEQ ID NO: 21223 - RNA, 64 nt, Human
gacaucagccugcuucuuccccucugcggcuuucacugcugaguuucuguucucccugggaagc

SEQ ID NO: 21224 - RNA, 64 nt, Human
gguacuugaagaagccagagcccacauccugugcacugcugaaggacccuacgcucgguggccu

SEQ ID NO: 21225 - RNA, 64 nt, Human
ccagaauauaaaucucagguaauaaggcuuuagaacugcugauaaagcggaucguucucaggcc

SEQ ID NO: 21226 - RNA, 64 nt, Human
gacuuccugcuauccaagcccauggaggaaaguuacugcugaggacccacccaauggaaggauu

SEQ ID NO: 21227 - RNA, 64 nt, Human
uuaaugaagugcauagugcugcucccaggagaccacugcugacagauacacagagaagagauca

SEQ ID NO: 21228 - RNA, 64 nt, Human
uguaccacagcuuaacuggaagaggaagcccguaacugcugaugacaauacuuucagugucccc

SEQ ID NO: 21229 - RNA, 64 nt, Human
uucuuuccuuccaucugaggagcaaggaaauccuacugcugaauagcuguuaguaucuauuuua

SEQ ID NO: 21230 - RNA, 64 nt, Human
gggucugagaucagggugucgcggguggggggucacugcugaggccgugaggggaaucugcuca

SEQ ID NO: 21231 - RNA, 64 nt, Human
ccaggaagugagggcccagcucgucguaaucaaaacugcugaggagcagguacacguggugggg

SEQ ID NO: 21232 - RNA, 64 nt, Human
ugaagcagaaugguggaacuugugccggagguacacugcugaaggugcguggcgguggaccagc

SEQ ID NO: 21233 - RNA, 64 nt, Human
guuccgucugugucucucaauuaaccacucgucaacugcugauucuacugggcugugggcucag

SEQ ID NO: 21234 - RNA, 64 nt, Human
uguacuuaaucauauauucuaaauuuuauuauuuacugcugacaucaguuucugucggauugua

SEQ ID NO: 21235 - RNA, 64 nt, Human
acacccccagggaucugagcccugacccuuugugacugcugaccccugagccacccccacuccc

SEQ ID NO: 21236 - RNA, 64 nt, Human
uaggaauuaucuuuauuacuucccguuuauugccacugcugagaaggcuguccuuccuaacuug

SEQ ID NO: 21237 - RNA, 64 nt, Human
agagacaagauacgagugacaugguucuccucccacugcugacggaggaauuaacacaaaagca

SEQ ID NO: 21238 - RNA, 64 nt, Human
ugagagggugggagggcccagggagggcuuucguacugcugaauguuuuccagagcauauauua

SEQ ID NO: 21239 - RNA, 64 nt, Human
cauuucugcagccuccuggccucaccuuuauggaacugcugaucggugagcuugaaucccaccu

SEQ ID NO: 21240 - RNA, 64 nt, Human
ugggucuucagcucagugcuacucugaauacaauacugcugaccacauuuggcuacuucagcuu

SEQ ID NO: 21241 - RNA, 64 nt, Human
ucucauuuaacuccaaaaucaucucucucuuaggacugcugacuugguuaugcagucaaugaga

SEQ ID NO: 21242 - RNA, 64 nt, Human
aaagccagauuccagccugagugcuggcccaauuacugcugaguggcccuggacaaaguuguuu

SEQ ID NO: 21243 - RNA, 64 nt, Human
ugggccaccacaccacuggauauuccugggagucacugcugacaccaucucucccagcagucuu

SEQ ID NO: 21244 - RNA, 64 nt, Human
cgcagaccccacacucagcagaaggagacucaggacugcugaaggcacgggagcugcccccagu

SEQ ID NO: 21245 - RNA, 64 nt, Human
cgcagacuccacacucaguagaaggagacucaggacugcugaaggcacgggagcugcccccagu

SEQ ID NO: 21246 - RNA, 64 nt, Human
uucaguuucauauuguuucuguucucauaaggauacugcugagugucuuugcagauucagccua

SEQ ID NO: 21247 - RNA, 64 nt, Human
auccaacauugagcuucuggacuacgcugacuccacugcugaauccucaauggaaagggucgac

SEQ ID NO: 21248 - RNA, 64 nt, Human
gggagggaggacugugaauggcuguucuccccucacugcugagucucccaggacccccuuugga

SEQ ID NO: 21249 - RNA, 64 nt, Human
uugguugucuucagcugacaguaugaaaaaugaaacugcugaaaaagcugagcaccuggucacc

SEQ ID NO: 21250 - RNA, 64 nt, Human
gaggggccggccugcuggccuggggcgugcagacacugcugaguggagacagagcugcgggguc

SEQ ID NO: 21251 - RNA, 64 nt, Human
cccagugugcuauaguagaaaaugucuacuccucacugcugacauguuaaacuuacucuugguu

SEQ ID NO: 21252 - RNA, 64 nt, Human
uagcugccucaucaaaaacacugaauaaccaaggacugcugaguuuuucuucauggggggucag

SEQ ID NO: 21253 - RNA, 64 nt, Human
uccccaccacccuccuccugccuccugacccaggacugcugaauacaaagauguuaauuuuuaa

SEQ ID NO: 21254 - RNA, 64 nt, Human
cacugcauucugaccugcuguacagacugcccacacugcugaccugccuagcgagcaggacauc

SEQ ID NO: 21255 - RNA, 64 nt, Human
caacuucccacagccacauuucagaccugcugagacugcugagugaggaauggcagugagguuu

SEQ ID NO: 21256 - RNA, 64 nt, Human
cagaaugcaguuguuguacaacucauaaauacuaacugcugauuuugacacaugugugcuccaa

SEQ ID NO: 21257 - RNA, 64 nt, Human
ucauuuccccucccgucuuccuccuccccuggcaacugcugaucgacuuugugucucuguuguc

SEQ ID NO: 21258 - RNA, 64 nt, Human
uugcccuaagcauugccacauauucugucuagucacugcugauuuucuaugucuuugcuccaua

SEQ ID NO: 21259 - RNA, 64 nt, Human
gccuuucuccucuucucuucuugggacaggaauaacugcugagcagucccccuuugccacuccu

SEQ ID NO: 21260 - RNA, 64 nt, Human
cucagugggauaaguuugaaauucaaguguuugaacugcugauaauuuggauuuuuuuuuuuuu

SEQ ID NO: 21261 - RNA, 64 nt, Human
uguccuuccaccugugccagccacccccugccccacugcugaaugaaggccauuucaagcgcug

SEQ ID NO: 21262 - RNA, 64 nt, Human
uuuuuauauuuaaaccccgagauagugcuggaacacugcugagguuuuauacucagguuuuuug

SEQ ID NO: 21263 - RNA, 64 nt, Human
cuguucuguccucaaguacucaaauauuucugauacugcugagucagacugucagaaaaagcua

SEQ ID NO: 21264 - RNA, 64 nt, Human
aagcauauugcuugcuauuaaucgccaaaacaggacugcugaugaggaauguauuugcauaugu

SEQ ID NO: 21265 - RNA, 64 nt, Human
cagaggaccuuggguucccaauacaaaaauaccuacugcugagagggcugcugaccauuugguc

SEQ ID NO: 21266 - RNA, 64 nt, Human
gccucagaaggacccuguugaggguccucaguccacugcugaggacacucaguguccaguugca

SEQ ID NO: 21267 - RNA, 64 nt, Human
uugugugccagguccugugcuugggaccuguuuuacugcugaggcuucauucaguccugccccu

SEQ ID NO: 21268 - RNA, 64 nt, Human
augguuucaugagucacaagcaagcguucccccaacugcugagucugugggauuaaggggauua

SEQ ID NO: 21269 - RNA, 64 nt, Human
cugcucagccuggagguagggggcugucuuggucacugcugagacccacaggucuaagaggaga

SEQ ID NO: 21270 - RNA, 64 nt, Human
gugugauuucuugcaacuuuauuuuacauuuuaaacugcugauauuggauauaaugcugcuuuu

SEQ ID NO: 21271 - RNA, 64 nt, Human
auguuuuuucucucacccuggcuuugucaagucuacugcugaacccauugaaggcauucuucaa

SEQ ID NO: 21272 - RNA, 64 nt, Human
cugagcuucaccccuuggucagacagcugaacaaacugcugacuuucaguucuuacgauagucu

SEQ ID NO: 21273 - RNA, 64 nt, Human
uacauuuaagaauauuuugauuauauuaaacaagacugcugauuuugcuacuuuuuuuaagggg

SEQ ID NO: 21274 - RNA, 64 nt, Human
aucuuacagcuuuccccuuccauguuagcacuuuacugcugaauucucaauuuucuuaacauug

SEQ ID NO: 21275 - RNA, 64 nt, Human
cuauguuguuuuacacaccacugcauuaacuagaacugcugagaggacuguauauaugauuuua

SEQ ID NO: 21276 - RNA, 64 nt, Human
uauggguguuggugaacuugguuuuaauuagugaacugcugagagacagagcuauucuccaugu

SEQ ID NO: 21277 - RNA, 64 nt, Human
uuggccauuccuccuuggugggaaucauccagguacugcugaggucaccugcgauuugccccau

SEQ ID NO: 21278 - RNA, 64 nt, Human
aggaacaaagguuuguguauuaguccauuuucacacugcugagaaagacauacccaagacuggg

SEQ ID NO: 21279 - RNA, 64 nt, Human
cuuccucaagaaauuaaacauuuguuucugugugacugcugagcauccugaaauaccaagagca

SEQ ID NO: 21280 - RNA, 64 nt, Human
gcucuucugugguggaaucccaauuguuaaaguuacugcugaguggcccuuauuuuuuaaagua

SEQ ID NO: 21281 - RNA, 64 nt, Human
ucacaguuuccaacuuguaaguugaguagugcuaacugcugacuucucccuuuucuucacccca

SEQ ID NO: 21282 - RNA, 64 nt, Human
ugaaguuuacaagcaccucucuucagaaaacaauacugcugaccaucaagcaggucauaaacag

SEQ ID NO: 21283 - RNA, 64 nt, Human
caccccuguaauggauugguggcaacuggguggcacugcugaugugcacuguguaggggggaac

SEQ ID NO: 21284 - RNA, 64 nt, Human
auuuauuuacaccaagcccuucccauaaaacacaacugcugaagaaaauagcagacguuucccc

SEQ ID NO: 21285 - RNA, 64 nt, Human
ccugggacccucgaccccacccuucuuuccuaccagcccagagccuuguggcuuguacaguuuu

SEQ ID NO: 21286 - RNA, 64 nt, Human
uuuaagucaccagauauuuuguucccaucaguuuagcccagagauagacaguagaaugcaaaua

SEQ ID NO: 21287 - RNA, 64 nt, Human
cuccauucuuuggcauaacaggcaacucuaaccuagcccagaagaggauggcucauccugggug

SEQ ID NO: 21288 - RNA, 64 nt, Human
cuuuccaucguucagcauagacuuaacucccuuaagcccagacaucuguugagaccugaccccu

SEQ ID NO: 21289 - RNA, 64 nt, Human
gggagcuggaacccgaggggccggggaagcugccagcccagaacaccccuaaugagggugugag

SEQ ID NO: 21290 - RNA, 64 nt, Human
gcaagaaggaagcaguucuccacguucucaccuaagcccagagcaaggaacagguauaauaagu

SEQ ID NO: 21291 - RNA, 64 nt, Human
caugcgugucgguguauauaggaaccauguacagagcccagagaagcccccuacauccccccgg

SEQ ID NO: 21292 - RNA, 64 nt, Human
cauagugucuugguagcaccagccaguguuucccagcccagaguuuacugacuuguaauucucu

SEQ ID NO: 21293 - RNA, 64 nt, Human
ccuugacugcagaagaccaagaaccuguuccccaagcccagagauguccaccugggcuggacug

SEQ ID NO: 21294 - RNA, 64 nt, Human
aacuuuuuuuuagaagaaaaauuaaguacagaaaagcccagauuuaaauacauuuaauauguca

SEQ ID NO: 21295 - RNA, 64 nt, Human
uggucgucuaucccaguguguguuuaacauucacagcccagaaccacagaugugucugggagag

SEQ ID NO: 21296 - RNA, 64 nt, Human
cucaaccugcacacuugacaaguggagaaacagaagcccagagagagcacuggguuuguucagg

SEQ ID NO: 21297 - RNA, 64 nt, Human
ugggaagucucaccaagcuagauugucuaccaucagcccagaacucuguaacuuuucagaacug

SEQ ID NO: 21298 - RNA, 64 nt, Human
guucuaccucucauuuuacagaugagaaaaccgaagcccagaaaaacucucauuugcucaaagu

SEQ ID NO: 21299 - RNA, 64 nt, Human
cacucuagucacuaaagaaggauuuuacucucccagcccagaaaggugauucuuucuuuaccau

SEQ ID NO: 21300 - RNA, 64 nt, Human
cacucugccaugagaacaggacaccauccugcccagcccagacgggguugcuccugguccaaga

SEQ ID NO: 21301 - RNA, 64 nt, Human
aauauucauugcauuuauaagaucuucugcaaaaagcccagaaaugguccuuuucaggugccuc

SEQ ID NO: 21302 - RNA, 64 nt, Human
gcaacccccagcgcugcgcuagagaaacccgcccagcccagagcgggcccgccccgcugcggcu

SEQ ID NO: 21303 - RNA, 64 nt, Human
cuuuccuugggccauaccuucccugcagaucuccagcccagaaccaucuuccccuguuguccuc

SEQ ID NO: 21304 - RNA, 64 nt, Human
agaggagaggggaccagaccaucuccgcaaccacagcccagagcuccagucaccagauagaaaa

SEQ ID NO: 21305 - RNA, 64 nt, Human
gcuauucaggaggcugaggugggaggaucauuugagcccagagguagaggcugcagugagccau

SEQ ID NO: 21306 - RNA, 64 nt, Human
aacagcaacagagcaaacagauaggaggaggcaaagcccagaaaguggacagugauucaaguaa

SEQ ID NO: 21307 - RNA, 64 nt, Human
cugcacugagcacucaguggauaaacacuccuccagcccagacacacuccuccucuugggcagg

SEQ ID NO: 21308 - RNA, 64 nt, Human
ccccagaaacgaucaagaagggcaauggguugacagcccagauauggcaggaccagacugcaau

SEQ ID NO: 21309 - RNA, 62 nt, Human
cagagccucaugcuacaugaaauguaaaagggagcccagaaauggaggacauuucauucuuu

SEQ ID NO: 21310 - RNA, 64 nt, Human
cugccaacaacuccucccccagagaucuggcuggagcccagaaaaagaagcaugugguuuaaaa

SEQ ID NO: 21311 - RNA, 64 nt, Human
cauagacacacacucucugcugguaagaaaccauagcccagaacugagccaauaagguuguuug

SEQ ID NO: 21312 - RNA, 64 nt, Human
guccagagagggucugggauucccaaggucacacagcccagaagagauggggcuggguuaagaa

SEQ ID NO: 21313 - RNA, 64 nt, Human
aguacagggauuagaguugugagccaccgcugccagcccagaguuacccucuaaagauaagaaa

SEQ ID NO: 21314 - RNA, 64 nt, Human
accauuguaucucuuucucuucaguaugguuuagagcccagaucaguuaguaggcuuucguugu

SEQ ID NO: 21315 - RNA, 64 nt, Human
cgcucacagaccacacacccagcccuccugggccagcccagagggcccuucagaccccagcugu

SEQ ID NO: 21316 - RNA, 64 nt, Human
acauggaggacgaggcccagcucagcugggccagagcccagaagugccaccucaucauaauuca

SEQ ID NO: 21317 - RNA, 64 nt, Human
agacucuggaggucaucuggcggaggucucugggagcccagaacccacauaaaagccccagcuu

SEQ ID NO: 21318 - RNA, 64 nt, Human
aaucacuuggaccugggaggcagagguuucagugagcccagaucgcgacacugcacuccagccu

SEQ ID NO: 21319 - RNA, 64 nt, Human
ucuugaccuucagcuccuaugcaggcuucucuugagcccagagacaaggcagcuuggucuagug

SEQ ID NO: 21320 - RNA, 64 nt, Human
uucgguugcuuuggauuuuacaaaaaaaaaaaaaagcccagaaacuuucgaacaaaaccaaaca

SEQ ID NO: 21321 - RNA, 64 nt, Human
cgucugugcugccugguuugcauccggcucacagagcccagacugcuggaacagccaaggacug

SEQ ID NO: 21322 - RNA, 64 nt, Human
gcccuccuaauaccucauauuccccaucuuccucagcccagaaagcaauggggcuuuagugaug

SEQ ID NO: 21323 - RNA, 64 nt, Human
agggggaagggccugagaggaauguaaggaaaccagcccagaucagucccaaggccagaguccu

SEQ ID NO: 21324 - RNA, 64 nt, Human
ggugcaggcagaugaccuggugaagaugcucuucagcccagaagagauggaccucucccaggag

SEQ ID NO: 21325 - RNA, 64 nt, Human
ggaguaaccgcuccagguaccuugaccuuuguacagcccagaggccaacacuguggguguguga

SEQ ID NO: 21326 - RNA, 64 nt, Human
agcacugggaucacaggugucagccauugcacccagcccagauugucuuaauuucuaucuuguu

SEQ ID NO: 21327 - RNA, 64 nt, Human
uucucuguuugcccagaaucagcucuggauuuuaagcccagacuucaguggacccagauagaaa

SEQ ID NO: 21328 - RNA, 64 nt, Human
cuuuggggauuuuuguucggaguucuauacuaucagcccagaaagcuaucaauguccaagugaa

SEQ ID NO: 21329 - RNA, 64 nt, Human
aucaccacauauuuggaaucucuuccacgggaccagcccagagcuaugccauggaaaugauauu

SEQ ID NO: 21330 - RNA, 64 nt, Human
cccugacaaacuggccaccguccgaauaacagacagcccagaggagauagugcagaaauuccgc

SEQ ID NO: 21331 - RNA, 64 nt, Human
cuucuauuuggagaauaagauggaugcuuauugaagcccagacauucuugcagcuuggacugca

SEQ ID NO: 21332 - RNA, 64 nt, Human
ugaagauuugaaugaaacuauaguuccauuuggaagcccagacauaggaugggucagugggcau

SEQ ID NO: 21333 - RNA, 64 nt, Human
gagugucaguuucccaaguucugagguaacucucagcccagaugugaaaugggagccuaccagc

SEQ ID NO: 21334 - RNA, 64 nt, Human
gguucugccaucuugaaacccccauucuguuuccagcccagaagaaaugcugccccuaccagau

SEQ ID NO: 21335 - RNA, 64 nt, Human
gggagauggaucaagcucagagacuggcagugagagcccagaaggaccuguauaaaaugaaucu

SEQ ID NO: 21336 - RNA, 64 nt, Human
agcucucuggacaggaauuaacaaacgcuggagcagcccagaggaaauucgugugaaagaggag

SEQ ID NO: 21337 - RNA, 64 nt, Human
agggggcagaggccaggccccagugcugacgaggagcccagauuugggccuaaucaggugggga

SEQ ID NO: 21338 - RNA, 64 nt, Human
cgccuccccaagucagcaguccuagccccaaaccagcccagagcagggucucucuaaaggggac

SEQ ID NO: 21339 - RNA, 64 nt, Human
cuccccuacaccaacaaagaggaauggcugcaagagcccagaucacccauuccggguucacucc

SEQ ID NO: 21340 - RNA, 64 nt, Human
uuguuaucuaaaccuuuaaaccuaucuuccaggcagcccagagaagaucuguuucccugugucc

SEQ ID NO: 21341 - RNA, 64 nt, Human
auuccaacuccuauaccuuaccagagcauggaagagcccagaucugaauguaaaacgucucugu

SEQ ID NO: 21342 - RNA, 64 nt, Human
guccaggauagucuaagggagguguucccaucugagcccagagauaagggugucuuccuagaac

SEQ ID NO: 21343 - RNA, 64 nt, Human
uuccccuuuggcccuccucacuggccucugggcuagcccagagucccuuagcuuguaccucgua

SEQ ID NO: 21344 - RNA, 64 nt, Human
cucaagugccugauccugcccugggcucagagccagcccagagggaagcaacugcacagcccca

SEQ ID NO: 21345 - RNA, 64 nt, Human
cgccagccuagaacauccugcucugaaugaacagagcccagauggggguccagagcuaagugac

SEQ ID NO: 21346 - RNA, 64 nt, Human
agcacuaaggaugucaguguacgagacggugcgaagcccagaggaggcggcuugggauccucug

SEQ ID NO: 21347 - RNA, 64 nt, Human
cuggacuguguccugauggacgcagcaccaucaaagcccagaauuucugaaaacggugacaagg

SEQ ID NO: 21348 - RNA, 64 nt, Human
gccccuuccuugcucugcacccccauauggucauagcccagaucagcuccuaacccuuaucacc

SEQ ID NO: 21349 - RNA, 64 nt, Human
uuguuuugaacuuccuuucccacuugguagaaagagcccagaagcagcccuggcccuguaagau

SEQ ID NO: 21350 - RNA, 64 nt, Human
uucagcaggugugugggccuagaggagagagcagagcccagaaaugucuuuugcaggcccacgu

SEQ ID NO: 21351 - RNA, 64 nt, Human
ccgagugguggcagccaggagagcagcgcagaacagcccagaaaaggcggugcucagcacgggg

SEQ ID NO: 21352 - RNA, 64 nt, Human
ugacuaaccaggcagcuaagaagucuuaggcagcagcccagacauguauagaggggcaguuaga

SEQ ID NO: 21353 - RNA, 64 nt, Human
gccccacaugucccugcaggguuggcagggacagagcccagaccauggugccagccagggagcu

SEQ ID NO: 21354 - RNA, 64 nt, Human
uuccucucacuccugccuccgcuggcuuugggaaagcccagacuuuagugcccugcccccuggc

SEQ ID NO: 21355 - RNA, 64 nt, Human
uucaagucuauucaauucaaguuaacucuagcccagcccagaucaacuccuccuacaaauauua

SEQ ID NO: 21356 - RNA, 64 nt, Human
aauugaaaauuauaucaacuuaaaauuuuaagacagcccagaagacauuaaugacucucacuua

SEQ ID NO: 21357 - RNA, 64 nt, Human
aaaccauaaucucuuuucacuggggccaaacuggagcccagauggguuaauuuccagggucaga

SEQ ID NO: 21358 - RNA, 64 nt, Human
ucaggaaacaggcagaccagggccccgugggggcagcccagaccaguacccuuaccgaacccag

SEQ ID NO: 21359 - RNA, 64 nt, Human
ucuaggacugacuggguucuuccucccuccccgaagcccagacaguucaguugggcuggggguu

SEQ ID NO: 21360 - RNA, 64 nt, Human
agugaagcccucagugagcugccacugagucgggagcccagaggaacggcgugaagccacugga

SEQ ID NO: 21361 - RNA, 64 nt, Human
caccuucauguaaaccagcuuugcaaaauuuuccagcccagauacucuucaucuauucaaaugg

SEQ ID NO: 21362 - RNA, 64 nt, Human
ugcugcuuuguauccaaauguagugcaggugaaaagcccagaaggaaaauuucagaagaccagu

SEQ ID NO: 21363 - RNA, 64 nt, Human
gcacauuguugucacccacccuccugcccuucucagcccagaugccaugccccugggcgggcag

SEQ ID NO: 21364 - RNA, 52 nt, Human
ccuuccugccaguggucugaagagcccagaggaggaguuuggccagguggac

SEQ ID NO: 21365 - RNA, 64 nt, Human
gccaggcugguaaauuuaggauauuacaauggccagcccagauggcucccugggcuggcauggg

SEQ ID NO: 21366 - RNA, 64 nt, Human
caucagaaaagggaaagccacggaaugugugugaagcccagaaauggcauuugcaguuaauuag

SEQ ID NO: 21367 - RNA, 64 nt, Human
ucuuccccgcccguuuuacaaagggggaggcuaaagcccagagacagcuugaucaaaggcacac

SEQ ID NO: 21368 - RNA, 64 nt, Human
auuaggugugcuguccccuguagccucgugagucagcccagaggaggguacaugcgacuguggc

SEQ ID NO: 21369 - RNA, 64 nt, Human
uuauuagaccuggggcuaaccaggugaagaucugagcccagaaaugacccuuccuccaccacac

SEQ ID NO: 21370 - RNA, 64 nt, Human
ugauucugacaaaaaguccagaacccauaaacauagcccagagaagagaggcucugaaagaaag

SEQ ID NO: 21371 - RNA, 64 nt, Human
guuagaaugagccuuaccaauaauaagagcccugagcccagaaaaaaggacuguauaguuuaaa

SEQ ID NO: 21372 - RNA, 64 nt, Human
gaggauggaauucuguccacaaaauaauuuugugagcccagauaucauuaggaucacacagagu

SEQ ID NO: 21373 - RNA, 64 nt, Human
cuuuccccucccugguggccacucuuugcucugaagcccagauuggcaagaggagcugguccau

SEQ ID NO: 21374 - RNA, 64 nt, Human
guacuuuggaaagccaagguaagaggauugcuugagcccagaacuucaagaugagccugggcuc

SEQ ID NO: 21375 - RNA, 64 nt, Human
acuucauagagucaacuguuucaucaucauagugagcccagagagccacugcccagcagcaugc

SEQ ID NO: 21376 - RNA, 64 nt, Human
uuuaccacugaaguagaauugauuguucagcuggagcccagagaauuuaauuuaauguuuuuuc

SEQ ID NO: 21377 - RNA, 64 nt, Human
agugcauauuaauucaugcaaaaaguuagauauuagcccagaaauguuaguaacaagaaacuac

SEQ ID NO: 21378 - RNA, 64 nt, Human
gguggcuggggacagaguccagcucccuuggaucagcccagaggauucaggauaggacaaaggc

SEQ ID NO: 21379 - RNA, 64 nt, Human
ugcagccacuggcuugauugggcccuggacguugagcccagauguuggagccacaccagccugg

SEQ ID NO: 21380 - RNA, 64 nt, Human
ugugcccacugcccgugcagccuccuucagccagagcccagagcauagacaggaguguaggagu

SEQ ID NO: 21381 - RNA, 64 nt, Human
ccugugcaguccagcccugccuugcugcagccccagcccagauggcacucagcgcucuccccug

SEQ ID NO: 21382 - RNA, 64 nt, Human
uucaauccuccuucacugucuuccuaccauguucagcccagacuccugccacauggaccaggau

SEQ ID NO: 21383 - RNA, 64 nt, Human
ccucauugugacauggcagaaaaagaaagcuguaagcccagaaaacauggucaccuucagcgag

SEQ ID NO: 21384 - RNA, 64 nt, Human
acuccaccaagccuggucagcccaaaccaccagaagcccagaauaaacuggcagcucagcuguu

SEQ ID NO: 21385 - RNA, 64 nt, Human
ucacuggacucuagccuacaacaugcugagcuacagcccagaagccagacaugccugucuuagc

SEQ ID NO: 21386 - RNA, 64 nt, Human
gcacuuugggaggcugaggaggaaggaucacuugagcccagaaguucgagacuagccugggcaa

SEQ ID NO: 21387 - RNA, 64 nt, Human
cugucuuacagguaugagcugacuccaaauggacagcccagaagcugaugaugagaauucuuau

SEQ ID NO: 21388 - RNA, 64 nt, Human
agaagauaauccuauugaagagauuucgguucuaagcccagaggaucuugaagcgaucaagaau

SEQ ID NO: 21389 - RNA, 64 nt, Human
agguccagccuucccuguagccagacaguuuaugagcccagagccuccugccacacacaugcac

SEQ ID NO: 21390 - RNA, 64 nt, Human
gcuugacacaggagcaaugggcagugagguggacagcccagacccugaaaggacguguggagac

SEQ ID NO: 21391 - RNA, 64 nt, Human
ccuucaggaauccaaauccugaacauuuggaaugagcccagauagaaauaucgaaugcaaagcu

SEQ ID NO: 21392 - RNA, 64 nt, Human
ccagggauguaggagggggaaggaggaaacaggaagcccagagagggcaaagggccuaccucgg

SEQ ID NO: 21393 - RNA, 64 nt, Human
cuuggaagagccugcaggugcugcugcguggcauagcccagacacagaagaggcugguucuuac

SEQ ID NO: 21394 - RNA, 64 nt, Human
gugugcauggaggcccuccugugcugggggaaugagcccagagaacagcgaaguagcuugcucc

SEQ ID NO: 21395 - RNA, 64 nt, Human
guccugagcaccugcuucaugaaggaagauagguagcccagagaagaaguuuuggacuuaacaa

SEQ ID NO: 21396 - RNA, 64 nt, Human
gccucccggggagcugagacuagggucccagcacagcccagaaaccuuuggccacaagaagugg

SEQ ID NO: 21397 - RNA, 64 nt, Human
aaagcauuguccagagguaggaacacagucugggagcccagagcucugggaggagugggaaaau

SEQ ID NO: 21398 - RNA, 64 nt, Human
auaaggccaaaacaagaguucugggccacagcucagcccagaggguuccuggggaugggaggcc

SEQ ID NO: 21399 - RNA, 64 nt, Human
cccuccaauggagagauucuggcaaccuuugaacagcccagagcuugcaaccuagccucaccca

SEQ ID NO: 21400 - RNA, 64 nt, Human
ugggaacucaggaaaagcaggaacccuuuccaaaagcccagagaugcccugggcucagaucugu

SEQ ID NO: 21401 - RNA, 64 nt, Human
accaggcuuugcagaggggcggggggugaggcuuagcccagaaggagaacugagcaggaaacca

SEQ ID NO: 21402 - RNA, 64 nt, Human
cugggggagaggaggccgccagcccggaggcugcagcccagaaacucuaccucauccacacugg

SEQ ID NO: 21403 - RNA, 64 nt, Human
ugacucccauuugcucucagugaccccagggcagagcccagagaaguguuccguacccacugcu

SEQ ID NO: 21404 - RNA, 64 nt, Human
uaucauuuuuccuauguuucccucuuuguucagaagcccagaugcauuuuuauaacucaguuuu

SEQ ID NO: 21405 - RNA, 64 nt, Human
augcaccaaggcuugccagagccaacaggaagugagcccagagcauggcacaugagcaucaccc

SEQ ID NO: 21406 - RNA, 64 nt, Human
gaguguaaucagcaccccauccaacuggcccgaaagcccagaccugcagcagaacucuccaacu

SEQ ID NO: 21407 - RNA, 64 nt, Human
ccucuggcagcaccauaauuggucgguuacccugagcccagagcucugaaagcaucuguggaau

SEQ ID NO: 21408 - RNA, 64 nt, Human
ucccaccugccuguucaguggaggccagggcagcagcccagaacagcacaugugggggaggugg

SEQ ID NO: 21409 - RNA, 64 nt, Human
caucugaucccuuuggggugcgggggugggguccagcccagagcaggcacugagugaaugcccc

SEQ ID NO: 21410 - RNA, 64 nt, Human
ugagguggucacucuugcucagggucuguugugcagcccagauggacaccuguuucuccaaccu

SEQ ID NO: 21411 - RNA, 64 nt, Human
uugauaauggccagagauauccacagcuuggaggagcccagagaccguuugcuuuauacccaca

SEQ ID NO: 21412 - RNA, 64 nt, Human
gugucagguuuucaggagagaaugaguuggggugagcccagagucugaaacuccugacugguca

SEQ ID NO: 21413 - RNA, 64 nt, Human
guacaauguacauuauucagggggugaugguuacagcccagacuuuaccacuaugcaauauauc

SEQ ID NO: 21414 - RNA, 64 nt, Human
ccuagcgaggcaccagcacaccuaaucacagcaaagcccagauccccccaucaguugcuuuuac

SEQ ID NO: 21415 - RNA, 64 nt, Human
gaggucagucaagggaucccugacgagaauaaagagcccagaaacagguccauguuuauauggg

SEQ ID NO: 21416 - RNA, 64 nt, Human
agggacuucccuagaagucuucauggucucuuccagcccagacauccugugaugucaugaaagc

SEQ ID NO: 21417 - RNA, 64 nt, Human
aacugugugcaaggcaauaguuagccuugauuuuagcccagagacagauggcagagcuaucucu

SEQ ID NO: 21418 - RNA, 64 nt, Human
gcaagccccucuucuuaaccguuucuuggcuuugagcccagaaacacagcucucccugucucca

SEQ ID NO: 21419 - RNA, 64 nt, Human
aaacugacucguuuuauuuagugccuauuuagcgagcccagaguaacguacauuugugcuguuu

SEQ ID NO: 21420 - RNA, 64 nt, Human
ugcgggacagaggaccauuacaacuagaucaaggagcccagaaaaccuccaguaguggacaaca

SEQ ID NO: 21421 - RNA, 64 nt, Human
cgccuugguuugggagcagggagggggaaguccuagcccagauggaccaaggacgggccugaag

SEQ ID NO: 21422 - RNA, 64 nt, Human
uaggcuuugacacugcuguugagguuugacucgaagcccagaguuuugguguggaugagcaggg

SEQ ID NO: 21423 - RNA, 64 nt, Human
gcccuuccuccucuuaugcaagcagcucgcagccagcccagaaucucuuaugcagcccaaaggg

SEQ ID NO: 21424 - RNA, 64 nt, Human
ccccacuccccuugccccacacccuuuacuccccagcccagagagacgcugcuuuuaccaggaa

SEQ ID NO: 21425 - RNA, 64 nt, Human
gccaaauggcuggcagaugauguggauuucaaagagcccagaaugaacucaucacuggcuuaga

SEQ ID NO: 21426 - RNA, 64 nt, Human
gagcuggagagaagagcugauuuuggcauuacuaagcccagaacgcacauaacccauagugaaa

SEQ ID NO: 21427 - RNA, 64 nt, Human
gagagagagaacagggaggauacagaaguauugcagcccagauccccuaucagggggacagcug

SEQ ID NO: 21428 - RNA, 64 nt, Human
ugccccagcgucuugacgggagcauuggccccugagcccagagaagcuggaagccugccgaaaa

SEQ ID NO: 21429 - RNA, 64 nt, Human
aaaccccagaccuggauucugaguuuuucagccuagcccagacuucuuaucuuaguagacaaaa

SEQ ID NO: 21430 - RNA, 64 nt, Human
ucaccuacgugccacuccuggggucacucaggacagcccagacgcagcugagucggaagcuccc

SEQ ID NO: 21431 - RNA, 64 nt, Human
ugagaucucggcacggcaagcccagcaucgccucagcccagacaggcuccaccaggagaucaag

SEQ ID NO: 21432 - RNA, 64 nt, Human
ccaaauuuuccagccccuugccucccagaaccccagcccagaacucuucagagauuuaagaauc

SEQ ID NO: 21433 - RNA, 64 nt, Human
uuggaaguguauggccgacagcaugaaauagcugagcccagauguuccuucugcauccuccgaa

SEQ ID NO: 21434 - RNA, 64 nt, Human
agccagacacguuguaaaugcugcuuccuauuggagcccagaaaaaaggaaaaggaaaguuuag

SEQ ID NO: 21435 - RNA, 64 nt, Human
aauuauuaggcugcagaggcaagaggauccccugagcccagaaguucaaggguauagugagucg

SEQ ID NO: 21436 - RNA, 64 nt, Human
ccuccgaaagaugaguagaaaccagcaccagcacagcccagaucuucucuuuccucuccuuuuc

SEQ ID NO: 21437 - RNA, 64 nt, Human
cuggaccccauagcuggaggccuguggugccagaagcccagauuaggguggcuguccaucccug

SEQ ID NO: 21438 - RNA, 64 nt, Human
ccuguugacucagugccuccucggcuuccuuggaagcccagagggacuaugaucugauggccuc

SEQ ID NO: 21439 - RNA, 64 nt, Human
acaucucuuugaauuuucuguguuuugcuguaccagcccagauguuuuacgucugggagaaauu

SEQ ID NO: 21440 - RNA, 64 nt, Human
agugcugggauuacaggcgugagccacuccacccagcccagauuaaauguuuuuauuucuaccu

SEQ ID NO: 21441 - RNA, 64 nt, Human
uaccucuuacuuccuagacuuugauuucuccggcagcccagauguucaguucucuuggccccuc

SEQ ID NO: 21442 - RNA, 64 nt, Human
cagauuuacacucagagccuggucgccccccguuagcccagauucaaaaggugaacaucuguuu

SEQ ID NO: 21443 - RNA, 64 nt, Human
agacuguggguguagauuaccugccacuuccaggagcccagagggccaagagagacauugccuc

SEQ ID NO: 21444 - RNA, 64 nt, Human
ggucucaagaccuuuccuccaaucagcccaacccagcccagacugggcuuuucuggggagcuga

SEQ ID NO: 21445 - RNA, 64 nt, Human
uccaaaucugaacagucacuguaaaucauucuuaagcccagauaugagaacuucugcuggaaag

SEQ ID NO: 21446 - RNA, 64 nt, Human
ugucuuuacgaguguuuuuuauuugggacccucgagcccagagauauuaauggauaucuguauu

SEQ ID NO: 21447 - RNA, 64 nt, Human
ucucagaggaagcagcccucccucgauggccucuagcccagagaagcccgcgcaucuuggaccc

SEQ ID NO: 21448 - RNA, 64 nt, Human
ugauucccgaguguuaaucugugguuuugaccagagcccagauggguaauccugugcauuuggg

SEQ ID NO: 21449 - RNA, 64 nt, Human
gccuuucuggaaagcaggaguucaagccuuagcaagcccagaggcccccagcagacgaugagga

SEQ ID NO: 21450 - RNA, 64 nt, Human
augauuauuuuauuuaguaaauaaaauaauagagagcccagaaaucaaccugcacaccuaccgc

SEQ ID NO: 21451 - RNA, 64 nt, Human
gagagaaauaaacauuuagaggauuuaauuagaaagcccagagaaaaagccagaaaaccaaggu

SEQ ID NO: 21452 - RNA, 64 nt, Human
ccucuuucauuggugacccauaaccccaagucccagcccagaaccccuaacccccaauacuuga

SEQ ID NO: 21453 - RNA, 64 nt, Human
gccacaaaugcacuacguuauuaaauuuuucugaagcccagaguuaaaaaucaucuguccaccu

SEQ ID NO: 21454 - RNA, 64 nt, Human
uuccuuuaaagggagggggagaagccagggugauagcccagacucugcccuguugugcuggcag

SEQ ID NO: 21455 - RNA, 64 nt, Human
caagcagugagacugcccacccacucccacaccuagcccagaaugcuguaggccacuaggcgca

SEQ ID NO: 21456 - RNA, 64 nt, Human
aaguuugauccccucgugcagaugaagaagcugaagcccagaguggggaaggggaguggcccaa

SEQ ID NO: 21457 - RNA, 64 nt, Human
gguccucauccuccuuguuggucuacucaggcccagcccagagcuguguucccugucucagguc

SEQ ID NO: 21458 - RNA, 64 nt, Human
uggacuauuucagacaaccagguuccgacaguccagcccagaacuuuuccuucucauuuugggu

SEQ ID NO: 21459 - RNA, 64 nt, Human
aacacauuuauggcaugcacugaccucuucuuggagcccagaacuuuauagaguugccuaccag

SEQ ID NO: 21460 - RNA, 64 nt, Human
cagagugcccagcguuuaucagaggcagcauccaagcccagagccagugucgacucuucggcug

SEQ ID NO: 21461 - RNA, 64 nt, Human
uuccauccauuuccucagguuucugugguucaguagcccagaccuguuuggcagccauuucuag

SEQ ID NO: 21462 - RNA, 64 nt, Human
cacaccuggcugaacaucagauauuuuaaaguguagcccagagucuaguugguaaauguuacuu

SEQ ID NO: 21463 - RNA, 64 nt, Human
guacugaccagcucccguugggccaggccagcccagcccagagcacaggcuccagcaauauguc

SEQ ID NO: 21464 - RNA, 64 nt, Human
aaagccaaagccgaaaauaguauaugagcauucuagcccagagacugucgcuacuaaaagaaug

SEQ ID NO: 21465 - RNA, 64 nt, Human
cuuuccucugucccagauucaaaugaggaguaagagcccagacgagaggaaggcaggcuggauc

SEQ ID NO: 21466 - RNA, 64 nt, Human
cuggaggcacuagaggagggcaucugucugugggagcccagaggcugcagggaggaggaggagg

SEQ ID NO: 21467 - RNA, 64 nt, Human
agggccccgacuuuucagaauaggagcagagagaagcccagacuuccuucccuggaguguagac

SEQ ID NO: 21468 - RNA, 64 nt, Human
ugaucccgauuucaugcacagcccugcaguaaggagcccagaaggaacauguguuuccuguuaa

SEQ ID NO: 21469 - RNA, 64 nt, Human
acuccagagagaagcauccccuggcccggugggaagcccagacgaggaggacggggaaccggau

SEQ ID NO: 21470 - RNA, 64 nt, Human
cuaacauuauuuuucaaaacauacauggaaauuuagcccagauugucuacauauaagguuuuua

SEQ ID NO: 21471 - RNA, 64 nt, Human
aaauuaucucuaacgucuuuguuguuuauggaaaagcccagauacuggauauaucacuauguau

SEQ ID NO: 21472 - RNA, 64 nt, Human
uuucgcugugucuccuguguguguuagaauccagagcccagaggaagugcaagcggguccuccg

SEQ ID NO: 21473 - RNA, 64 nt, Human
caggugcuggccucaacccuggcaggggagggggagcccagagugauguuucuccuaaggccaa

SEQ ID NO: 21474 - RNA, 64 nt, Human
aacaggcuucacuguauaaauaggagaggaugagagcccagagguaacagaacagcuucagguu

SEQ ID NO: 21475 - RNA, 64 nt, Human
gguggaugcucguaaccacggugacagcccccacagcccagacaugagcuacgagaucaugagc

SEQ ID NO: 21476 - RNA, 64 nt, Human
gugcugcccugccucucgugccggguguugcuucagcccagagccagagggcugggucccgggu

SEQ ID NO: 21477 - RNA, 64 nt, Human
uguaagggggccugccccucaucugcgaaagaagagcccagacaccgggaaccccugacccagg

SEQ ID NO: 21478 - RNA, 64 nt, Human
caauuucucauuaccccuacacaucucuccacggagcccagaccccagcacagauauccacaca

SEQ ID NO: 21479 - RNA, 64 nt, Human
uucugcuucugcuucucucugcuccacugucugcagcccagauccuguugggccuggcuggugu

SEQ ID NO: 21480 - RNA, 64 nt, Human
uuacuuugggaggcccaggugggaggaucgcuugagcccagaaguuugagaccagccuaggcaa

SEQ ID NO: 21481 - RNA, 64 nt, Human
cucgaucacgagccugagaacugcacgggggagcagcccagacuggcuggaaaccauguuuuca

SEQ ID NO: 21482 - RNA, 64 nt, Human
cacuuaggcagaguagacacaauuaaagguacaaagcccagaggaagugguagagcagcaccgu

SEQ ID NO: 21483 - RNA, 64 nt, Human
ccacaacuuccagggugcacaugguaaaaucugaagcccagaauuuucucucaagcugcguggu

SEQ ID NO: 21484 - RNA, 64 nt, Human
ccccgagagcugucggaaccagaugcaacccggcagcccagagaacucuccugggaggcugugg

SEQ ID NO: 21485 - RNA, 64 nt, Human
aaaccagcuucccgacucccaggagcucaagccaagcccagaggcaguggcuggggucccugca

SEQ ID NO: 21486 - RNA, 64 nt, Human
aaauguaguucucuauuaaccugaaauguacacuagcccagaacaguuuaaugguacuuacuga

SEQ ID NO: 21487 - RNA, 64 nt, Human
cugagaggggaccugcuugcuguggugguugccuagcccagaugagcauuuaccuaccaccuuc

SEQ ID NO: 21488 - RNA, 64 nt, Human
uauaaaguuguagauucuuauguguuuuuguauuagcccagacaucuguaauguuuuugcacug

SEQ ID NO: 21489 - RNA, 64 nt, Human
gauccccaccaguucaacacuccauuaacugggaagcccagaguccuguccggccugccaaguu

SEQ ID NO: 21490 - RNA, 64 nt, Human
ugccgacuggagggucuugcuuuuucaaacucagagcccagaggaaaugcaaggguggauaaac

SEQ ID NO: 21491 - RNA, 64 nt, Human
ccaaaaugccaagaagugauggagccuagacagaagcccagaacuuucugacucacacuagucc

SEQ ID NO: 21492 - RNA, 64 nt, Human
gcaccccaacaaauauuaaauggcuucuucuuaaagcccagagaaagagguuuuuuaaaagacu

SEQ ID NO: 21493 - RNA, 64 nt, Human
aaacagacucauaccacacuuacaauuaaggucaagcccagaaagugauaagugcagggaggaa

SEQ ID NO: 21494 - RNA, 64 nt, Human
uccaugaguauugugguacuucuagacuuguuuaagcccagaacucauuccuucaaaacagaga

SEQ ID NO: 21495 - RNA, 64 nt, Human
gggagcgcagccuucccaguaacuucuaccugccagcccagagggaaauauggauuuucacacc

SEQ ID NO: 21496 - RNA, 64 nt, Human
cacuaauuuuuuaaaaauggaagguaaacugcauagcccagagaaagauaaguaaauauuuaag

SEQ ID NO: 21497 - RNA, 64 nt, Human
caggcugccugcgugggaggcgaagucccaggacagcccagaggggggcuacagagaggagucg

SEQ ID NO: 21498 - RNA, 64 nt, Human
cuuugacuuaagaucccacaccucacaaaccuacagcccagaaaccagaagccccuauagaggc

SEQ ID NO: 21499 - RNA, 64 nt, Human
gcacuuugggaggucaagaugggaggauugcuugagcccagaaguucgagacuagccugggaaa

SEQ ID NO: 21500 - RNA, 63 nt, Human
cagcugcuggucgccaguaauaaguauccugagagcccagaaaagguacacuuugccuugcug

SEQ ID NO: 21501 - RNA, 64 nt, Human
gaagagcgcccuggacugcugagggugggccaacagcccagagcucaggacacuuggcuuuggg

SEQ ID NO: 21502 - RNA, 64 nt, Human
ccacugguggcuccccagagccucagacccacacagcccagaggacgaggccuucaagccugcc

SEQ ID NO: 21503 - RNA, 64 nt, Human
gauggagcaagccugugacuccaagcugggcccaagcccagagccccugccugccccaggggag

SEQ ID NO: 21504 - RNA, 64 nt, Human
gaaagcaucugaagacaucuaacuuagagucugcagcccagagccacaugcaaaacaccuucaa

SEQ ID NO: 21505 - RNA, 64 nt, Human
cauccagauaacuuauacauucccaagaaaguucagcccagauggaagguguucagggaaaggu

SEQ ID NO: 21506 - RNA, 64 nt, Human
uccuguggcguugccuggacauccacucccugacagcccagagcagcacugucuggcuucccuu

SEQ ID NO: 21507 - RNA, 64 nt, Human
agcccagcaugccggugggcccacagcccgagccagcccagagcugccggaagggccgcccuuc

SEQ ID NO: 21508 - RNA, 64 nt, Human
cugccaucuucuccccgaggcugccccaggccggagcccagauacgggggcugugacucugggc

SEQ ID NO: 21509 - RNA, 64 nt, Human
gcucaggcccacaccuugugauuuuugaaaccaaagcccagaagaugauguuuacuucucucuc

SEQ ID NO: 21510 - RNA, 64 nt, Human
agggcugagccccuccucuccucguccggccugcagcccagaacgggccuccccgggggucccc

SEQ ID NO: 21511 - RNA, 64 nt, Human
cacuuugugugcucuuaaccuucugagugcugcuagcccagaccuguggacgaggcagaccaca

SEQ ID NO: 21512 - RNA, 64 nt, Human
gggaccagucggaagggauucuggcuauugggggagcccagagacaggggaaggcagccugucc

SEQ ID NO: 21513 - RNA, 64 nt, Human
ccucaccccacccuccaggguugggggagcaggaagcccagauauuuggaggaacagaaacacc

SEQ ID NO: 21514 - RNA, 64 nt, Human
auauucaggaaagaagugcagaauuucuuccccaagcccagagaagagcagcccugagccccug

SEQ ID NO: 21515 - RNA, 64 nt, Human
agcucccuccuggcacaugggggcuggccacaauagcccagagggucagaacuggacagcugca

SEQ ID NO: 21516 - RNA, 64 nt, Human
uaucuauuuuacaaaaugcagagccaggucccucagcccagacucagucagacauguucacuaa

SEQ ID NO: 21517 - RNA, 64 nt, Human
ugcuuaggagagggaagcagcuugccaguuaaacagcccagaaggagcagaucuggggucagaa

SEQ ID NO: 21518 - RNA, 64 nt, Human
aauuaacuggacauuaguguacagcccauguccaagcccagagagaaaacaaugggaacaauuu

SEQ ID NO: 21519 - RNA, 64 nt, Human
aauugcuugaacuggggaggcagagguugcggugagcccagaucgcgccauugcacuccagccu

SEQ ID NO: 21520 - RNA, 64 nt, Human
gggguuggauuugaagacuuuuaaguuuccuuccagcccagaaagucucucauucuaggccucc

SEQ ID NO: 21521 - RNA, 64 nt, Human
ggggagacaggagccuagcggagcccagccugggagcccagaggguggcaagaacagugggcgu

SEQ ID NO: 21522 - RNA, 64 nt, Human
acagcaccuccccgcugggaagagaagagggcccagcccagagccaccuggaucuaucccugcg

SEQ ID NO: 21523 - RNA, 64 nt, Human
uuuuacuuuaaaugccugccaaggagcagccucaagcccagagaagacugaggcuacggggaac

SEQ ID NO: 21524 - RNA, 64 nt, Human
uacugaggacgcuuccccuuccuuguuucugcucagcccagaugcacagacacuauuggcaaug

SEQ ID NO: 21525 - RNA, 64 nt, Human
uuaucaaagaaauaacucagaguaauuugacaccagcccagaucauauauugauuauacaauug

SEQ ID NO: 21526 - RNA, 64 nt, Human
cccaccccuugucaagcauugccugugauugcccagcccagauucaucugugccuuggacaugg

SEQ ID NO: 21527 - RNA, 64 nt, Human
guauuaagcaagagguggacucgagcaauccaggagcccagacugagcaaauaaguacuuucca

SEQ ID NO: 21528 - RNA, 64 nt, Human
uuccaggaguccugcccagcagccucaguggccaagcccagacacucacccaccuuccccagug

SEQ ID NO: 21529 - RNA, 64 nt, Human
ccuggauguauuaccacaugggcagacuggcagaagcccagacuuaccuggacaagguggagaa

SEQ ID NO: 21530 - RNA, 64 nt, Human
uucgagccacaagggccaaccaggaggccccuggagcccagaucugucaucuggugcugccagc

SEQ ID NO: 21531 - RNA, 64 nt, Human
gcccgacggcagcgccgccgccgcccagaaucccagcccagaaucccgaccgccgcgccggacg

SEQ ID NO: 21532 - RNA, 64 nt, Human
ccagccccuuccuuuccaaaccaugcaauggaagagcccagaugggugaagauugauuuugccu

SEQ ID NO: 21533 - RNA, 64 nt, Human
uaacagcuuucucaaagcggugaccacucaggccagcccagacaaaucugagggauggccagug

SEQ ID NO: 21534 - RNA, 64 nt, Human
ugccaccagagaaggugcuugguguucgccugccagcccagagcccuggaggagccggcugcac

SEQ ID NO: 21535 - RNA, 64 nt, Human
aucagcgggaaccaccaucacaucuuuauuccucagcccagacacucgaggcacucaacagaau

SEQ ID NO: 21536 - RNA, 64 nt, Human
gaucccacauucacacugacuugggcagugacagagcccagagcaaacagggccaggccagccc

SEQ ID NO: 21537 - RNA, 64 nt, Human
aauugcuugaaaccaggaggcggagguugcagugagcccagaucacgccacugcacuccagccu

SEQ ID NO: 21538 - RNA, 64 nt, Human
uuucggcucuggccuccaaguccacaguggaaccagcccagacccuucuccuuagaaguggaag

SEQ ID NO: 21539 - RNA, 64 nt, Human
uggaggaaccaaaggcugugcauuguuagaauuuagcccagaugcaggauaaacuagcuugccu

SEQ ID NO: 21540 - RNA, 64 nt, Human
agaaacccaggggccuccuaugcacagaucuugcagcccagaaccaagucagccucccugcgac

SEQ ID NO: 21541 - RNA, 64 nt, Human
cucuccccuucccugcccagugccccuccuccccagcccagacccccaggugcccaaggccugc

SEQ ID NO: 21542 - RNA, 64 nt, Human
ggaucccugagugcugaaugcucgccugcagagcagcccagaaagagcccugacuggggagaga

SEQ ID NO: 21543 - RNA, 64 nt, Human
uuggccucaccaaggcccugacucagauggaggaagcccagaggaaacggacacaacuccggga

SEQ ID NO: 21544 - RNA, 64 nt, Human
ggcagccgcuccgagccucggcccugccccaaguagcccagaagccuccggcggcccaggauuc

SEQ ID NO: 21545 - RNA, 64 nt, Human
accugcuguuccuggagucgaaggacaagcccacagcccagauuccgguucucccaacucagga

SEQ ID NO: 21546 - RNA, 64 nt, Human
acaagguccaacccugcaaugaagcagccacuucagcccagagagauuauaagaacugaugugg

SEQ ID NO: 21547 - RNA, 64 nt, Human
ucccagcguuugccagagguggccacuucagccaagcccagagaagugugggcagaagcaguga

SEQ ID NO: 21548 - RNA, 64 nt, Human
uugguugugccaaacacuuuauuugggaaaggaaagcccagauuugaaugggucuuuccccugg

SEQ ID NO: 21549 - RNA, 64 nt, Human
uggcucaggagucuuagagcuuuaccuaaauaugagcccagaaaacggaggauggggguggggc

SEQ ID NO: 21550 - RNA, 64 nt, Human
agcguggcagccaccagguccacagaacuacugcagcccagaggacagcuuugaaguuugcguc

SEQ ID NO: 21551 - RNA, 64 nt, Human
ccuugugagccgcugccuccgaaaucuccuuugaagcccagacaucuuucuccagcuucagacu

SEQ ID NO: 21552 - RNA, 64 nt, Human
cguccacacugccagcaaugccccuggcccagugagcccagacgcuccuccaccccuuccagac

SEQ ID NO: 21553 - RNA, 64 nt, Human
ccugaaugccuucugggguauuuccauaugcaacagcccagagucauagccuugggcaaccaca

SEQ ID NO: 21554 - RNA, 64 nt, Human
uagcagaaauauugucuguaaagcuaggcagaugagcccagaagaauggucccagagaaagcag

SEQ ID NO: 21555 - RNA, 64 nt, Human
gaaaauuguguuuugggauugaguucuuugucucagcccagaaucccagguccugggccugguu

SEQ ID NO: 21556 - RNA, 64 nt, Human
gacaguuugaguaaaagaaaagucauauugaagaagcccagaggguugugcccaggggcagaaa

SEQ ID NO: 21557 - RNA, 64 nt, Human
uguuuuguugagauggagucucgcucuguugcccagcccagaguacaguggcacuaucucagcu

SEQ ID NO: 21558 - RNA, 64 nt, Human
gugaguuucuaagggggaagccggccagggagcgagcccagaacggaccggacgccugugcacc

SEQ ID NO: 21559 - RNA, 59 nt, Human
ugauacagaagaucagcuaagacacacccagcccagauucaacaggaaaccgaucuucc

SEQ ID NO: 21560 - RNA, 64 nt, Human
uuaccgugcacguaaauuggucagcagaaaagggagcccagaaaaggcagcagauggaccaugc

SEQ ID NO: 21561 - RNA, 64 nt, Human
caagaauaacucaugaggugguaccaaagaugaaagcccagacuucaguaaucuuuugaaccag

SEQ ID NO: 21562 - RNA, 64 nt, Human
gcaaagggccucaauuccuauaagagacccucgcagcccagaggcgcccagaggaagucagcag

SEQ ID NO: 21563 - RNA, 64 nt, Human
cacacuacugaauggaagcaggcugucuuguaaaagcccagaucacugugggcuggagaggaga

SEQ ID NO: 21564 - RNA, 64 nt, Human
cccuauggauuaucuuuauaucacugucuuucuaagcccagagaugucauaagugacaagaaaa

SEQ ID NO: 21565 - RNA, 64 nt, Human
aagaaaaguagagguggcuuugcugccuccugggagcccagaacuugcaguaacccuuuagggu

SEQ ID NO: 21566 - RNA, 64 nt, Human
aggcaaacccucuuuauugaacauuagccagcccagcccagaccccagggcugccuaaggacac

SEQ ID NO: 21567 - RNA, 64 nt, Human
ccuaccccacggaggaugagaagaggcagaucgcagcccagaccaaccucacccuccugcaagu

SEQ ID NO: 21568 - RNA, 64 nt, Human
cuuggaacacagugacucccuggaguagucgggcagcccagauggcacugaucacugagcagga

SEQ ID NO: 21569 - RNA, 64 nt, Human
gaauggcaugaacccgguaggggagcuugcagugagcccagaucaugccacuguacuccagccu

SEQ ID NO: 21570 - RNA, 64 nt, Human
uccuuuaccccuguucugcuuaacagaacugccaagcccagaaguaccuuugcacuccugguuu

SEQ ID NO: 21571 - RNA, 64 nt, Human
cagaguagggaagacucccacugaucugagaaugagcccagaggcuuguuuggggacuguuuua

SEQ ID NO: 21572 - RNA, 64 nt, Human
aggggaggggagcucaagguuuggguggggacucagcccagaucuacgugagacauuuuucugu

SEQ ID NO: 21573 - RNA, 64 nt, Human
aagaaaauuugacuuaaagcuaaaaagaggacauagcccagaguuucuguuauugggaaauuga

SEQ ID NO: 21574 - RNA, 64 nt, Human
uggcuucccaggacccugggucaccuuccugggcagcccagagagacccugccaacuuuccaga

SEQ ID NO: 21575 - RNA, 64 nt, Human
aaauauuucccauuugugccagaggaauccuggcagcccagagacuuuguagauccuuagaggu

SEQ ID NO: 21576 - RNA, 64 nt, Human
ucuguguaugccugggauccuuccaagcacucauagcccagauaggaauccucugcuccuccca

SEQ ID NO: 21577 - RNA, 64 nt, Human
aggcagucucagaggcuaguauggggcuagaugaagcccagaguaacacccacaauauaaaugg

SEQ ID NO: 21578 - RNA, 64 nt, Human
agugcaggacaacccagcuaugcccacaugcucaagcccagaaggcagaaucaagcuuugcuuu

SEQ ID NO: 21579 - RNA, 64 nt, Human
cccagaguuuacaauuauguccauauaaaauucuagcccagaaguucucaucugggguagauuu

SEQ ID NO: 21580 - RNA, 64 nt, Human
cugcuacagaucaaagacuccuccaaaaagcacaagcccagaacaugggucaccaauggggggu

SEQ ID NO: 21581 - RNA, 53 nt, Human
cuucaagagaagaacuuugagucagcccagaaucacacuccuguguaucccgg

SEQ ID NO: 21582 - RNA, 64 nt, Human
gaggcuccugggcagauggggucaaggcugggccagcccagaugaagccuaugggagucaggac

SEQ ID NO: 21583 - RNA, 64 nt, Human
uacaggaguguccauagauggauggaggagguggagcccagagcccaaggaagagcugggaauu

SEQ ID NO: 21584 - RNA, 64 nt, Human
uggccuggcacggcugugcuccuccccugcucccagcccagagcagccaucaggcuggagguga

SEQ ID NO: 21585 - RNA, 64 nt, Human
cagagggauaacccaaacaaaaaugacucuaaauagcccagaucccaagagauuauguaacucc

SEQ ID NO: 21586 - RNA, 64 nt, Human
uucccuacccuuccugccaagccagggacuaagcagcccagaagcccaguaacugcccuuuccc

SEQ ID NO: 21587 - RNA, 64 nt, Human
cagaugcccaagucuugggggagaaaggaaugggagcccagacagccacucugcuuagacaugg

SEQ ID NO: 21588 - RNA, 64 nt, Human
aaagagggggaggccgagccaagaggaccccaggagcccagagcagcgggagaggguccuuccu

SEQ ID NO: 21589 - RNA, 64 nt, Human
aagggaaagggaagcacaugaucaugggaaugauagcccagaacaaaaagaaaucuugucuuac

SEQ ID NO: 21590 - RNA, 64 nt, Human
gcacuuugggaggcugagaugggaagaucacuugagcccagaauuagagauaagccuauggaaa

SEQ ID NO: 21591 - RNA, 64 nt, Human
aaauaucuuagaauuaaugaucucuuuggaagagagcccagauuuguaugaaaacuuguuuuuc

SEQ ID NO: 21592 - RNA, 64 nt, Human
acuuucuacggggaggagggggggaucaucaggaagcccagaacacuaacaagcgguucuccca

SEQ ID NO: 21593 - RNA, 64 nt, Human
aguccaacaacaguguccacacuagucaagguucagcccagaaaacagaaagcacucuaggaau

SEQ ID NO: 21594 - RNA, 64 nt, Human
aggaaccucacagggguaucaaaaagauguaaacagcccagaggcuuaugagcuacagugauga

SEQ ID NO: 21595 - RNA, 64 nt, Human
aaucacuugaacccgggaggcagagguuguagugagcccagauugugccacugcucuccagccu

SEQ ID NO: 21596 - RNA, 64 nt, Human
gcuuggcccuaggcccuccagcucagccagaaaaagcccagaaacccaggugcuggaccagggc

SEQ ID NO: 21597 - RNA, 64 nt, Human
cucucugcauuaggggagucucucaggaaaaagaagcccagaucucuucagcaaucguuucuuc

SEQ ID NO: 21598 - RNA, 64 nt, Human
augguguggucaagcccucgucuagagcagacccagcccagaccucugacacauuagccuugaa

SEQ ID NO: 21599 - RNA, 64 nt, Human
ccagcucacagacgcucuuguugugcccccuucaagcccagauugugccaggucagcugucccu

SEQ ID NO: 21600 - RNA, 64 nt, Human
agcuauucuuugucacuugggugccaaacaugagagcccagaaaacugucauuuagcuggcugc

SEQ ID NO: 21601 - RNA, 64 nt, Human
uucagauauccccaaggcugccucucccaccacaagcccagaguggaugggcugggggaggggu

SEQ ID NO: 21602 - RNA, 61 nt, Human
uguuggaccuaagauauugaagacaggcuggagcccagagccuucauucaaucucagauuu

SEQ ID NO: 21603 - RNA, 64 nt, Human
cucuuugggccuggcucccugggaaugugacuugagcccagagugaacacucuugguagaagcc

SEQ ID NO: 21604 - RNA, 64 nt, Human
gauaugggggcuuaggaaaacaauccaacucccuagcccagacccucaggucaggaggccugcg

SEQ ID NO: 21605 - RNA, 64 nt, Human
agccuaaacagggcacauagaucucucccacuagagcccagagggaugagaggagagagcaacu

SEQ ID NO: 21606 - RNA, 64 nt, Human
ccacaucucuucuagcuucacuggccacucacucagcccagagucccuaagugcucccccacuu

SEQ ID NO: 21607 - RNA, 64 nt, Human
ggcuuguaacuggggaaauauuccaccugauaauagcccagauucuacuguauucccaaaaggc

SEQ ID NO: 21608 - RNA, 64 nt, Human
aggugcugacggccagggagaagcuccucuccccagcccagagacauacuugaagggccagagc

SEQ ID NO: 21609 - RNA, 64 nt, Human
aggaggcaggcagcaccagcagggguccaccaagagcccagaccagccccucugcccuccuacc

SEQ ID NO: 21610 - RNA, 64 nt, Human
aggaaauggggggaucacuuuccaagugccaaagagcccagagggacucuaagaaccuaaggug

SEQ ID NO: 21611 - RNA, 64 nt, Human
caguaaguggccuuugcucuuuuuuguaccaaagagcccagaugauuccuacagucccuuucuu

SEQ ID NO: 21612 - RNA, 64 nt, Human
uggacacagucuuagaaacauuacagaauaaaaaagcccagacaucuucaguccuuuggugauu

SEQ ID NO: 21613 - RNA, 64 nt, Human
caucccuguuugggggauaccauucaccgccuucagcccagaugauacuuuccuuuaaaucugu

SEQ ID NO: 21614 - RNA, 64 nt, Human
gucaaaauugguuuucacucauuugauugguuugagcccagaacagccuacaggggaaaaacaa

SEQ ID NO: 21615 - RNA, 64 nt, Human
acagugccagaauuaagugagucaagccaaguaaagcccagagaagauucucaucagcacuuuu

SEQ ID NO: 21616 - RNA, 64 nt, Human
agccucccagcggcucaugaagcaucgagcuccaagcccagaugccaagcucccuggcugagcu

SEQ ID NO: 21617 - RNA, 64 nt, Human
uuggagaaagcugguucccguuuuccagagggggagcccagagcuugaaaggccgcgguuggca

SEQ ID NO: 21618 - RNA, 64 nt, Human
ggcacuggcuccuuuccgaaguucucaguaacugagcccagaguaacugcacgccuuugugcag

SEQ ID NO: 21619 - RNA, 64 nt, Human
gagagccuggcccugugcuguggucucugcugcaagcccagauuucugggaguaacuaguguua

SEQ ID NO: 21620 - RNA, 64 nt, Human
aggguuucuguucuaggaguggacuagaaguuuaagcccagagucaguaaacacuguuuugaag

SEQ ID NO: 21621 - RNA, 64 nt, Human
ugugaauaagaagccaggaaaggaaagauggggaagcccagaucaccaggcuucuauuaaggag

SEQ ID NO: 21622 - RNA, 64 nt, Human
cacauuuggcaguacaaaugagucugaguguaauagcccagagauuuauauauaguugaauguc

SEQ ID NO: 21623 - RNA, 64 nt, Human
gucuuguccugggagccggguccugcugcucacaagcccagagcugccagggagcuccuggcag

SEQ ID NO: 21624 - RNA, 64 nt, Human
ugaaauuauauuuuuggaaaaaaaaaacacuugaagcccagauggaaauacguuuauuucagca

SEQ ID NO: 21625 - RNA, 64 nt, Human
cucauuuugaauguuccagagggagcaucauaagagcccagagcuccgauuuccaaagagugau

SEQ ID NO: 21626 - RNA, 64 nt, Human
gcuacaggggaggcugagacgcaaggaucacuugagcccagaagcucaaggcugcagugagcca

SEQ ID NO: 21627 - RNA, 64 nt, Human
agauuugggugaggacacagagccauaccauaucagcccagaucaaguagugacagaguaggga

SEQ ID NO: 21628 - RNA, 64 nt, Human
aauauguaaugaucguauuaaaaacaauaaauaaagcccagaaguuuaaugagaaggacugaac

SEQ ID NO: 21629 - RNA, 64 nt, Human
gcuccuaggcccagccagccagagaggacaguggagcccagacacgucuccuugggauucacua

SEQ ID NO: 21630 - RNA, 64 nt, Human
guaaucucagcucuccuaaucccaucacuuccccagcccagagaagacauuccaacccugucug

SEQ ID NO: 21631 - RNA, 64 nt, Human
uaguaccccgcuacccuguucugucuuauggagcagcccagauuaucuuuacucccucuuucuc

SEQ ID NO: 21632 - RNA, 64 nt, Human
uuggaaaucaaaaugucacauucucgggggaggaagcccagaaaauuggguauguucuagagau

SEQ ID NO: 21633 - RNA, 64 nt, Human
aaagugcugggauuacaggcaugagccaucgcccagcccagaagcuaauuuuuuaauauuguau

SEQ ID NO: 21634 - RNA, 63 nt, Human
acuguuacuccuacagcuaauucugcagggcacagcccagagccauguggauuugacuuacgg

SEQ ID NO: 21635 - RNA, 64 nt, Human
caaaauaggaauguuguucucaagugucaccuccagcccagaggugguuccuuaggcagcaugu

SEQ ID NO: 21636 - RNA, 64 nt, Human
ucacccagggcgucccugacagagguacaaguaaagcccagaucucugcaucucugguucaagg

SEQ ID NO: 21637 - RNA, 64 nt, Human
cuuacugcuagcucugcuuuuuaugcaggagaaaagcccagaguucacugugugucagaacaac

SEQ ID NO: 21638 - RNA, 64 nt, Human
aauuuuauucaucaauuacauuacacauucauuuagcccagauuucaaauagugggggaagaaa

SEQ ID NO: 21639 - RNA, 64 nt, Human
cuuuccaucuuucagcauagacuuaauccccuuaagcccagacaucuguugggaccugaccccc

SEQ ID NO: 21640 - RNA, 64 nt, Human
gagagcugaauuuagaaaccagacaacgucaugcagcccagaaacuccuguuguuaccuuugcc

SEQ ID NO: 21641 - RNA, 64 nt, Human
agagcagcccgaccacaggagcauggccgcugccagcccagacgcugcugacgcuguguaaaug

SEQ ID NO: 21642 - RNA, 64 nt, Human
gggugcauuugagagaagccacgcuguccucucgagcccagauggaaagacguuuuugugcugu

SEQ ID NO: 21643 - RNA, 64 nt, Human
ccaaggggaggagcgacaccuccaggcuuccgggagcccagagagcauguggcaggcagugggg

SEQ ID NO: 21644 - RNA, 64 nt, Human
cugggagggaagaagucggggcccuccuauuagaagcccagacuggaagugagaggcaugaugg

SEQ ID NO: 21645 - RNA, 64 nt, Human
uccagaggugccagaccgcggauuuuauuuagcaagcccagaccuuccggucuaacgucucaca

SEQ ID NO: 21646 - RNA, 64 nt, Human
cacugagcuggcugacuaagccccgucugaccccagcccagacagcaagguguggaggcuccug

SEQ ID NO: 21647 - RNA, 64 nt, Human
cuguccuccacccuggaccccagccggcugcuggagcccagaggccaccuucucccugcauccu

SEQ ID NO: 21648 - RNA, 64 nt, Human
aagugcguggucacaaaauaucagaaaugccaguagcccagagggacuugcaggaaaagcgugc

SEQ ID NO: 21649 - RNA, 64 nt, Human
aucaagggaugcaccuucagucaaacugucaaaaagcccagaauucccaaaggcauuagguuuc

SEQ ID NO: 21650 - RNA, 57 nt, Human
ugagggaagaugagggcuaaaggugcgagcccagauggcgagccccaggggauggcc

SEQ ID NO: 21651 - RNA, 64 nt, Human
uccauauuuuagacuacugccucuaccauuaacuagcccagacauuugaauggccuuguaaaca

SEQ ID NO: 21652 - RNA, 64 nt, Human
cugagugucccaguuuuaucugcuccugagacugagcccagauccccaaaucuaaucugauuua

SEQ ID NO: 21653 - RNA, 64 nt, Human
ugaucucagcuuauccugcaacuaaccauccuugagcccagauggggcucagggcccuuccaga

SEQ ID NO: 21654 - RNA, 64 nt, Human
aaguucuacgggaaguaauugaucguuugcugccagcccagaaggaugaaggaaagaagcaccu

SEQ ID NO: 21655 - RNA, 64 nt, Human
accaauacugccuuuggaauaugacagaaucaauagcccagagagcuuagucaaagacgauauc

SEQ ID NO: 21656 - RNA, 64 nt, Human
aaugaaugaguuccuuuaagugccaccgccagcaagcccagaggcacacaguccgagugcaccc

SEQ ID NO: 21657 - RNA, 64 nt, Human
ggcccaggcugggugcccuguggccugagaacugagcccagacuuugacaaacccaccucaaca

SEQ ID NO: 21658 - RNA, 64 nt, Human
uauuggacuuacugcuauacuugugauacuggguagcccagacuuugaaggugcuuugugaggu

SEQ ID NO: 21659 - RNA, 64 nt, Human
aauacaaguauauuugcgugaugguuacacuagaagcccagacuuuacgacuacacaauauauu

SEQ ID NO: 21660 - RNA, 64 nt, Human
gcuacuccaggggcugaggugacagcauugcuuaagcccagaaggucgaggcugcagugagcug

SEQ ID NO: 21661 - RNA, 64 nt, Human
acauggcuguguuugcagccugcucuagugggacagcccagagccuggcugcccaucauguggc

SEQ ID NO: 21662 - RNA, 64 nt, Human
gcguugggggugccaagggcuucuccgcaagggaagcccagauuuacuucuuucaaaaucauau

SEQ ID NO: 21663 - RNA, 64 nt, Human
ucaccaccugcccuccuucuaccaggaccucagaagcccagaccuggggaccccaccuacacag

SEQ ID NO: 21664 - RNA, 60 nt, Human
aaccaaaacuccccaccugaagcugagcccagcccagacccagcugcucccggggacaug

SEQ ID NO: 21665 - RNA, 64 nt, Human
ccccuuccaguguguaacuggauuggcucccaccagcccagaagauuuacgacgugggaaaugg

SEQ ID NO: 21666 - RNA, 64 nt, Human
ccacuuacuucccuguucaccucugccccaccccagcccagaggaguuugagccaccaacuuca

SEQ ID NO: 21667 - RNA, 64 nt, Human
ggacaguuucccgggcagcuccuggccagcuuccagcccagaguccucaaguccagggcaccuu

SEQ ID NO: 21668 - RNA, 64 nt, Human
cuugcucugagaguucaaguccugccaggccgccagcccagagccuccucacccuauccuguuc

SEQ ID NO: 21669 - RNA, 64 nt, Human
cacugguggggaccugggacccagacccggaaccagcccagauaucaccccugaggacccaugc

SEQ ID NO: 21670 - RNA, 64 nt, Human
uuguuuuuccagaguucguggagguggacugcagagcccagagcccuucaucucucugaggguc

SEQ ID NO: 21671 - RNA, 64 nt, Human
ccucccugcagagccaauggugcacauugguuuaagcccagagauccugcuugagcccuggacu

SEQ ID NO: 21672 - RNA, 64 nt, Human
gcacacauuacaggagagagcugaacguucucucagcccagagcagcaaacacaugaaagucag

SEQ ID NO: 21673 - RNA, 64 nt, Human
caucaucuugggaaagguguuugugacuuuucagagcccagauuccuguugucuauuaaaacuu

SEQ ID NO: 21674 - RNA, 64 nt, Human
gggaaauuggcgaugucacccguguacgguacgcagcccagagcagacccucaauaaacgucag

SEQ ID NO: 21675 - RNA, 64 nt, Human
cccuacagaaaaggucugccugagaggccugaggagcccagagcacuugacugagcuucccgga

SEQ ID NO: 21676 - RNA, 64 nt, Human
ucuuccgggcccugcugucaggcagcuuugcagaagcccagauggaccuggugccccugcgagg

SEQ ID NO: 21677 - RNA, 64 nt, Human
cagguucuggguguagggcccagagaagcagaacagcccagagccccaggugccuggccuggcc

SEQ ID NO: 21678 - RNA, 64 nt, Human
agagcacugcagacaggcccuggcucagaaucagagcccagaaaguggcugcagacaaaaucaa

SEQ ID NO: 21679 - RNA, 64 nt, Human
cacccuggccagcacccagcuuagugcugggacuagcccagaaacuugaaugggacccugagag

SEQ ID NO: 21680 - RNA, 64 nt, Human
cuucaaaacguuagagaaaguucuucaaaagugcagcccagagcugcugggcccacuggccguc

SEQ ID NO: 21681 - RNA, 64 nt, Human
uguuucugacacaagauccgugguuuguacucaaagcccagaauccccaagugccugcuuuuga

SEQ ID NO: 21682 - RNA, 64 nt, Human
ccuggcugccaucacucuauaaaagugcuucaugagcccagaccaaaagcccacagugaaauga

SEQ ID NO: 21683 - RNA, 64 nt, Human
gcaccccgacguagcugccccccuggggggccacagcccagagaaccagccuaggaacacucgg

SEQ ID NO: 21684 - RNA, 64 nt, Human
cuaucuggccccaacacaccugagagaauucagcagcccagacugagggucugggaugggguga

SEQ ID NO: 21685 - RNA, 64 nt, Human
uagaaaagcucuucagaaucuugucccucuguugagcccagaucucaugugcuacgaaggaaac

SEQ ID NO: 21686 - RNA, 64 nt, Human
gcuacucaggagguugaggugggaggaucacuugagcccagaaguucaaggcugcaaugagcca

SEQ ID NO: 21687 - RNA, 64 nt, Human
caacaucgcuggguggcuacggcccuccuuaggaagcccagaaggaccuuuauuauuaaaauaa

SEQ ID NO: 21688 - RNA, 64 nt, Human
cccucuaggacuggggguggggccaauccagggcagcccagagggaacauccugccacaccgcc

SEQ ID NO: 21689 - RNA, 64 nt, Human
ugagcgaggcugucuggcuugggggagaucugacagcccagaccuuucuacggcuggcagcaga

SEQ ID NO: 21690 - RNA, 64 nt, Human
auuuccuugugacacagagaagggcaaaggucugagcccagaguugacggagggaguauuucag

SEQ ID NO: 21691 - RNA, 64 nt, Human
ggcacaggaaacagcaaacaguggggugaucugcagcccagagaccuucaaaugcgaacacuau

SEQ ID NO: 21692 - RNA, 64 nt, Human
ggagaucccaccugccguaggcacauggaggaggagcccagaguugggcacuggcaaaugucuc

SEQ ID NO: 21693 - RNA, 64 nt, Human
gcuggcuuugggacuauuccaccuccuuccccugagcccagaucugcccccaccauccuuucuc

SEQ ID NO: 21694 - RNA, 64 nt, Human
ggaugugcuugggcuaugguggccauaaacccugagcccagagagcuugggucacugucaccug

SEQ ID NO: 21695 - RNA, 64 nt, Human
ccaaggcugcagcauauagaccaggaaaucagguagcccagacuggugauggagcagagucugg

SEQ ID NO: 21696 - RNA, 64 nt, Human
ccugaaaccaagcaauaccgucauguuucagccaagcccagagcccuaagauuacaaacaacua

SEQ ID NO: 21697 - RNA, 64 nt, Human
uccagccugaccuagaagcguuugucagcccuggagcccagagcgguggccuugcucuuccggc

SEQ ID NO: 21698 - RNA, 64 nt, Human
aaucuuucuucuguccucagcuugagaucuucuuagcccagagagcaguggaguugagugagga

SEQ ID NO: 21699 - RNA, 64 nt, Human
gcuagugcuaagagggaaggcccagguuugagagagcccagaggggcagagcccagagccuugu

SEQ ID NO: 21700 - RNA, 64 nt, Human
gaaggcccagguuugagagagcccagaggggcagagcccagagccuuguuuggcccugaucucu

SEQ ID NO: 21701 - RNA, 64 nt, Human
ggaaugaaggaggcugaaaguauugucuaaagugagcccagaggccacugagaaugcagauuac

SEQ ID NO: 21702 - RNA, 64 nt, Human
cggggauguguccugacacugcaauuggcaccgaagcccagagggucugggggcacaagacuga

SEQ ID NO: 21703 - RNA, 64 nt, Human
aacgaugacucugccucuugucagcccagccaagagcccagacgaccccucuguccucguuccc

SEQ ID NO: 21704 - RNA, 64 nt, Human
aaucgccugaaccugggagguggagauugcagugagcccagauugcaccacugcucucuagccu

SEQ ID NO: 21705 - RNA, 64 nt, Human
uccucugugcccucugguggcucauuguccucagagcccagacaguuccagccacuaggaggcc

SEQ ID NO: 21706 - RNA, 64 nt, Human
cccaggcccacugaagcauguuccauuucuaaaaagcccagaguucagugugucccaaggaaaa

SEQ ID NO: 21707 - RNA, 64 nt, Human
uguucugagagcagcgugggcagcaaggcagggcagcccagagguggcagcggcaggcaaucug

SEQ ID NO: 21708 - RNA, 64 nt, Human
gcuuuggcagaagagugaaagaacuccugccaagagcccagaccucuacaaacguuguaugucc

SEQ ID NO: 21709 - RNA, 64 nt, Human
ccaaaacccagccaaugggccaccucuuccuccaagcccagaugcagagauggucaugggcagc

SEQ ID NO: 21710 - RNA, 64 nt, Human
cucuuagggagcagagagcagaacuccgcagcccagcccagaggagugucaccucccaccuuug

SEQ ID NO: 21711 - RNA, 64 nt, Human
aaacggggaugcuugccccucuccaggacuauugagcccagagagagcuguccucucauugggu

SEQ ID NO: 21712 - RNA, 64 nt, Human
cuggucagcugccugcacaggcagaggugcccucagcccagauuagcaacacucauaguuuugc

SEQ ID NO: 21713 - RNA, 64 nt, Human
guguauguucacuuuguuuaaguuguauagacauagcccagaauguuuugugaagauuugcaau

SEQ ID NO: 21714 - RNA, 64 nt, Human
uucccuagagcuaguauccuaaagcugcagagcuagcccagaccucauugguuuccuuguccuu

SEQ ID NO: 21715 - RNA, 64 nt, Human
uggggcagauccccacuguccuaccaguugcccuagcccagacucugagcugcucaccggaguc

SEQ ID NO: 21716 - RNA, 64 nt, Human
uuuaucaauuaaaaaugcugugugauaaaaucccagcccagauugcucagcuguuuguaccuga

SEQ ID NO: 21717 - RNA, 64 nt, Human
ggcucuggggagcugggcuaggaagaggaggugcagcccagacucuuccuagccuuucuaaacc

SEQ ID NO: 21718 - RNA, 64 nt, Human
ucuccccaggaaguggcucagaccccucagccccagcccagacaaagaugucuuaaccucaggg

SEQ ID NO: 21719 - RNA, 64 nt, Human
auaaagauagcaagcuaccuuccaaggccgagccagcccagagaggagcaugucuuccuuuacc

SEQ ID NO: 21720 - RNA, 64 nt, Human
aaccccaguucuggccacguacagccagcgggucagcccagaggcagccucagcuccagggcua

SEQ ID NO: 21721 - RNA, 64 nt, Human
uccagaggaggggacuuguaggaaucugccuuccagcccagacccccaguguauuuuguccaag

SEQ ID NO: 21722 - RNA, 64 nt, Human
cuaggucagagguggggacagagaacuccccuacagcccagagauguggcagggcucagagaag

SEQ ID NO: 21723 - RNA, 64 nt, Human
ccuucucaccucuggagcugugcugcacugcuucagcccagagggcccugagagaggagcgugc

SEQ ID NO: 21724 - RNA, 64 nt, Human
cugcucaggauuccuguugaggagaugccucccuagcccagauggcaccuggacaccaggaugg

SEQ ID NO: 21725 - RNA, 64 nt, Human
cacuggaaaucucuguggucugcaagugcuucccagcccagaacagggguggauuccccaaccu

SEQ ID NO: 21726 - RNA, 64 nt, Human
ccuuuuauguguaguugucucucuucagacucucagcccagaagaaaauucuccugauaaaaca

SEQ ID NO: 21727 - RNA, 64 nt, Human
cuccaagugcuuguuauauaccuccacgggugucagcccagaugacuccucacccauccaccac

SEQ ID NO: 21728 - RNA, 64 nt, Human
cacaaaaaucaauaaacacugugauugcacucccagcccagaucagcauuuuuagccaucucaa

SEQ ID NO: 21729 - RNA, 64 nt, Human
gagcugcacucuuaacaucaagagaacugucaggagcccagaaccaaccccaggucuuggucuc

SEQ ID NO: 21730 - RNA, 64 nt, Human
ccucauugggcucccagacgugcuggaaagguugagcccagaguggccgaggcuggacccugug

SEQ ID NO: 21731 - RNA, 64 nt, Human
uuccuccucaaugcccaagguaaugugggacuaaagcccagaaauuugaaaagaauauucagaa

SEQ ID NO: 21732 - RNA, 64 nt, Human
gaaugugcaaagcaguauguacaggcugagacacagcccagagacugaacggcaaucuuuccac

SEQ ID NO: 21733 - RNA, 64 nt, Human
uucuauucugaucuuauucuguggugucuuuugcagcccagacaaaugugguuacacacuuuuu

SEQ ID NO: 21734 - RNA, 64 nt, Human
gaccuggcccauguggagcuggcaugggggacacagcccagagacagagaagcuuaugaggaag

SEQ ID NO: 21735 - RNA, 64 nt, Human
cccagcccccugccccggcccugcuccagaacccagcccagaucggaggacaaguuccucucua

SEQ ID NO: 21736 - RNA, 64 nt, Human
cccaacuccagaacccaacccuucucuagaauccagcccagaucugaggccaagcuaugugcua

SEQ ID NO: 21737 - RNA, 64 nt, Human
gcacagagagggacccugggaacuuggccugggaagcccagagcaggaagccacagcugucucu

SEQ ID NO: 21738 - RNA, 64 nt, Human
gccaucgccauugggaaggggcgacuccacggaaagcccagacgggcuucugcauccauucccu

SEQ ID NO: 21739 - RNA, 64 nt, Human
acaggccugagauuucaucugcucuccuuccuggagcccagaggagggcagcagaagggggugg

SEQ ID NO: 21740 - RNA, 64 nt, Human
guggccuucugaggaccccgagcggcgcugccggagcccagagcgcgcgucgaaccgucggccc

SEQ ID NO: 21741 - RNA, 64 nt, Human
acuuaccaacuggaaaauuuuaugcaucccaugaagcccagauacacaaaauuccaccccauga

SEQ ID NO: 21742 - RNA, 64 nt, Human
cacaaauagacgagaggauauuuagggcuagaugagcccagauuucuucccccuccaucucuca

SEQ ID NO: 21743 - RNA, 64 nt, Human
cgaauauuaugcccaguuucugccucugagggaaagcccagaaaaggacagaaacgaaguagaa

SEQ ID NO: 21744 - RNA, 64 nt, Human
gacccugacccggcccccuucaccccuucagccgagcccagaccuccccucuuccuggagcccc

SEQ ID NO: 21745 - RNA, 64 nt, Human
cagccuggcaggcaggaaacagacauaggaccccagcccagaucugaauggcaugggaggugcu

SEQ ID NO: 21746 - RNA, 64 nt, Human
agggaagggacuucauuuccaggggccacagccaagcccagagucccccagcggcucgcauguc

SEQ ID NO: 21747 - RNA, 64 nt, Human
gccaagcccagagucccccagcggcucgcaugucagcccagaccccaggguccuuggccuagga

SEQ ID NO: 21748 - RNA, 64 nt, Human
aaucgcuugaacccgggagguggagauugcagugagcccagaucgcaccacugcacuccagucu

SEQ ID NO: 21749 - RNA, 64 nt, Human
ugacacagacaccggacaaaccauugucuuggggagcccagaagagaaagugggcagggugggg

SEQ ID NO: 21750 - RNA, 64 nt, Human
gaguuaguuaggcauugaguuugcccugggcaaaagcccagaagugggaguaugugguauaucu

SEQ ID NO: 21751 - RNA, 64 nt, Human
ggauaagcaauaccuauuucugacugagucucccagcccagacccagggacccuuggccccaag

SEQ ID NO: 21752 - RNA, 64 nt, Human
gaaagaaaacaaaaccaacaguuaguggagucaaagcccagacacuguaaauagaacccccucc

SEQ ID NO: 21753 - RNA, 64 nt, Human
ugagaucaacaguuucuuagccauagagauucacagcccagagcaggaggacgcugcacaccau

SEQ ID NO: 21754 - RNA, 64 nt, Human
agcugccuccaguagacaucacugaaccccagccagcccagaccccugacacagaccacuagaa

SEQ ID NO: 21755 - RNA, 64 nt, Human
gauaccagcauguacauagaacuuccaaaugcugagcccagauccaaaguugucuucuguccac

SEQ ID NO: 21756 - RNA, 64 nt, Human
guggcuuccauucagaagaagaaaggccuuuucuagcccagaagggugcaggcugagggcuggg

SEQ ID NO: 21757 - RNA, 64 nt, Human
caugugguucuucuugccugcuuuucugcugcuuagcccagaacggacaccugccaugcccacc

SEQ ID NO: 21758 - RNA, 64 nt, Human
uaaaucuccgguaacccguccaccuggccgaggcagcccagagcagcgggaugagcuggcggcc

SEQ ID NO: 21759 - RNA, 64 nt, Human
agcuccgucagcuccguccuuguccuuagagcugagcccagaccccggggucuggccgaauccu

SEQ ID NO: 21760 - RNA, 64 nt, Human
ugcugaccuguuccuugagcucccccauaucagcagcccagaguguggguccccugucaggcca

SEQ ID NO: 21761 - RNA, 64 nt, Human
cuccaagagggcagcgcucccaguggugggacucagcccagacugcccuggggcagcuuccugg

SEQ ID NO: 21762 - RNA, 64 nt, Human
aggagguugucagggacacacagcagggggaggcagcccagaucccugcucaugcgugguuugg

SEQ ID NO: 21763 - RNA, 64 nt, Human
ugagccacaggaacaaugauggagauuccagcuaagcccagaccccguggauucuagauagauu

SEQ ID NO: 21764 - RNA, 64 nt, Human
gcggguguugcgggucccuccuucacagccgcugagcccagaggucccgcuggccccuccucug

SEQ ID NO: 21765 - RNA, 64 nt, Human
cccugggacuuccugcucaucauaguacccagugagcccagagauccuacuagacugggucagc

SEQ ID NO: 21766 - RNA, 64 nt, Human
cccaccccacccuccaggguuagggggagcaggaagcccagauaaucagagggacagaaacacc

SEQ ID NO: 21767 - RNA, 64 nt, Human
accagcucuauuugggggaaguguagugaggaggagcccagaggaccccaggggagugaggagg

SEQ ID NO: 21768 - RNA, 64 nt, Human
gcacuuggggaggccaaggcgggaggaucgcuugagcccagagguucgagaucaaccugggcaa

SEQ ID NO: 21769 - RNA, 64 nt, Human
gccagcaggagggacugaggcccucuaggaggaaagcccagagggagggggcccucauuccuuc

SEQ ID NO: 21770 - RNA, 64 nt, Human
aauuauacuuuauucaggugaugguuacaugaacagcccagacuucaccacuacgcaauauauc

SEQ ID NO: 21771 - RNA, 64 nt, Human
caggucucucaacuucaucaguguggcuucuaugagcccagaucaccaccugaacguucugucu

SEQ ID NO: 21772 - RNA, 64 nt, Human
caucaaauguaauauugaaauaccaauauuauauagcccagaaacuauaauaacauaaaguuca

SEQ ID NO: 21773 - RNA, 64 nt, Human
gcccaggcauccucaagcucuggacacccacuugagcccagauuccuggaagagcagagggcug

SEQ ID NO: 21774 - RNA, 64 nt, Human
agggcccagaaagucugaucucuccagaaugaucagcccagaggaaugcugagaaaucaccugg

SEQ ID NO: 21775 - RNA, 64 nt, Human
gaaagaugguguggguguccugccugucugccccagcccagauuccccugugucaucccaucau

SEQ ID NO: 21776 - RNA, 64 nt, Human
gcuuucacaccuguaugauagucauggaaacugaagcccagagagguuaagaaauuugcuagga

SEQ ID NO: 21777 - RNA, 64 nt, Human
cgcagccacacaguggccggggcugaagccacacagcccagaaggccagaaaaggcagccagau

SEQ ID NO: 21778 - RNA, 64 nt, Human
augguggcaggagagagauggcugaagccugagcagcccagagucccgcuggucuaggcuggug

SEQ ID NO: 21779 - RNA, 52 nt, Human
caguccaggaaugggugugagcagcccagagcccucucuauccacuuggucu

SEQ ID NO: 21780 - RNA, 64 nt, Human
aaaacacacguaccauuggcuguaaaacaguaugagcccagacugacgcugaaaucccucauga

SEQ ID NO: 21781 - RNA, 64 nt, Human
accuugggcugcucagacccuccagaugagguccagcccagaucugagaggaacccuggaaaug

SEQ ID NO: 21782 - RNA, 64 nt, Human
acagcagcaccagcccuguggggcauggaguggaagcccagaagggcuucugcaagcugcacag

SEQ ID NO: 21783 - RNA, 64 nt, Human
cuaaucuauuuaucaaaacugacuacuggaccggagcccagaaaccaugggucaaguuacacgu

SEQ ID NO: 21784 - RNA, 64 nt, Human
aaauucagauugcaugaauucaggucaguaguauagcccagaaaauuuaaggaaauauauuauu

SEQ ID NO: 21785 - RNA, 64 nt, Human
gaugugggcaggagggguggugaaggccucccccagcccagacccuguggucccuccugcagug

SEQ ID NO: 21786 - RNA, 64 nt, Human
caacaacuucaucaucgcuguuaaggacccucggagcccagaugcagcuggagccaccauccug

SEQ ID NO: 21787 - RNA, 64 nt, Human
ggcaccugggagagcuuccagaauccucgcagacagcccagagccugccgcuacccucggccug

SEQ ID NO: 21788 - RNA, 64 nt, Human
cuccuucaggagcucucuacccaggggcaaggagagcccagagagaagcgcccuggucucuuga

SEQ ID NO: 21789 - RNA, 64 nt, Human
aacugcacuaaacauuugucaugcuguaguugccagcccagaauauuagaaguuacaagacuga

SEQ ID NO: 21790 - RNA, 64 nt, Human
gugggugggcaggacuggaacucgguucuccaacagcccagagcucacucuuuuacacccagag

SEQ ID NO: 21791 - RNA, 64 nt, Human
uuccauuccuccuccucuaggggugcagcuuuggagcccagaggugcgggauucugaccaacgg

SEQ ID NO: 21792 - RNA, 64 nt, Human
ugucagcacucagguagggagcuaaggaagacacagcccagacaagauggcuggaaggagccag

SEQ ID NO: 21793 - RNA, 64 nt, Human
cuuucucaacguuccuaauccuuugcaucauaguagcccagacacauuuucuggguccugaaga

SEQ ID NO: 21794 - RNA, 64 nt, Human
auggaugagagggaaccacuauaacaugaguccaagcccagaagacuucugucuauacaauauu

SEQ ID NO: 21795 - RNA, 64 nt, Human
cgggugggcugcucagggcagcugccgaagguggagcccagagccugucuggaagggcugucug

SEQ ID NO: 21796 - RNA, 54 nt, Human
aagauuguccgccugucugaggggagcccagaggcacauccggacaaguuucag

SEQ ID NO: 21797 - RNA, 64 nt, Human
gcucugacgggugggcucugccagagcccgggugagcccagaaaggaagacagcagccaccguc

SEQ ID NO: 21798 - RNA, 64 nt, Human
cuggcuccgaggacacggguggcaggcccguugcagcccagagccacuggucccuacagggcgc

SEQ ID NO: 21799 - RNA, 64 nt, Human
cugacugucaggauaaacuccguggggguacaggagcccagacaaagcccaggccugucaagag

SEQ ID NO: 21800 - RNA, 64 nt, Human
uuucagauacgaaugagaagacaaguuuggacauagcccagaaaauaugcuauuauuucauaga

SEQ ID NO: 21801 - RNA, 64 nt, Human
aaagccaccaacagccacucagaaaagacgcaccagcccagaagugcagaacugcagucacugc

SEQ ID NO: 21802 - RNA, 64 nt, Human
cacuuggcccugagccccugcgugcccuugcggaagcccagaagcuucuuccugcugcaccucc

SEQ ID NO: 21803 - RNA, 64 nt, Human
gaagaggcucagacagcaggcuccggggccacgcagcccagaccacaccugccacggucuucca

SEQ ID NO: 21804 - RNA, 64 nt, Human
cuuuguauagaaggauuuugcuaagggggcaaaaagcccagauaccauuuuaacuggcccaguu

SEQ ID NO: 21805 - RNA, 64 nt, Human
acucauuaaugaaucguucaacuccacucacugaagcccagaccuccgugcccaggcccaaucu

SEQ ID NO: 21806 - RNA, 64 nt, Human
cuguacccaggucaggcuguccacaccacaugggagcccagaggaggaggggcccgccuuagcc

SEQ ID NO: 21807 - RNA, 64 nt, Human
aauguuuaugcagucaaggccaaagccugcccugagcccagacacaccuggguccccauucugg

SEQ ID NO: 21808 - RNA, 64 nt, Human
cagaaggcuucccuggugcucucaguccaggcaaagcccagagcaucugagcacgucucugacu

SEQ ID NO: 21809 - RNA, 64 nt, Human
cugaugccagcaugucacugguuuugaagggaugagcccagacuugauguuuugggauuguccu

SEQ ID NO: 21810 - RNA, 64 nt, Human
ccuacugccacagggucaaaggagguuuucgaucagcccagaccagaggcucugagcccugaac

SEQ ID NO: 21811 - RNA, 64 nt, Human
gcuacuugggaggcugaggcaggaggaucacuuaagcccagaaggcagagguuguagugagcug

SEQ ID NO: 21812 - RNA, 64 nt, Human
aucucacgaagaaucccucacucuucccggguucagcccagaagcccuuccaggcaugaucuuc

SEQ ID NO: 21813 - RNA, 64 nt, Human
aguccgcguguugcuggagggacacguguauuggagcccagaagaggggcuguguggccuggga

SEQ ID NO: 21814 - RNA, 64 nt, Human
guguaagggcuuggggucuuagaagcugcucuuuagcccagauacacauacucuuuuuugucuu

SEQ ID NO: 21815 - RNA, 64 nt, Human
agcggcagccaccaccaguguuguuuugaauaaaagcccagaagccuauuuaagaauuucuccg

SEQ ID NO: 21816 - RNA, 64 nt, Human
ccccggccccagggcccaccacauaaaaucugggagcccagagcugcugagguguggucagcuc

SEQ ID NO: 21817 - RNA, 64 nt, Human
ggcaccugucaggacagaacagcagcagcgcuacagcccagagguuauacauuucaacagaaca

SEQ ID NO: 21818 - RNA, 64 nt, Human
cauggagccccgaauugacccucacugccuccaaagcccagagccugccugucagcccagcugg

SEQ ID NO: 21819 - RNA, 64 nt, Human
uguggaaaggcccauuuccagguuugcguagaagagcccagaaaacagagucucaagacccccg

SEQ ID NO: 21820 - RNA, 64 nt, Human
cagagcugggauggccacugagagccccagugacagcccagaagaugguccaggccugaguccc

SEQ ID NO: 21821 - RNA, 64 nt, Human
cgagacagcccaacucccccagcccagcucccccagcccagagccagggaagaggaaggugggg

SEQ ID NO: 21822 - RNA, 64 nt, Human
gcuggaggacagaggggcaccucagccgcccccaagcccagagcacagcaauaaggucggccug

SEQ ID NO: 21823 - RNA, 64 nt, Human
aagggaccucuguggcuccagcugccaacccuggagcccagaccgagguggccauggagacucc

SEQ ID NO: 21824 - RNA, 64 nt, Human
aaucgucuaagcccgggagguggagguugcagugagcccagauggcgcugcugcacucaagcuu

SEQ ID NO: 21825 - RNA, 64 nt, Human
ucagcugcccacagcccucuugccugaccccugaagcccagaacucugaucuucacagcccuag

SEQ ID NO: 21826 - RNA, 64 nt, Human
aguuggcauuuuuucuagaaccugaucguccacuagcccagaguguguguguucaacccccaca

SEQ ID NO: 21827 - RNA, 64 nt, Human
uugccccaccccugccugccaccugggcccucacagcccagacccucacugggaggugagcuca

SEQ ID NO: 21828 - RNA, 64 nt, Human
aucugccuggugucaaucagcuagcaagugauggagcccagauuucaaaccaaaggggguuacg

SEQ ID NO: 21829 - RNA, 64 nt, Human
ucaccuacggcuguggccgugcaggccuccuuccagcccagaguggcccaguagagcaaggcag

SEQ ID NO: 21830 - RNA, 64 nt, Human
ucccuggacuucaacccuccuguuguuuggccuuagcccagagggagcugcucaccugagcacc

SEQ ID NO: 21831 - RNA, 64 nt, Human
aacaugccuacuacuaccagcagaaagggagcagagcccagagcaucaccaggagugccugcua

SEQ ID NO: 21832 - RNA, 64 nt, Human
gucuuuauuuauggucgugcccuucccucuccucagcccagaguguucugcguggguggugaug

SEQ ID NO: 21833 - RNA, 64 nt, Human
ugcccauugccugcuugaggggcaccacuacuccagcccagaaggaaaggggggcagcucagug

SEQ ID NO: 21834 - RNA, 64 nt, Human
cugcauaacuacauaaacagcagagguguuuaagagcccagaaaaacauaauuugauuuuaaca

SEQ ID NO: 21835 - RNA, 64 nt, Human
ucaaccugccuccccuccauagucuuguuggagaagcccagagagaaugggacuccaacuaagg

SEQ ID NO: 21836 - RNA, 64 nt, Human
cuuuauguguuuuugcuuggggggcgcugggccuagcccagaguagugcuugcucccccugccu

SEQ ID NO: 21837 - RNA, 64 nt, Human
cuuuacagaauugaaucuagagucuuccccgaaaagcccagaaacuucucugcaguaucuggcu

SEQ ID NO: 21838 - RNA, 64 nt, Human
guugagacaaaaaauacaguagagacagaaacgaagcccagaacaaagaugaaacuugaauuac

SEQ ID NO: 21839 - RNA, 64 nt, Human
cgagccagucuaugcccuuucuccaguaggccccagcccagaccucuucggcuucaggaacuug

SEQ ID NO: 21840 - RNA, 64 nt, Human
caggcaagagaauugaaaugaggugccacccaguagcccagagugagcuuuagcucucucuaga

SEQ ID NO: 21841 - RNA, 64 nt, Human
aagaccccaucuggggacuugagacuuuggucccagcccagacuccucagacuuuucucucagu

SEQ ID NO: 21842 - RNA, 64 nt, Human
ggucugaguccuagagauuacauaaauaguguguagcccagaaaaguaaaauaggugucacgcu

SEQ ID NO: 21843 - RNA, 64 nt, Human
ugcccauuguuuuaacuugugugaaacaauacaaagcccagaaauucuuuucggggcaugagua

SEQ ID NO: 21844 - RNA, 64 nt, Human
aacuggccgcgggggcaggggaggccaucuggagagcccagaguccccccacucccagcaucgc

SEQ ID NO: 21845 - RNA, 64 nt, Human
aacaguugccccagaaagacaugucuuguuuuaaagcccagaaccugaaauuauuauagauuuu

SEQ ID NO: 21846 - RNA, 64 nt, Human
agaccaaaaugacaaugaugaugauaaugaugaugacgacgacaacgaugaugcuuguaacaag

SEQ ID NO: 21847 - RNA, 64 nt, Human
agacacacuccaccuccagcacgcgacuucucaggacgacgaaucuucucaaugggggggcggc

SEQ ID NO: 21848 - RNA, 64 nt, Human
cugucugucuuacacauuuauaaggacccugcaagacgacgacaaaggccuuuggccugugcua

SEQ ID NO: 21849 - RNA, 64 nt, Human
ucaggcucggagggaagguuucccuuuauaugaagacgacgaaggaagagcaaggccaucugag

SEQ ID NO: 21850 - RNA, 64 nt, Human
cuuggccaacguuaccucagccaccugggacuucgacgacgaggcauucgaugagaucuccgac

SEQ ID NO: 21851 - RNA, 64 nt, Human
auacauguuuaaauacaaaauaauuaugggccaugacgacgauuaauauuaaaacugugauuuc

SEQ ID NO: 21852 - RNA, 64 nt, Human
gcgcuccgcugaaggggcaggggcuaggcugggagacgacgaaggaacaggcguuucugacgag

SEQ ID NO: 21853 - RNA, 64 nt, Human
aaaaaaacaaaaaaaaaaaaaaaaaaaacaagaugacgacgacaaccacaaaaaaaauugacau

SEQ ID NO: 21854 - RNA, 64 nt, Human
uguggccucugcuuccuccguccuccugcccaaggacgacgaggauugcuccagggcugcuggg

SEQ ID NO: 21855 - RNA, 64 nt, Human
ccccucccucccccuccuccccucuuuuacucuagacgacgaauaaagcccuguuagaggaugc

SEQ ID NO: 21856 - RNA, 64 nt, Human
uuaguauaauuccucucacuuacugaaauacaacgacgacgacugcaaaguguaugcacaccgc

SEQ ID NO: 21857 - RNA, 64 nt, Human
uuuaacuauugucaggagauugggcuaaagagaagacgacgagaguaaggaaauaaagggaauu

SEQ ID NO: 21858 - RNA, 57 nt, Human
auccgggacugucugauugaggacagugacgacgaggcgggccagagcugagcguga

SEQ ID NO: 21859 - RNA, 64 nt, Human
aguccaggccccugaugcuccaaccucccggggggacgacgaugacaaugugaaaccaucacag

SEQ ID NO: 21860 - RNA, 64 nt, Human
ggagugucacaucucugccuggaacuucuaccaggacgacgauuucaggugcucacagcggcac

SEQ ID NO: 21861 - RNA, 64 nt, Human
cuuuuugucacacaggauggcaugugauccucaagacgacgaacaaugaacuaaagccaaaugc

SEQ ID NO: 21862 - RNA, 64 nt, Human
gggcacagcguggcuacagagggucucccucgaugacgacgacgacgacgccaccaccccagcc

SEQ ID NO: 21863 - RNA, 64 nt, Human
cacagcguggcuacagagggucucccucgaugacgacgacgacgacgccaccaccccagccccc

SEQ ID NO: 21864 - RNA, 64 nt, Human
agcguggcuacagagggucucccucgaugacgacgacgacgacgccaccaccccagcccccguc

SEQ ID NO: 21865 - RNA, 64 nt, Human
cucccuucccacacagcccauggagguguuuguggacgacgagaccaagcucacgcugcacggc

SEQ ID NO: 21866 - RNA, 64 nt, Human
cggcauugaccggccggcggagcucuccaaggaggacgacgaguaugaggcguuccgcaagagg

SEQ ID NO: 21867 - RNA, 64 nt, Human
ggagagacuugcuuuuguugguuccgcccguggagacgacgauaguguuucuguauaauaaagu

SEQ ID NO: 21868 - RNA, 61 nt, Human
gcacuccggccuaggcaacgagagcaaaacuccaauacaaacaaacaaacaaacaccugug

SEQ ID NO: 21869 - RNA, 61 nt, Human
gucagucuggcacguaagaugaacaucccuaccaauacagagcucaccaucucuuauacuu

SEQ ID NO: 21870 - RNA, 61 nt, Human
aucaagaaucuucuguuccacauccacacagccaauacaauuagucaaaccacuguuauua

SEQ ID NO: 21871 - RNA, 61 nt, Human
aguuuguuaauugccuguuacuaguacuugaccaauacauugugcuauauguaaaugugua

SEQ ID NO: 21872 - RNA, 61 nt, Human
ggucuguuuauuagcaaauuuccuauuuguuccaauacaaacucacuuuauucuaaaguau

SEQ ID NO: 21873 - RNA, 61 nt, Human
ucuuugcacaggaaccugugguuuuaacaaaccaauacacauauugaagaagucauuuuaa

SEQ ID NO: 21874 - RNA, 61 nt, Human
cuccuguuggauggugaggucacuccauaugccaauacaaacaacaaugcgguggauugca

SEQ ID NO: 21875 - RNA, 61 nt, Human
ugacuuaguauauuuguaauugguuuuaaaaccaauacaccauacuuucuuucugcaaaca

SEQ ID NO: 21876 - RNA, 61 nt, Human
gacugcauaggacagaucccaucuccuccacccaauacauuauuagacugaacugugaccu

SEQ ID NO: 21877 - RNA, 61 nt, Human
caugccacaucuguauauagaugggguuuuuccaauacagcugguucgugauaaacugcau

SEQ ID NO: 21878 - RNA, 61 nt, Human
auuuguucuuuuacagaauucuguagcaaagccaauacaaaaaucagcuaaagcugccaca

SEQ ID NO: 21879 - RNA, 61 nt, Human
ucccagcauguacucacugugggcagaugcaccaauacaugguaauccucuuacucauuuu

SEQ ID NO: 21880 - RNA, 61 nt, Human
uugagaggugguuuagggauuuuggcccuaaccaauacauugaauguaugaugacuauuug

SEQ ID NO: 21881 - RNA, 61 nt, Human
gccucuccuacuguguaggagccuccgcuucccaauacagccgugucugcagccacugccu

SEQ ID NO: 21882 - RNA, 61 nt, Human
cuguccccuuuccacuuccccagcuucugccccaauacacauaccucccuuaagccaggau

SEQ ID NO: 21883 - RNA, 61 nt, Human
aacuuugacuacuuccugucuuaguaauagaccaauacauggcucuauuuagcaaaguuuu

SEQ ID NO: 21884 - RNA, 61 nt, Human
cugcauuuguaucuugcaaguuuguauaaacccaauacaggaaauaaaaugaaugguuugu

SEQ ID NO: 21885 - RNA, 61 nt, Human
guuuuagaguguucagccugaccccgccucaccaauacacggacacaaccaaaucauaaca

SEQ ID NO: 21886 - RNA, 61 nt, Human
agacggagucuugcucugccacugugcccggccaauacauuauuauuaacuuaaggcugua

SEQ ID NO: 21887 - RNA, 61 nt, Human
agcacuguuuggauaugagauguagcaaauuccaauacauuauuggacuuccauuuggaau

SEQ ID NO: 21888 - RNA, 61 nt, Human
ggaagagugugugugucuacacaggauaaacccaauacauauuguacugcucagugauuaa

SEQ ID NO: 21889 - RNA, 61 nt, Human
uuuuccccuaugagaagauauuuugaucuccccaauacauugauuuugguauaauaaaugu

SEQ ID NO: 21890 - RNA, 61 nt, Human
acaaaaagaucaccacacuucuaaauaaagaccaauacaauucuaauaguaaagauugaaa

SEQ ID NO: 21891 - RNA, 61 nt, Human
gagcuuacauucuacagggagaaagagauagccaauacauaggaauaaauauauacaaggu

SEQ ID NO: 21892 - RNA, 61 nt, Human
aggaaaaaacacuacuguaaauugugaauagccaauacauaacuguauuguaugcaaaucu

SEQ ID NO: 21893 - RNA, 61 nt, Human
acaauauccccuugaagggacagcucagcugccaauacauucaacccuuucucuuccuuca

SEQ ID NO: 21894 - RNA, 61 nt, Human
uucugauuugauaacuacccaaaccaaacaaccaauacauacaugggaagagaggcccugu

SEQ ID NO: 21895 - RNA, 61 nt, Human
agguaugcaguacagcaguauagaauccaugccaauacagagcauagggaaagguccacuu

SEQ ID NO: 21896 - RNA, 61 nt, Human
cacaucugaacugggacuguuaacacugaugccaauacaguguggggugccagaaaguguc

SEQ ID NO: 21897 - RNA, 61 nt, Human
uuuccugucaucuccucuuuacuggauuguaccaauacauuuuagaagugaacuggacuug

SEQ ID NO: 21898 - RNA, 61 nt, Human
cuucucauccuggagcguauucaagaucuucccaauacaagaaaauuaauaaaaaauuuau

SEQ ID NO: 21899 - RNA, 61 nt, Human
aaaucauuuguguccuacuauuggacuuaucccaauacagauguguguguuuuucuggagg

SEQ ID NO: 21900 - RNA, 61 nt, Human
cugacuuuauucauauuuccaucaaacuucuccaauacaguaagagauaguguugaaccag

SEQ ID NO: 21901 - RNA, 61 nt, Human
uagaaauacaauucuuuuuaaauuuuuaggaccaauacaaaauaacaaaaauguaauggaa

SEQ ID NO: 21902 - RNA, 61 nt, Human
ugugugagaaaaacuaacuugauagggucuaccaauacaaaauguauuacgaaugccccug

SEQ ID NO: 21903 - RNA, 61 nt, Human
acauuugggauuuacuuuucuccaauaccugccaauacagaaaacuauuaucaguuguuau

SEQ ID NO: 21904 - RNA, 61 nt, Human
agggucacuuugaauugugcacauaagaaaaccaauacaaaaaacaauuuguauucaauau

SEQ ID NO: 21905 - RNA, 61 nt, Human
uggcaauaucauauucuaaaaguaauaaauuccaauacaaguuacauacauuuaaaaaaca

SEQ ID NO: 21906 - RNA, 61 nt, Human
ggaggcuuggagcuauuaguuaaucuaucuuccaauacacuguuuaauauagcacugaaua

SEQ ID NO: 21907 - RNA, 61 nt, Human
cucagcucucuucccugggggcagauauuucccaauacauaccacuuugaauaggaugaua

SEQ ID NO: 21908 - RNA, 61 nt, Human
cccuccagguggggcuggagccugcuggcgcccaauacaaaacccauacauccaggugggu

SEQ ID NO: 21909 - RNA, 61 nt, Human
ggugggcggggccccgcccacagggccgaccccaauacaccagcgacucaaccuugaugcc

SEQ ID NO: 21910 - RNA, 61 nt, Human
uuacagcuuauuuuuuucuacauaauugugaccaauacauuuguauuuugugaugaaucua

SEQ ID NO: 21911 - RNA, 61 nt, Human
auaacgaugaaaaauaauacaaauuuaaaaaccaauacaguauaacaacuauuuacauagu

SEQ ID NO: 21912 - RNA, 61 nt, Human
aaagacuugagaagucuaauucacaggcaaaccaauacagaauugacugcaguugaacaga

SEQ ID NO: 21913 - RNA, 61 nt, Human
ggaaaaaaauauauaauuuucucacaaacaaccaauacauaaccuauggcaguugguugaa

SEQ ID NO: 21914 - RNA, 61 nt, Human
uuuaagaauauuaacaauauauuaacaaacaccaauacaacuaauccuauuugguuuuaau

SEQ ID NO: 21915 - RNA, 61 nt, Human
auauguagagaugcaaauuauuaaguuguuuccaauacaauaaauaaaagcaucuguuuuu

SEQ ID NO: 21916 - RNA, 61 nt, Human
gggaaauucucuccuucuguuggcugggugcccaauacaacaaaaaggcagaggaaaggca

SEQ ID NO: 21917 - RNA, 61 nt, Human
guaaaccaugucaucuuuacaauguugucuuccaauacaugaauaugguacagcucuucau

SEQ ID NO: 21918 - RNA, 61 nt, Human
aaggcaaauaaugucuccauagaaucacuuuccaauacaacggcucuuuucagagccaccu

SEQ ID NO: 21919 - RNA, 61 nt, Human
ucuuuauucccacguucgcccuuuguucaguccaauacaggguuguggggcccuuaacagu

SEQ ID NO: 21920 - RNA, 61 nt, Human
aacguaccuucaccccagccacaugccccagccaauacaaauuggaaaaucuggcccauuu

SEQ ID NO: 21921 - RNA, 61 nt, Human
ccaaauaacaguagugaggguuagaguccugccaauacagcuguugcauuuuccccaccac

SEQ ID NO: 21922 - RNA, 61 nt, Human
aaauccuauauagucuuauucaccaauauauccaauacacccacagcaaugguaccuuuuu

SEQ ID NO: 21923 - RNA, 61 nt, Human
ggacuguuagcccuauugagagcaaggcuuuccaauacauaaauagugucuguuucuuaga

SEQ ID NO: 21924 - RNA, 61 nt, Human
gaagaggacgcaggcuuccagaggacaaaccccaauacaggagaagcacaagacagagaag

SEQ ID NO: 21925 - RNA, 61 nt, Human
agaauuuuuuaaugccauccucauuaguuuuccaauacaauauaaguugaaacaauguaca

SEQ ID NO: 21926 - RNA, 61 nt, Human
gugacucucagugucccccugauggccguuaccaauacaacacugaugugguguuugauuc

SEQ ID NO: 21927 - RNA, 61 nt, Human
uacaguuuucaaaaaaucaagacaaguaggcccaauacaaacuacugaaucaucuucuaau

SEQ ID NO: 21928 - RNA, 61 nt, Human
acauauauaaggagauaaaguuucccauuuuccaauacaguuucacauuugaacagcccua

SEQ ID NO: 21929 - RNA, 61 nt, Human
augggccccugggugcccagccuccccuccuccaauacauucucugauaaucugaccuugu

SEQ ID NO: 21930 - RNA, 61 nt, Human
uguaaauugcgauaaggaaauguacugauugccaauacaccccacccucauuacaucauca

SEQ ID NO: 21931 - RNA, 61 nt, Human
cacaucucacaaaaucuugacaucuuacauuccaauacauuaucaagcaagcacaaguaug

SEQ ID NO: 21932 - RNA, 61 nt, Human
gccauugcuuaaaauauaacauguuuuggauccaauacacacauuguuacaacuaacacaa

SEQ ID NO: 21933 - RNA, 61 nt, Human
gugacuuuucuuauauuaauaauauuuacauccaauacacugaaucuuccuuuagagguaa

SEQ ID NO: 21934 - RNA, 61 nt, Human
uuccaauagaaagaaacuaaacagaaaacucccaauacaaagaugacuggucccucauagc

SEQ ID NO: 21935 - RNA, 61 nt, Human
gcacuugcaagaaauauaacccucccuucccccaauacacagaaccaccgccaccaccacc

SEQ ID NO: 21936 - RNA, 61 nt, Human
ucaguccagucaagaaaagaaccuaauagcaccaauacaaauugaggacuuaauuuacuuu

SEQ ID NO: 21937 - RNA, 61 nt, Human
uagcauuuucaaugugauauaaacagcuucuccaauacagcaaaccuaauugcacaacaga

SEQ ID NO: 21938 - RNA, 61 nt, Human
ugacgucaagugaucugccugccuuggucucccaauacaggcaugaaccacugcacccacc

SEQ ID NO: 21939 - RNA, 61 nt, Human
uaguuacuaguaguaguauucuuacuaagacccaauacaaauggauuauuuaaaccaaguu

SEQ ID NO: 21940 - RNA, 61 nt, Human
agugggcgcgggucacggcugacuccaacuuccaauacaacagccaucacuagcacagugu

SEQ ID NO: 21941 - RNA, 61 nt, Human
cccugagcagaauacuggucucaggccaagcccaauacagccauuaaagaugaccuacagu

SEQ ID NO: 21942 - RNA, 61 nt, Human
auucagcuuuguccaaaggaaagcuuaaaacccaauacagucuaguuuccugguuccguuu

SEQ ID NO: 21943 - RNA, 61 nt, Human
uuuucuuaccuuauugcacugguuagcaaccccaauacagagaccaccagaucagguauag

SEQ ID NO: 21944 - RNA, 61 nt, Human
cuacugcugugaggccauagguacuagacaaccaauacaugcaggguuggguuuucuaauu

SEQ ID NO: 21945 - RNA, 61 nt, Human
aacaaaagaguaguggggagagaaaaacaauccaauacauauuuuucucucagaauagaaa

SEQ ID NO: 21946 - RNA, 61 nt, Human
caguacaauguuuggauucuccuugauauuaccaauacauuuucccuguuaucuugcacug

SEQ ID NO: 21947 - RNA, 61 nt, Human
ggaaaugcagccauagagggccugaugacauccaauacagaguucugguaaagauaaaauu

SEQ ID NO: 21948 - RNA, 61 nt, Human
agauaauucagcauuggcguauuugcuugucccaauacaagaaugccaaaggaggaaacag

SEQ ID NO: 21949 - RNA, 61 nt, Human
ggcuaucaggccaaaauucauuauuguauuuccaauacaguuugucuugaaugucugucuc

SEQ ID NO: 21950 - RNA, 61 nt, Human
cagauaagauuuuuaccuggaaauuccaugaccaauacaugugcaaaagaaaaugaugggu

SEQ ID NO: 21951 - RNA, 61 nt, Human
uucucuuuuuuagggaacauuaagcaaaaucccaauacacagagucugucacagacaggua

SEQ ID NO: 21952 - RNA, 61 nt, Human
ccuuuaaaguauugaaguaacuggagaauugccaauacagccagagagaaagggacuacag

SEQ ID NO: 21953 - RNA, 61 nt, Human
aaaggguuugguucuugacuuuguauuccuuccaauacagcaauaaacuuugucucccuuu

SEQ ID NO: 21954 - RNA, 61 nt, Human
uauuucauucaguuuuuggagcucaguuaagccaauacauuuaaaguuuugcaugaggaac

SEQ ID NO: 21955 - RNA, 61 nt, Human
aauaaauccuuucauuuuaaaaagagaauugccaauacagaaaaggaguauccaaacaaug

SEQ ID NO: 21956 - RNA, 61 nt, Human
ggaaaauaaauaguuggccagaauuaagcaaccaauacaugauagacagggcuaaaacugg

SEQ ID NO: 21957 - RNA, 61 nt, Human
gcccuggcuucuccagugggaugugcugaguccaauacaauugcuuuuauaauugcuuuug

SEQ ID NO: 21958 - RNA, 61 nt, Human
ucucacuuuagugagaacuuuucuagcuauuccaauacagaguucuuucuuauagggcuau

SEQ ID NO: 21959 - RNA, 61 nt, Human
aauuuguuucuauuaagcaaguaccaguuuaccaauacaugaguaacugaaguguaacugu

SEQ ID NO: 21960 - RNA, 61 nt, Human
uuuuucuuacaaauaaaugggacccuguuuuccaauacaaauguaccguguuuuuguuagg

SEQ ID NO: 21961 - RNA, 61 nt, Human
uaccuucaaaaggugggauaguaguucuaauccaauacaaugcuaauaaaaugaaacccga

SEQ ID NO: 21962 - RNA, 61 nt, Human
auucaaagaacaauggucucuuuaauggcacccaauacaguauugaaaaucagaucaucaa

SEQ ID NO: 21963 - RNA, 61 nt, Human
augcuuccuuaagugcugacagccuuuuuaaccaauacauuuaaaauuguacagaacaaaa

SEQ ID NO: 21964 - RNA, 61 nt, Human
uaaacauaguauaguccaacauucguugaucccaauacaggcaaacaaccuggucaaccuu

SEQ ID NO: 21965 - RNA, 61 nt, Human
uagcacauugcaacaacaaucaugcuuaugaccaauacagucacuagguuguaguuuuuuu

SEQ ID NO: 21966 - RNA, 61 nt, Human
ugcaagaauaagucaugaccaagacaaacugccaauacaaaagcccacugauacuaauuau

SEQ ID NO: 21967 - RNA, 61 nt, Human
ggcuuuuuuauuuuaaaaaaacagaguuaucccaauacauuauccugugauuuaccuuacc

SEQ ID NO: 21968 - RNA, 61 nt, Human
auaaaggcaaugauuuauuuuuuucccagugccaauacaauuuugagcuaagcacucaagg

SEQ ID NO: 21969 - RNA, 61 nt, Human
uagggccaccacucacuggguuuagggucccccaauacacugugaccucaucuuaacuaau

SEQ ID NO: 21970 - RNA, 61 nt, Human
gauccccucacccucaccccauccuuccccaccaauacacacaaauuuuuuaaucccauga

SEQ ID NO: 21971 - RNA, 61 nt, Human
aaaguucaugggugagggauaaaaugaggcuccaauacaugggaagcuuugcugaaaaagu

SEQ ID NO: 21972 - RNA, 61 nt, Human
gcuaagcugaauaaugacaaaguugaaaggaccaauacagccccuuuuauaaggauuuuga

SEQ ID NO: 21973 - RNA, 61 nt, Human
acuuuguuuguacaaaaacaaagacauauagccaauacaaaucaaaugccggagguguuug

SEQ ID NO: 21974 - RNA, 61 nt, Human
agcccucucccucaguccuuuauuguccauuccaauacauugaacacauuuccuuuacccu

SEQ ID NO: 21975 - RNA, 61 nt, Human
acacagcuggucccugugaugugucucgacaccaauacacaacccccuucccaccauccuu

SEQ ID NO: 21976 - RNA, 61 nt, Human
uugaaguauauuuuaagggaaacagugaucaccaauacauguuuucaguuuuuuuuuuuuu

SEQ ID NO: 21977 - RNA, 61 nt, Human
augugaguuugugccuuuuugucucaaucuuccaauacagguauauugagaaaaaaagcag

SEQ ID NO: 21978 - RNA, 61 nt, Human
augaaaaugacccacauuuaugaaacagaggccaauacaugcuccugccagagagguuuaa

SEQ ID NO: 21979 - RNA, 61 nt, Human
aagcagagaugggcuuucagcagaauaucaaccaauacauuuuucacaugcaaaacucauc

SEQ ID NO: 21980 - RNA, 61 nt, Human
gaagagauaacuauccuaaauauauaugcacccaauacaggagcacccagauucauaaagc

SEQ ID NO: 21981 - RNA, 61 nt, Human
uuuaaaaaaauguuucaccaugugucuuuacccaauacacauacuuuuucuugauguggau

SEQ ID NO: 21982 - RNA, 61 nt, Human
guaaugcccggcuuuuccucacuccugguaaccaauacaagcugguuucugccuuaggcuc

SEQ ID NO: 21983 - RNA, 61 nt, Human
gccccuucgccauccuagagugaggcucuguccaauacauggcucugcccuccagaacuuc

SEQ ID NO: 21984 - RNA, 58 nt, Human
acuucucccucaaggagugaggcuugguccaauacauggcucugccccccagaacuua

SEQ ID NO: 21985 - RNA, 61 nt, Human
cccucccccauccccccuccccacccccuccccaauacagcuacguuuguacaucaugguc

SEQ ID NO: 21986 - RNA, 61 nt, Human
uucucgccaagguuagugauccaagagaggaccaauacagaggccaaaauggcuuuuauga

SEQ ID NO: 21987 - RNA, 61 nt, Human
guguauucugcguguccauggcggggguucuccaauacacucacacuguccauguucuuuu

SEQ ID NO: 21988 - RNA, 61 nt, Human
aauuaaacuuuaaaguaugucuuguuuguagccaauacaugguguauagcaccaaaaaaug

SEQ ID NO: 21989 - RNA, 61 nt, Human
agaaccucuucccccaauaguagacacaucuccaauacaaacacagguuuauaauaaguaa

SEQ ID NO: 21990 - RNA, 61 nt, Human
uugcuuucuucaggcucuagggcugugcuauccaauacaguaaccacaugcggcuguuuaa

SEQ ID NO: 21991 - RNA, 61 nt, Human
uauggauucuaaggauucuagccugucugaaccaauacaaaauuucacagauuauuugugu

SEQ ID NO: 21992 - RNA, 61 nt, Human
ggaaagguucacaaauguggagugucugcguccaauacacgcgugugcuccucuccuuacu

SEQ ID NO: 21993 - RNA, 61 nt, Human
aacaaaacuggaacuguuguugaauccauagccaauacauuuacagcaaucuguguacuga

SEQ ID NO: 21994 - RNA, 61 nt, Human
gccaagguuauuaugugcaucuguuauuuuuccaauacauguaaacaguugcagcaugaug

SEQ ID NO: 21995 - RNA, 61 nt, Human
aacaaaaaacuaugugaugccucuauuuuccccaauacagucacacaucagcucaaaauuu

SEQ ID NO: 21996 - RNA, 61 nt, Human
uuagcaugcauucacucccccaucacauauuccaauacacacccuguccuaggcacugaga

SEQ ID NO: 21997 - RNA, 61 nt, Human
uaaaaaacagcuucaaaauaugcagcaaaaaccaauacaacaaaacgaguggcacgauuua

SEQ ID NO: 21998 - RNA, 61 nt, Human
ucccagacccucuucccuuugcccuucuccuccaauacauaaaggacacagacaaggaacu

SEQ ID NO: 21999 - RNA, 61 nt, Human
caaaaauucaucuuucggugauugugggcggccaauacauaccuucuguaacuccucccua

SEQ ID NO: 22000 - RNA, 61 nt, Human
gcugcuccagggagcaccagcugcagcugauccaauacaccaagccugugucucccucuuc

SEQ ID NO: 22001 - RNA, 61 nt, Human
uaccucauaggguuguugaggauuaagugaaccaauacauauacagugcuuagcacuuaau

SEQ ID NO: 22002 - RNA, 61 nt, Human
guugagccacuaagcagaggaccuuggguucccaauacaaaaauaccuacugcugagaggg

SEQ ID NO: 22003 - RNA, 61 nt, Human
aguaguaaaagcaguaccugggauuuucccaccaauacaaaccaguuacagcaacuguaau

SEQ ID NO: 22004 - RNA, 61 nt, Human
ccuaguuucacucaguuugaccugagacuuuccaauacaaucuguuguuuuguuuuguuuu

SEQ ID NO: 22005 - RNA, 61 nt, Human
gaacacagggauuggggagggaccagagcgcccaauacacacagcuccauuaugcaaucca

SEQ ID NO: 22006 - RNA, 61 nt, Human
cagucaacugcacaauacacaacuguauuucccaauacacuugagcaguugccugugaaug

SEQ ID NO: 22007 - RNA, 61 nt, Human
cccccccaaaaaauuacaauaauuuugucaaccaauacagaacaugagcccuuuuuaaaug

SEQ ID NO: 22008 - RNA, 61 nt, Human
uucuguuuccuuaaguauuauauaaacugugccaauacagacaaagcauaaucaauauaau

SEQ ID NO: 22009 - RNA, 61 nt, Human
guugucauuauuuguaguaguaacuacauauccaauacagcuguauguuucuuuuucuuuu

SEQ ID NO: 22010 - RNA, 64 nt, Human
cuuugcuuacacggucaaguacgugcugaggagcaucgcgcaggagugaggcccaggcgccgag

SEQ ID NO: 22011 - RNA, 64 nt, Human
uguggcaagugcacaccuggcaucccugcgucagaucgcgcaccuucaggucgcgcaccuucgc

SEQ ID NO: 22012 - RNA, 64 nt, Human
ugaaaccaggaggcagagguugcagugagcugagaucgcgcaaauugcacuccagccucgguga

SEQ ID NO: 22013 - RNA, 64 nt, Human
auauuuaugccuucucauucagaacuguaagaugaucgcgcagggcaucaugucaccaugucag

SEQ ID NO: 22014 - RNA, 64 nt, Human
agagcaugaugaaaggugucaauaaagccguaggaucgcgcaacccuuuguguguguggcugcu

SEQ ID NO: 22015 - RNA, 64 nt, Human
aaagugagccuagccaggagguguuuggggcucuaucgcgcaucucuccuaccaagcugggcaa

SEQ ID NO: 22016 - RNA, 64 nt, Human
uuuaaugaaccauguuguugcugguuguccuggcaucgcgcacacuguauguacauacuggcaa

SEQ ID NO: 22017 - RNA, 64 nt, Human
uccuuaagauagaugcaaaaugguaagccgaggcaucgcgcaaaagcuggugcgaugcuucagg

SEQ ID NO: 22018 - RNA, 64 nt, Human
ccauggcaaccugcagaagcacacgguacucaucaucgcgcaccggcugagcaccguggagcac

SEQ ID NO: 22019 - RNA, 64 nt, Human
caaucgcuaccugacgcggcggcggcgcaucgagaucgcgcacgcccugugccugacggagagg

SEQ ID NO: 22020 - RNA, 64 nt, Human
ggaguuucucucuugucucccaggcuggagugcaaucgcgcaaucucggcucacgguaaccucu

SEQ ID NO: 22021 - RNA, 64 nt, Human
guugucuuucucuuauuuuuaauaaaauagaaaaaucgcgcacuugcgcgucccccccccaccc

SEQ ID NO: 22022 - RNA, 64 nt, Human
aggagcagacagcaauacuucguccacaccugggaucgcgcagggcccgcagggcacaggcgcc

SEQ ID NO: 22023 - RNA, 64 nt, Human
gccccagcgagccucgcccucccaguuuugcucugcccagcaguguuggugcccagagaugaca

SEQ ID NO: 22024 - RNA, 64 nt, Human
auuucacgagccacagguggggcucauccaggccgcccagcagcugcugugugaugagcaggcc

SEQ ID NO: 22025 - RNA, 64 nt, Human
caagcgccugguccuguccucuugagcugcccuugcccagcacugcacucuggagguggguggu

SEQ ID NO: 22026 - RNA, 64 nt, Human
uugucaccccaagucuuccagcugguggaucugggcccagcaaagacuguucuccucccgaggg

SEQ ID NO: 22027 - RNA, 64 nt, Human
ccucuuggaccuuucuucuuugccgacaaccacugcccagcagccucugggaccucgggguccc

SEQ ID NO: 22028 - RNA, 64 nt, Human
uuccuccagccugugcgcaccugcccuccuugcagcccagcacaccugcagguguaagggacga

SEQ ID NO: 22029 - RNA, 64 nt, Human
acaccucucccaaaaagcagcccacaaggcaggggcccagcagcccagccaucacucaucuuug

SEQ ID NO: 22030 - RNA, 54 nt, Human
auccgccagcuccaaagugagccggcccagcaagaugaaacagggcaccccagc

SEQ ID NO: 22031 - RNA, 54 nt, Human
auccgccagccccaaagugagccggcccagcaagaugaaacagggcaccccagc

SEQ ID NO: 22032 - RNA, 64 nt, Human
agggcaggcgggcccaugaagaaagccccucguugcccagcacugucugcgucugcucuucugu

SEQ ID NO: 22033 - RNA, 64 nt, Human
cuucccguuaaugaccacagcagacagaauuugagcccagcaccuaaaaguacaggaauuucac

SEQ ID NO: 22034 - RNA, 64 nt, Human
cucugcugggguucccccuccacccaguggccacgcccagcacccuauugauggcuauaggaca

SEQ ID NO: 22035 - RNA, 64 nt, Human
aggggaauguguccuccugcucugcuuccucagggcccagcaggcggggguuugagcccuggac

SEQ ID NO: 22036 - RNA, 64 nt, Human
gguggaaagaagaggcagagaggucgucgucgucgcccagcagcaagggcugcaaaauaguaga

SEQ ID NO: 22037 - RNA, 64 nt, Human
aucaaggagagcagcaaguuuccauuuggcauuagcccagcacagagccaccggaacaucaaga

SEQ ID NO: 22038 - RNA, 64 nt, Human
ccaaguagcugggaugacaggcgcacaccaccacgcccagcaaauuuuuuguauuuuuaguaga

SEQ ID NO: 22039 - RNA, 64 nt, Human
cuuucaggcucuuagaagccauagauuuggacaagcccagcaagauggguguccuuccaggccu

SEQ ID NO: 22040 - RNA, 64 nt, Human
ggagucuuggacccuuucuuucucugggaucccugcccagcaccuuccuauagagaugacuuua

SEQ ID NO: 22041 - RNA, 64 nt, Human
gauaugccacauuaccugcucccaucaccauccagcccagcacccuggacuucagucgccuggc

SEQ ID NO: 22042 - RNA, 64 nt, Human
cagagagccuagaacaucccugggcaaguggauggcccagcaggcaggcacuguggcccuucug

SEQ ID NO: 22043 - RNA, 64 nt, Human
gucaucacugaucuaagcaguggcaucugagugggcccagcacauggccauagaggcccaggca

SEQ ID NO: 22044 - RNA, 64 nt, Human
cuugaugccagagggccagcaggcuccuggcugugcccagcaggcccagcaugcaggugguggg

SEQ ID NO: 22045 - RNA, 64 nt, Human
agagggccagcaggcuccuggcugugcccagcaggcccagcaugcagguggugggacacugggc

SEQ ID NO: 22046 - RNA, 64 nt, Human
ccagcagccugccuauggcuccagcugugcuguggcccagcagcauggccugcaucuggaagga

SEQ ID NO: 22047 - RNA, 64 nt, Human
gcauaucugugagcagcuguucccuguagccacugcccagcaccuccucaggccagccuggugc

SEQ ID NO: 22048 - RNA, 64 nt, Human
cagaggugcuggaccacaucuccgccaagucacugcccagcagccuucuccguccuguccccag

SEQ ID NO: 22049 - RNA, 64 nt, Human
aaauggauguauuaauuggcucuauaaacuaugugcccagcacuaugcugagcuuacacuaauu

SEQ ID NO: 22050 - RNA, 64 nt, Human
ggggaaggcagcucucuccagacagagucucagggcccagcaaggucagguuaucugcuuucau

SEQ ID NO: 22051 - RNA, 64 nt, Human
ucucaggacaucucuggcaggugcauuugugccugcccagcaguuccagcuguggcaaaagucu

SEQ ID NO: 22052 - RNA, 64 nt, Human
uuugaaaaguaaacgauaaaauguggauuaaagugcccagcacaaagcagauccucaauaaaca

SEQ ID NO: 22053 - RNA, 64 nt, Human
uuaggacgggaggcuguguccgugggugugcagugcccagcacgggacccggcugcaggggacc

SEQ ID NO: 22054 - RNA, 64 nt, Human
caccagagcgugaccucggcaggcuggacacacugcccagcacaggcagacccaccaggcuccu

SEQ ID NO: 22055 - RNA, 64 nt, Human
uucuccuccugccucucccgugagucuccagccugcccagcaccggcagcuguggagcacgugg

SEQ ID NO: 22056 - RNA, 64 nt, Human
cccuuccuuugagggccguggagggcuguggacagcccagcaaccugucgcucuuggaggcugg

SEQ ID NO: 22057 - RNA, 64 nt, Human
gaauagugcuuccagauguggucucccguguggggcccagcaaugggggccccugaugccaaga

SEQ ID NO: 22058 - RNA, 64 nt, Human
ucugcccgcaggugacaugguccugggaccaguugcccagcagagcucuugguaagggacauca

SEQ ID NO: 22059 - RNA, 64 nt, Human
caggguccagccugagcccccaccaggggucucugcccagcacaggaagcugacccuggcccag

SEQ ID NO: 22060 - RNA, 64 nt, Human
agcaccugcugugcugggaaggccgaggaugggggcccagcacuguccaggccugcuggggccu

SEQ ID NO: 22061 - RNA, 64 nt, Human
ugaggcaccguccaggccccaccggccaggccgcgcccagcagaggcguacuacccagcucugu

SEQ ID NO: 22062 - RNA, 64 nt, Human
ggccugacccagcauccucugccuucuaggaagugcccagcaagagggaaagcagaccccuuua

SEQ ID NO: 22063 - RNA, 64 nt, Human
uccagagaccacaggagccaaagcgagccuccaggcccagcaaugagggacuugggagaaaucu

SEQ ID NO: 22064 - RNA, 64 nt, Human
aggucaaggguggcaaaggcacuuguccaaggucgcccagcagugcugcucugaugacuugugc

SEQ ID NO: 22065 - RNA, 64 nt, Human
aggucagcgugggaggcaccuuuggguucccagugcccagcacuuuguagucucaucccagauu

SEQ ID NO: 22066 - RNA, 64 nt, Human
cccuaaaauggucguugaaggcgccugggccgcagcccagcaguaguuggagaggcaggcagag

SEQ ID NO: 22067 - RNA, 53 nt, Human
aaggggggaacauuagcuagccagcccagcaucuuccccccuucuuccaccac

SEQ ID NO: 22068 - RNA, 64 nt, Human
cucugccucagugggccugugggagccuacuggagcccagcacuuacucccccugagcagcgag

SEQ ID NO: 22069 - RNA, 64 nt, Human
ccugaggccaccagaagacacuuccaucccucgggcccagcaguacacacuugguuuccagagc

SEQ ID NO: 22070 - RNA, 64 nt, Human
cccacugauaaggggcccuaggguacagggugcugcccagcaggucgccaccgagugucuucuc

SEQ ID NO: 22071 - RNA, 64 nt, Human
uuucuccaccacagccaaggccuggagacugggggcccagcagagccugcucccacccuccucc

SEQ ID NO: 22072 - RNA, 64 nt, Human
gauuuuugcuccucaggcccaauauucucagacagcccagcagugugaacacacaaugccaggc

SEQ ID NO: 22073 - RNA, 64 nt, Human
caggcugaucaccaaagucagugucacccuggaugcccagcagcccuguccugugucuugggcc

SEQ ID NO: 22074 - RNA, 64 nt, Human
agagauggaccucucccaggagcagccccuggaugcccagcaggguccccccgaaccugcacaa

SEQ ID NO: 22075 - RNA, 64 nt, Human
gguauuucaccucuuaagagggaaucuuccacaagcccagcacaagcugccaggccugagcuac

SEQ ID NO: 22076 - RNA, 64 nt, Human
ucccuugcacugagguccuggaggccuugaugaggcccagcaaacaggcauucucacagcuggg

SEQ ID NO: 22077 - RNA, 64 nt, Human
ccagaaucuacagaccuggcuccucggaucugaagcccagcacaaaauaaucuccccguccaag

SEQ ID NO: 22078 - RNA, 64 nt, Human
gcccguguacauagugcauuguuucugugggcgggcccagcacuuuccgucaacguuguacugu

SEQ ID NO: 22079 - RNA, 64 nt, Human
ccacgaccuaggcaguaggccggugugccugacugcccagcauuuggguaauuuagauuguaaa

SEQ ID NO: 22080 - RNA, 64 nt, Human
accuaagaaggcaugguacucugacaaagccagugcccagcaaugaagugaauucauggcacag

SEQ ID NO: 22081 - RNA, 64 nt, Human
cagacacuagggcuaucagaaggucuccuuuuuagcccagcacaggcccaggccacuuugucgu

SEQ ID NO: 22082 - RNA, 64 nt, Human
ugccuugggauuugacuagaguugcuggcucgaggcccagcacgaggacuuacccugggguuuu

SEQ ID NO: 22083 - RNA, 64 nt, Human
uuuuaauccaguggcaaggugcucccacuccagggcccagcacaucuccuggauuccuuagugg

SEQ ID NO: 22084 - RNA, 64 nt, Human
agaacugcugggcccaggucuccugaaaugggaagcccagcaauaccacgcagucccuccacuu

SEQ ID NO: 22085 - RNA, 64 nt, Human
aaacucuggggcuuguccugugcuugcuuagagugcccagcagagguuugcugacaggugaugc

SEQ ID NO: 22086 - RNA, 64 nt, Human
cuuggggggugggggcuguccugcucaccugugugcccagcaccuggaggggcaccagguggag

SEQ ID NO: 22087 - RNA, 64 nt, Human
ucuucaggaacucagugucugggaggaaagcauggcccagcauucagcauguguuccuuucugc

SEQ ID NO: 22088 - RNA, 64 nt, Human
gaguugagaaagcagccccaguaguuccauucuugcccagcacuuucugcauuccaaacagcau

SEQ ID NO: 22089 - RNA, 64 nt, Human
cagagucaggagaccccaaggcaugugagcaucugcccagcaaccuguggagacaacccacacu

SEQ ID NO: 22090 - RNA, 50 nt, Human
gaagucauggcaccuugugagcccagcagagccaccacccagcaucccag

SEQ ID NO: 22091 - RNA, 64 nt, Human
aaggcgaaggacaauguuaucugggauucaccgugcccagcacccgaagugccaaauuccagga

SEQ ID NO: 22092 - RNA, 64 nt, Human
gcccaauagaagcuuaaugaugcuucuguuugaggcccagcaagcaccacuaaauuacuggaug

SEQ ID NO: 22093 - RNA, 64 nt, Human
cugcuugccccgaugaagccggggacacuccucugcccagcaaggagccuuggucauuuucaua

SEQ ID NO: 22094 - RNA, 64 nt, Human
gugacaaccccagugcgcaggccagagugagugagcccagcacggcgcuccgacuggcuuccuc

SEQ ID NO: 22095 - RNA, 64 nt, Human
uggaugcagcuguccagccacugcccuuuaacaugcccagcacacaugggaggccuguggcccu

SEQ ID NO: 22096 - RNA, 64 nt, Human
ucaaaagcccacgucaggaccacagaccccccaggcccagcagaagagccuccuucagcagcua

SEQ ID NO: 22097 - RNA, 64 nt, Human
agcuguggcugguaaggcaacugcuugaccacuggcccagcaagcagaggcgggcaggaggauc

SEQ ID NO: 22098 - RNA, 64 nt, Human
uggguccuuagagugggcuggagagaccuagagggcccagcauguggcugggaaacuguuggug

SEQ ID NO: 22099 - RNA, 64 nt, Human
uccagccccacucauccucucggauguucugcaggcccagcaaacucaucauguccaaagugaa

SEQ ID NO: 22100 - RNA, 64 nt, Human
gugucccuccucuuccuguagugccccucccauggcccagcagcuuggcugagcccccucuccu

SEQ ID NO: 22101 - RNA, 64 nt, Human
auuccuuagcagcucaggcgcagcccuagugggagcccagcacacugcuucucggaggccaggc

SEQ ID NO: 22102 - RNA, 64 nt, Human
cguuggaagacacaugucuuaccccccaaagggagcccagcacugggagccuucuugaugaucu

SEQ ID NO: 22103 - RNA, 64 nt, Human
cuuacuuggaguuagagccaagcugucagacggugcccagcacacauuaauguuagcuucuuuc

SEQ ID NO: 22104 - RNA, 64 nt, Human
ucccccaucuccaucaggaaaaauacaccccaucgcccagcaccccugcugauaccaccagaca

SEQ ID NO: 22105 - RNA, 64 nt, Human
ccugcuaccugacgcgccagaagcacccagcccugcccagcaaccggccccagcagcagguccu

SEQ ID NO: 22106 - RNA, 64 nt, Human
caaccgccccgucugauaaguaaggagccccucugcccagcagccgccccgucugagaagugag

SEQ ID NO: 22107 - RNA, 64 nt, Human
cagccgccccgucugagaagugaggagccccucugcccagcagccacccugucugggaagugag

SEQ ID NO: 22108 - RNA, 64 nt, Human
cgcccuccaucuccucggagccccgcgagguccggcccagcaacuucccggcauccgcgcucua

SEQ ID NO: 22109 - RNA, 64 nt, Human
ccaaguagcugggauuauaggcaugugccaccaugcccagcaaauuuuguauuuuuuuuuggua

SEQ ID NO: 22110 - RNA, 64 nt, Human
caaacgaaucauuggcuauaaccuccagccuccugcccagcacaggaaucgguggucuccaccu

SEQ ID NO: 22111 - RNA, 64 nt, Human
ucauucaaaaaaacauuucuugagcaccuucugugcccagcauaugcuaggcccaccagcuaag

SEQ ID NO: 22112 - RNA, 64 nt, Human
ggcccagcuccccucuuggcagggggagaggauggcccagcaggccuggcccagcucccaguuc

SEQ ID NO: 22113 - RNA, 64 nt, Human
uggcccccagccaguucucagaaacguggcuggggcccagcacagcagccugcaagggccccug

SEQ ID NO: 22114 - RNA, 64 nt, Human
gcccugggaggguggggccgucuaauuuauuacugcccagcauuccuuccaacgggaaguagau

SEQ ID NO: 22115 - RNA, 64 nt, Human
ccagccucuucugacccuuccaugcuggccccuggcccagcaggccugucuguggggacaucgg

SEQ ID NO: 22116 - RNA, 64 nt, Human
agucagggcuaacaccuggaucuccagaaaccuagcccagcagguuaaucuucacacaucucug

SEQ ID NO: 22117 - RNA, 64 nt, Human
aucuguagccaagcaugggaaucuuugcucccaggcccagcaccgagcagaacagaccagagcc

SEQ ID NO: 22118 - RNA, 64 nt, Human
cagcagcccuggcagaacugaagagcggcaccgggcccagcaggcaaagagagaggccucccug

SEQ ID NO: 22119 - RNA, 64 nt, Human
ggcacgggcaccugcucugucugggacagauacugcccagcacccacccggccaugaggaccug

SEQ ID NO: 22120 - RNA, 64 nt, Human
aggggagaaaaggcuaaagauuugcaguuugacagcccagcagggaggaagcaucacacagcgu

SEQ ID NO: 22121 - RNA, 64 nt, Human
aaaaaaaucagugcacaagaauugggcugguuaggcccagcaccacacugaagugggcucagug

SEQ ID NO: 22122 - RNA, 64 nt, Human
cugcaacccaagcuggcccauaaucagcaguggggcccagcagcacaggaggggcggacgguua

SEQ ID NO: 22123 - RNA, 64 nt, Human
gcaguuacaucgggucuggugcuccagaccuagggcccagcacuuucaucagauccugccuccu

SEQ ID NO: 22124 - RNA, 64 nt, Human
guucucuaugcccacugcccuccucccucuccuggcccagcaguauugcucacgggggcuccag

SEQ ID NO: 22125 - RNA, 64 nt, Human
uguuucaucaucauagugagcccagagagccacugcccagcagcaugcucacaccaccuacccu

SEQ ID NO: 22126 - RNA, 64 nt, Human
ccugcuccgggauuccugagucuguaaauagugugcccagcagcugugaacuccccuuauagcc

SEQ ID NO: 22127 - RNA, 64 nt, Human
auguaaguuuccagauuuaaaggacaugcugggugcccagcaggauggauucaagggaaaccua

SEQ ID NO: 22128 - RNA, 64 nt, Human
guaaguagagguggcuucagaaauggaacccccagcccagcagacaucaagcucaaggcaaugg

SEQ ID NO: 22129 - RNA, 54 nt, Human
aauuuuccucauucuggugaccaugcccagcauggugaguacaagcagccugua

SEQ ID NO: 22130 - RNA, 64 nt, Human
cucauucccuccuugcacagaugcauacacuggggcccagcagcugccuccugaggugacacag

SEQ ID NO: 22131 - RNA, 64 nt, Human
ucaguguguacagcaaauucuauagugcuucugagcccagcagggcuuuaccugccccuggaga

SEQ ID NO: 22132 - RNA, 64 nt, Human
agcucagcuuuacucuucuuccacacuaggcugggcccagcaauacaggagaggaugaagggag

SEQ ID NO: 22133 - RNA, 64 nt, Human
ugugugucuucugggucaguccuaggcacaugcugcccagcacauguccaccugggaaaugaga

SEQ ID NO: 22134 - RNA, 64 nt, Human
uuagccuacagauguccuacgggaacgugggcuggcccagcauagggcuagcaaauuugaguug

SEQ ID NO: 22135 - RNA, 64 nt, Human
cccugguaggagcugcaguuggaggccguucugugcccagcagcggugagcggcucccaugggc

SEQ ID NO: 22136 - RNA, 64 nt, Human
ggccuuuagggaguccccucuuaggacaggcacugcccagcagcaagggcagcagaguugggug

SEQ ID NO: 22137 - RNA, 64 nt, Human
uuacucgaaggcauuggccuugaaaaccuggacagcccagcagccacuaaggcucagauuguua

SEQ ID NO: 22138 - RNA, 64 nt, Human
ucccuguguuucauccauggggaaguuccaagaagcccagcauggccaucagugaggacuucag

SEQ ID NO: 22139 - RNA, 64 nt, Human
uucugaugagaaauagggaauacucccaguccaggcccagcaaaaccaaaaugcuaagcaauga

SEQ ID NO: 22140 - RNA, 64 nt, Human
gacccugggcuggcuggguuacagcagcagggaggcccagcagcccacuggcagaggcgagagc

SEQ ID NO: 22141 - RNA, 64 nt, Human
gugcuugcugugauguuccuacuguggcccagcugcccagcauggaccuggugacucuccacag

SEQ ID NO: 22142 - RNA, 64 nt, Human
ucccugcuccaugcugucugugagcaggccccaugcccagcacgccagccaccgcaggauaccu

SEQ ID NO: 22143 - RNA, 64 nt, Human
acguggcaaugagaccuggcagggcagaguacaagcccagcacccagugucccagccuuacugg

SEQ ID NO: 22144 - RNA, 64 nt, Human
gccaaggcaaggauuugccaaaaauguucugggggcccagcaaaugcaggagccgaccuggggc

SEQ ID NO: 22145 - RNA, 64 nt, Human
guguuccagaggaccugaugccaagggguaaugggcccagcagugccucuggagcccaggcccc

SEQ ID NO: 22146 - RNA, 64 nt, Human
gauaaccugcaccccucccugcaagggguucagagcccagcacaggagcuuucucuggcagaau

SEQ ID NO: 22147 - RNA, 64 nt, Human
acacuacuuuaugggcagggcccuagaagagcgagcccagcagcacagagaagcucugauagca

SEQ ID NO: 22148 - RNA, 64 nt, Human
cagcacagcuaccucugguggcaggagaagagaggcccagcacagcagcaggccaggccuuccu

SEQ ID NO: 22149 - RNA, 64 nt, Human
ccggcucggcccagcacccccucuccuggagggcgcccagcagccugccagcaguuacugugaa

SEQ ID NO: 22150 - RNA, 64 nt, Human
cgaaggccgacaccacuccugccagcccggcucggcccagcacccccucuccuggagggcgccc

SEQ ID NO: 22151 - RNA, 64 nt, Human
gcacucccgggauggguggaccaaacccuuagcagcccagcauuucccgaaggccgacaccacu

SEQ ID NO: 22152 - RNA, 64 nt, Human
uggaggccagagagcuggucaggcucccccaucugcccagcacggccugcacugugcccaccca

SEQ ID NO: 22153 - RNA, 64 nt, Human
ucauucacgugugaaguuguucauuuuauauugugcccagcaaagaaacuuucacccaguucag

SEQ ID NO: 22154 - RNA, 64 nt, Human
ccccuucuuagagcagaggcacaaguuagagcaggcccagcauuugggccaacuuacugugggg

SEQ ID NO: 22155 - RNA, 64 nt, Human
uacgacuuuggguacugcggacagaccuggauaggcccagcauucguucugaagaucacaguuc

SEQ ID NO: 22156 - RNA, 64 nt, Human
caaagcuuggugucuuggcacuguuagugacagagcccagcaucccuucugcccccguuccagc

SEQ ID NO: 22157 - RNA, 64 nt, Human
uggccaccuaguagcaguggugaggagugggagggcccagcaagcauuuaucagaaauagaauc

SEQ ID NO: 22158 - RNA, 64 nt, Human
ccgaggcaccggacgcuggagacccugcgccccugcccagcaccuccuccgugggcagcuccuc

SEQ ID NO: 22159 - RNA, 63 nt, Human
ccaccgaugcccaucuguagcagggccaggccugcccagcagccucugcucccuccuggggac

SEQ ID NO: 22160 - RNA, 64 nt, Human
uuaaacaaaaagcaaaaaaguaaaaugcugcacugcccagcagcccgguuagggcuccuggagc

SEQ ID NO: 22161 - RNA, 64 nt, Human
ggccggcugcaggggccaacaagaggucagcuuugcccagcaggggacccggaggagccuggug

SEQ ID NO: 22162 - RNA, 64 nt, Human
ucgacugguacgacagcuagccagggccacgggggcccagcacgagaguccucaugggcacuca

SEQ ID NO: 22163 - RNA, 64 nt, Human
agggggagauggccagccugaagucacgguccuggcccagcacaggugggcagcagcgagcugg

SEQ ID NO: 22164 - RNA, 64 nt, Human
uuauguuuucuuucauugggcaacagcuaagagggcccagcaagguaauuuaugguugagcuga

SEQ ID NO: 22165 - RNA, 64 nt, Human
cuauucaggaggcugaggugggaggauugcuugagcccagcagguugaggcuguggugauuugu

SEQ ID NO: 22166 - RNA, 64 nt, Human
acaaagcucaggcaaguggcucaguaguuggccagcccagcaggguccucuguaugagugugca

SEQ ID NO: 22167 - RNA, 64 nt, Human
cgggaggggguggucaucacgaggaacagagauggcccagcagacauuuggccucuagauccuu

SEQ ID NO: 22168 - RNA, 64 nt, Human
cauuucuuuccuuaucacccccuuguuguaaaaagcccagcacuugaauuguuauuacuuuaaa

SEQ ID NO: 22169 - RNA, 64 nt, Human
agccccucugcccagcaugcccugugaucgccuggcccagcaggagcugcuucagccgagaggg

SEQ ID NO: 22170 - RNA, 64 nt, Human
caggugggaagaugaagccggccagagccccucugcccagcaugcccugugaucgccuggccca

SEQ ID NO: 22171 - RNA, 64 nt, Human
gggaguucuagauugaucucugaaugugaucgacgcccagcaaggacaagcuuuaaaaugucug

SEQ ID NO: 22172 - RNA, 64 nt, Human
ggaggacccugaauuugagauccccggggcuggggcccagcacaacugcuguuuagugaacagg

SEQ ID NO: 22173 - RNA, 64 nt, Human
aaacaugagacaaagcugacuguucacacugauugcccagcacauaccgucuugccaguuucuu

SEQ ID NO: 22174 - RNA, 64 nt, Human
agauccugagaugauuuggucagauugggauaaggcccagcaaucugcauuuuaacaagcaccc

SEQ ID NO: 22175 - RNA, 64 nt, Human
ucugaagugcugggauucaggugugagccacugugcccagcagggaugcuucaucuuucuaaga

SEQ ID NO: 22176 - RNA, 64 nt, Human
uugggaggccaaggugggagggucccuuccuugagcccagcaguuugagaccaauguagugaga

SEQ ID NO: 22177 - RNA, 64 nt, Human
augucaauuuuagcacucuccaggcacaaggacagcccagcaccagcuuuacagggcaguguuu

SEQ ID NO: 22178 - RNA, 64 nt, Human
auguguagcuggcgaggaauuacuuccacuucuggcccagcacaagcccugcuuuggccaccug

SEQ ID NO: 22179 - RNA, 64 nt, Human
cagcccacaagaaggcccugcgggcccccccauugcccagcacugucucauagaaggcucuggu

SEQ ID NO: 22180 - RNA, 64 nt, Human
gagugucuuuaugagaaucacuguguccccugaggcccagcaguaccugcuucccuguaugugg

SEQ ID NO: 22181 - RNA, 64 nt, Human
uugaggcugaccuuccugaucauacacacacacagcccagcaaaagccucuccugaaccaaaca

SEQ ID NO: 22182 - RNA, 64 nt, Human
ggccaaucaggucccagagcuugaaugcuaacaagcccagcauccccuggggcugugaucaugg

SEQ ID NO: 22183 - RNA, 64 nt, Human
ccagccagccaaaguaaugacacauuccagcccugcccagcaugcugaccuuuggccucuaacc

SEQ ID NO: 22184 - RNA, 64 nt, Human
cacugcugccggguggccaggguauggggcaugugcccagcaauguggcuccuuggccccgcug

SEQ ID NO: 22185 - RNA, 60 nt, Human
caaccaccuuggaagacuagaggugauucugcccagcaucccauauugggccagccauga

SEQ ID NO: 22186 - RNA, 64 nt, Human
auuccggacuccccucauaacaauagacacaugugcccagcaauaauccgccccuuccugugug

SEQ ID NO: 22187 - RNA, 64 nt, Human
cuccugaccccucccugcaggggcuacguuagcagcccagcacauagcuugccuaauggcuuuc

SEQ ID NO: 22188 - RNA, 64 nt, Human
aaagaggagguaggauuuuucacugauucuauaagcccagcauuaccugauaccaaaaccaggc

SEQ ID NO: 22189 - RNA, 64 nt, Human
cuggauguccuucgaaggaaccaggacccucagagcccagcauccaucucugucaucaucuuca

SEQ ID NO: 22190 - RNA, 64 nt, Human
ggaggacuucuggcaugagaucucggcacggcaagcccagcaucgccucagcccagacaggcuc

SEQ ID NO: 22191 - RNA, 64 nt, Human
uggaaaguguuuggccuagcacaauuacugcuaggcccagcacaaugaacagauuuaccauccc

SEQ ID NO: 22192 - RNA, 64 nt, Human
uaggaaacgcucccacucccacgggccaucgagggcccagcacggcugagcggcugaaaaaccg

SEQ ID NO: 22193 - RNA, 64 nt, Human
aaugauuaaaguauuuucauacauuuugcuucuugcccagcagggacagguggcagagccgagg

SEQ ID NO: 22194 - RNA, 52 nt, Human
ccccuugugaccggcccugaacgcccagcagagugguggccagaggggagag

SEQ ID NO: 22195 - RNA, 64 nt, Human
caguuggacaagacuuggcccccggacaagacucgcccagcacuugcggcugggcccggggagc

SEQ ID NO: 22196 - RNA, 64 nt, Human
ccccaccucccaugccauggacugagcagcaggggcccagcaucccuuggauaugguggcugug

SEQ ID NO: 22197 - RNA, 64 nt, Human
aaauccgucaccaaauuguaaccuggauguuauagcccagcaucuagaaauccuaugaaacgua

SEQ ID NO: 22198 - RNA, 64 nt, Human
gggaggcagggguccugcagguccuggugggucagcccagcaccugcucccagugggagcuucc

SEQ ID NO: 22199 - RNA, 64 nt, Human
uagcugcgggggggaagaaacacagggucggugagcccagcaugugcguugguuugagggggcg

SEQ ID NO: 22200 - RNA, 64 nt, Human
gaaagagcagaagaauuacagcccugucacaugugcccagcacuccgccccaugccuugcuaaa

SEQ ID NO: 22201 - RNA, 64 nt, Human
acagcugcuguagacagcuguguuccuacaauuggcccagcacccuggggcacgggagaagggu

SEQ ID NO: 22202 - RNA, 64 nt, Human
caugagaauaaauaccuccccaaauucaaucugagcccagcaggagaggaugguaggguugcca

SEQ ID NO: 22203 - RNA, 56 nt, Human
acccuuggcuuaacuccuaagccccugcccagcaccacagcagagaucacacacug

SEQ ID NO: 22204 - RNA, 64 nt, Human
aguccccccuccaccuucgccaccucccgcucgugcccagcacaagugagccugguguggaaac

SEQ ID NO: 22205 - RNA, 64 nt, Human
gaaaggaugcagggucccccagaccccuccucuagcccagcagcggcuggggucuggcuccuuu

SEQ ID NO: 22206 - RNA, 64 nt, Human
acuucccaagcccuggugaccagaccaaggcagggcccagcauaauuccuccaguuggaugaac

SEQ ID NO: 22207 - RNA, 64 nt, Human
ggugcugugcugaggaaaggggaugcagagcccugcccagcaccaccaccuccuaugcuccugg

SEQ ID NO: 22208 - RNA, 64 nt, Human
augucaucuaaaggccaccaggaacacaccuguagcccagcaaaguugaggccaucgacuggcu

SEQ ID NO: 22209 - RNA, 64 nt, Human
uaaauuuuaaaggaauggaguuuuucagccuguggcccagcacuggucaagaaaacaagauggc

SEQ ID NO: 22210 - RNA, 64 nt, Human
uugguuuuguuuucuucacuaugggaucuucugugcccagcacagugccugacacauagaaaac

SEQ ID NO: 22211 - RNA, 64 nt, Human
uucucuaagauaagaggccaggccagucaguuuggcccagcaaacauguggguacuucuccacc

SEQ ID NO: 22212 - RNA, 64 nt, Human
cccuccuccuguguagcugccaccuccccgcugggcccagcauggcucaccugucccgugggcu

SEQ ID NO: 22213 - RNA, 64 nt, Human
gacacccucaacaaccaggauuugcucgaucucagcccagcaggccaggcagacacaccccgcu

SEQ ID NO: 22214 - RNA, 64 nt, Human
gaauucaaguuaccaauguaacacuggccagcgggcccagcaaucuccauguguacuuauuaca

SEQ ID NO: 22215 - RNA, 64 nt, Human
uguccccugggccuuuggcuccaguggccccugugcccagcaguccagcucuuggaaccucgcu

SEQ ID NO: 22216 - RNA, 64 nt, Human
agucauuaauuuucaacucaaugaaauaugugaagcccagcaucucuguugcuaacacacagag

SEQ ID NO: 22217 - RNA, 64 nt, Human
gcucauuugcaagcagaaaaccacagagacaggugcccagcaggagggcauagguggccucugc

SEQ ID NO: 22218 - RNA, 64 nt, Human
ggagagcacacugauagaaauccuuguguccagugcccagcaacuccugccucagccucccgag

SEQ ID NO: 22219 - RNA, 64 nt, Human
ccaaagugcugggauuacaggcgugagccacugcgcccagcauguuagacaauuuuuaauucau

SEQ ID NO: 22220 - RNA, 64 nt, Human
uuuauagucugauuacaaaacgugcaauucaggagcccagcagugacacacuuaucacgccuag

SEQ ID NO: 22221 - RNA, 64 nt, Human
ccacauuuugaaacccagaaagaccuggaaaggagcccagcauguccaucuuuucaaagauaca

SEQ ID NO: 22222 - RNA, 64 nt, Human
ccgccguucuguaaauagcgacgucgguguugcugcccagcagcgugcuugcauugccggugca

SEQ ID NO: 22223 - RNA, 64 nt, Human
agcaggcugccgucccaccacacguggccucugcgcccagcacggugcucgccgacaguggugu

SEQ ID NO: 22224 - RNA, 64 nt, Human
uacagcaggcucagcccuucccacccugccccaugcccagcagcacaacacggagugagacagg

SEQ ID NO: 22225 - RNA, 64 nt, Human
uuguuggcagguuaaugggacuauaaaugcuggagcccagcacucacacuuaauuauauuuaug

SEQ ID NO: 22226 - RNA, 64 nt, Human
ucacaggucccucugcaaaacuuccuggaguucagcccagcaaggccagaccaaggaggcagca

SEQ ID NO: 22227 - RNA, 64 nt, Human
gcuacagcaggagcgugcgggcuugcaggaggaggcccagcagcugcgggaugagauugaggag

SEQ ID NO: 22228 - RNA, 64 nt, Human
uuuggcucuauuggauuuguccaaacaggugcuggcccagcauggaaucugaugaaaauauucu

SEQ ID NO: 22229 - RNA, 64 nt, Human
caccccagcaggcucacucagcaaggagcucucugcccagcauauugcaggcccuguuuugagu

SEQ ID NO: 22230 - RNA, 64 nt, Human
ucugucuuguuugcugugccacgccugaugcccagcccagcagcaugcuuuguacacugauaua

SEQ ID NO: 22231 - RNA, 64 nt, Human
aagacaucuguggccaacaauccuauggaaaaaagcccagcaucacugaucauuagagaaaugc

SEQ ID NO: 22232 - RNA, 60 nt, Human
accagcccgcgccccaguaggagccccgcggcccagcaggugcggcgcgcacggagcgcc

SEQ ID NO: 22233 - RNA, 64 nt, Human
agccaaggaggaaauguggaaacgcaguuguguggcccagcacgagccugggcgaccaccgggu

SEQ ID NO: 22234 - RNA, 64 nt, Human
acauucaaucgcccaacuacccagacgauuaccggcccagcaaagucugcaucuggcggaucca

SEQ ID NO: 22235 - RNA, 64 nt, Human
ccguggaguguuuuuggcauggugaccugucugggcccagcauguugcagauguguauuuaugc

SEQ ID NO: 22236 - RNA, 64 nt, Human
gugcuauuaaucacuuguuagagcaacaugacaugcccagcaucccacuucccgaaaaugucua

SEQ ID NO: 22237 - RNA, 64 nt, Human
cuuuuccucccgaguuuggcuggcacgagagcuagcccagcacaugaagcaggugauguuaagu

SEQ ID NO: 22238 - RNA, 64 nt, Human
gaccuggaggcccugcccagcccugcucugcccagcccagcaggggcuccaggccuuggcuggc

SEQ ID NO: 22239 - RNA, 64 nt, Human
ggccccuccaacccucucugcugcuguuuccauggcccagcauucuccacccuuaacccugugc

SEQ ID NO: 22240 - RNA, 64 nt, Human
cacccagcaggagaggcuccugguguagugggcagcccagcacuucccgcugcugccugccugu

SEQ ID NO: 22241 - RNA, 64 nt, Human
cgacgugggcggugggccccagccccacagaccagcccagcauucagguuaguucuacuucuuc

SEQ ID NO: 22242 - RNA, 64 nt, Human
cccacccuccaccccgucccccacggugggcacugcccagcaccgcaugccacguguccggaau

SEQ ID NO: 22243 - RNA, 64 nt, Human
cggcaagccacaggaaggaggggagagacaggcagcccagcaguguggagacccugccacagcc

SEQ ID NO: 22244 - RNA, 64 nt, Human
cccuccacggagcagcagcacccuccagcaggcagcccagcaugccaggggugugugcgcaccu

SEQ ID NO: 22245 - RNA, 64 nt, Human
auuagaaauagacaguauauuuauagucacaagagcccagcagggccucaaaguuggggcaggc

SEQ ID NO: 22246 - RNA, 64 nt, Human
gaggagucccuaccacccaucucaucacuuuccagcccagcacucuucaugcucauucauuuaa

SEQ ID NO: 22247 - RNA, 64 nt, Human
ugacaggggaccaguagggugguuucccucucaggcccagcagcccauugacagcauuagacug

SEQ ID NO: 22248 - RNA, 64 nt, Human
cuuagauuauaguaaaugccuuuuacuuaacugugcccagcaggcugggugcguuaaaaagccc

SEQ ID NO: 22249 - RNA, 64 nt, Human
uuggaucaugacaugucgggcgaugcuuggaagagcccagcauguauguaugcacacauugugu

SEQ ID NO: 22250 - RNA, 64 nt, Human
uacccgcagaauggugcucuccuuugcccucccugcccagcagccugauaggacucuccuaguc

SEQ ID NO: 22251 - RNA, 64 nt, Human
gagccccaaggcuggggccacagcuccuaccccugcccagcagcccugagcucagcugcaggaa

SEQ ID NO: 22252 - RNA, 64 nt, Human
ugcgugaaccugccuugggccucaucugcuccuagcccagcagagagaguugaccccuccugaa

SEQ ID NO: 22253 - RNA, 64 nt, Human
uacgugaaccugccuugggccucaucugcuccuagcccagcagagagaguugaccccuccugaa

SEQ ID NO: 22254 - RNA, 64 nt, Human
uaagcaggggagcagagcaccaggccgggcgccugcccagcaggagcugaugccggaggcagug

SEQ ID NO: 22255 - RNA, 64 nt, Human
agugugcacacaaucuggcucaauguauauauuggcccagcaaggcaaagaacugaaguuccag

SEQ ID NO: 22256 - RNA, 64 nt, Human
auuccaaguaguauauggacaguccagggcuuaugcccagcagcccacuggaggcauucuucag

SEQ ID NO: 22257 - RNA, 64 nt, Human
caaaaucaucccaaaccaggcugccccagccccagcccagcaacagugaacucccuugggucaa

SEQ ID NO: 22258 - RNA, 64 nt, Human
augucagccacugggguguugugcucacuucagggcccagcacaaaaauccuuguuugacaucu

SEQ ID NO: 22259 - RNA, 64 nt, Human
cuugccagcccugaccuggucacugggcaggcuggcccagcagccugggggcugcagaagacau

SEQ ID NO: 22260 - RNA, 64 nt, Human
cagggagguaaagcaggacccuugcagacauguugcccagcacacaguaggcccucaauaaaag

SEQ ID NO: 22261 - RNA, 59 nt, Human
cugacaaggagcaggccugagcgaggccggcccagcacagcaagcagcaggaccgcugc

SEQ ID NO: 22262 - RNA, 64 nt, Human
cuggccuuagcagaugguaugcuugcggaccgcagcccagcaugccggugggcccacagcccga

SEQ ID NO: 22263 - RNA, 64 nt, Human
aaggguauacccuggcucugccacccaugaaccagcccagcauccagccagugagugggcaccc

SEQ ID NO: 22264 - RNA, 64 nt, Human
aaggcuggggcaucccagcccacacacccuggaugcccagcaaggccacagaaagagccugaug

SEQ ID NO: 22265 - RNA, 64 nt, Human
cucugcccuggggccaccucggcugcugcagccugcccagcagcacauuccagucacugccccc

SEQ ID NO: 22266 - RNA, 64 nt, Human
agcccaguuugcagguguggccuuguuucuccuugcccagcagugcugccuucagcggccguga

SEQ ID NO: 22267 - RNA, 64 nt, Human
gccacagcagagccaaucacagacccaccacacagcccagcagcccuucgugaauccugcacug

SEQ ID NO: 22268 - RNA, 64 nt, Human
gcccucccucugcccucccgucugugagcucccugcccagcaccaccuccugcacugcacuucu

SEQ ID NO: 22269 - RNA, 64 nt, Human
caucccuguguccacugagacuuuccccucucgcgcccagcauuugguuuuacacaggaagaga

SEQ ID NO: 22270 - RNA, 64 nt, Human
uuggacacugacucuuccacuguacaaaaguacugcccagcauacuuaaaaaguagauccuugg

SEQ ID NO: 22271 - RNA, 64 nt, Human
acagaagaaaauaauaagcccucuauacauaaaugcccagcacaauucauuguuaaaaaacaac

SEQ ID NO: 22272 - RNA, 64 nt, Human
ccucaugcccucuuccugcucacaugcuagcggggcccagcagcccugggugguuuugccagca

SEQ ID NO: 22273 - RNA, 64 nt, Human
auccaauuuguagcuuccugccuggcuucagagagcccagcaaccuucuaggccugcuuuccag

SEQ ID NO: 22274 - RNA, 64 nt, Human
aaaaaugggucaguagcccuuccuguucucuccagcccagcauacaggaggaucaaaggaggug

SEQ ID NO: 22275 - RNA, 64 nt, Human
gcuacuggagguagagacggcccuuugagauggugcccagcaggccaaacccaccugccucugc

SEQ ID NO: 22276 - RNA, 64 nt, Human
cagcagcauggcauagccccggccccccgcgcucgcccagcaggagagacugagcagccgccag

SEQ ID NO: 22277 - RNA, 64 nt, Human
guaaccgcgcagucccguuugacgguggugccgugcccagcaucgugccaaggacuccccuacu

SEQ ID NO: 22278 - RNA, 64 nt, Human
caauaaguacuggcucaugcucaacgagaaggaggcccagcaaguguauggugggaaggaggcc

SEQ ID NO: 22279 - RNA, 64 nt, Human
uguacuucucagccccgcugagccccucauuugugcccagcauuuugugugcacacauggccuc

SEQ ID NO: 22280 - RNA, 64 nt, Human
uuuuagucauuaaauggaagugucugccagcugggcccagcaccucgucuuggguugcgcguuc

SEQ ID NO: 22281 - RNA, 64 nt, Human
gugucgggguacacccagcacuuugcgaccugcggcccagcaggcgcggaggauggcggggagg

SEQ ID NO: 22282 - RNA, 64 nt, Human
gacaugaaaugucaccuugcugaggcccagcccagcccagcauagcccgagggcuggaaaaacg

SEQ ID NO: 22283 - RNA, 64 nt, Human
gguccauacagcauggguggcaggguuuggacccgcccagcagcaccacggaccccagccacuc

SEQ ID NO: 22284 - RNA, 64 nt, Human
caguguccacccaccucgcucagcggcucccggggcccagcaccagcucagaauaaagcgauuc

SEQ ID NO: 22285 - RNA, 64 nt, Human
cuggggagggucacagcccacgggcuggcagccagcccagcaccuacuuguaaaaauuuuguaa

SEQ ID NO: 22286 - RNA, 64 nt, Human
cugcuaguuacaguguaggcaccccggcccagcagcccagcagcccacauguguucaggacccu

SEQ ID NO: 22287 - RNA, 64 nt, Human
gcacuaugcugcuaguuacaguguaggcaccccggcccagcagcccagcagcccacauguguuc

SEQ ID NO: 22288 - RNA, 64 nt, Human
agucuuagugguuaagcauuccuuucucuucagugcccagcagcacccaguguuggucuguguc

SEQ ID NO: 22289 - RNA, 64 nt, Human
ccacauggcauugagagggugcugcccgcucaaugcccagcagcagcucuggaaggcagugcuc

SEQ ID NO: 22290 - RNA, 64 nt, Human
uguguguguguguguguguguguuuuuccuguuugcccagcagugcauuguggguuccaagagu

SEQ ID NO: 22291 - RNA, 64 nt, Human
uuacucauguucuuucuuguugaugaguucugcggcccagcauauagaaauggcucagaacguu

SEQ ID NO: 22292 - RNA, 64 nt, Human
gagccccaggccaggaggcuguuccaggaguccugcccagcagccucaguggccaagcccagac

SEQ ID NO: 22293 - RNA, 64 nt, Human
cccucuguccagagucuagggcaguccuccacuggcccagcacuccaguuuccuuucccugccu

SEQ ID NO: 22294 - RNA, 64 nt, Human
ggucuuuccaagguugggacccaaggaucggggggcccagcagcccgcaccgaucgagccggac

SEQ ID NO: 22295 - RNA, 64 nt, Human
acagcccucuuucucaccuacccccugccgcacagcccagcaggagggaggcggacagccagau

SEQ ID NO: 22296 - RNA, 64 nt, Human
agguaccgaaggaaggccaggugcaguggcucacgcccagcacuuugggaggcugaggugggag

SEQ ID NO: 22297 - RNA, 64 nt, Human
caggugggguccggaccguggcugcccccguugugcccagcauugcccgggugagggcucugcc

SEQ ID NO: 22298 - RNA, 64 nt, Human
cccucacaugucaguaccuucaaacuagggccaagcccagcacugcuugaggaaaacaagcauu

SEQ ID NO: 22299 - RNA, 56 nt, Human
gccgcaccacggagcccugacccuucgcccagcaccgcgguuccgcuuugggagcc

SEQ ID NO: 22300 - RNA, 64 nt, Human
ccggugagaccacuccaggguggaaagaagccacgcccagcagagcugccuucucggagccuuc

SEQ ID NO: 22301 - RNA, 64 nt, Human
uugagaacaaaggagggaccugagguggagagaggcccagcaccccaaaucucugccaucacac

SEQ ID NO: 22302 - RNA, 64 nt, Human
cagcuuaaacccuagcccugugagagcuuccugugcccagcaggaaggaagucaaauaaaccac

SEQ ID NO: 22303 - RNA, 64 nt, Human
caaagcaagcagggggccaguggcggggcccagcgcccagcaggacacccaugcaagaggcuga

SEQ ID NO: 22304 - RNA, 64 nt, Human
aggcagcuucaagugccuuuugcugcgcaccaaugcccagcaggggaggugaggggggcuggcg

SEQ ID NO: 22305 - RNA, 64 nt, Human
ccugucagcuuccccaggagcucucugcugagcagcccagcacaacccccaggaaacacaaaug

SEQ ID NO: 22306 - RNA, 64 nt, Human
ccgaauagcugggauuacacgugcccaccaccaugcccagcauggugaaaccccauaucuacua

SEQ ID NO: 22307 - RNA, 64 nt, Human
gcaggugagcuggucauugucucguggccagagggcccagcagccacuguggaccuggggcguu

SEQ ID NO: 22308 - RNA, 64 nt, Human
gccugaagccugaagacucgccccacccaccacugcccagcacccaguguccucccgugccccu

SEQ ID NO: 22309 - RNA, 64 nt, Human
acacccuggcccugcugaggcauacagagcuucagcccagcacagaagcaagacaaaaucagug

SEQ ID NO: 22310 - RNA, 64 nt, Human
gagccagccagggaggggcagcugcagugaccaggcccagcagggaggacuugugcagccgggc

SEQ ID NO: 22311 - RNA, 64 nt, Human
aaggagaggacaggccuggcaggggcccacuggugcccagcaccaaggcgagcuccgggcucag

SEQ ID NO: 22312 - RNA, 64 nt, Human
uuggucuccccccugggcacacgugcucacucaggcccagcaaugaccucugcucauuuuugca

SEQ ID NO: 22313 - RNA, 64 nt, Human
ccgccugcgggcagggggaggccagcaggcccgggcccagcaccccuucccuggcaccaggguc

SEQ ID NO: 22314 - RNA, 64 nt, Human
gcuggaccucaggacaggcauggaggccacaggggcccagcagcccacccuuuccucuccccac

SEQ ID NO: 22315 - RNA, 64 nt, Human
auagcuauuucugaggaugaaaugggagacauaugcccagcaccugauguaaguuuauauaaug

SEQ ID NO: 22316 - RNA, 64 nt, Human
ucucccuccuuuccucucccuugagcuugguucugcccagcacucgugcuuguucacauaauua

SEQ ID NO: 22317 - RNA, 64 nt, Human
cacagccuggacuuugguucucuccaggaagguagcccagcacugugaagacccagcaggaagc

SEQ ID NO: 22318 - RNA, 56 nt, Human
ucugccagagcagccugugaacuaaugcccagcauuccucaaggucagccagacaa

SEQ ID NO: 22319 - RNA, 64 nt, Human
cugcagcugggacugugaggaccgagaagcaauggcccagcagacgagacagcaaagaccaagg

SEQ ID NO: 22320 - RNA, 64 nt, Human
uuccuauggaagucuagcaaagcaauacgacucagcccagcacucucugccccaggacucaugg

SEQ ID NO: 22321 - RNA, 64 nt, Human
gaacauugucacuguuuucacugucaugcagggagcccagcacuguggccaggauggcagagac

SEQ ID NO: 22322 - RNA, 64 nt, Human
cgagacuucccugccguguuugugacccccuccugcccagcaaccugccagcuacaggagcccc

SEQ ID NO: 22323 - RNA, 50 nt, Human
ugcaggacccccaggccugagcccagcacccgcuccaccccagccagcug

SEQ ID NO: 22324 - RNA, 64 nt, Human
uucucccuugccaugcccauuugggauuuucuuugcccagcauaugugccauaaacagaacaaa

SEQ ID NO: 22325 - RNA, 64 nt, Human
gaaggauagaggcugagagaagaaggaagaaucagcccagcagguaugggcaucugggaaaccu

SEQ ID NO: 22326 - RNA, 64 nt, Human
uguccuauguccuauuugaguggcagcagcgccagcccagcaagaaggcuggggguugucaagg

SEQ ID NO: 22327 - RNA, 64 nt, Human
aggagaaagaaggcuuaacauuaaguauuccuuggcccagcagcggcccagauugcggugugag

SEQ ID NO: 22328 - RNA, 64 nt, Human
ucagccucccuuuguaaugcugcuccucuccacugcccagcaccaugaguugggugcagacacc

SEQ ID NO: 22329 - RNA, 64 nt, Human
uuuuucuaacauggaaaaagauucucagccugccgcccagcaugcagguggccucgcuuugccg

SEQ ID NO: 22330 - RNA, 64 nt, Human
gagccucaguuuccucaucuguaaacuggagagagcccagcacuuggcagguguccaguaccua

SEQ ID NO: 22331 - RNA, 64 nt, Human
aguaggcccugguuccugcuguccugguggcugggcccagcaggggcccucacucuugaagucc

SEQ ID NO: 22332 - RNA, 64 nt, Human
cggcggcuccagcagggucugguuaagggguccagcccagcacuggaccauuccgucuccugcu

SEQ ID NO: 22333 - RNA, 64 nt, Human
ucccucuggccccuucucccauggggacaucucggcccagcaccccuaucccauuuccagaguu

SEQ ID NO: 22334 - RNA, 64 nt, Human
uuucauuugagcagccagaugauaaagcacagaugcccagcacugaaagaguuacuucgacaag

SEQ ID NO: 22335 - RNA, 64 nt, Human
gcccuacgugcucucucucguccuaccuaucaaugcccagcauggcagaaccugcagcccuugg

SEQ ID NO: 22336 - RNA, 64 nt, Human
caaggacaaccugccccuccccagcccuuugcaggcccagcagacuugagucugaggccccagg

SEQ ID NO: 22337 - RNA, 60 nt, Human
agagugucuaugggaaaugagugguuggaagcccagcagaugggagcaccuggacuuggg

SEQ ID NO: 22338 - RNA, 64 nt, Human
gcugcaaaguggaaaauaugaaaagaccacacaggcccagcaguccagaaacugggcaaaaaua

SEQ ID NO: 22339 - RNA, 64 nt, Human
aaggagacacucaguuucacaagugagcccucuugcccagcacacaccuauggcuggcugggca

SEQ ID NO: 22340 - RNA, 64 nt, Human
agagguucaaaggcagcaaggcagugagcuaugagcccagcauggaugugucucaggcaccuca

SEQ ID NO: 22341 - RNA, 64 nt, Human
cucccuuugccucuaccuggcccucaucccaacagcccagcaaggggagagagaaagagaauuc

SEQ ID NO: 22342 - RNA, 64 nt, Human
gcagcagcucaaggauggcacucagaucuccauggcccagcaaggccaagauaaaucuaccacc

SEQ ID NO: 22343 - RNA, 64 nt, Human
uuaaaaauacagaaagauuuugaguaaauuuugugcccagcaagcuguuaguuuuauuuuugua

SEQ ID NO: 22344 - RNA, 64 nt, Human
uggucuuuauuuagaaauugggugauguuuuugugcccagcaacaugcuguaggaauuuaacuc

SEQ ID NO: 22345 - RNA, 64 nt, Human
ugcucccaauaccucagcaugguaaggggacagagcccagcagaucccagcugugaagaggcca

SEQ ID NO: 22346 - RNA, 64 nt, Human
gccccucccuguggcagcagcaggacaggugugugcccagcacccucccuaccugggccuggaa

SEQ ID NO: 22347 - RNA, 64 nt, Human
agauuaggaaccccccagccuguuuccauucucugcccagcagucucuuaccuucccugaucuu

SEQ ID NO: 22348 - RNA, 64 nt, Human
ccuaauggccccaucuccugcagaagccaggugagcccagcacuggacugaaguucuugcagac

SEQ ID NO: 22349 - RNA, 64 nt, Human
gcugaagggagaaaaauguuuuaguacauuauaggcccagcagcuuuuauucauguccaccagc

SEQ ID NO: 22350 - RNA, 64 nt, Human
aguguggccagggcccuggguaucauguccacaugcccagcaagagccuugccuccccugccuc

SEQ ID NO: 22351 - RNA, 64 nt, Human
aggcucgggagauagauugucucccuugccucuggcccagcagagccuaagcacugugcuaucc

SEQ ID NO: 22352 - RNA, 64 nt, Human
gacgaggucccugcagcucacuguguccagcugggcccagcacuggugucucugugcuuccuuc

SEQ ID NO: 22353 - RNA, 64 nt, Human
aacuagcuaaaaucaucuuauguaccacuaauaugcccagcacauuuuguaaaacaguccugau

SEQ ID NO: 22354 - RNA, 64 nt, Human
gagagguccugcaugaacagcuucaccugggggggcccagcacgaagucacaucccagccccag

SEQ ID NO: 22355 - RNA, 64 nt, Human
uuggccaggaaagcaugcaauagacuugcucggagcccagcacuccugggucucggggucgggg

SEQ ID NO: 22356 - RNA, 64 nt, Human
cuaaugcauuaaguugaagucgacugccaaagaggcccagcagagggcagcacccccaucauuu

SEQ ID NO: 22357 - RNA, 64 nt, Human
uuacucauuaacuuugcuuauaaugcuuuuuauagcccagcacagaauuuaaagccauaccacc

SEQ ID NO: 22358 - RNA, 64 nt, Human
uguuagugagugaauguuuguaaaacaggauagugcccagcacauacuaguaacaaauguaaaa

SEQ ID NO: 22359 - RNA, 64 nt, Human
gugucuuuuagaguaggaaucagcauagugggaugcccagcaggcacaaaccauggguccaggg

SEQ ID NO: 22360 - RNA, 64 nt, Human
aagaucacuuauuaaaaauccuuauuuucuccaagcccagcaaacguugacuucugggcaaacc

SEQ ID NO: 22361 - RNA, 64 nt, Human
uguuucucucccaucauccggauuucugguuguggcccagcaauuaacaaaaacagcuucaacu

SEQ ID NO: 22362 - RNA, 64 nt, Human
cucgcucuuugcugagagccccuuuugacagaaagcccagcacgacccugcuggaagaacugac

SEQ ID NO: 22363 - RNA, 64 nt, Human
gcacugugcaggacguggaccagcuggagcugcugcccagcacagaggagagucgccgcagaug

SEQ ID NO: 22364 - RNA, 64 nt, Human
cugguucuuuccauccucuugugguacccguagugcccagcauccagaccuuugugccccugug

SEQ ID NO: 22365 - RNA, 64 nt, Human
gucucuuccucuuuucccauccccugcuacccuggcccagcacaggcacuuucuagauauuucc

SEQ ID NO: 22366 - RNA, 64 nt, Human
gcagcagcauguggcccauggcaccacccccacggcccagcacaaccccuagagcaggaaagag

SEQ ID NO: 22367 - RNA, 64 nt, Human
acagugcuacaccaccugccugauugccaagggugcccagcacguggccccagaccaaucugag

SEQ ID NO: 22368 - RNA, 64 nt, Human
guccgugcauuccugcucuccggacccccaaagggcccagcauuggugggugcaccaguaucuu

SEQ ID NO: 22369 - RNA, 64 nt, Human
ggaggggaggccaguguacauguaaaugcccacagcccagcauuggguuucccucccaaggccc

SEQ ID NO: 22370 - RNA, 64 nt, Human
gagcugcuggaaaccagcacacgcaaaagaugacgcccagcacagcagcaggacacaccaugug

SEQ ID NO: 22371 - RNA, 64 nt, Human
uuagcuuuuccuguggccugaccugccugugagugcccagcaagccuugggcacaccccgcugg

SEQ ID NO: 22372 - RNA, 64 nt, Human
cuggcucagccaauaaauccuaaggagacaagcagcccagcagugaucagcaguagccaccuua

SEQ ID NO: 22373 - RNA, 64 nt, Human
gucugcaauaauaaaguaaguagccaaccugggugcccagcagugcugagaccuggcugcucua

SEQ ID NO: 22374 - RNA, 64 nt, Human
aucucacauuauucugguuugaauauguccauaagcccagcacagaaacagcuggauucuucua

SEQ ID NO: 22375 - RNA, 64 nt, Human
cugccagaauucccaggagggcauaucagcaacugcccagcagagcuauauuuugggggagaag

SEQ ID NO: 22376 - RNA, 64 nt, Human
uuccaugcugucuggggagagcagcacacuggccgcccagcacugcugcuaugacgaggacagc

SEQ ID NO: 22377 - RNA, 64 nt, Human
gggagggucggcgucuggggucagggcgcgcacagcccagcagcccgaggccgcccgcgacuag

SEQ ID NO: 22378 - RNA, 64 nt, Human
caggacgugcacuuccccaagucggcacugaguggcccagcaccgccuagcccugccaccccac

SEQ ID NO: 22379 - RNA, 64 nt, Human
ccuguuccaguucaccuaaaggcugauugugcaggcccagcacuguggcuggacugccgcgcca

SEQ ID NO: 22380 - RNA, 64 nt, Human
cgcacauuccacucccauucucccuccaagaggggcccagcauuguauuucccugugaccccuu

SEQ ID NO: 22381 - RNA, 64 nt, Human
cugucaugcaggacaccuaggagcacccaggcuugcccagcaaacccugcgugccauucuucua

SEQ ID NO: 22382 - RNA, 64 nt, Human
ugcacugcccucacccucagccgucccaaggagugcccagcacuacucagcauguaguccagga

SEQ ID NO: 22383 - RNA, 64 nt, Human
cacaggccucuggaaucagaaucuucaggguggggcccagcagucuguguuuuaacagguucuc

SEQ ID NO: 22384 - RNA, 64 nt, Human
auggccccuguggucugcuuguccuucagcccaugcccagcagauaccucucugacuggagacg

SEQ ID NO: 22385 - RNA, 64 nt, Human
cuggcucuccugucucugcagcucuacaggugaggcccagcagagggaguagggcucgccaugu

SEQ ID NO: 22386 - RNA, 64 nt, Human
aauccacucccaggcagcccuacuucuuugcuuugcccagcauuuuacugauucauacauuauc

SEQ ID NO: 22387 - RNA, 64 nt, Human
cucaccuuccuccacucuaagggauaucaacacugcccagcacaggggcccugaauuuaugugg

SEQ ID NO: 22388 - RNA, 64 nt, Human
gugcacagugauuuuuuucuuguaauuuaaacaggcccagcauugcugguucuauuuaauggac

SEQ ID NO: 22389 - RNA, 64 nt, Human
gacagaagagguaagggaggcuaaguggguaacagcccagcaucagggucacuguggcaacagc

SEQ ID NO: 22390 - RNA, 64 nt, Human
uguuuuggggaaggaacuggauaucucuccugcagcccagcaccgagauacccaggacgggccu

SEQ ID NO: 22391 - RNA, 64 nt, Human
uugacacugaagcagcuggugugggcuggaacuggcccagcauugaccugggccgggcugguuc

SEQ ID NO: 22392 - RNA, 64 nt, Human
agugucuuugaugguggugagggugggugauggugcccagcaccaacaguuuuaguggccuguc

SEQ ID NO: 22393 - RNA, 50 nt, Human
uaaacccagcugacacuugagcccagcauccuggggauccagcggaugga

SEQ ID NO: 22394 - RNA, 64 nt, Human
ugugauuccugauagaacagacuuuacuuuucuagcccagcauugaucuagaagcagaggaauc

SEQ ID NO: 22395 - RNA, 64 nt, Human
acuuuccgugggugccuuaugugguggugguugugcccagcacagaccuggcaggguucuugcc

SEQ ID NO: 22396 - RNA, 64 nt, Human
uuauaauauccucuugcguuuucccugugggaaugcccagcauuaauuaaguccauuucauuuu

SEQ ID NO: 22397 - RNA, 64 nt, Human
uccugaugcuguugcagggcaggucugagagggugcccagcagcacccggugucagggccaccu

SEQ ID NO: 22398 - RNA, 64 nt, Human
gcaugggugaggggacacccugggccucucucccgcccagcauccucccugaguccccacacag

SEQ ID NO: 22399 - RNA, 64 nt, Human
ucuccucuaaaggggaggcauuaaaauucacugugcccagcacaugggugguacacuaauuaug

SEQ ID NO: 22400 - RNA, 64 nt, Human
ugaagcccucuucgagcuagagaaaaauagauaagcccagcagccccagaagauggucugaaca

SEQ ID NO: 22401 - RNA, 64 nt, Human
gggacccagccuuugggccuccccagccagagcagcccagcaacaguguguccuguggucauaa

SEQ ID NO: 22402 - RNA, 64 nt, Human
uacccuggggccccagggagcaggacgcuccggggcccagcacguugcccugggccuguggccg

SEQ ID NO: 22403 - RNA, 64 nt, Human
gggccccaccuucaggucuuagugguucacaagagcccagcagccaggcuggcuuuuucauugu

SEQ ID NO: 22404 - RNA, 64 nt, Human
gcccgucugaacugaccucugaccucugccccacgcccagcacagccuugggggaaguguacag

SEQ ID NO: 22405 - RNA, 64 nt, Human
uuggccuaacacugggcugcagagacuggaccccgcccagcauugggcugggcucgccacaucc

SEQ ID NO: 22406 - RNA, 64 nt, Human
ggagcuuccaggccugggauuuacaccacgccuagcccagcagaggccuuagucccauuugggg

SEQ ID NO: 22407 - RNA, 64 nt, Human
ggaagguagagaguuuuccuguucagauuacccugcccagcaggaacuggaauacaguguucgg

SEQ ID NO: 22408 - RNA, 64 nt, Human
ccuuguccuggaccucagguucccagcgucccgagcccagcacugucucuucagugcccugauu

SEQ ID NO: 22409 - RNA, 58 nt, Human
ccaacucggagcccgccugagcuccagugcccagcagcagcaugucagcugagccucc

SEQ ID NO: 22410 - RNA, 64 nt, Human
aaucucuccuaccaagaugguguuccacuguccagcccagcaugaguagcagguagagcacagc

SEQ ID NO: 22411 - RNA, 64 nt, Human
caccacagccuccaaaaauggcagugacuccccagcccagcaccccuuccucgugggucccaga

SEQ ID NO: 22412 - RNA, 64 nt, Human
cugcuuuuccagcccacaaagggggacgaucacggcccagcaaaagcgaugcugagaggggaaa

SEQ ID NO: 22413 - RNA, 64 nt, Human
gggccagacuccugccggccucagaggacaccuggcccagcacaggcagcuagaagggccggug

SEQ ID NO: 22414 - RNA, 64 nt, Human
ccgggaccagggauggggcagcgcacaggcccgggcccagcacagaacugcccaucgggacgcc

SEQ ID NO: 22415 - RNA, 64 nt, Human
gccugccucugccgcuccuccacaucuugccgcugcccagcagagcuggcuucuggguccaccu

SEQ ID NO: 22416 - RNA, 64 nt, Human
gccccuaccagccugaccugagucggcgccgugggcccagcaggccucgcgcagccuagcuccu

SEQ ID NO: 22417 - RNA, 64 nt, Human
ggccucuggcuccaucugaguccccugggagagagcccagcacccaagauccagcaggggacag

SEQ ID NO: 22418 - RNA, 64 nt, Human
uggagcuacaacagccaucuuagguccccgaggugcccagcaucacguaaaacaucgauaugcu

SEQ ID NO: 22419 - RNA, 64 nt, Human
guagcuauaaagacauaugagcgaggccagcugagcccagcacugcggccaagucgaagacuuu

SEQ ID NO: 22420 - RNA, 64 nt, Human
gucauagcuuucauguccauugaagaauuaccaagcccagcaaguaaaaaaaauuacaauaaca

SEQ ID NO: 22421 - RNA, 64 nt, Human
ucaagugaggguccaggaaagcucuugcccucuugcccagcagccgcaggcauaucucaacgga

SEQ ID NO: 22422 - RNA, 64 nt, Human
uucccagcacuucccugccucccccaggccucaggcccagcacccaguuccuccucacauggca

SEQ ID NO: 22423 - RNA, 64 nt, Human
gugcugggauuacaggugggagccacuacagcuggcccagcagcucuguuucugauagaggugg

SEQ ID NO: 22424 - RNA, 64 nt, Human
auccuuaccaccacaccacacgcacacuccacaugcccagcagaguggcacuugguggccagaa

SEQ ID NO: 22425 - RNA, 64 nt, Human
gcugugacccgccacacucacugucaguauuaaggcccagcagccuguugauaagcuacccugu

SEQ ID NO: 22426 - RNA, 64 nt, Human
uucucacaccucuguucccagggccccgcucagggcccagcagagaguccguaggcuugaacau

SEQ ID NO: 22427 - RNA, 64 nt, Human
cucccccuguauucccccucccagggcagccccugcccagcacaaaaccccaggacccuggcuc

SEQ ID NO: 22428 - RNA, 64 nt, Human
accaauccaccaggcagcucagggcuccugcccagcccagcagcuucuguugucuaacguaugg

SEQ ID NO: 22429 - RNA, 64 nt, Human
gcccuguauuuauucccccaucuucaucccaacagcccagcaagaaggaggagacagagagcuc

SEQ ID NO: 22430 - RNA, 64 nt, Human
ccucugccuggccaccaccccaucugggaggugugcccagcagcucauugagaacgggccauga

SEQ ID NO: 22431 - RNA, 64 nt, Human
uaaacaguugaguuucuucuaaagaggaagccuugcccagcaaggaccagugagacagccggau

SEQ ID NO: 22432 - RNA, 64 nt, Human
ccggccggagaacaucugccuugcugcaccugaggcccagcagagccguuccugggacugucag

SEQ ID NO: 22433 - RNA, 64 nt, Human
gguugagcucuccggcuuccagggagaccuccccgcccagcagcccccagagacacaacaaccu

SEQ ID NO: 22434 - RNA, 64 nt, Human
aaaagauacuuaaaagggcuccugggguacacaagcccagcagguccugagugaagccgugggc

SEQ ID NO: 22435 - RNA, 57 nt, Human
uguacaccugcaagcacuaggccuacugcccagcaagccagucuggcacugccagga

SEQ ID NO: 22436 - RNA, 64 nt, Human
ggauuaggcaaggcuccacucauuguugauauuugcccagcaggaaaaucauguaaguuauacc

SEQ ID NO: 22437 - RNA, 64 nt, Human
ggcaugggcaauagcaagcuggcggcagaguccagcccagcauaugacuugcccugaauggaag

SEQ ID NO: 22438 - RNA, 64 nt, Human
ccugucucuucguacucgguuauuaaauggccuagcccagcaaaugaucagccuugcaaauaau

SEQ ID NO: 22439 - RNA, 64 nt, Human
cacucaggaggcugaggcggggaggauccauugagcccagcaguccaaccugggcaaaauagug

SEQ ID NO: 22440 - RNA, 64 nt, Human
gcaaaguuuuccaagaaaaugccccgacaggggugcccagcacacugccugagggacaacagac

SEQ ID NO: 22441 - RNA, 64 nt, Human
aggguuggcaucaucugauggcauguccaagugugcccagcagcggaugcugaagcaccagagc

SEQ ID NO: 22442 - RNA, 64 nt, Human
aagggacucuccaggcuccuccucccccuggcaggcccagcaacaugugccccagaucuggaag

SEQ ID NO: 22443 - RNA, 64 nt, Human
ugggacgcaggugaugccagccaggcccaggagugcccagcaucccccaacugaugacacagua

SEQ ID NO: 22444 - RNA, 64 nt, Human
ugggccugguggaugccaaccuggauaaccuguggcccagcauugacuguccacccagccuugc

SEQ ID NO: 22445 - RNA, 64 nt, Human
gaaaagacaguggcaggcagcuggaguagagcgagcccagcagcccuaaaaggcugccuucaug

SEQ ID NO: 22446 - RNA, 64 nt, Human
gccagacacgcuagguucuuccaaagagucccaagcccagcaccugcuccuggggccacgaccu

SEQ ID NO: 22447 - RNA, 64 nt, Human
accuccagucacugugcccagcagggugggcugugcccagcaggagucaggcuaagaaacgcca

SEQ ID NO: 22448 - RNA, 64 nt, Human
agggacugugcagccuggaaccuccagucacugugcccagcagggugggcugugcccagcagga

SEQ ID NO: 22449 - RNA, 64 nt, Human
gugcucugucagcagccuggccuggucugugccugcccagcauguucccaaaucugugcuggac

SEQ ID NO: 22450 - RNA, 64 nt, Human
acccuuccacagucauuucuucuagguuuucuuggcccagcacugcccaucccaccccaugagg

SEQ ID NO: 22451 - RNA, 64 nt, Human
guagguggcaaguggcacagcuccauguccggaggcccagcacuccgucugaugggaggagucg

SEQ ID NO: 22452 - RNA, 64 nt, Human
uguuuguuuaggcccagguucugcccagaccggggcccagcagagcucucaggaggcugagaaa

SEQ ID NO: 22453 - RNA, 64 nt, Human
ugugaacagggcccaugguguauucuaggccacagcccagcacuccucugggcugcucucaaac

SEQ ID NO: 22454 - RNA, 64 nt, Human
ggugccagggagcacugccagcuugccaguuucugcccagcaaaagcacguaugcuucaggggc

SEQ ID NO: 22455 - RNA, 64 nt, Human
ucaaaccugcccucggacgcuccuggagcuuugugcccagcacucggauucuccuggacaccau

SEQ ID NO: 22456 - RNA, 64 nt, Human
gcuggaugugcugcaggagcuccgaggcacuguggcccagcaggugacugguucuucaggaacu

SEQ ID NO: 22457 - RNA, 64 nt, Human
ccgagucaugcacucaggcagacagcaggcuggagcccagcauucagggguggcuucugucugu

SEQ ID NO: 22458 - RNA, 64 nt, Human
caccaaagucagggagccuggaagccaaacaaaggcccagcagccuucugacaagcaagggcug

SEQ ID NO: 22459 - RNA, 64 nt, Human
cugccucuuccagggccucugggagccugacagugcccagcaugaagguggggccagugcuggg

SEQ ID NO: 22460 - RNA, 64 nt, Human
cccuggggcaucccuuugccuuggcaucccuguagcccagcaacccugccccuccccagcaucc

SEQ ID NO: 22461 - RNA, 64 nt, Human
ucugaaguguauucuacauaaacucucagaggaugcccagcaggauggagucccaguugcccgc

SEQ ID NO: 22462 - RNA, 64 nt, Human
uccacaucuuucccugacucuuggauaugaaacugcccagcauuccugggagucuuaggauuuu

SEQ ID NO: 22463 - RNA, 64 nt, Human
cuuccccagagcagcaggccccgagccccuucaggcccagcacugccccagacucgcuggcacu

SEQ ID NO: 22464 - RNA, 64 nt, Human
ucuuauucaccauguccaagauccugggaucugggcccagcaucucuuccuccuuuguagaugc

SEQ ID NO: 22465 - RNA, 64 nt, Human
gggugggggagagaggaaaggagggaggggagaagcccagcagaagcugagccaggcagagggg

SEQ ID NO: 22466 - RNA, 64 nt, Human
ccaaguggcccccacccucagcccgcuccugcccgcccagcacccccaggcccugggggaccug

SEQ ID NO: 22467 - RNA, 64 nt, Human
cuccccagaagacacaggaaacaauguauugucugcccagcaaucaaaggcaaugcucaaacac

SEQ ID NO: 22468 - RNA, 64 nt, Human
cggcucccauuuucucugcuggcguuucugcugugcccagcaguggcugcuggggaagcagcug

SEQ ID NO: 22469 - RNA, 64 nt, Human
gcugucucuaauuuggccucuguggcaagaccacgcccagcaaaaguggucggcugcagugcca

SEQ ID NO: 22470 - RNA, 64 nt, Human
ugccuagggggacggcgaugggccucacgggcccgcccagcacccugagaccacacuguugccu

SEQ ID NO: 22471 - RNA, 64 nt, Human
acucucuuuagccccaggggagcagcucagcuuagcccagcaugaagagaugggcucugcucug

SEQ ID NO: 22472 - RNA, 64 nt, Human
agggaaaaaauggauucaaagcuaggauuucagggcccagcaguguuccuccaucagcauguua

SEQ ID NO: 22473 - RNA, 64 nt, Human
uuuaagcaggacagugugcgugcacgagcuccgagcccagcacagacaugccuggaacccccgc

SEQ ID NO: 22474 - RNA, 62 nt, Human
uucagcaaaaugcccuauaaacaauuaauuuugcccagcaagcuucugcacuaguaacugac

SEQ ID NO: 22475 - RNA, 64 nt, Human
gggcugcagguugcagucagggcuugaaguaggagcccagcaaagaaccaccugcuggacaguc

SEQ ID NO: 22476 - RNA, 64 nt, Human
gugcguguggggaccucagaacacugugaccuuagcccagcaagccaggcccuucaugaaggcc

SEQ ID NO: 22477 - RNA, 64 nt, Human
cuugggucuggcuggcuccugcccgugacgccuugcccagcagcaaggugcgcaacauggcugc

SEQ ID NO: 22478 - RNA, 64 nt, Human
ccagguagcuaguacuauaggugugcaccaccacgcccagcaaauuuuuaaauuuauuauagag

SEQ ID NO: 22479 - RNA, 64 nt, Human
ccagagaggccuguggcuaguuugcccugggggggcccagcacagccccagcccggagcccagc

SEQ ID NO: 22480 - RNA, 64 nt, Human
uaugugcuagagcccaggccagcucugagaccaagcccagcauugagaauaagcucuguucuaa

SEQ ID NO: 22481 - RNA, 64 nt, Human
cagguagccgaccugcaggagggccuacaaacgggcccagcaagagcugggcaacagcuggcuu

SEQ ID NO: 22482 - RNA, 64 nt, Human
cggccgcgggucuccccgggcgccccucccuggggcccagcaccccuccucgccccauccccgu

SEQ ID NO: 22483 - RNA, 64 nt, Human
gaguccggcauaugaaggcgcaugguucuggacggcccagcagcuccuguggccacagcagcuu

SEQ ID NO: 22484 - RNA, 64 nt, Human
ugggaggaaccaagcccucuucaucuguucaugugcccagcauuuauuaagcaccugcuguaug

SEQ ID NO: 22485 - RNA, 64 nt, Human
gaaacacaggcaaggaaauuggaacugccacccagcccagcaugguggcucaauugguugguug

SEQ ID NO: 22486 - RNA, 64 nt, Human
gccuccagcuccugggauccgggaguccaucccggcccagcacccccagcauccccguguaugg

SEQ ID NO: 22487 - RNA, 64 nt, Human
acacaacaucacacacaggugggggggccugauagcccagcacccaugauacagggccuaccaa

SEQ ID NO: 22488 - RNA, 64 nt, Human
cccucagcccagcuauaaccaguaucagcaguaugcccagcaguggaaccaguacuaucagaac

SEQ ID NO: 22489 - RNA, 64 nt, Human
uuggccaaggcccuuugcacugcaucacccuggugcccagcaacaucagguaaccuucacugag

SEQ ID NO: 22490 - RNA, 64 nt, Human
gucccucuguguuuccagccaucucgcccugccagcccagcaccacugggaaucauggugaagc

SEQ ID NO: 22491 - RNA, 64 nt, Human
ggagggagacggggaugucacgccgucccgcagggcccagcacagccccagacccgaaaaaagu

SEQ ID NO: 22492 - RNA, 64 nt, Human
ggaaagugcccuggaccggcagcuggcgcaccaggcccagcagcagcuggaggaggaggaggag

SEQ ID NO: 22493 - RNA, 64 nt, Human
cgcuucugagcaggggccccuggggacuucaacugcccagcaacauggaggaugguguccugag

SEQ ID NO: 22494 - RNA, 64 nt, Human
cccggcugcccucccuccccagcuuacaccucaagcccagcacgcagugcaccuugaacagagg

SEQ ID NO: 22495 - RNA, 64 nt, Human
acuguaaauagaacccccuccaccaccccccgccgcccagcauccuaccuggacugcggugcua

SEQ ID NO: 22496 - RNA, 64 nt, Human
ugcugcaccuaucaacccauuaccuaguuauuaagcccagcaugcauuagcucuuuuuccugau

SEQ ID NO: 22497 - RNA, 64 nt, Human
ggcggugaagagcugugacaggccggacggggaggcccagcagggagagagggucucucuccua

SEQ ID NO: 22498 - RNA, 64 nt, Human
agccggggagccaagugguucccaugcccacugagcccagcaagcuaagauccacuggcuugga

SEQ ID NO: 22499 - RNA, 64 nt, Human
cuguuagugucgccaccgcccauaaaggagcugagcccagcaggggcacugccuggggcccugu

SEQ ID NO: 22500 - RNA, 64 nt, Human
acauucccaaaaccaaaggacaacugaggagacugcccagcacauaaugaauaaauaagaaaau

SEQ ID NO: 22501 - RNA, 64 nt, Human
uuccugucguaaucaguggugcugcuugacaccugcccagcauguuccugucucuccuuuuccu

SEQ ID NO: 22502 - RNA, 64 nt, Human
gugggugugggcaggggcugcauuuuaugaaacugcccagcaagcugcgcucccuggggcccca

SEQ ID NO: 22503 - RNA, 64 nt, Human
uuuucuuucuuuuuggcuagggaaggugcagguggcccagcauucagggaggagucguaagauc

SEQ ID NO: 22504 - RNA, 64 nt, Human
uccacccacccuggcuuccuccagcucacauggcgcccagcacugggcuucagccaggugcucg

SEQ ID NO: 22505 - RNA, 64 nt, Human
uuccccucugcugcuugugcgcaugcgugcggccgcccagcaagcugugccuuuugcgccucuu

SEQ ID NO: 22506 - RNA, 64 nt, Human
cuaccauguagaauugugcuuggcucauaauagggcccagcaauuacugaagaaagugaagaaa

SEQ ID NO: 22507 - RNA, 64 nt, Human
cuaccacaucuuggcuugcuuuuggaacaggcuggcccagcaucauuugucaucaaguccacug

SEQ ID NO: 22508 - RNA, 64 nt, Human
uuaaaaaaaacagucgcuaguuaacagcgacagagcccagcacccuggggucuuugugaauauc

SEQ ID NO: 22509 - RNA, 64 nt, Human
ucuguccccucccagagggggaacccuggcacuggcccagcagccucuucucugagcuccaugu

SEQ ID NO: 22510 - RNA, 64 nt, Human
ccuuaacugucccccccagucacuucucccacaggcccagcaggacgcaguccugaggaucagg

SEQ ID NO: 22511 - RNA, 64 nt, Human
cucgccuguuggugcuggcccuuggggagcuggagcccagcaugcuggggagugcggucagcuc

SEQ ID NO: 22512 - RNA, 64 nt, Human
cacccacccccacagcgcccugcacccggccgcugcccagcaccgcgcuggcuggcacugaagg

SEQ ID NO: 22513 - RNA, 64 nt, Human
auaccucaaaaggcccuagcuaauaaaccuguaagcccagcauuugagagaagguagggugugu

SEQ ID NO: 22514 - RNA, 64 nt, Human
aggagaaaagcaggugcccuaagauugcucuaaggcccagcaugugguuacaguucucugacuu

SEQ ID NO: 22515 - RNA, 64 nt, Human
caaaggcgccccuccccagagggaucccuaacgugcccagcauguagauucuggacuaacagac

SEQ ID NO: 22516 - RNA, 64 nt, Human
ucaggauuguguuacuaucacuaaguagcaaauugcccagcacauuaguccuaaacgucccaug

SEQ ID NO: 22517 - RNA, 64 nt, Human
uacacuacaaaaggcaagaaugcccauguaaggagcccagcagucuggacagauccuucuuccu

SEQ ID NO: 22518 - RNA, 64 nt, Human
ccucgcccugccgucggggcgcggcugcucacccgcccagcacacgccggggccccaggacaac

SEQ ID NO: 22519 - RNA, 64 nt, Human
ucaggcccucaggaagugucugcugaauggaauggcccagcauuagcccaguauuggaaaagac

SEQ ID NO: 22520 - RNA, 64 nt, Human
cuguuucauucaccacagucagcaugccccaagugcccagcauggggcggauggccaggaauga

SEQ ID NO: 22521 - RNA, 64 nt, Human
gaguguaaucgcauuucugcuugguagaggccgagcccagcaaagguggcuccuucugaaugug

SEQ ID NO: 22522 - RNA, 64 nt, Human
acagcucacgaggcuuggaccugcuguggagggugcccagcagggggcugagcucugaggggug

SEQ ID NO: 22523 - RNA, 64 nt, Human
acgguucacaaggcuuggaccugccauggagggugcccagcagacguggugugagagggacagc

SEQ ID NO: 22524 - RNA, 64 nt, Human
auggcucaugaggcuuggaccugccguggagggugcccagcagacgugguaugagagggauggc

SEQ ID NO: 22525 - RNA, 64 nt, Human
gaacggcucacgagacuuggaccugguggagggugcccagcagacguggugugagagggacggc

SEQ ID NO: 22526 - RNA, 64 nt, Human
acggcucacgaggcuuggaccugcuguggagggugcccagcagacguggugugagaggaacggc

SEQ ID NO: 22527 - RNA, 64 nt, Human
gacaggccaaucccuucccucccagaagcuggccgcccagcaggagggacugaggccagacuca

SEQ ID NO: 22528 - RNA, 64 nt, Human
gcucccuguggcuugugcccaugcaccugccagggcccagcaggccaacccaucaucuagagua

SEQ ID NO: 22529 - RNA, 64 nt, Human
gucuccccaccggcacugggauuggcggguccaagcccagcaaccggcuucgcuccacaacaca

SEQ ID NO: 22530 - RNA, 64 nt, Human
uacauggcaagcuguuucaguuugcaaaaucacugcccagcauguuugaggucaguuggcaccu

SEQ ID NO: 22531 - RNA, 64 nt, Human
ugcaaguuguggagagaaggagcaccggguuccugcccagcacugugcuugcgggaggcggugg

SEQ ID NO: 22532 - RNA, 64 nt, Human
ugcgcaguguggggaggggauggggugcgucagggcccagcaucgccgccuggcaucucucugc

SEQ ID NO: 22533 - RNA, 64 nt, Human
ccaaagugcugagauuacaggugugagccacugugcccagcaguuucccagaauauauuuaaau

SEQ ID NO: 22534 - RNA, 64 nt, Human
ccggggcucuuggcucugcagcgagaaagacacagcccagcagggcuggagacgcccaugucca

SEQ ID NO: 22535 - RNA, 64 nt, Human
cggcgacagaaccugacccguggagacugggagagcccagcaggcaccuguauugcagggcucc

SEQ ID NO: 22536 - RNA, 64 nt, Human
gagagaagggagccccaggcuggagcagcaugaggcccagcaagaagggcuuggguucugagga

SEQ ID NO: 22537 - RNA, 64 nt, Human
aggccgggcgagcccgguguucugaagaccuguggcccagcagagccucugacaguaaaguuuu

SEQ ID NO: 22538 - RNA, 64 nt, Human
cccacagagcccaaaacagaagggggcugccccagcccagcagagcacagaguuucuggagcuc

SEQ ID NO: 22539 - RNA, 64 nt, Human
cugcuuaguugcucggugguuauggauaaacuuugcccagcaugauuuuuggguucaucuuauc

SEQ ID NO: 22540 - RNA, 64 nt, Human
ugauggggaccgccaccuuuucugcaggaaaugugcccagcagcucuuggucaaagcacuguug

SEQ ID NO: 22541 - RNA, 64 nt, Human
cuggcccugacgccuggguuucuuggccccagcugcccagcaggugccucgauucccugcccuu

SEQ ID NO: 22542 - RNA, 64 nt, Human
ggaagaggcgcccugugaacccugaguguugcaggcccagcagacccugcugucccaagcccac

SEQ ID NO: 22543 - RNA, 64 nt, Human
cugagcaccagggagcaguugcccucaggccugugcccagcaugcccuccccuuuuuauacgaa

SEQ ID NO: 22544 - RNA, 50 nt, Human
ccagcaagcuccaagacugagcccagcaccaccccugggcagcagcaucc

SEQ ID NO: 22545 - RNA, 64 nt, Human
cagcagcgauggugagcauuuugguuuccuuaaggcccagcaagacuuccagggacaucucugg

SEQ ID NO: 22546 - RNA, 64 nt, Human
caaggcccucuaggccuggcagggaugucccugugcccagcacagggugccuggcagggggaga

SEQ ID NO: 22547 - RNA, 64 nt, Human
cgaaaucagacccaccugacaccaucacgcggaggcccagcagcaccugcacccacuuccagcu

SEQ ID NO: 22548 - RNA, 64 nt, Human
agaguuggccccucuguggccagccuggcccucagcccagcagagagggcaucaaccaaggaag

SEQ ID NO: 22549 - RNA, 64 nt, Human
uggccugaggggcugcuggacugaccgaggggcugcccagcaagacugcagccucuuccucccu

SEQ ID NO: 22550 - RNA, 64 nt, Human
ucccugcgcuagucucccccgaggguuuaggcuggcccagcacauccuguccuccugagcucgc

SEQ ID NO: 22551 - RNA, 64 nt, Human
aggagccaaacucuugaagcacccccugggucaggcccagcagcggaguggccagccccaguuu

SEQ ID NO: 22552 - RNA, 64 nt, Human
ugccauccuuuguuccuccaccccugaccaaggugcccagcagccugucuucaccagucaagga

SEQ ID NO: 22553 - RNA, 64 nt, Human
cuagaacagcccuccugcacccaggcuggcgacagcccagcagugcccacacaggacugggccc

SEQ ID NO: 22554 - RNA, 64 nt, Human
ucuagcaucuccagcaggacuccaggaugguucagcccagcaccauccaaagggugggagcaca

SEQ ID NO: 22555 - RNA, 64 nt, Human
aaccuaaauauucuagaacuuucccagccucguagcccagcacuucucaaacuuggaaaugcau

SEQ ID NO: 22556 - RNA, 64 nt, Human
ucaggcccuaacccuuggcuccaggagacacagggcccagcacccagguugcugucggcaggcu

SEQ ID NO: 22557 - RNA, 64 nt, Human
cagcgggucuccucccagcggccuccggcgucuugcccagcagcucaagaagaaaaagaaggac

SEQ ID NO: 22558 - RNA, 64 nt, Human
uaccucccccggcaggcaauguccuggcuucucagcccagcaccaucuguuccccuagacuucu

SEQ ID NO: 22559 - RNA, 64 nt, Human
ccugcagcuugugcucugcccagcagugccccuggcccagcaccucagccugcucuucucucug

SEQ ID NO: 22560 - RNA, 64 nt, Human
uagcaaugcucccagguccugcagcuugugcucugcccagcagugccccuggcccagcaccuca

SEQ ID NO: 22561 - RNA, 64 nt, Human
auacaggcaucccgggcacauccacaagcugcuggcccagcagcuggucuccccagugaagugg

SEQ ID NO: 22562 - RNA, 64 nt, Human
ggaaaaggcaccuggaagguuuccauguggcccagcccagcauggaagcagggugggaacucug

SEQ ID NO: 22563 - RNA, 64 nt, Human
gggcugcucuuccagacuggcugugccugccugugcccagcaaccugugcagccggcagugugc

SEQ ID NO: 22564 - RNA, 56 nt, Human
gccuggagauugagcagugaggugcugcccagcagccccugagagccuguggaggg

SEQ ID NO: 22565 - RNA, 64 nt, Human
gcuggcccacaguuuuugagggucaggaguccaggcccagcauaacuggguccucugcucaggg

SEQ ID NO: 22566 - RNA, 64 nt, Human
caauuggggccacugaggcguggcgcccguggcugcccagcaccuucuucgacccaucucaccc

SEQ ID NO: 22567 - RNA, 64 nt, Human
uuccacugaauauugagaaaguuucuuuucaugugcccagcagguuaaguagcguuuucagaau

SEQ ID NO: 22568 - RNA, 64 nt, Human
ucuagaauucuagucuucguguuagauguuuauagcccagcaucuugggaccuuuccaguuacu

SEQ ID NO: 22569 - RNA, 64 nt, Human
cugcucagguucagcuggacucugccaucugugggcccagcaucacucuguaaguuccuugaaa

SEQ ID NO: 22570 - RNA, 64 nt, Human
ccuguacugucccggaggagguugggagguggaggcccagcaucccgcgcagaugacaccauca

SEQ ID NO: 22571 - RNA, 64 nt, Human
gccugggggcacagggugcaaagccaggcacugugcccagcagugggcucccugccugccaccu

SEQ ID NO: 22572 - RNA, 64 nt, Human
ucuccuuaagugaagaaagagucaaugagauuuugcccagcacauggagcuguaauccagagag

SEQ ID NO: 22573 - RNA, 64 nt, Human
ggaccugugacuccuuaauaaggaccugugacaugcccagcaucaagggauaagaccguaaauu

SEQ ID NO: 22574 - RNA, 64 nt, Human
aggagccaggccccaccccuucccuauaggaacagcccagcacagguauuucaggugugaaaga

SEQ ID NO: 22575 - RNA, 64 nt, Human
uaacuacguaagccucuuuggcaaggguccuggugcccagcacccaggcuaaaauauccugucu

SEQ ID NO: 22576 - RNA, 64 nt, Human
guucuuccauuaagccucggcugagugagggaaagcccagcacugcugcccucucggguaacuc

SEQ ID NO: 22577 - RNA, 59 nt, Human
ucuucuuccuggugcacugacugccuggugcccagcacaugugcugcccuacagcaccc

SEQ ID NO: 22578 - RNA, 64 nt, Human
uggugcaggaaaacuaccuggaguaccggcaggugcccagcagugaucccauaugcuaugaguu

SEQ ID NO: 22579 - RNA, 64 nt, Human
uguuccagccucugaagacaguugaggagaucaagcccagcaaugguggcagaaucuuacucca

SEQ ID NO: 22580 - RNA, 64 nt, Human
uuccuuugaauauugagaaaguuucuuuucaugugcccagcagguuaaguagcguuuucagaau

SEQ ID NO: 22581 - RNA, 64 nt, Human
uccaggcuucacucaggguagagaaacaagcaaagcccagcagcgcacagggugcuuguuaucc

SEQ ID NO: 22582 - RNA, 64 nt, Human
agaccugucccugucccuccucagcucuagggugaaaggcgagagguugcacaggacauggaca

SEQ ID NO: 22583 - RNA, 64 nt, Human
acauugcugugcaauuguuggggaggguagggggaaaggcgagaggagauacuuauuggucuuu

SEQ ID NO: 22584 - RNA, 64 nt, Human
aaucucugggaacuuuggguuucuuauccucaaaaaaggcgauggaagggcuggggaagugauu

SEQ ID NO: 22585 - RNA, 64 nt, Human
gcugagcagaacaucagaaaaagcaagaagaagaaaaggcgacaucaagaaggaaaggucucag

SEQ ID NO: 22586 - RNA, 64 nt, Human
agcugguacaauaccaacuccccuucuaguucccaaaggcgauguccagacacagacuuuauga

SEQ ID NO: 22587 - RNA, 64 nt, Human
uuuaacauuugaagccacuucagcagcagcagcaaaaggcgaacucaucucuacccaagauguu

SEQ ID NO: 22588 - RNA, 64 nt, Human
agugucgugggccugcucgcuagcagaagucagaaaaggcgauaggcuuggcuuuaaggauuuc

SEQ ID NO: 22589 - RNA, 64 nt, Human
agcauucuucaucauucaaguucuaccuggacacaaaggcgaggacccugggguuccaacaaag

SEQ ID NO: 22590 - RNA, 64 nt, Human
uugccaaaagaguuugggaaaugcuggcuuaaacaaaggcgagaggaaguuccuuucacgucag

SEQ ID NO: 22591 - RNA, 64 nt, Human
aaaaaaaaguuaaacccucucauuauuaaagaggaaaggcgauggugaugucuguaguacaaua

SEQ ID NO: 22592 - RNA, 64 nt, Human
caggaaauccucaccagaaucuggcacugcagccaaaggcgauacuuccagaguucuaguaggc

SEQ ID NO: 22593 - RNA, 64 nt, Human
gucaggugagaaggcguccacaaaagaggggagaaaaggcgacgaaucaggacacagugaacuu

SEQ ID NO: 22594 - RNA, 64 nt, Human
cagagggcgcguuuggguuugauggcgaguuucuaaaggcgaggaaaugguuuguaagagggga

SEQ ID NO: 22595 - RNA, 64 nt, Human
aaugcaggaagaacuuagacaaugccugaaaugcaaaggcgacacuggagucuucuuucucuaa

SEQ ID NO: 22596 - RNA, 64 nt, Human
auuuuagaggaaaagagguugccugcuuccuaucaaaggcgacucugugcuacauguugguuuc

SEQ ID NO: 22597 - RNA, 64 nt, Human
ucggcuuuauuuauguaacauuugcuagcuuguaaaaggcgaaugugaaauauugcaucugcau

SEQ ID NO: 22598 - RNA, 64 nt, Human
cgcucaaaugccggacugagcccugaguguuuggaaaggcgagacuccgccuuucuaaucacaa

SEQ ID NO: 22599 - RNA, 64 nt, Human
aauacgaaugaaggaagagcccucagauggaacgaaaggcgaugugcaaggccaucccagagag

SEQ ID NO: 22600 - RNA, 64 nt, Human
uccccucccuuguccuugaaaguaggauauagcgaaaggcgaguccaggagcucaggaagaaga

SEQ ID NO: 22601 - RNA, 64 nt, Human
ccagcuuaagggcaaagugaguuaauguguagacaaaggcgagggacaagagagaguuaacauc

SEQ ID NO: 22602 - RNA, 64 nt, Human
ugggggcauuuuuagagcggcaauaauugaaaaaaaaggcgaacucugccuuggagagguagau

SEQ ID NO: 22603 - RNA, 64 nt, Human
gguugggguggggcggaguugugugucucuguagaaaggcgaaggggcaguuccuaucaggacu

SEQ ID NO: 22604 - RNA, 64 nt, Human
cagccacacacgggccuugcaaccuugucagagaaaaggcgaacagggcccucacccugccugu

SEQ ID NO: 22605 - RNA, 64 nt, Human
uagagagccugaaaaacugccccaaugccacgguaaaggcgaggaagucuuggcuggcguugcu

SEQ ID NO: 22606 - RNA, 64 nt, Human
cuucuaggauugaaaggugcauuuuccccauaaaaaaggcgaggaaaacccauggcugcuuugu

SEQ ID NO: 22607 - RNA, 64 nt, Human
gaaguaagccagcuguggaucccgcccacucagaaaaggcgagaaggcuuugugauuuucuaca

SEQ ID NO: 22608 - RNA, 64 nt, Human
ccaagugacugugugugggguuugacaacuguggaaaggcgagcagaaaacuccggcggucuga

SEQ ID NO: 22609 - RNA, 58 nt, Human
caacuaaaaaauauaucuaagcauuugcaaaggcgacaauaaauuauugacgcuuaac

SEQ ID NO: 22610 - RNA, 64 nt, Human
augcaaauugauaaggaucuaacacuaggaaaauaaaggcgaguuuugguuugguugguuucag

SEQ ID NO: 22611 - RNA, 64 nt, Human
cuugauggaggggcuagaggcgacccuuguuguaaaaggcgaucagaacaccugagggaggaag

SEQ ID NO: 22612 - RNA, 64 nt, Human
agauguguugacagucgugaguguguauccuaggaaaggcgagcuggacucugucuccauggug

SEQ ID NO: 22613 - RNA, 64 nt, Human
agaaugugccuguguacuggacauggucugcaugaaaggcgagguggcuggugcaggggugagg

SEQ ID NO: 22614 - RNA, 64 nt, Human
gcagccauuuggaccucaguaugagguaguguuaaaaggcgaagucauuucuucaggaaguaaa

SEQ ID NO: 22615 - RNA, 64 nt, Human
ccaggcaucacagaagcacaggaggccaguucugaaaggcgagcagaacucccccuggggagga

SEQ ID NO: 22616 - RNA, 64 nt, Human
cuggucucaaaagucaccugccuacaaauguacaaaaggcgaagguucugauggcugccuugcu

SEQ ID NO: 22617 - RNA, 64 nt, Human
ggggggacccuggcaccgcauuagagcucgaaauaaaggcgauagcugacuuucauuuggggca

SEQ ID NO: 22618 - RNA, 64 nt, Human
gccguggaggggguccuagcuccgcugcauucugcaucccaagugggcacguggaggaaggguc

SEQ ID NO: 22619 - RNA, 64 nt, Human
ccggggcucuggacccaggguaacagccccaguucaucccaaccccucucagagccucaagagg

SEQ ID NO: 22620 - RNA, 64 nt, Human
gauacgacagcucucugugcacugauugcauaugcaucccaagauuauauuauuguuuucuacu

SEQ ID NO: 22621 - RNA, 64 nt, Human
ggauuuugcuuccucuuguauucugauugcccuucaucccaaguguuuacugaaaauuccauuc

SEQ ID NO: 22622 - RNA, 64 nt, Human
gggguuacuucugucugauccugggccuuucuuucaucccaaaugacaaggaauguggcucaga

SEQ ID NO: 22623 - RNA, 64 nt, Human
ugcgaauucugugagccaagcagaccuucccucucaucccaaggagccagaguccucccaagau

SEQ ID NO: 22624 - RNA, 64 nt, Human
gggucaccugaccuguaguccuuuaacccaccaucaucccaaacucuccuguccuuugccuuca

SEQ ID NO: 22625 - RNA, 64 nt, Human
uguaggcaaccuucccucucuccuuggugaagaacaucccaagccagaaagaaguuaacuacag

SEQ ID NO: 22626 - RNA, 64 nt, Human
aaaacaaaaaccuagauuccggauuaggggaugacaucccaaacagcccggaguauuugcagaa

SEQ ID NO: 22627 - RNA, 64 nt, Human
gaaaucuccucaaacccagaagguuuaaucacuucaucccaaaaaugggauugugaaugucagc

SEQ ID NO: 22628 - RNA, 64 nt, Human
agaaaagucuagguuuuaaggcugugccagaacccaucccaauaaagagaccgagucugaaguc

SEQ ID NO: 22629 - RNA, 64 nt, Human
uugcuguggauuaucaaguuuugaaggaacuguacaucccaacagacugaaacauucuaaguga

SEQ ID NO: 22630 - RNA, 64 nt, Human
auucacauauaagagaugaacauccaugugagaucaucccaaucagaauauaagacucaaggag

SEQ ID NO: 22631 - RNA, 64 nt, Human
uccagauagcuccagaguaugaugaccccagccccaucccaaucucuagcgaaaggguuaugca

SEQ ID NO: 22632 - RNA, 64 nt, Human
ucuucggggaagagaggugggguggggcuacuagcaucccaauuuagaaaacagaggaguuugu

SEQ ID NO: 22633 - RNA, 64 nt, Human
acaucuccccaggugcccauggaacaccugcuuucaucccaaauauccguccaccuaggcgggg

SEQ ID NO: 22634 - RNA, 64 nt, Human
cuugcugccuuguuuccugccaggagcgcccugacaucccaaaaccaucuucccacaugugggu

SEQ ID NO: 22635 - RNA, 64 nt, Human
ggccgagugaggucgggccuggggagcugagugacaucccaagcuugggcuuggguagugagug

SEQ ID NO: 22636 - RNA, 64 nt, Human
acacuggaggucucuucugccauugugcuggucccaucccaagaauuguaggacagagaccaca

SEQ ID NO: 22637 - RNA, 64 nt, Human
ucgaucucuugaccucgugauccgcccgccucagcaucccaaagugcugggauuacaggcauga

SEQ ID NO: 22638 - RNA, 51 nt, Human
agcagauucucaccaugugaucaucccaaaagagcuggagugacaugggag

SEQ ID NO: 22639 - RNA, 64 nt, Human
agauucugcacuuggggucucugacacaacacaccaucccaaaguagccggaagagcuaaacac

SEQ ID NO: 22640 - RNA, 64 nt, Human
cugccaucuagccagccccucuuccccaaugcuccaucccaaccaggcaccucuuccuugaugu

SEQ ID NO: 22641 - RNA, 64 nt, Human
accagcauauaauuuuuaauaucuuuacuucuaucaucccaaaucaaagaacucuucucuauua

SEQ ID NO: 22642 - RNA, 64 nt, Human
aauugucuugccauuacuuaguauauguagacuucaucccaauugucaaacauccuagguaagu

SEQ ID NO: 22643 - RNA, 64 nt, Human
uuacccuuaagcuaggauguugcucagaagugaccaucccaacuuuggugcgggcacaauaaau

SEQ ID NO: 22644 - RNA, 64 nt, Human
aggcugagccuugggaauaguuuggcagguuuaacaucccaaggcuaaccuaacguaguuggga

SEQ ID NO: 22645 - RNA, 64 nt, Human
aauagacuaaggaugccuuugcagaacaccaaagcaucccaaggaacugguagggaaguggcgc

SEQ ID NO: 22646 - RNA, 64 nt, Human
cucaagcagcagagguaagaggaagaggcagcagcaucccaagaaggaaagagcuggagucagc

SEQ ID NO: 22647 - RNA, 64 nt, Human
auuccccuuaaaaggaaacagaucaacuacaccgcaucccaacaacccagguucuuuuccuucc

SEQ ID NO: 22648 - RNA, 64 nt, Human
uggacugaaggagaaaaaagcaaaauucuuguuucaucccaauucuaguuagaacaaaguuaaa

SEQ ID NO: 22649 - RNA, 64 nt, Human
aaaaugccuaacccaggaccuuggaaauucuacucaucccaaaugauaauuccaaaugcuguua

SEQ ID NO: 22650 - RNA, 64 nt, Human
uguaggucuuaacuuuauacuuagcaaguuacuccaucccaauuuagugcuccugugugaccuu

SEQ ID NO: 22651 - RNA, 64 nt, Human
gaaacauuagucuuaggaauucuucaaaaaauggcaucccaaugaaaauaaauuugaugacuau

SEQ ID NO: 22652 - RNA, 64 nt, Human
ggcugucaugugucucgaaaucagcagcccuccccaucccaaucccaggcagcuuguguguaca

SEQ ID NO: 22653 - RNA, 64 nt, Human
aguaaggaaaauuggagaugcuaacauccucccccaucccaacugcaccuuaaaauaugcaugu

SEQ ID NO: 22654 - RNA, 64 nt, Human
aaaagcuuugauucaacacaauuguucaucuucacaucccaaacagaaucacuguuucuugaau

SEQ ID NO: 22655 - RNA, 53 nt, Human
cuccaccaccuccucuuugaugacaucccaauucgcagacaauguccucugug

SEQ ID NO: 22656 - RNA, 64 nt, Human
ugaaguugcaagacuuaaagaaauaauccaucugcaucccaaguccuauuuuauaaggauauuc

SEQ ID NO: 22657 - RNA, 64 nt, Human
caugaagaggaagccucaagaucccuuggaauugcaucccaaggcaaagcuuuuggcucaccga

SEQ ID NO: 22658 - RNA, 64 nt, Human
uuguucccuucagacucaggggcuccaccaaugccaucccaaaacagggucagacacugcccag

SEQ ID NO: 22659 - RNA, 64 nt, Human
gccaucuuaaaggaagcaauggauggaucccuuucaucccaacuguucuucgcgguaucaaaaa

SEQ ID NO: 22660 - RNA, 64 nt, Human
ccaacaucuuccauggacacaugacauugaagaccaucccaagcuaucgccacccuuggagaug

SEQ ID NO: 22661 - RNA, 64 nt, Human
uauagauugacacccuccugccuguuuuucucugcaucccaaccuggccaaggccccuccugug

SEQ ID NO: 22662 - RNA, 64 nt, Human
acgacagguccacccaagacugucaagggaugagcaucccaaaccugcuccacagagguagcug

SEQ ID NO: 22663 - RNA, 64 nt, Human
uuguacaucuuuguacagagacaucuuggcaccucaucccaacaaaucacauuuguagaaaugu

SEQ ID NO: 22664 - RNA, 64 nt, Human
uuaauuuuuuucuuuuaaaauaaacagcugggaccaucccaaaagacaagccaugcauacaacu

SEQ ID NO: 22665 - RNA, 64 nt, Human
acugggggacgugcccccagagccacccacuucucaucccaaacccaguuucccugcccccuga

SEQ ID NO: 22666 - RNA, 64 nt, Human
uaaggcaaugguuucacaugguuacauaucaaaacaucccaauucuuuagugcugaucaucgag

SEQ ID NO: 22667 - RNA, 64 nt, Human
ccuaggauuauaauucuuugugcacaaugcaucccaucccaaagacaguccacagcaggacuug

SEQ ID NO: 22668 - RNA, 64 nt, Human
uggaccugugggugugcccuggggaccccugacccaucccaaaacacuguggaaagaagggccu

SEQ ID NO: 22669 - RNA, 64 nt, Human
guuugaagcaacaaagucacagcccagcuguggccaucccaagcaaauugagaauauauucacu

SEQ ID NO: 22670 - RNA, 64 nt, Human
agcuuucuuuggaaaucucccaggugaggauucacaucccaaaauaaaauucagaagccaggug

SEQ ID NO: 22671 - RNA, 64 nt, Human
caagagcgaaacucuugucugaaaaaauaaaguucaucccaacuuucaagucuacaaaaacaua

SEQ ID NO: 22672 - RNA, 64 nt, Human
acuuggccucaccccacccauggaauaccugccucaucccaaagaucagguaugggcugaaugc

SEQ ID NO: 22673 - RNA, 64 nt, Human
ccuggaacuccuaaaccuuugccccuggggcuuccaucccaaccagugccaaggaccuccucuu

SEQ ID NO: 22674 - RNA, 64 nt, Human
agugaucucagaggggcccauggauuaacgcccucaucccaagguccgucccaugacauaacac

SEQ ID NO: 22675 - RNA, 64 nt, Human
accaccagugcuaccaccguugccacugagcccacaucccaagagacaggcccagagccuaaag

SEQ ID NO: 22676 - RNA, 64 nt, Human
gguuuugauauggcuagugaccagcacugaccaccaucccaagcugggaagagcaauuggugaa

SEQ ID NO: 22677 - RNA, 64 nt, Human
cuuccaaauacuuguagccaaacauuggcuagaacaucccaagauaugcugacacuguccuguu

SEQ ID NO: 22678 - RNA, 64 nt, Human
aguucacuguuguuggagacaugacaaucauuuucaucccaagaacacuuuaaggaaacauuuu

SEQ ID NO: 22679 - RNA, 64 nt, Human
guuuggaauauuugcauuauacuuaccaguugggcaucccaaaucugaaaucugaaauguucca

SEQ ID NO: 22680 - RNA, 64 nt, Human
aagaaccagccauuuuuaaaaagguuauuauugacaucccaauauuuugucuuggugggcuuac

SEQ ID NO: 22681 - RNA, 64 nt, Human
gacuccaaguaguaaucccagaccccaccuugcucaucccaaccuguuccggucuccccaucag

SEQ ID NO: 22682 - RNA, 64 nt, Human
cacucuggcuuuccgugccacucuucuuccuuuccaucccaaaagucucuugcggccccugaaa

SEQ ID NO: 22683 - RNA, 64 nt, Human
agaacuguaaugcuguuuuggaaucaucccaaggcaucccaagacaccauaucuucccauuuca

SEQ ID NO: 22684 - RNA, 64 nt, Human
augccaaagaagaacuguaaugcuguuuuggaaucaucccaaggcaucccaagacaccauaucu

SEQ ID NO: 22685 - RNA, 64 nt, Human
auauauuuuagucuguuauuuaagaaaaacauaacaucccaaaaucuuugacaauucucgaaag

SEQ ID NO: 22686 - RNA, 64 nt, Human
uuguauggcuugaaaaagaaaugacaauauggaacaucccaaggcugucccauaggguuggaag

SEQ ID NO: 22687 - RNA, 64 nt, Human
agugauuugcauguauaauaucaggaaaauuaagcaucccaagugugacuggacaaagagagca

SEQ ID NO: 22688 - RNA, 64 nt, Human
uuugcacacucuuauuuuucuguaaaauauuucacaucccaaaugugaagaagugaaaaagacu

SEQ ID NO: 22689 - RNA, 64 nt, Human
uuaaaggauguggcuuuauuuuauaaaucacaaccaucccaacaguggauuuaaacaagauuuc

SEQ ID NO: 22690 - RNA, 64 nt, Human
gagugggauuauucaucaaacucuuugcccaguucaucccaaugggggaaguauucccuucuuu

SEQ ID NO: 22691 - RNA, 64 nt, Human
acaguauguuuuacauguauuuaaaguagcaucccaucccaacuuccuuuaauuauugcuuguc

SEQ ID NO: 22692 - RNA, 64 nt, Human
accccuuggggagcaggcucgggcuccccagccccaucccaaacccuucagugccaaaaacaac

SEQ ID NO: 22693 - RNA, 64 nt, Human
gucccuucacucugagagagaaaaucguggcgugcaucccaaacccuaggccacgccugugggu

SEQ ID NO: 22694 - RNA, 64 nt, Human
aaggagacuuagagccaaacuguuuaagcuguaucaucccaacaaaguauccuuucaugaacgg

SEQ ID NO: 22695 - RNA, 64 nt, Human
uugguaaauguuaggaacacaccaggucaccugacaucccaagaaugcucacaaaccugcaggc

SEQ ID NO: 22696 - RNA, 64 nt, Human
aaaacaugauuauaguggcagcugaccaaucccccaucccaaauugaccauuuagauguaccaa

SEQ ID NO: 22697 - RNA, 64 nt, Human
ugcaucucaucuggacuauggguuguacugugaccaucccaacaccucacccucugucuacaag

SEQ ID NO: 22698 - RNA, 64 nt, Human
acaaacagaaaagcucgaggcucccaccccgccacaucccaacuucauuucccccucacuguag

SEQ ID NO: 22699 - RNA, 64 nt, Human
ucuuugcaaaccgagaagaguggcaugcuucuggcaucccaagucaggauuuuagcucagauga

SEQ ID NO: 22700 - RNA, 64 nt, Human
agaaacccaauuaauuugauaagcuuggggacaacaucccaauagauaaaaauuuuuaagggaa

SEQ ID NO: 22701 - RNA, 64 nt, Human
aaagaauucagaccucauggaacucuggguucuucaucccaaguuucccaggcacuuuuggcca

SEQ ID NO: 22702 - RNA, 64 nt, Human
ccugaacucgcagaugaauccugccacacaugcucaucccaaaagcuagaggagauugcucugg

SEQ ID NO: 22703 - RNA, 64 nt, Human
aaacuccugaccucaggugaucugccugccuuggcaucccaaagugcugggauuacaagaauga

SEQ ID NO: 22704 - RNA, 64 nt, Human
aggcugcugaagugaguagcugagcagcuggagccaucccaagcaucagugucucagaguccuc

SEQ ID NO: 22705 - RNA, 64 nt, Human
cuagaaagggcucacucuaccucuaggcauguuucaucccaacaaucagacugugccaaagcag

SEQ ID NO: 22706 - RNA, 64 nt, Human
cuaccuccgaggcacccugcagggcaaugcaugucaucccaacccccacacuccccauccucca

SEQ ID NO: 22707 - RNA, 64 nt, Human
uuuuaaccuuuuuguuuaacuucucucuucacugcaucccaauccaucuacaggcaugcacacu

SEQ ID NO: 22708 - RNA, 64 nt, Human
accuguaaagcaaguccuuucaaguuucacugcacaucccaaaccauguuacaaaaagagcaac

SEQ ID NO: 22709 - RNA, 64 nt, Human
caggugcggggaagggaagggcccaggccagacccaucccaaacggaugaugggaugaugggac

SEQ ID NO: 22710 - RNA, 64 nt, Human
cgcugcaguauugacuuggaauccugaccauguccaucccaaaauucaguccucaguuaacgga

SEQ ID NO: 22711 - RNA, 64 nt, Human
ucuuugggucuuucccggguacacuagauggcuccaucccaaggcaucuugucauaaaacagcu

SEQ ID NO: 22712 - RNA, 64 nt, Human
gcucaugcagccacaggucaccuucugugauccccaucccaaggcacugguggugacucugcuu

SEQ ID NO: 22713 - RNA, 64 nt, Human
gagauaucccuaucuggucucacucaguccucugcaucccaacauucccaggacaugcaugauc

SEQ ID NO: 22714 - RNA, 64 nt, Human
aaacuccugaucucaagugaucugcccaccucaccaucccaaagugcugggauuacaggcguga

SEQ ID NO: 22715 - RNA, 64 nt, Human
ucccaaucugcagugggagagcuuugcugaauuccaucccaaagucaaacaugggcaagaggug

SEQ ID NO: 22716 - RNA, 64 nt, Human
gcaagaaaacaccugcugcugaugcaaugcaaugcaucccaaugguuguggggauugugggcuc

SEQ ID NO: 22717 - RNA, 64 nt, Human
uucgauacccaggaccaagccacagcagguccuccaucccaacagccaugcccgcauuagcucu

SEQ ID NO: 22718 - RNA, 64 nt, Human
uugaucucuugaccuugugauccaccugccucaucaucccaaagugcugggauuacaggcguga

SEQ ID NO: 22719 - RNA, 64 nt, Human
uaggcuugaaucaugggcuccuuggcuuuccuagcaucccaaagcagucaacagugauuucuua

SEQ ID NO: 22720 - RNA, 64 nt, Human
accggugggaccaaaagggaacaggugccucagccaucccaacagugucgucagagggucccca

SEQ ID NO: 22721 - RNA, 64 nt, Human
caugugcuuuagcauaaaagaauauuuagaaaaacaucccaagaaaaucacaucacuaccuaga

SEQ ID NO: 22722 - RNA, 64 nt, Human
gaauucacuuuaugugagaucucccgagaguuuccaucccaacaugauggacuuugguuugaac

SEQ ID NO: 22723 - RNA, 64 nt, Human
ccaauuaaaucaugauaugccaucaauuaugagacaucccaauuugagagauguuagauuauag

SEQ ID NO: 22724 - RNA, 64 nt, Human
gaauaggaaaaccuuuaaaccccggucauccggacaucccaacgcaugcuccuggagcucacag

SEQ ID NO: 22725 - RNA, 64 nt, Human
aggcgacugugcuugaguccucucuugcucuuuacaucccaaaucccaucaauugucacgccuu

SEQ ID NO: 22726 - RNA, 64 nt, Human
guucauguccuuaaauaucaccuauacucugccacaucccaaagggaucucaagccuucagcuc

SEQ ID NO: 22727 - RNA, 64 nt, Human
uccaauagacaacaaaguugaggaaccacuggcacaucccaagcuaagauacaagguuaaaugg

SEQ ID NO: 22728 - RNA, 64 nt, Human
cacuuccuugccuccguaaggccagaggaagaaccaucccaaucauuugaucuccagcuccaca

SEQ ID NO: 22729 - RNA, 64 nt, Human
agccaggaugcccugugguuguggcgccccaggccaucccaaacccaguggcagaggaagcugc

SEQ ID NO: 22730 - RNA, 64 nt, Human
uuacuccuguaccuucugcucaauuuccuuuccucaucccaaauaaaugccuuguuacaagauu

SEQ ID NO: 22731 - RNA, 64 nt, Human
gccacagcaaguacagcggcuccccucugcuucucaucccaaccucuuuuuccuccuggacaca

SEQ ID NO: 22732 - RNA, 64 nt, Human
aauugccucucccagggccugcugggugagucaccaucccaaagcaggaagggugcccuggaga

SEQ ID NO: 22733 - RNA, 64 nt, Human
gcucugugcuaguuuuuuuuuucuguuuuagccucaucccaaauauaaagcuuugugaaguaca

SEQ ID NO: 22734 - RNA, 64 nt, Human
uuuucccccuugaaauguccagauuccugugguucaucccaaggaaauuuucacacaaagcuug

SEQ ID NO: 22735 - RNA, 64 nt, Human
guuaaccacugcuuuggcaaugcugcuuauaacacaucccaagugcaggccgcagugguccacg

SEQ ID NO: 22736 - RNA, 64 nt, Human
gcuuacaugauuacaccuguaaaguaagcccaaacaucccaaauguccgucaacugaugagugg

SEQ ID NO: 22737 - RNA, 64 nt, Human
ugguccaaacagaacuaagcauaaaucauugugccaucccaaaccucguuccagccgccuugcc

SEQ ID NO: 22738 - RNA, 64 nt, Human
agcauccuccacacaccgugacaaugggcaaaaucaucccaaaccaggcugccccagccccagc

SEQ ID NO: 22739 - RNA, 64 nt, Human
cuagauucugcaggaaaccccagcagugugaacgcaucccaacauagguuaagagcaaguugaa

SEQ ID NO: 22740 - RNA, 64 nt, Human
aaguuucgccaugcuggaugaugaaauggauucccaucccaaagucugagauggauugcauaua

SEQ ID NO: 22741 - RNA, 64 nt, Human
agccuguggcccaggcccuucuguccccaggcaucaucccaacagcucauuuucccuaguccgc

SEQ ID NO: 22742 - RNA, 64 nt, Human
ccccuggcuacccccacccuggcuaccccaacggcaucccaaggccaggugggcccucagcuga

SEQ ID NO: 22743 - RNA, 64 nt, Human
ucccguggaugcucuuucaaugcagcacccuugccaucccaagcccagugaccuuacucguaua

SEQ ID NO: 22744 - RNA, 64 nt, Human
guucgcagugucaccccagagucagaacuguacacaucccaaaauuugguggccguggaacaca

SEQ ID NO: 22745 - RNA, 64 nt, Human
uggugcuagagccagggccaucuggacuaugcuccaucccaagggccaagggucaggggccggg

SEQ ID NO: 22746 - RNA, 64 nt, Human
aagugaagccagcagaggagugauagcugcuccccaucccaaagugggccugggcagucaggcu

SEQ ID NO: 22747 - RNA, 64 nt, Human
uacuugaagaggcuuuacauaaaggguucucucucaucccaagacugcuaauuuagugauucug

SEQ ID NO: 22748 - RNA, 64 nt, Human
auuugaguuuaccaacauacuuuaaaaguccuuacaucccaaauuguguuuauaauuauuuucu

SEQ ID NO: 22749 - RNA, 64 nt, Human
uucccaggcuggucugacaugcagcuuaggcuuucaucccaaguuagguacugaccccucccuc

SEQ ID NO: 22750 - RNA, 64 nt, Human
gucgccaugccguugcgaggccuccgggaugucccaucccaagccaucacacuccacaaaaaca

SEQ ID NO: 22751 - RNA, 64 nt, Human
uggauaaaacuguguaaaccacauaauuuuuguacaucccaaaggaugagaaugugaccuuuaa

SEQ ID NO: 22752 - RNA, 64 nt, Human
uagcgaacaaccacaggaauuuuaaaaacaaaaacaucccaagauuuuuucauuucaaaaugcu

SEQ ID NO: 22753 - RNA, 64 nt, Human
acauccuucagcagcugagaaacgaacacgaauccaucccaaccgagaugccauuaacauucau

SEQ ID NO: 22754 - RNA, 64 nt, Human
uucaugauuccucgcaagcugggcccaguccucucaucccaagagcagagccaccguagccgga

SEQ ID NO: 22755 - RNA, 64 nt, Human
gcuuccugguggcaaguaacugugcacccuccaacaucccaaccccagaggaaccagugggauu

SEQ ID NO: 22756 - RNA, 64 nt, Human
gugcuuuuugugucauguuuaagaaauuuuugcccaucccaaaaucauaagauauuuuucauga

SEQ ID NO: 22757 - RNA, 64 nt, Human
ggugcagccaaauaucacaccuucugaucuuagccaucccaaaccaguaucugucccgagagga

SEQ ID NO: 22758 - RNA, 64 nt, Human
ucauagcgugaucuuagccuagguaggccacauccaucccaaaggaaaauguagacaucaccug

SEQ ID NO: 22759 - RNA, 64 nt, Human
uuuaccaccaacuuaggggacuguuuuaaagagccaucccaaggccucuccuagcaggcagaag

SEQ ID NO: 22760 - RNA, 64 nt, Human
gcuggagcaguucuuuuucaguucucauccucuccaucccaauccaguauaucaaucaacucua

SEQ ID NO: 22761 - RNA, 64 nt, Human
ugccuccuggguucaagcgaaccuccugccucagcaucccaaguagcugggauuacaggcaccc

SEQ ID NO: 22762 - RNA, 64 nt, Human
ugguacccguaaaaguugugggaauugugacccccaucccaaggggaugccaaaauuucucuca

SEQ ID NO: 22763 - RNA, 64 nt, Human
ggcaggaauaugcugaccuuucacccugccaucccaucccaaccccagcucacuagccuucaua

SEQ ID NO: 22764 - RNA, 64 nt, Human
ucugaaaaauggccaacaauuuuuuuagaaguagcaucccaagcagcgugccuaaacauuacau

SEQ ID NO: 22765 - RNA, 64 nt, Human
cugugugacaguuugaugaaacugguuacauuuacaucccaaaacuuugguugaguuugcagga

SEQ ID NO: 22766 - RNA, 64 nt, Human
aguucccuccuuuucuugcauguaaguugucccccaucccaaaguauuccaucuacuuuucuau

SEQ ID NO: 22767 - RNA, 64 nt, Human
agagugcccccacguggaacauucuggagcuggccaucccaaauucaaucaguccauagagacg

SEQ ID NO: 22768 - RNA, 64 nt, Human
cccacacaauaaaugguaacauaggagacauccacaucccaauucugacaagaccucaugccug

SEQ ID NO: 22769 - RNA, 64 nt, Human
ccucccagggaggcugugcacagacugucuugaacaucccaaaugccaccggaaccccagcccu

SEQ ID NO: 22770 - RNA, 64 nt, Human
uuuaccggcagugcgggaggaauuucugaguggccaucccaaggucuagguggagguggggcau

SEQ ID NO: 22771 - RNA, 64 nt, Human
ucuacucaccccuagggccucaguaaacucagaccaucccaacuggggcuccuggggguacagg

SEQ ID NO: 22772 - RNA, 64 nt, Human
ucaauucugccauuagagacacauccaaugcucccaucccaaagguucaaaaguuuucaaauaa

SEQ ID NO: 22773 - RNA, 64 nt, Human
cccucuaggcacacgcgcacuuccaucucugccccaucccaacugcaccagcacugccuccccc

SEQ ID NO: 22774 - RNA, 64 nt, Human
cccuaacuuucuugcuucaaaaauuaaaauccagcaucccaagaucauucuacaaguaauuuug

SEQ ID NO: 22775 - RNA, 64 nt, Human
guccaccaccaucuccuccacguugagugaagcucaucccaagcaaggagccccagucucccga

SEQ ID NO: 22776 - RNA, 64 nt, Human
ccggaaccuucuuggcaccaaacacuacaaacuucaucccaacuugcucacuugaagaagugug

SEQ ID NO: 22777 - RNA, 64 nt, Human
auauauaaauaucuauaugacgcucuuaaaaaaacaucccaaccaaaaccaaccaaacaaaaac

SEQ ID NO: 22778 - RNA, 64 nt, Human
gacaaaaggaguaauuauuugguauagauccacccaucccaaccuuucucuccucagucccugc

SEQ ID NO: 22779 - RNA, 64 nt, Human
aacuugucccaaaucuagcuuugcccacgaauggcaucccaacagaguuaaagaaacugcuugc

SEQ ID NO: 22780 - RNA, 64 nt, Human
auuccguaaaagcauugacgcagccccuacacuccaucccaaccaagaaacugcauuuccuggg

SEQ ID NO: 22781 - RNA, 64 nt, Human
gaguguuuuccucccuuugccucuaccuggcccucaucccaacagcccagcaaggggagagaga

SEQ ID NO: 22782 - RNA, 64 nt, Human
gggagggagauguggcuugaggucaagcgccaugcaucccaagccuuugaccuucccgcuaugg

SEQ ID NO: 22783 - RNA, 64 nt, Human
ccucagcgauuugugcuuguuugugcuagaagaacaucccaaauaggagaaccucucacaagcu

SEQ ID NO: 22784 - RNA, 64 nt, Human
gaccuguguuuuggcaaggugauccuuccagagccaucccaaaaagucagcacugacaugggau

SEQ ID NO: 22785 - RNA, 64 nt, Human
uaaguuaauacuaucauaguaauauuauuauugucaucccaagaaaaaauauauuaaaaagaua

SEQ ID NO: 22786 - RNA, 64 nt, Human
aaaauuaauacuaucauguuaauacuauuauugucaucccaagaaaaaagauauuuuaaaaauu

SEQ ID NO: 22787 - RNA, 64 nt, Human
cccaacuuccaaaggucaauaugucguccuuuggcaucccaacuaacaauaaagaauaggcuau

SEQ ID NO: 22788 - RNA, 64 nt, Human
cccaacuucuaaaggucaauauaucauccuuuggcaucccaacuaacaauaaagaguaggcuau

SEQ ID NO: 22789 - RNA, 64 nt, Human
guucccuaagaacugcuucugugugcccuguuuucaucccaagauuucucacuucauccucucc

SEQ ID NO: 22790 - RNA, 64 nt, Human
gggaaagucccacacuguccuccuauuaccuuaacaucccaagcuuccuuuccuuuuuuggucu

SEQ ID NO: 22791 - RNA, 64 nt, Human
uuuuauccucuaaccaaaaaauuguuuaauuuugcaucccaaauguuuuuaaucuuuguauauu

SEQ ID NO: 22792 - RNA, 64 nt, Human
uagcugaggugucaaguccugccuuuccuuucaucaucccaaauuuccccugccaugugugcug

SEQ ID NO: 22793 - RNA, 64 nt, Human
aaaauugcaaccucaggcauaaauggguuaaggacaucccaagcccaagugguacgugccucac

SEQ ID NO: 22794 - RNA, 64 nt, Human
ccauccucggcgguucccaucaccacugcaguuccaucccaagucacagcugcccuaggucccg

SEQ ID NO: 22795 - RNA, 64 nt, Human
uuagagauaugacugucaguugcagugaguucugcaucccaaguggagggaauuggguuugugg

SEQ ID NO: 22796 - RNA, 64 nt, Human
cacauguaucccagugagcaguaaaucaauggaacaucccaagaagaggauaaggaugcuuaaa

SEQ ID NO: 22797 - RNA, 64 nt, Human
gccagcaagcuucggaaaaccacagcaucaaagacaucccaaauaacaugcccagcuagcucug

SEQ ID NO: 22798 - RNA, 64 nt, Human
uuuauaaaucacccacaaacuuguucuuuaauuucaucccaaucacuuuuucagaggccuguua

SEQ ID NO: 22799 - RNA, 64 nt, Human
uacccucccaaggcaccaguacucuaccauggggcaucccaagugggguccucacccaucccag

SEQ ID NO: 22800 - RNA, 64 nt, Human
guuggaaagagauggaauguggcugggaacauugcaucccaaagagcuucucaguggaggaggc

SEQ ID NO: 22801 - RNA, 64 nt, Human
aaaaaauuggaaagcaucuuacccauuuucuucacaucccaaauuuuuauuuguuccaugucau

SEQ ID NO: 22802 - RNA, 64 nt, Human
gcagaggguuagaggcacuugagcaaggcccccacaucccaacucugggaguuguggugggagg

SEQ ID NO: 22803 - RNA, 64 nt, Human
cuggaucugucucuguauuccucacucccuuccccaucccaaccccuucuuucucuagauuguu

SEQ ID NO: 22804 - RNA, 64 nt, Human
cccucgugacagaaccuuucagcauaacgccucacaucccaagucuauacccuuaccugaagaa

SEQ ID NO: 22805 - RNA, 64 nt, Human
cugcccaccaauggagaaucccaauguugaaucucaucccaauguuguuuuguuguucugcaaa

SEQ ID NO: 22806 - RNA, 64 nt, Human
agcuucggguaucagaggaggcugaccuggcccccaucccaaguuacaagaacuucagugagac

SEQ ID NO: 22807 - RNA, 64 nt, Human
guguuuaauggguuaaaaauaagccacugccugacaucccaacauuugacaccccagcaaugug

SEQ ID NO: 22808 - RNA, 64 nt, Human
uuuacuguauguuuuuacugaaugaucuauuccccaucccaaggcaagcaugaauaaaauuagg

SEQ ID NO: 22809 - RNA, 64 nt, Human
gguaguguucagcugcuucagcaguguccccaaccaucccaauagggugggggccugugggcca

SEQ ID NO: 22810 - RNA, 64 nt, Human
ugaaccacuucucagagauaucuucccaggugcccaucccaacguuacuauuauaucauaauuu

SEQ ID NO: 22811 - RNA, 64 nt, Human
aaagaucauguauauaaucgaaguguauuaguaccaucccaagguuuuuuucucauuuaacaua

SEQ ID NO: 22812 - RNA, 64 nt, Human
uggguguggccugggcucaugccugguggugucacaucccaaggcagcaagagcauggauaccg

SEQ ID NO: 22813 - RNA, 64 nt, Human
aucuuucacuggggaagccaguuuccacaggcagcaucccaagguucaauaaggccuuauuuaa

SEQ ID NO: 22814 - RNA, 64 nt, Human
uuucucugccaagcccauuuacccccaccucaugcaucccaaggcucuacugggucccuggacc

SEQ ID NO: 22815 - RNA, 64 nt, Human
aaagacucaaguggacccuacaaugaagccuacacaucccaauagaagccccuucuuaugcuga

SEQ ID NO: 22816 - RNA, 64 nt, Human
uaacuccuuccaguguccuuagaacauuuuaauucaucccaacugucuuuuuuucccuaccauu

SEQ ID NO: 22817 - RNA, 64 nt, Human
gagcagcacaugcgcgugcuguggcaggaggacgcaucccaaucgggagggagagacagagaca

SEQ ID NO: 22818 - RNA, 64 nt, Human
gaggugacaucucauccccucacugaagcaacagcaucccaaggugcucagccggacucccugg

SEQ ID NO: 22819 - RNA, 64 nt, Human
agcuguugcugaggagggggcugggaccccuucccaucccaaccuugagccccaggagauaccg

SEQ ID NO: 22820 - RNA, 64 nt, Human
gcaccugcucccacagaagggggaacgcaagaggcaucccaagaccucaucugccugcaguguc

SEQ ID NO: 22821 - RNA, 64 nt, Human
ccccaugggggcuguggccccuccgcaggcaggacaucccaaccccuggcugggacugaaccac

SEQ ID NO: 22822 - RNA, 64 nt, Human
ugcauggcacagcucacuuuggcccuucuccacccaucccaaccccauugcuaacaacauggua

SEQ ID NO: 22823 - RNA, 64 nt, Human
cauauguacagcauucuucuuagaguugccuuuucaucccaauuacagugagucugauuuccau

SEQ ID NO: 22824 - RNA, 64 nt, Human
gccacuuagugggcaugguuacauugguuuauagcaucccaagaacuguagaucccuaggcccc

SEQ ID NO: 22825 - RNA, 64 nt, Human
gugcuugguggaagucagcagggcaucuggagcucaucccaauggugucucuauaguuauuaau

SEQ ID NO: 22826 - RNA, 64 nt, Human
uucccuccagucuucugagggauaggggacauuccaucccaagcuucucccuuacccacaccua

SEQ ID NO: 22827 - RNA, 64 nt, Human
agaaauuagugcagauugcagauguucugucuuccaucccaaacaagccugccaugagguagga

SEQ ID NO: 22828 - RNA, 64 nt, Human
ucccagaagcgcccuguauuuauucccccaucuucaucccaacagcccagcaagaaggaggaga

SEQ ID NO: 22829 - RNA, 64 nt, Human
ccuccugguggugagccagucugcauucccacgccaucccaaagcccuuucaucuuccccgugc

SEQ ID NO: 22830 - RNA, 64 nt, Human
ccccaacccccuugggguggggcagaaggugaagcaucccaacugacuagagacucaggcccug

SEQ ID NO: 22831 - RNA, 64 nt, Human
caaauagauuuuugauucagcucauuaugaaaaacaucccaaacuuuaaaaugcgaaauuauug

SEQ ID NO: 22832 - RNA, 64 nt, Human
cucaauugcugugcagguuaaaacuacagaaccacaucccaaagguaccugguaagaauguuug

SEQ ID NO: 22833 - RNA, 64 nt, Human
cacuuccccuccuugagaagaccagaagucaacccaucccaaagacaaacugcaugaaaagggu

SEQ ID NO: 22834 - RNA, 64 nt, Human
caggaauagaauggagggagcuccagaaacuuuccaucccaaaggcagucuccgugguugaagc

SEQ ID NO: 22835 - RNA, 50 nt, Human
ucagaccugccaaagucuaacaucccaaggugaugaaaaugacccacauu

SEQ ID NO: 22836 - RNA, 64 nt, Human
cagcacucacuacugccuacaucaaggcuaaggccaucccaauccccggggccaagucuugaug

SEQ ID NO: 22837 - RNA, 58 nt, Human
gcccugucugcuuccuguaaacucccuccaucccaaccuggcucccucccacccaacc

SEQ ID NO: 22838 - RNA, 64 nt, Human
uaugugaacaucaggcaaagccaugagaucaaaccaucccaagccuuucaccaaugagguacaa

SEQ ID NO: 22839 - RNA, 64 nt, Human
uucagccaaaugccccaacuuucagucuguaccccaucccaagcauagccagcucccccuccuu

SEQ ID NO: 22840 - RNA, 64 nt, Human
uccauagaagggcuucccaaaccuuguuuugcaacaucccaaauugucuccaguugaaggaagg

SEQ ID NO: 22841 - RNA, 64 nt, Human
gcgugcaguccggcaucucccgcggaugcuuuuccaucccaagugccugcggagcgccgaggag

SEQ ID NO: 22842 - RNA, 64 nt, Human
uccuucccgugugagaagggccagaggguccaggcaucccaaguccagcgugaagggccacagc

SEQ ID NO: 22843 - RNA, 64 nt, Human
acaaggguaaacauuuuacuuuauguaauugccacaucccaagauguaaaacggcaguaauuua

SEQ ID NO: 22844 - RNA, 64 nt, Human
aauuucucacucuuccuucucccucuccccgucccaucccaaccacugaucugcucaggcaacu

SEQ ID NO: 22845 - RNA, 64 nt, Human
uugcaucgauguaaucagaaugaagaccgcaugccaucccaagauuauguccucacuuauaacu

SEQ ID NO: 22846 - RNA, 52 nt, Human
ccagagacuucuacccauagcacaucccaacaccgucacgccaaaggaagag

SEQ ID NO: 22847 - RNA, 64 nt, Human
gcugugcuugggaacccccacuccccacuccccacaucccaacauccuggugucuguccccagu

SEQ ID NO: 22848 - RNA, 64 nt, Human
agggugcugugucuccccuugccugugcccaggucaucccaaacccuucuguuauuuauuaggg

SEQ ID NO: 22849 - RNA, 64 nt, Human
ugccuucugguuucaagcaacucuucugccucagcaucccaaguagcugggauaacaggugcca

SEQ ID NO: 22850 - RNA, 64 nt, Human
cccuggaauucacccucucauguuucccuacuaacaucccaauaaaguccucuucccuaccagg

SEQ ID NO: 22851 - RNA, 64 nt, Human
uguuagacuuuagaagauugauacugaugcacugcaucccaaaccaucaagggccuuuuccccu

SEQ ID NO: 22852 - RNA, 64 nt, Human
cucccuuucugcuggaguccccuguguccucagccaucccaagaaggguuugcuggucccuccu

SEQ ID NO: 22853 - RNA, 64 nt, Human
gccaucuuaaaggaagcaggggcuggaugccuuucaucccaacuauucucugugguaucaaaaa

SEQ ID NO: 22854 - RNA, 64 nt, Human
caacacauuuaaaggaauuguguucuuuuggaaucaucccaauuauaacacgagcuauugcaua

SEQ ID NO: 22855 - RNA, 64 nt, Human
ugagagugccauccgaaagaagcuaaaccuugcacaucccaacacccaccccagggagaguucc

SEQ ID NO: 22856 - RNA, 64 nt, Human
aagccaaguaccuuuucagcuuuuuaacugcccccaucccaacccagggaggccugugucacuc

SEQ ID NO: 22857 - RNA, 64 nt, Human
guagcccugcacaaaggguggggagucaggagaccaucccaaaggcaucucccugucuuccucu

SEQ ID NO: 22858 - RNA, 64 nt, Human
gccgcuggucccccaccaggcuugggagcccuggcaucccaaaggggcaacgggaggaagggga

SEQ ID NO: 22859 - RNA, 64 nt, Human
cagucccguggaaggagcagggguuggagaaaggcaucccaaagcuucgauggagagcagggaa

SEQ ID NO: 22860 - RNA, 64 nt, Human
cagugaugcuggaggacacaccauggggugaagccaucccaaggcugacagcucagucuucacc

SEQ ID NO: 22861 - RNA, 64 nt, Human
accuucaccuucauccauguccaacccccgacuucaucccaaaggacagccgccuggagaugac

SEQ ID NO: 22862 - RNA, 64 nt, Human
uguuuacauagcauuuguguaaagacuaugaucucaucccaauaaaaugauauauuaaaccuuc

SEQ ID NO: 22863 - RNA, 64 nt, Human
ccucccucaccaguggaggcuggguagugcuggccaucccaaaagggcucuguccugggagucu

SEQ ID NO: 22864 - RNA, 64 nt, Human
uucaggggagcguuucuuccaugacacacagcaacaucccaaagaaauaaacaagugugacaaa

SEQ ID NO: 22865 - RNA, 64 nt, Human
uaccagcauagacuguaugauuucugcuauuuugcaucccaauauaggaguagaauaauaucua

SEQ ID NO: 22866 - RNA, 64 nt, Human
uagcagcacuggcccucugucuuccuggguggcacaucccaagagccccuuccugcacuccugg

SEQ ID NO: 22867 - RNA, 64 nt, Human
guucaugggguaguggccucucaaaggcugggcgcaucccaagacagccagcagguugucucug

SEQ ID NO: 22868 - RNA, 64 nt, Human
agcuccuccagagcuuucuccgcccaccucacugcaucccaaguggagcuuuugguguccaguu

SEQ ID NO: 22869 - RNA, 64 nt, Human
cacugcagcaucccccacuucuccacggaagccccaucccaaagcugcugccuggccccuugcu

SEQ ID NO: 22870 - RNA, 64 nt, Human
ccaggaaaguggccaagaagcaguggccuuauugcaucccaaaccacgccucuugaccaggcug

SEQ ID NO: 22871 - RNA, 64 nt, Human
gaccacggcuguuccccucacccaaaagaauuaucaucccaacagccaagacccaacaggugcu

SEQ ID NO: 22872 - RNA, 64 nt, Human
ucuguagguugccagaacucaaaagucugaaaaacaucccaaaagaccauucuuagguuguacu

SEQ ID NO: 22873 - RNA, 64 nt, Human
aaaccaaggaaggccgaggauggaugcgcauccccaucccaagaagucgggaagaagccaggaa

SEQ ID NO: 22874 - RNA, 64 nt, Human
gagcucgccugcauaugcagggucugucauggaacaucccaagucugugcagcagggagcccca

SEQ ID NO: 22875 - RNA, 64 nt, Human
ggcuggggguucucacaccuuacuccaccgggcacaucccaaccugcacuggggcccacucgag

SEQ ID NO: 22876 - RNA, 64 nt, Human
gguuggagaccccgcucccaugccccagcugugccaucccaaauacuugggcagcagcucagca

SEQ ID NO: 22877 - RNA, 64 nt, Human
cugugucaucacacauacccacuucacacacacacaucccaaauaccaccaccaaccaccuucu

SEQ ID NO: 22878 - RNA, 64 nt, Human
ggcuggggguucucacaccuuacuccaccgggcacaucccaaccugcacuggggcccacccgag

SEQ ID NO: 22879 - RNA, 64 nt, Human
agcugcaggaucccaggggaagggucucucucugcaucccaagccauccagcccuucucccugu

SEQ ID NO: 22880 - RNA, 64 nt, Human
gguggagggugcggcccggaguuguccaucuguccaucccaacagcaagacgaggauguggcug

SEQ ID NO: 22881 - RNA, 64 nt, Human
cugaggccaggaacgugcaaauuugcaggugcugcaucccaagccccucaugcuccugccuucc

SEQ ID NO: 22882 - RNA, 64 nt, Human
cuucccaucuuguggcauguggugcccccaccaacaucccaaggggaccaauccccuugccacc

SEQ ID NO: 22883 - RNA, 64 nt, Human
aaauauccucccugcauggcuuuauccucccucucaucccaaagcagguaucuucugguuguca

SEQ ID NO: 22884 - RNA, 64 nt, Human
cucucguugccaccuugaccuuggcuggggcuugcaucccaaggcauccaucagagcagacgcc

SEQ ID NO: 22885 - RNA, 64 nt, Human
acggagucuucccagagggccggcuggaacaguacaucccaagucggccauugaaaacucaaga

SEQ ID NO: 22886 - RNA, 64 nt, Human
accaaauaagaauaacacucaagacuauguucuccaucccaacacaucacuuaccacuugcacu

SEQ ID NO: 22887 - RNA, 64 nt, Human
uguaguuuggauuaacuccccucccgccuacccccaucccaaacugcauuuauaauuuugugac

SEQ ID NO: 22888 - RNA, 64 nt, Human
cccagauuaggaagguucugccauccaucccagccaucccaaacaacuaccagaauaauggauu

SEQ ID NO: 22889 - RNA, 64 nt, Human
cauugccucugucuaguuccaaaacauuuuuuaucaucccaaaaugaaacccuguagccauuaa

SEQ ID NO: 22890 - RNA, 64 nt, Human
uaaauugauuauuugaaacuuuacaacacaauugcaucccaaauacaaauuguauugcuuauuc

SEQ ID NO: 22891 - RNA, 64 nt, Human
caguggcaacaagcauggcaauugacucuguccucaucccaaguuggaaucgcuuuucucucug

SEQ ID NO: 22892 - RNA, 64 nt, Human
uucguguuuucugagcagaauguacgaggugugccaucccaaaaccagcugcuacccuguccuu

SEQ ID NO: 22893 - RNA, 64 nt, Human
ucugaggucuaacauuguuauccuauaucauuuucaucccaaguagugauaucugugaaaucac

SEQ ID NO: 22894 - RNA, 64 nt, Human
ccacauauugcacgugcagggagguaagugccugcaucccaaaucgguucuaggucaacuggcc

SEQ ID NO: 22895 - RNA, 64 nt, Human
gcggaaaggaggcuccgugagaugggguccagcccaucccaacacaagggugcagcuugauucg

SEQ ID NO: 22896 - RNA, 64 nt, Human; identical to SEQ ID NO: 8469

SEQ ID NO: 22897 - RNA, 64 nt, Human; identical to SEQ ID NO: 8470

SEQ ID NO: 22898 - RNA, 64 nt, Human; identical to SEQ ID NO: 8471

SEQ ID NO: 22899 - RNA, 64 nt, Human; identical to SEQ ID NO: 8472

SEQ ID NO: 22900 - RNA, 64 nt, Human; identical to SEQ ID NO: 8473

SEQ ID NO: 22901 - RNA, 64 nt, Human; identical to SEQ ID NO: 8474

SEQ ID NO: 22902 - RNA, 64 nt, Human; identical to SEQ ID NO: 8475

SEQ ID NO: 22903 - RNA, 64 nt, Human; identical to SEQ ID NO: 8476

SEQ ID NO: 22904 - RNA, 64 nt, Human; identical to SEQ ID NO: 8477

SEQ ID NO: 22905 - RNA, 64 nt, Human; identical to SEQ ID NO: 8478

SEQ ID NO: 22906 - RNA, 64 nt, Human; identical to SEQ ID NO: 8479

SEQ ID NO: 22907 - RNA, 64 nt, Human; identical to SEQ ID NO: 8480

SEQ ID NO: 22908 - RNA, 64 nt, Human; identical to SEQ ID NO: 8481

SEQ ID NO: 22909 - RNA, 64 nt, Human; identical to SEQ ID NO: 8482

SEQ ID NO: 22910 - RNA, 64 nt, Human; identical to SEQ ID NO: 8483

SEQ ID NO: 22911 - RNA, 50 nt, Human; identical to SEQ ID NO: 8484

SEQ ID NO: 22912 - RNA, 64 nt, Human; identical to SEQ ID NO: 8485

SEQ ID NO: 22913 - RNA, 64 nt, Human; identical to SEQ ID NO: 8486

SEQ ID NO: 22914 - RNA, 64 nt, Human; identical to SEQ ID NO: 8487

SEQ ID NO: 22915 - RNA, 64 nt, Human; identical to SEQ ID NO: 8488

SEQ ID NO: 22916 - RNA, 64 nt, Human; identical to SEQ ID NO: 8489

SEQ ID NO: 22917 - RNA, 64 nt, Human; identical to SEQ ID NO: 8490

SEQ ID NO: 22918 - RNA, 64 nt, Human; identical to SEQ ID NO: 8491

SEQ ID NO: 22919 - RNA, 51 nt, Human; identical to SEQ ID NO: 8492

SEQ ID NO: 22920 - RNA, 64 nt, Human; identical to SEQ ID NO: 8493

SEQ ID NO: 22921 - RNA, 64 nt, Human; identical to SEQ ID NO: 8494

SEQ ID NO: 22922 - RNA, 64 nt, Human; identical to SEQ ID NO: 8495

SEQ ID NO: 22923 - RNA, 64 nt, Human; identical to SEQ ID NO: 8496

SEQ ID NO: 22924 - RNA, 64 nt, Human; identical to SEQ ID NO: 8497

SEQ ID NO: 22925 - RNA, 64 nt, Human; identical to SEQ ID NO: 8498

SEQ ID NO: 22926 - RNA, 64 nt, Human; identical to SEQ ID NO: 8499

SEQ ID NO: 22927 - RNA, 64 nt, Human; identical to SEQ ID NO: 8500

SEQ ID NO: 22928 - RNA, 64 nt, Human; identical to SEQ ID NO: 8501

SEQ ID NO: 22929 - RNA, 63 nt, Human; identical to SEQ ID NO: 8502

SEQ ID NO: 22930 - RNA, 64 nt, Human; identical to SEQ ID NO: 8503

SEQ ID NO: 22931 - RNA, 64 nt, Human; identical to SEQ ID NO: 8504

SEQ ID NO: 22932 - RNA, 64 nt, Human; identical to SEQ ID NO: 8505

SEQ ID NO: 22933 - RNA, 64 nt, Human; identical to SEQ ID NO: 8506

SEQ ID NO: 22934 - RNA, 64 nt, Human; identical to SEQ ID NO: 8507

SEQ ID NO: 22935 - RNA, 64 nt, Human; identical to SEQ ID NO: 8508

SEQ ID NO: 22936 - RNA, 64 nt, Human; identical to SEQ ID NO: 8509

SEQ ID NO: 22937 - RNA, 64 nt, Human; identical to SEQ ID NO: 8510

SEQ ID NO: 22938 - RNA, 64 nt, Human; identical to SEQ ID NO: 8511

SEQ ID NO: 22939 - RNA, 64 nt, Human; identical to SEQ ID NO: 8512

SEQ ID NO: 22940 - RNA, 64 nt, Human; identical to SEQ ID NO: 8513

SEQ ID NO: 22941 - RNA, 64 nt, Human; identical to SEQ ID NO: 8514

SEQ ID NO: 22942 - RNA, 64 nt, Human; identical to SEQ ID NO: 8515

SEQ ID NO: 22943 - RNA, 64 nt, Human; identical to SEQ ID NO: 8516

SEQ ID NO: 22944 - RNA, 64 nt, Human; identical to SEQ ID NO: 8517

SEQ ID NO: 22945 - RNA, 64 nt, Human; identical to SEQ ID NO: 8518

SEQ ID NO: 22946 - RNA, 64 nt, Human; identical to SEQ ID NO: 8519

SEQ ID NO: 22947 - RNA, 64 nt, Human; identical to SEQ ID NO: 8520

SEQ ID NO: 22948 - RNA, 64 nt, Human; identical to SEQ ID NO: 8521

SEQ ID NO: 22949 - RNA, 64 nt, Human; identical to SEQ ID NO: 8522

SEQ ID NO: 22950 - RNA, 64 nt, Human; identical to SEQ ID NO: 8523

SEQ ID NO: 22951 - RNA, 64 nt, Human; identical to SEQ ID NO: 8524

SEQ ID NO: 22952 - RNA, 64 nt, Human; identical to SEQ ID NO: 8525

SEQ ID NO: 22953 - RNA, 64 nt, Human; identical to SEQ ID NO: 8526

SEQ ID NO: 22954 - RNA, 64 nt, Human; identical to SEQ ID NO: 8527

SEQ ID NO: 22955 - RNA, 64 nt, Human; identical to SEQ ID NO: 8528

SEQ ID NO: 22956 - RNA, 64 nt, Human; identical to SEQ ID NO: 8529

SEQ ID NO: 22957 - RNA, 64 nt, Human; identical to SEQ ID NO: 8530

SEQ ID NO: 22958 - RNA, 64 nt, Human; identical to SEQ ID NO: 8531

SEQ ID NO: 22959 - RNA, 64 nt, Human; identical to SEQ ID NO: 8532

SEQ ID NO: 22960 - RNA, 64 nt, Human; identical to SEQ ID NO: 8533

SEQ ID NO: 22961 - RNA, 64 nt, Human; identical to SEQ ID NO: 8534

SEQ ID NO: 22962 - RNA, 64 nt, Human; identical to SEQ ID NO: 8535

SEQ ID NO: 22963 - RNA, 64 nt, Human; identical to SEQ ID NO: 8536

SEQ ID NO: 22964 - RNA, 64 nt, Human; identical to SEQ ID NO: 8537

SEQ ID NO: 22965 - RNA, 64 nt, Human; identical to SEQ ID NO: 8538

SEQ ID NO: 22966 - RNA, 64 nt, Human; identical to SEQ ID NO: 8539

SEQ ID NO: 22967 - RNA, 64 nt, Human; identical to SEQ ID NO: 8540

SEQ ID NO: 22968 - RNA, 64 nt, Human; identical to SEQ ID NO: 8541

SEQ ID NO: 22969 - RNA, 64 nt, Human; identical to SEQ ID NO: 8542

SEQ ID NO: 22970 - RNA, 64 nt, Human; identical to SEQ ID NO: 8543

SEQ ID NO: 22971 - RNA, 64 nt, Human; identical to SEQ ID NO: 8544

SEQ ID NO: 22972 - RNA, 64 nt, Human; identical to SEQ ID NO: 8545

SEQ ID NO: 22973 - RNA, 64 nt, Human; identical to SEQ ID NO: 8546

SEQ ID NO: 22974 - RNA, 64 nt, Human; identical to SEQ ID NO: 8547

SEQ ID NO: 22975 - RNA, 54 nt, Human; identical to SEQ ID NO: 8548

SEQ ID NO: 22976 - RNA, 64 nt, Human; identical to SEQ ID NO: 8549

SEQ ID NO: 22977 - RNA, 64 nt, Human; identical to SEQ ID NO: 8550

SEQ ID NO: 22978 - RNA, 64 nt, Human; identical to SEQ ID NO: 8551

SEQ ID NO: 22979 - RNA, 64 nt, Human; identical to SEQ ID NO: 8552

SEQ ID NO: 22980 - RNA, 64 nt, Human; identical to SEQ ID NO: 8553

SEQ ID NO: 22981 - RNA, 64 nt, Human; identical to SEQ ID NO: 8554

SEQ ID NO: 22982 - RNA, 64 nt, Human; identical to SEQ ID NO: 8555

SEQ ID NO: 22983 - RNA, 64 nt, Human; identical to SEQ ID NO: 8556

SEQ ID NO: 22984 - RNA, 64 nt, Human; identical to SEQ ID NO: 8557

SEQ ID NO: 22985 - RNA, 64 nt, Human; identical to SEQ ID NO: 8558

SEQ ID NO: 22986 - RNA, 64 nt, Human; identical to SEQ ID NO: 8559

SEQ ID NO: 22987 - RNA, 64 nt, Human; identical to SEQ ID NO: 8560

SEQ ID NO: 22988 - RNA, 64 nt, Human; identical to SEQ ID NO: 8561

SEQ ID NO: 22989 - RNA, 64 nt, Human; identical to SEQ ID NO: 8562

SEQ ID NO: 22990 - RNA, 64 nt, Human; identical to SEQ ID NO: 8563

SEQ ID NO: 22991 - RNA, 64 nt, Human; identical to SEQ ID NO: 8564

SEQ ID NO: 22992 - RNA, 64 nt, Human; identical to SEQ ID NO: 8565

SEQ ID NO: 22993 - RNA, 64 nt, Human; identical to SEQ ID NO: 8566

SEQ ID NO: 22994 - RNA, 64 nt, Human; identical to SEQ ID NO: 8567

SEQ ID NO: 22995 - RNA, 64 nt, Human; identical to SEQ ID NO: 8568

SEQ ID NO: 22996 - RNA, 64 nt, Human; identical to SEQ ID NO: 8569

SEQ ID NO: 22997 - RNA, 64 nt, Human; identical to SEQ ID NO: 8570

SEQ ID NO: 22998 - RNA, 64 nt, Human; identical to SEQ ID NO: 8571

SEQ ID NO: 22999 - RNA, 64 nt, Human; identical to SEQ ID NO: 8572

SEQ ID NO: 23000 - RNA, 64 nt, Human; identical to SEQ ID NO: 8573

SEQ ID NO: 23001 - RNA, 64 nt, Human; identical to SEQ ID NO: 8574

SEQ ID NO: 23002 - RNA, 64 nt, Human; identical to SEQ ID NO: 8575

SEQ ID NO: 23003 - RNA, 64 nt, Human; identical to SEQ ID NO: 8576

SEQ ID NO: 23004 - RNA, 64 nt, Human; identical to SEQ ID NO: 8577

SEQ ID NO: 23005 - RNA, 64 nt, Human; identical to SEQ ID NO: 8578

SEQ ID NO: 23006 - RNA, 64 nt, Human; identical to SEQ ID NO: 8579

SEQ ID NO: 23007 - RNA, 64 nt, Human; identical to SEQ ID NO: 8580

SEQ ID NO: 23008 - RNA, 64 nt, Human
aaauauuaauuauucuuguuuuucucacacaggcauacuccaaaugcuucuuccaguucauuuu

SEQ ID NO: 23009 - RNA, 64 nt, Human
uggacuuuuuuguacauaaauaagaaaaaccaaaauacuccaaagaugacuuccccugccuccu

SEQ ID NO: 23010 - RNA, 64 nt, Human
caaagguaauggcccaucgaugagcauuuuuaacauacuccauagucuuuuccugugguguuag

SEQ ID NO: 23011 - RNA, 64 nt, Human
agugauuuucuuuauaagaaaauuugggcucugaauacuccauucugccucacuuccuugaccu

SEQ ID NO: 23012 - RNA, 64 nt, Human
gggagccugagccccuucagcuuugaggggggugauacuccaggcuguuuggggugggagccaa

SEQ ID NO: 23013 - RNA, 64 nt, Human
uucugacuuccauccccaaaacacauuuaccagcauacuccaaacuguuucugauguguuccau

SEQ ID NO: 23014 - RNA, 64 nt, Human
aagcucuuuucuccugcagaaagggccacccaugauacuccacucccagcagcucaaccuaccc

SEQ ID NO: 23015 - RNA, 64 nt, Human
acaaagguccccuggcccuucaucugggaaucauauacuccacucuagcucccagaaucuacag

SEQ ID NO: 23016 - RNA, 52 nt, Human
gacuguucaaaaaaucuugagcauacuccagcaagauauguuuuugguagca

SEQ ID NO: 23017 - RNA, 64 nt, Human
gcaaauaacugagccaaccagaauaaaauaaccaauacuccacugcucauauuuuuaucuaauu

SEQ ID NO: 23018 - RNA, 64 nt, Human
ggaccugcguugccgucuaugcaaaugcaugcaaauacuccaggcccugggaugugggcuugug

SEQ ID NO: 23019 - RNA, 64 nt, Human
gaaaacggugacaagguuaacauaaggacaacaaauacuccacccugucaugguaugugaggug

SEQ ID NO: 23020 - RNA, 64 nt, Human
auccuauaacucacucagagacacaugguaacacauacuccagauugaccuuauaaauaaaaga

SEQ ID NO: 23021 - RNA, 64 nt, Human
auguuuacucaguuuagugucuuguauuucuauaauacuccaacaggaaugguagucacacugu

SEQ ID NO: 23022 - RNA, 64 nt, Human
ccagggaggcgucccucccuaggagccacacauuauacuccaagucccugccgggcuccgccuu

SEQ ID NO: 23023 - RNA, 64 nt, Human
gagacugcaggugccgcacauugucaaguuagaaauacuccagguggguguuagcacuguggug

SEQ ID NO: 23024 - RNA, 64 nt, Human
cuuccuguaccuugacaugcaaaaggcucuccuaauacuccacauucaaacugaagaggaaaau

SEQ ID NO: 23025 - RNA, 64 nt, Human
ccguucucuggaaauggcaucagauuuaaggauaauacuccaucauagaaauaagccuuaauaa

SEQ ID NO: 23026 - RNA, 64 nt, Human
uaauggcaaugguagucuuugguuagcugcaaaaauacuccauuucaaguuaaaaaugcaucuu

SEQ ID NO: 23027 - RNA, 64 nt, Human
acaguuggaaaauauaauugcucuuugauagcauauacuccaauuuuuccauaguccuaacuac

SEQ ID NO: 23028 - RNA, 64 nt, Human
ggcuuaauagugcauuuauuuuuagcacugaauaauacuccauugucuagaugaauaguuuauc

SEQ ID NO: 23029 - RNA, 64 nt, Human
uuuucgaaccuauuugguuuacccugcaagcuaaauacuccacggcagagcuuaauuauccuuu

SEQ ID NO: 23030 - RNA, 64 nt, Human
augcaaacauaacaaaaucacuuccauagugacgauacuccaaccauauggauauuagucauag

SEQ ID NO: 23031 - RNA, 64 nt, Human
gcagcccuuuggguacuacugcugcaaagugcaaauacuccaagcuucaagugauauauguauu

SEQ ID NO: 23032 - RNA, 64 nt, Human
uuguaaaaagaaauugugaaaaaugagcuuguaaauacuccauuauuuuauuuuauagucucaa

SEQ ID NO: 23033 - RNA, 64 nt, Human
gaaaugaauuagaaagaaaccauaagccuuaacaauacuccaaucacaguuaaauuaauuuaga

SEQ ID NO: 23034 - RNA, 64 nt, Human
ccuguaaauuauuauagacaauagauugcaugucauacuccauuugguucaacacaacaaccua

SEQ ID NO: 23035 - RNA, 64 nt, Human
uugugaacagaccggagaggacaguggauuguuuauacuccaguguacauaguguaauguagcg

SEQ ID NO: 23036 - RNA, 64 nt, Human
ccuugagaugaggucugugccugauguacaacggauacuccauaaauguuugacaaaccaacga

SEQ ID NO: 23037 - RNA, 64 nt, Human
ugcaauguuuguuuuuauuuuuggcuuuaugucuauacuccacagagagcuuuuuaaguaauga

SEQ ID NO: 23038 - RNA, 64 nt, Human
gugguugggaaaaauaaaaauacagugguguggaauacuccaaaaccuagaaaugcuguaggaa

SEQ ID NO: 23039 - RNA, 64 nt, Human
uagaaccaaacccaauaugcauaaaagaaauacaauacuccaggcuuuagcugaaggaagcaac

SEQ ID NO: 23040 - RNA, 64 nt, Human
cacgucacuguacuccagccugggugacagagugauacuccaucucaaaaaaaaaaaaaaaaaa

SEQ ID NO: 23041 - RNA, 64 nt, Human
auaauuuauauccaaaauuuguguuuuaaauuucauacuccagaacuuucauguuuaugaguau

SEQ ID NO: 23042 - RNA, 64 nt, Human
agaaauguaaaagaugugacaaaaccuuuaagccauacuccaggcuucuuaaacauaaugagaa

SEQ ID NO: 23043 - RNA, 64 nt, Human
ucaauuaguauuaaacuucacuaaaaaguaaaccauacuccaaauuguauauuggauugcauuu

SEQ ID NO: 23044 - RNA, 64 nt, Human
aggaaucugaugcuccuuugcugcccccaagaguauacuccaccgagaaccaccagccacacca

SEQ ID NO: 23045 - RNA, 64 nt, Human
uuuaauuuacugugacuagauuugaagcaaauaaauacuccagauccaugcagcuagaacacac

SEQ ID NO: 23046 - RNA, 64 nt, Human
guacuuguaaauagcacuaguuagacucuuuagaauacuccaagaguuagggcagcagagugga

SEQ ID NO: 23047 - RNA, 64 nt, Human
auaaauaagacuuaguuaaggauaguuaacuauuauacuccaacaauucaugagcaacaguaua

SEQ ID NO: 23048 - RNA, 64 nt, Human
acugccacaaaaaaagaugaaauguaauuucuaaauacuccaggugugugguauuauggaaagc

SEQ ID NO: 23049 - RNA, 64 nt, Human
caaauuuucuauagaaucaagauagaaccuuuagauacuccaacucaccaaaauguaaaaaaac

SEQ ID NO: 23050 - RNA, 64 nt, Human
cuccucuuuccgcucccccaucucggcccugcccauacuccaagggucagcucccaucucuccu

SEQ ID NO: 23051 - RNA, 64 nt, Human
uaaugauauuuaaagcaauaauuuuuuguaugucauacuccacaauuuacauguauauuacagc

SEQ ID NO: 23052 - RNA, 64 nt, Human
gccagucugugaagacaacugccagauacuggcaauacuccagccuggugacagagugagacuc

SEQ ID NO: 23053 - RNA, 64 nt, Human
uagacucaaggaagaauaauuuuaacagacauguauacuccauagaaacuaaacuaaaauaguu

SEQ ID NO: 23054 - RNA, 64 nt, Human
ccaugugcccuuuuuagggaagcuguuggagaaaauacuccagcaaaaugaaggaguacacaaa

SEQ ID NO: 23055 - RNA, 64 nt, Human
ggaaagggcucagccugugauaggcauucaauaaauacuccaaugcugucauuccuuugucuac

SEQ ID NO: 23056 - RNA, 64 nt, Human
agcugggucugaccguuguaugguuugaccugauauacuccauucuccccugcgccuccuccuc

SEQ ID NO: 23057 - RNA, 64 nt, Human
aaauguaaaggacucaaaguuuaaguaaaaagugauacuccaccuuguguuucaaagaauuuag

SEQ ID NO: 23058 - RNA, 64 nt, Human
aaggcccauaagacaagugauuauuaugauucccauacuccagauacaaaccauaucccagcca

SEQ ID NO: 23059 - RNA, 52 nt, Human
gcuguggcaaggacagcuaguuauacuccauucuuuggucgucguccucggu

SEQ ID NO: 23060 - RNA, 64 nt, Human
auguuuuuacaagaugaaauaauagauaaaagcuauacuccaucuaaaauaagacaugccugaa

SEQ ID NO: 23061 - RNA, 64 nt, Human
gccguguggguuagucgggugccaggacaaugaaauacuccagcaccuguggcugacgaauuug

SEQ ID NO: 23062 - RNA, 64 nt, Human
auguauauguauauauauauaguaacuacuuuuuauacuccauacauaacuugauauagaaagc

SEQ ID NO: 23063 - RNA, 64 nt, Human
ucuugcuugauugaaaacgacaucaucccuugguauacuccagggauugguuucaggaccccug

SEQ ID NO: 23064 - RNA, 64 nt, Human
gacuuauuucuuuaguucugcacuuuuccacauuauacuccauaugaguauuaauccuauggau

SEQ ID NO: 23065 - RNA, 64 nt, Human
ucacagccagugaacaaucaccaugcucauucacauacuccaguggaaaguaaguuugguguag

SEQ ID NO: 23066 - RNA, 64 nt, Human
uguuacacccuccacugaacccucaaccuucgaaauacuccaguuuuguggguuuggucauuuu

SEQ ID NO: 23067 - RNA, 64 nt, Human
gaacuggaaauuauacaaaaguaaauugggaaggauacuccagcaucugacacuggcaaaaugg

SEQ ID NO: 23068 - RNA, 64 nt, Human
uguacacaauuacuguaaggcuaauucacgugccauacuccaccugaaagccugaguuaucuug

SEQ ID NO: 23069 - RNA, 64 nt, Human
gacuacagcuguuaucuuuccucuccuacaaagaauacuccacacauaaaaacuuagguaaaug

SEQ ID NO: 23070 - RNA, 64 nt, Human
ggcagagauugcacugagccgagaucgcgccacuauacuccagccugggcaacagacauccugu

SEQ ID NO: 23071 - RNA, 64 nt, Human
ugugcuaacccauucauaguuggcaguuaaacacauacuccaaaagacugcuacuaucuacuau

SEQ ID NO: 23072 - RNA, 52 nt, Human
aaucucugugcucaugcugaagauacuccagcgccuuccuggagauagcugg

SEQ ID NO: 23073 - RNA, 64 nt, Human
gcuuugggugaucuugaaaaucaaauacuauccuauacuccagcugcuuaacuucauuuuauuc

SEQ ID NO: 23074 - RNA, 64 nt, Human
aaacauuccuguugaugggaaaagcccccaguuaauacuccagagacagggaaaggucagcccg

SEQ ID NO: 23075 - RNA, 64 nt, Human
uauaucagcucuaaagcagagauguauuauggugauacuccaagguggcauagccauucauuua

SEQ ID NO: 23076 - RNA, 64 nt, Human
uuuauuccugaagcuuaccagauaugaauggcuaauacuccauuguucugcuuguuguaauggu

SEQ ID NO: 23077 - RNA, 64 nt, Human
gaacuccuuggaugaaaguccacuggggccagcaauacuccagagcccaguuucugcuggaucc

SEQ ID NO: 23078 - RNA, 64 nt, Human
ucuuguggaugagcucuaaguacaugcccaguggauacuccaugugacaugguuucucccuaug

SEQ ID NO: 23079 - RNA, 64 nt, Human
agcucagugguguggggaaacguuccccuggaucauacuccagaauucugcucucagcaauugc

SEQ ID NO: 23080 - RNA, 64 nt, Human
ugauugcugagggugcaucaauuacaagcauugaauacuccauccccuucccucccagugaaug

SEQ ID NO: 23081 - RNA, 64 nt, Human
ugacagcuuuguauuuggugaaaugguuuuaauuauacuccauguguauuuugcccacuuuuuu

SEQ ID NO: 23082 - RNA, 64 nt, Human
ggaaagagcacgaggauguucucagcucuggccaauacuccauuucauaaaccauguuacauuu

SEQ ID NO: 23083 - RNA, 64 nt, Human
uucugucagucuguaagcuuugauaaccugcuuaauacuccaaagugugaguuccucugaucuc

SEQ ID NO: 23084 - RNA, 64 nt, Human
gugaaauuuucagaauguuguuuuuuucauguagauacuccaggaagaguuaagcacugcuuuc

SEQ ID NO: 23085 - RNA, 64 nt, Human
uguuaccaaauaauggcuaauguuacaaaaaguuauacuccagagacccaaagcuugacauuua

SEQ ID NO: 23086 - RNA, 64 nt, Human
uccucuauuauuuucacuauucauuuagguuuuuauacuccaccuccuuucaaaaaagauuuaa

SEQ ID NO: 23087 - RNA, 64 nt, Human
uauuuuuagcaaugccuauugcaagugcaauuauauacuccagggaaauucaccacacugaauc

SEQ ID NO: 23088 - RNA, 64 nt, Human
cacucacagaggcaaguguuguagacuaacaaagauacuccaaaauacaauggcuuaaagaaug

SEQ ID NO: 23089 - RNA, 64 nt, Human
uuccuaccucuuauuucucauugagccucaggcuauacuccagcuggccaaggcuggaaaccug

SEQ ID NO: 23090 - RNA, 64 nt, Human
ugggguugggggggaggugagguaccagccuuggauacuccaugggguggggguggaaaaacag

SEQ ID NO: 23091 - RNA, 64 nt, Human
aagauuugucaaaacucaguguuuucuccaucagauacuccaugaaaggucacaauuucucuug

SEQ ID NO: 23092 - RNA, 64 nt, Human
uggugagggccagauguuauucccuuucuuaaagauacuccaagccacaugccacuaaccacaa

SEQ ID NO: 23093 - RNA, 64 nt, Human
aaauaagagaccucuaagagauccccauggcugaauacuccaaauaauccuaugucacaauaua

SEQ ID NO: 23094 - RNA, 64 nt, Human
uugauccccagaagaaccauuuuaacuccaucugauacuccauugccuaugaaauguaaaaugu

SEQ ID NO: 23095 - RNA, 64 nt, Human
ugcuuuaaacuguaguaguuggucuagaaacaaaauacuccaagaaaaagaaaauuuucaaaua

SEQ ID NO: 23096 - RNA, 64 nt, Human
uaugauuugaagacagacuauaugucauuuuauuauacuccaucaaucuauaauauauuagacu

SEQ ID NO: 23097 - RNA, 64 nt, Human
gaagaaaaagcgccagugaagaaaucuauacgagauacuccagccaaaaaugcacaaaagucaa

SEQ ID NO: 23098 - RNA, 64 nt, Human
aacacauagugguaauuggagguuacuguuaugaauacuccaucugacuacgacuaagagagug

SEQ ID NO: 23099 - RNA, 64 nt, Human
uuuacugccacuguggaaacagguucuagauuucauacuccaucuaaagucauuuuucaguuac

SEQ ID NO: 23100 - RNA, 64 nt, Human
uacuuucuuuuucuauuggaaaugguuacaaguuauacuccaaaagauauuugaauuaucuuga

SEQ ID NO: 23101 - RNA, 64 nt, Human
aucagucuguauguacuaucuggaaagauaacacauacuccagccaccucaccugauuggcuau

SEQ ID NO: 23102 - RNA, 64 nt, Human
guauuugugguaucaguuuggaaaaaaaaaucugauacuccauuugauuauuguaaauauuuga

SEQ ID NO: 23103 - RNA, 64 nt, Human
acaaauguacauacacucaggaagguaguacaagauacuccauacaacacaaccaugugcuauu

SEQ ID NO: 23104 - RNA, 64 nt, Human
acaaaucugauguuaauguuugcucuuagaagucauacuccauggucuucaaagaccaaaaaau

SEQ ID NO: 23105 - RNA, 64 nt, Human
caguauuuugcuuuuaugcugcuuuuucuuuuugauacuccagguuuauaaacuaucuuuuaaa

SEQ ID NO: 23106 - RNA, 64 nt, Human
ccucccggggacuguucugggauugaaauugugcauacuccaaacuuucgcagccaucuucccg

SEQ ID NO: 23107 - RNA, 64 nt, Human
agaagcagccagaaggagacuuaaacauggaaagauacuccacugaugaguuuagaagugauua

SEQ ID NO: 23108 - RNA, 64 nt, Human
gaaugccauacacuacugucucuucagaucugaaauacuccaguuuagagccaggaaauuucac

SEQ ID NO: 23109 - RNA, 64 nt, Human
ucuaacaguguauuuguguaaaguuugucauuucauacuccauacacuacaguugcugucacug

SEQ ID NO: 23110 - RNA, 64 nt, Human
acagaaacugaucucaaaugacaggaaaaugaauauacuccauugaaaggaaaaauaaggaaau

SEQ ID NO: 23111 - RNA, 64 nt, Human
gaacuuacagaauuuacuuugcagaagcguuaucauacuccauuuacaucuguguuacacguga

SEQ ID NO: 23112 - RNA, 64 nt, Human
aggggauggggacaugaugcccagagccaccccuauacuccagucucccuggcaucagcuacug

SEQ ID NO: 23113 - RNA, 64 nt, Human
uuucuuucauuagcuaggaucuacuagaugcauuauacuccauaccugcuuuucccauggccgc

SEQ ID NO: 23114 - RNA, 64 nt, Human
cucacaaugcaggauccucuuugcugacucaggaauacuccauauuuuagacuacugccucuac

SEQ ID NO: 23115 - RNA, 64 nt, Human
auauugugccauaugacaacaaagucuuuccuaaauacuccaucuguuuaguacuguauugugg

SEQ ID NO: 23116 - RNA, 64 nt, Human
uuugccuuggaaguugcauggcaucaccuccaccauacuccaucaguuagagcugacacaaacc

SEQ ID NO: 23117 - RNA, 64 nt, Human
ccuuaaaccagaaugggaguuugaaagagagaucauacuccagcugaaguuuguugacccuuuu

SEQ ID NO: 23118 - RNA, 64 nt, Human
auuuaggggcaaguaauaauggaaugcuacuaagauacuccauauucuuccccgaaucacacag

SEQ ID NO: 23119 - RNA, 64 nt, Human
aauguauccauugccuuugaugauguucccagccauacuccagucaacggggacuacuaguccc

SEQ ID NO: 23120 - RNA, 64 nt, Human
cuaagaaaagugguccauccugaauaaacauguaauacuccagcagggauaugaagccucugaa

SEQ ID NO: 23121 - RNA, 64 nt, Human
cauuacuccuggucuugggaguugccuucugaggauacuccacuggggguaccugagccuggau

SEQ ID NO: 23122 - RNA, 64 nt, Human
cagagcgagacuuaucucauaaauaaauagauagauacuccagccugggugacagagcgagacu

SEQ ID NO: 23123 - RNA, 64 nt, Human
ccucucucgggagcccuagcccugcuccaacuccauacuccacuccaagugccccaccacuccc

SEQ ID NO: 23124 - RNA, 64 nt, Human
auuaauguuuauuuagcucugaagcaagagugauauacuccaggacuuagaauagugccuaaag

SEQ ID NO: 23125 - RNA, 64 nt, Human
caggggucuaauccaaaagaaaugucauuaaccaauacuccaaguccuugaguuuuguuauauc

SEQ ID NO: 23126 - RNA, 64 nt, Human
auuggacccuugcuuugauaccauucuugggcacauacuccaagauuguauuagauuuuuguga

SEQ ID NO: 23127 - RNA, 64 nt, Human
uuuuuuuaaaaaaaaaaaaaaaagcccacaucuuauacuccaaugaguguguuugugaguuuuu

SEQ ID NO: 23128 - RNA, 64 nt, Human
uaauuugugggcagggguggaggaugcauguaugauacuccauaaauucaacauucuuuacuau

SEQ ID NO: 23129 - RNA, 64 nt, Human
gacucacugcacagccgcuuccuagcagggagcuauacuccaacuccuacuugaguuccugcgg

SEQ ID NO: 23130 - RNA, 64 nt, Human
gggccggccacaagacccaugucuccaucuggucauacuccauagcuaccaaguuaaccugcuc

SEQ ID NO: 23131 - RNA, 64 nt, Human
gagcaggaccguggaucaccugcaacaagcucugauacuccaggggauacuuaagcccucauca

SEQ ID NO: 23132 - RNA, 64 nt, Human
agcugagucagaauuaaaggagggaauuguauugauacuccaauaccuaaauuucacaauacca

SEQ ID NO: 23133 - RNA, 64 nt, Human
uuuauaaaacuuccuaagagacuaucugaacucuauacuccagacaguuaggugggaguauaaa

SEQ ID NO: 23134 - RNA, 64 nt, Human
gcacccccauuauauuaauuuucagggauaguaaauacuccaaaaugaaauugguauuguuuuc

SEQ ID NO: 23135 - RNA, 64 nt, Human
uguauaauucaacaauuuuagauuaugguguaagauacuccaguaacuuaucuuucuguccuuu

SEQ ID NO: 23136 - RNA, 64 nt, Human
uagucuauggaguuuucugauuucccuggaguaaauacuccaugguuauuuuaagcuaccuaca

SEQ ID NO: 23137 - RNA, 64 nt, Human
auccccuucuuucccaugagagagagaacuggugauacuccaacaccguccaguuguggcagcu

SEQ ID NO: 23138 - RNA, 64 nt, Human
uuuauauuguccuuuuuuacuggaagacguacgcauacuccaucgauguuguauuugcaguggc

SEQ ID NO: 23139 - RNA, 64 nt, Human
ccuggggccucccaccccagccucccugaggcccauacuccacggagaggagccccaugcccag

SEQ ID NO: 23140 - RNA, 64 nt, Human
gugagcgcauugagccaguggugcuaaaugcuacauacuccaacugaaauguuaaggaagaaga

SEQ ID NO: 23141 - RNA, 64 nt, Human
gcccccuagccagccccgcacacacucaacucugauacuccagcccuguggcaccccagacccu

SEQ ID NO: 23142 - RNA, 64 nt, Human
gugggagaauuagagaauuuauuugugucagaaaauacuccagaacaaccaccccauauuauga

SEQ ID NO: 23143 - RNA, 64 nt, Human
uucugccaacauaguuuuauccugucucaguaggauacuccauaacacaauagcaguacaccac

SEQ ID NO: 23144 - RNA, 64 nt, Human
cuagagggaaaguuaggaauaggccucccagaggauacuccagacaguugacaagcaucgcagc

SEQ ID NO: 23145 - RNA, 64 nt, Human
uauuuucgggcaauuauguuuagcuuucaucauuauacuccaacagacccgucugaagggguau

SEQ ID NO: 23146 - RNA, 64 nt, Human
gugcccccagaugccucuugauaggagaggcaacauacuccaaauaguuggguucuucagggaa

SEQ ID NO: 23147 - RNA, 64 nt, Human
agagagcuacauuuuaaaggcugucuuggcaaaaauacuccauuugggaacucacugccuuaua

SEQ ID NO: 23148 - RNA, 64 nt, Human
guagccagugacccguuaggagcucucaccguacauacuccagucuaauuuaaaucugaccaca

SEQ ID NO: 23149 - RNA, 64 nt, Human
ugccggugucccuucuccccagaucccucauuugauacuccaaaaccaucaccauguaccaugu

SEQ ID NO: 23150 - RNA, 64 nt, Human
guccgaauugcuuuuauuuucuuauacuuucaguauacuccauagaccaaagagcaaaaucuau

SEQ ID NO: 23151 - RNA, 64 nt, Human
caacacuuauuagugacaguauugacaucugagcauacuccaguuuacuaauacagcaggguaa

SEQ ID NO: 23152 - RNA, 64 nt, Human
uguguguuaaaaugauaacuaacaugugaauaaaauacuccauuugaaacucuucgguuauuug

SEQ ID NO: 23153 - RNA, 64 nt, Human
ucaaaaugagauaugcaauaaauauuauuugaugauacuccaccagugaaaauugaugcuaagu

SEQ ID NO: 23154 - RNA, 64 nt, Human
gcuauucguccuguaaucuguuucuaggugaagcauacuccaguguuuuagggguuuugaaaau

SEQ ID NO: 23155 - RNA, 64 nt, Human
uggaagccgugguaugugaggaaccccaagugaaauacuccacguugcacacgcagucugcaga

SEQ ID NO: 23156 - RNA, 60 nt, Human
cgugaccguaucccucugccacaccccaggcccugcgaggggcuaucgagaggagcucac

SEQ ID NO: 23157 - RNA, 60 nt, Human
gccaaggugggcugagcccuggcaggaugacccugcgaaggggcccugguccuuccaggc

SEQ ID NO: 23158 - RNA, 60 nt, Human
uguuguaccaaauagggcuccccaccccaccccugcgacaagugcucuucuagaacaggu

SEQ ID NO: 23159 - RNA, 60 nt, Human
ucguggugaaaccggucagcuguggaccugcccugcgaaucggcagaggccuccguggug

SEQ ID NO: 23160 - RNA, 60 nt, Human
cuacagaugguuuccacacuugaaauugugcccugcgaguugcauagcuggaaguucaau

SEQ ID NO: 23161 - RNA, 60 nt, Human
ugaccagggaugcugggcugggcccucuuucccugcgagacgcacacagcugagcacuua

SEQ ID NO: 23162 - RNA, 60 nt, Human
ggacuggucagucacaagagcuucaaccugcccugcgagcccucucugcaccugcucaag

SEQ ID NO: 23163 - RNA, 60 nt, Human
gugguccuuaggggaguggccccuccugagcccugcgagcagcguccuuuuccucuuccc

SEQ ID NO: 23164 - RNA, 60 nt, Human
gaggcuggacagauggcggaagcagagguucccugcgaagacuugagauuuagugucugu

SEQ ID NO: 23165 - RNA, 60 nt, Human
ccuuaggaucacucaaguagacccuucacucccugcgagaaauuaggaugaauaacuacc

SEQ ID NO: 23166 - RNA, 60 nt, Human
acacacguauacacaacauuacugaaagaacccugcgaaucaaaacaacccccacacaga

SEQ ID NO: 23167 - RNA, 60 nt, Human
acugggagcucccgguccgccucccagcaucccugcgagcguucaugggguguucguguu

SEQ ID NO: 23168 - RNA, 54 nt, Human
augacagcauauuaaagugagugacccugcgacccacucuuuggaccagcagcg

SEQ ID NO: 23169 - RNA, 60 nt, Human
auguuggccaggauggucucaaucuccugacccugcgaucugcccaccucagccucccaa

SEQ ID NO: 23170 - RNA, 60 nt, Human
agguuucaguacaaaaggaaccaugggugacccugcgauauccacugucauuuuccaucc

SEQ ID NO: 23171 - RNA, 60 nt, Human
gacccacauggccugggcucugaaugcccacccugcgacgguggguucugcaucagcaaa

SEQ ID NO: 23172 - RNA, 60 nt, Human
caaguuggaaauauucaugcuucuuccuuacccugcgauuuugccugugucugaaguggu

SEQ ID NO: 23173 - RNA, 60 nt, Human
cagaaugguaacuaagggugcugugcccaacccugcgacuagcaaggcucgcagcaagag

SEQ ID NO: 23174 - RNA, 60 nt, Human
uggcacccuggcgugggugcccgccaaacgcccugcgaccgcucagaagcacaaaugcug

SEQ ID NO: 23175 - RNA, 60 nt, Human
gaggagggagguaucuggugugagcguugccccugcgacauuugggaccacacagguggg

SEQ ID NO: 23176 - RNA, 60 nt, Human
acccaaacucuccagacaucaccaacuguccccugcgaggagaaaucacuccugggggag

SEQ ID NO: 23177 - RNA, 60 nt, Human
ggacagggccuacccagguggaggggaccacccugcgaucagguguuugcgacagggguu

SEQ ID NO: 23178 - RNA, 60 nt, Human
gccuggagggggugcugcgggaccagcuggcccugcgagccuuggaggaggcggugagcg

SEQ ID NO: 23179 - RNA, 60 nt, Human
cucugucaguuucagcaacuacaagggauacccugcgaaaguaccaugagaaauaucaga

SEQ ID NO: 23180 - RNA, 60 nt, Human
ugcuuuccaguuuaaugaaagcuuaaaugucccugcgaacccacaaucucugccagcaga

SEQ ID NO: 23181 - RNA, 60 nt, Human
gaguggcucguguuucacagugggcggcuucccugcgacggaggcaggaccaggcauuua

SEQ ID NO: 23182 - RNA, 60 nt, Human
cauccaccuauuagcccugggccuggaccucccugcgauuucccacuccuuucuuagucu

SEQ ID NO: 23183 - RNA, 60 nt, Human
aggcuuggaguccucgcccagaucucucuccccugcgagcccuuuuuauuugagaaggaa

SEQ ID NO: 23184 - RNA, 60 nt, Human
agaucuugcagcccagaaccaagucagccucccugcgacugcccaggcacacugcccacc

SEQ ID NO: 23185 - RNA, 60 nt, Human
cccacaaagugaaggaacaguuuccaaaaccccugcgaggcagaguuaagaccugugacg

SEQ ID NO: 23186 - RNA, 57 nt, Human
gaggguggcagccccuauagugcggggcccugcgacugguaccgugagcgccuggga

SEQ ID NO: 23187 - RNA, 60 nt, Human
ucccgcuggcccaggucuccucuccagucccccugcgacucccuguuuccugggcuaguc

SEQ ID NO: 23188 - RNA, 51 nt, Human
cacagauccaugcagaaugagcccugcgagcaauagaguugaagcagccuc

SEQ ID NO: 23189 - RNA, 60 nt, Human
cagccccugcagacgagagucaggccagcacccugcgaccagcuucuccacugaugcaca

SEQ ID NO: 23190 - RNA, 60 nt, Human
uauugugcagcuguugguuuucauguagugcccugcgauggaaauuagauauauuucaug

SEQ ID NO: 23191 - RNA, 60 nt, Human
cacaaacacaagaagcaggacccgcugcagcccugcgacacggaguaccccguguucgug

SEQ ID NO: 23192 - RNA, 60 nt, Human
agcgugcaacccggagccgccuugggcccucccugcgacagccggacccgccuccgcauc

SEQ ID NO: 23193 - RNA, 60 nt, Human
ccgggccuggguuuccugcccuggcccuggcccugcgaucucucacugugauuccucucc

SEQ ID NO: 23194 - RNA, 60 nt, Human
gggagugaggagaggauugcagggacuuuucccugcgaaacaaaugagacaaugacauaa

SEQ ID NO: 23195 - RNA, 60 nt, Human
gaacacuguccgccgcugugaggccugcuccccugcgaccgcccugccccccgucaccga

SEQ ID NO: 23196 - RNA, 60 nt, Human
ccagagccacagcugggagaccugcacugucccugcgaaauacuaagaacaccuagggug

SEQ ID NO: 23197 - RNA, 60 nt, Human
gcuuugcagaagcccagauggaccuggugccccugcgaggucugucgccuggugcagccu

SEQ ID NO: 23198 - RNA, 60 nt, Human
ggccccuuccugcugucucaccccguguuucccugcgaguggacgugcccagcugucccc

SEQ ID NO: 23199 - RNA, 60 nt, Human
cucauggucauggacagauagacagugcugcccugcgaaguggcucucaggggccaguga

SEQ ID NO: 23200 - RNA, 60 nt, Human
cgggucucugccagaggaagacuuaagcaucccugcgaccucacauucuagacagagaug

SEQ ID NO: 23201 - RNA, 60 nt, Human
cagcagcgcuaagguggacaugggauuccucccugcgaugcgugucuuucccacgcagag

SEQ ID NO: 23202 - RNA, 60 nt, Human
cuugaucuuuuugguuuuacuuuaauuaagcccugcgagaaugcuggauaaaugccuuga

SEQ ID NO: 23203 - RNA, 60 nt, Human
agaugcaacagagaacguaugccacauagccccugcgaagaaaaggcauuauguaucugu

SEQ ID NO: 23204 - RNA, 60 nt, Human
gaugcagaguggaggggaggugggcacccacccugcgauucuccacccuuuccccuucuu

SEQ ID NO: 23205 - RNA, 60 nt, Human
ggagcagugguggcgccugcccugaggcugcccugcgauggccugggugggagagcuggg

SEQ ID NO: 23206 - RNA, 60 nt, Human
ugcgcuuaacgugaggguggguccagugugcccugcgaugggucccgugucacuguuuac

SEQ ID NO: 23207 - RNA, 60 nt, Human
guaugagcucuugugaggaugcugccgccacccugcgacggagcggcgccccggacugcc

SEQ ID NO: 23208 - RNA, 60 nt, Human
cugaggacuggcagagcugccggcgccggacccugcgacaaccggggucccccaggacag

SEQ ID NO: 23209 - RNA, 60 nt, Human
cgugccgugugacucgaagccuagcgcccucccugcgaagcaucagacgccacccagccc

SEQ ID NO: 23210 - RNA, 60 nt, Human
ggugucagugagaucucagcccugaugacacccugcgagaccuggagcguagggcccagc

SEQ ID NO: 23211 - RNA, 60 nt, Human
aggucggccgcuacuaggacugcccccggacccugcgaugaugacccgggcgcaaccugg

SEQ ID NO: 23212 - RNA, 60 nt, Human
ggagcuggaggcgcaugcgcauccgcgauucccugcgaccaggccccgagagggcgagac

SEQ ID NO: 23213 - RNA, 60 nt, Human
cuaagaugagggggccaggcgguggcuucucccugcgaggaggggagaauucuuggggcu

SEQ ID NO: 23214 - RNA, 60 nt, Human
ggccaccaaguucuggaaaccacguggugucccugcgaauggggcgaucaaguccagagc

SEQ ID NO: 23215 - RNA, 60 nt, Human
ccgcggggcuguggcugcugcugugcaugucccugcgaugggagucuugucucccagccu

SEQ ID NO: 23216 - RNA, 60 nt, Human
ucagugucucguuuacaucucacacagugacccugcgaggcaaggguuugcccaguuugc

SEQ ID NO: 23217 - RNA, 60 nt, Human
cuucaggaagggccagccacaugccaucuucccugcgaucaggcaaaaaaguggaauuaa

SEQ ID NO: 23218 - RNA, 60 nt, Human
ugcgugugguccguauggaaagccugguagcccugcgaguuaaguacugcuuccauucau

SEQ ID NO: 23219 - RNA, 60 nt, Human
gggcuucugggccaccugcccucggggggccccugcgagggugccuggaguucccacgug

SEQ ID NO: 23220 - RNA, 60 nt, Human
cuucagauacguuaagcaagcaacagcagacccugcgaaugcacaucgacauacccaggg

SEQ ID NO: 23221 - RNA, 60 nt, Human
uuucucaggaaccuuucaagcggccagaaccccugcgaaucacacaugaccuuugcggga

SEQ ID NO: 23222 - RNA, 60 nt, Human
cggcuuccaagugaugcccuccugccacuccccugcgauuuauaagggaauuuuaauuuu

SEQ ID NO: 23223 - RNA, 60 nt, Human
ugcccucaaagcugucccacaaucauggagcccugcgaccucccugcccugccgccacau

SEQ ID NO: 23224 - RNA, 60 nt, Human
ugcccuugaagcugccccacaaucauggagcccugcgaccuacccgcccugccgccacau

SEQ ID NO: 23225 - RNA, 60 nt, Human; identical to SEQ ID NO: 23221

SEQ ID NO: 23226 - RNA, 60 nt, Human
uacagugcuuagcacuuaauaaguauuccccccugcgacaccuagcugaacuaugguuug

SEQ ID NO: 23227 - RNA, 60 nt, Human
caccuguacccacaccuccagaaugcccugcccugcgaguguguccccuguccccaccug

SEQ ID NO: 23228 - RNA, 60 nt, Human
uggugucaccgggacuccaggcacccgcuccccugcgaccaugccaggcacgcugggagg

SEQ ID NO: 23229 - RNA, 61 nt, Human
guguauauauagaagguagaaaugaaaagugagaaaauauuugaaagggauuauauuaauu

SEQ ID NO: 23230 - RNA, 61 nt, Human
ugucacguuuccauaucuccugcuggaaaucagaaaauauaauaaaauugcacaaaaaaaa

SEQ ID NO: 23231 - RNA, 61 nt, Human
cucuacuguaaagugauuuuguuugcagguaagaaaauaauagaugacucaccacaccucu

SEQ ID NO: 23232 - RNA, 61 nt, Human
gcuugucuuuuccacaugauuugucugugaaagaaaauaauuuugagaucguuuuaucuau

SEQ ID NO: 23233 - RNA, 61 nt, Human
agcauuuauuucugugcccuuaaacccauuuagaaaauaacuacaaaguaaaaauguagag

SEQ ID NO: 23234 - RNA, 61 nt, Human
acccaaaacuuuaauaaugugucuguaaccaagaaaauauugauagcaucauccuaaugaa

SEQ ID NO: 23235 - RNA, 61 nt, Human
gagauggaaacagcaacuuguacaguggcugagaaaauaggauauaguuuugauuuuuuua

SEQ ID NO: 23236 - RNA, 61 nt, Human
aguugcccagaacccuaaauuuauucauaagagaaaauauugauuaauuauuggucauucc

SEQ ID NO: 23237 - RNA, 61 nt, Human
gaaauaaaccuuuauguacuuaaaguuauacagaaaauagaauaaaguuaauaccaaacuu

SEQ ID NO: 23238 - RNA, 61 nt, Human
guauauaauaguauagucaccaucaagauguagaaaauagaaaauaggcuaggcacagugg

SEQ ID NO: 23239 - RNA, 61 nt, Human
auaguauagucaccaucaagauguagaaaauagaaaauaggcuaggcacaguggcucacgc

SEQ ID NO: 23240 - RNA, 61 nt, Human
caagggccauaucccaagugacuuuguacccagaaaauaacagcuguucaauaaaugugua

SEQ ID NO: 23241 - RNA, 61 nt, Human
auugcuagacagucgugccauucacaaagucagaaaauacagcaggaagagacagcuuuua

SEQ ID NO: 23242 - RNA, 61 nt, Human
uaagcuaaaaaugaaugaaaaugguggcuaaagaaaauagggacucugaagaugucgaaau

SEQ ID NO: 23243 - RNA, 61 nt, Human
guuuggcuguucauguagucacggugcucucagaaaauauauuaacgcagucuuguaggca

SEQ ID NO: 23244 - RNA, 61 nt, Human
aaacuuuuuugacucuuucuggaaaagggaaagaaaauagucuuccuucuuucuugggcaa

SEQ ID NO: 23245 - RNA, 61 nt, Human
ugagauaauacacaggugauaaacaguuucgagaaaauaaaaauuggcuagaaucucaagu

SEQ ID NO: 23246 - RNA, 61 nt, Human
aaguauucaagauguuacaaaauuuacauuuagaaaauauuguaguauuugaauacuguca

SEQ ID NO: 23247 - RNA, 61 nt, Human
aacuacuuaaaggaaugguuuuuauguuaggagaaaauacaauacaccacuuuuuucucac

SEQ ID NO: 23248 - RNA, 61 nt, Human
ccaguggaaagaaaggaggaagggagaauugagaaaauauauuagucuauuauuuuagagu

SEQ ID NO: 23249 - RNA, 61 nt, Human
uaauugucauuaaaauaauuuuaaagagugaagaaaauauugugaaaagcucuugguugca

SEQ ID NO: 23250 - RNA, 61 nt, Human
aaugccaugaauugccacuguguguuuauguagaaaauacaaauaaaaguuauuuugaugg

SEQ ID NO: 23251 - RNA, 61 nt, Human
cguuggugaaaguuauaaccuccugccugggagaaaauauacaucaccuaaaaugaacuua

SEQ ID NO: 23252 - RNA, 61 nt, Human
gggcaaaugucauuguuaccucuguguguuaagaaaauaaaaauauuuucuaaaggucugu

SEQ ID NO: 23253 - RNA, 61 nt, Human
gaacauuuuucuuuuauuguuuuaucuucacagaaaauaaaagguguuaauuugcuuuuua

SEQ ID NO: 23254 - RNA, 61 nt, Human
uaauguaugauuuucgagcuucuguaugcuaagaaaauaggugugaaaaacugguguucug

SEQ ID NO: 23255 - RNA, 61 nt, Human
uuagaaaaccaaaaaucaugaacauucuaagagaaaauaaauauagaauuuaaaaaauuau

SEQ ID NO: 23256 - RNA, 61 nt, Human
auaaaauuuuucacugcaaaaaaauuucaguagaaaauaaggaugcagggccaguuacaau

SEQ ID NO: 23257 - RNA, 61 nt, Human
agaaaauguuacuuagaaaaucauaaggaagagaaaauauauuuacuguguuuaucaauac

SEQ ID NO: 23258 - RNA, 61 nt, Human
gggcaaauucaccagcaggggcuaggaauuuagaaaauauacuguaauucagacacucagc

SEQ ID NO: 23259 - RNA, 61 nt, Human
caugaaauguaaauacuguaucauaaguagaagaaaauaauuuuuguuuucuaaaaaugca

SEQ ID NO: 23260 - RNA, 61 nt, Human
uaguuaguucuuggagcagcugcuuuugaggagaaaauauauagcuuuggacacgaggaag

SEQ ID NO: 23261 - RNA, 61 nt, Human
guuuuauuuuaucaaacauuaagcuuuuuuaagaaaauaauugggcagugaaauaaaugua

SEQ ID NO: 23262 - RNA, 61 nt, Human
uagaggaauuuaaagaggaaaaaaauuacaaagaaaauaauaaaaguguuuguacguuuuc

SEQ ID NO: 23263 - RNA, 61 nt, Human
cuauaauagaauucuguuuauagaauaagggagaaaauaauccagucuucacuggguuccc

SEQ ID NO: 23264 - RNA, 61 nt, Human
uaugcuaacccauuuauaauugguaaaaaucagaaaauacaagauuuacauaaaggucauu

SEQ ID NO: 23265 - RNA, 61 nt, Human
gucuguaguauuugaaggguuugggggagggagaaaauauuaaugggaaaggcauucagaa

SEQ ID NO: 23266 - RNA, 61 nt, Human
uacauagggaacuuaguucugggccauguacagaaaauaucacuguaauauaccaaaagga

SEQ ID NO: 23267 - RNA, 61 nt, Human
cucagccugcacuuacucuucuauuaagaccagaaaauaaaauaauuuuccguugagucac

SEQ ID NO: 23268 - RNA, 61 nt, Human
ugguauuuuccuggcuuucguuuaauacaauagaaaauaaaguauuacaccgaauacuugc

SEQ ID NO: 23269 - RNA, 61 nt, Human
uuugaaucccucuuccucacuuuuuuuucuaagaaaauaaacauuuuacuguuuuuaugga

SEQ ID NO: 23270 - RNA, 61 nt, Human
auauugucacaaguaaauagcaaucaaaaggagaaaauaacuuuuguauuuuuuuaaugug

SEQ ID NO: 23271 - RNA, 61 nt, Human
aaggaagaaauauuuucaaauucuuaauccaagaaaauacugaguuggaaucuuagacuuc

SEQ ID NO: 23272 - RNA, 61 nt, Human
uaaauuagcauuacuuaaaauuuguuucuuuagaaaauaaaugcagguuauaaaugugugu

SEQ ID NO: 23273 - RNA, 61 nt, Human
acuaaggccuccuuucucugaccucccaggaagaaaauagcuucuccuacagugauucaug

SEQ ID NO: 23274 - RNA, 61 nt, Human
uuuucuuguguucuaguuuccauaauaggagagaaaauauagaaauauaugcaaaaauuau

SEQ ID NO: 23275 - RNA, 61 nt, Human
gcuugcugacuuagccaaagaagaguuaagaagaaaauacacacaaguauacagacuguuc

SEQ ID NO: 23276 - RNA, 61 nt, Human
uagucaggggaaaagacugcauuuaggagauagaaaauaguuuggauuacuuaaaggaaua

SEQ ID NO: 23277 - RNA, 61 nt, Human
uggaaagaacgucucauacugacauaaaugaagaaaauauguguaucuaguagagcuuguu

SEQ ID NO: 23278 - RNA, 61 nt, Human
acucaaugguaucauuacaauuuucuguaagagaaaauauuacuuauuuauccuaguauuc

SEQ ID NO: 23279 - RNA, 61 nt, Human
cagaaaguguauucaaauuuuaucaguuuaaagaaaauaaagcugugauaaauacuguaau

SEQ ID NO: 23280 - RNA, 61 nt, Human
ugaaaauguaauuuuccagaaaaacaccuaaagaaaauaaaacauggacaugccuaguaaa

SEQ ID NO: 23281 - RNA, 61 nt, Human
uugacaaacuuaugauagagauggauggaacagaaaauaaaucuaaauuuggugcaaaugc

SEQ ID NO: 23282 - RNA, 61 nt, Human
acagcuauaccucacaauaagaaugaaucucagaaaauauuaaggaaaaaagcaaguuuga

SEQ ID NO: 23283 - RNA, 61 nt, Human
auacacaugccuucuauauauuguaacuuaaagaaaauacuuauaaaaagacuucauuuuu

SEQ ID NO: 23284 - RNA, 61 nt, Human
gcacuaaaaccaaaauacauguauuauuuauagaaaauauuuucuguuuuaaucuuuucuu

SEQ ID NO: 23285 - RNA, 61 nt, Human
agauuuuauuuuuaaguguccucagcauugcagaaaauaacauuguaauagcaaguaaagg

SEQ ID NO: 23286 - RNA, 61 nt, Human
ucuuuggggaucacuauagggaauauuguauagaaaauaucuucaagaaaagauaggacca

SEQ ID NO: 23287 - RNA, 61 nt, Human
guaaaauuuuggaaaacccuggaaauuauagagaaaauaaacauaaucuauacucccaaca

SEQ ID NO: 23288 - RNA, 61 nt, Human
ugcucuuguggagcuuagagguugguggggaagaaaauaggcaugcaccaaggaauuguac

SEQ ID NO: 23289 - RNA, 61 nt, Human
uuaucuguuuuauauuuuaaaagauucugccagaaaauaaaaccagaccuuguucuaaagc

SEQ ID NO: 23290 - RNA, 61 nt, Human
gaccaauauggugaaacccugucucuacuaaagaaaauacaaaaauuagccgggcguggug

SEQ ID NO: 23291 - RNA, 61 nt, Human
uugguuucuuauaaaaugauuaaaugaauagagaaaauauuaauuuucaaggggaaaaaac

SEQ ID NO: 23292 - RNA, 61 nt, Human
uucagauaaguggaacuauugaguuacauaaagaaaauagauuugcauuugucaggcagac

SEQ ID NO: 23293 - RNA, 61 nt, Human
guuuucagaaaagccuuuggaaaucuggaucagaaaauagauaccaugguuugugcaauua

SEQ ID NO: 23294 - RNA, 61 nt, Human
cuggggccucaguuuccccaucuguaacuugagaaaauagaacuagaucuguaaagucugg

SEQ ID NO: 23295 - RNA, 61 nt, Human
agcacaugaugccagaaauagcacugaaucaagaaaauagccauugcggagcugcccucuu

SEQ ID NO: 23296 - RNA, 61 nt, Human
uuguuucugaaaauuccagaaaggauauuuaagaaaauacaauaaacuauuggaaaguacu

SEQ ID NO: 23297 - RNA, 61 nt, Human
aauuauuauucauugaagaaugcaguggccaagaaaauaucaaauguagauuguuaacgcu

SEQ ID NO: 23298 - RNA, 61 nt, Human
aaagauuggauuuucuauaacaccuuguguaagaaaauaaaaaacuugaucuaacugaaaa

SEQ ID NO: 23299 - RNA, 61 nt, Human
auuuuaagcccagacuucaguggacccagauagaaaauauaaagucucugaucuauaggcc

SEQ ID NO: 23300 - RNA, 61 nt, Human
guugauuuacuuauaacuagacgucuaugugagaaaauauauguauacauauauaugauau

SEQ ID NO: 23301 - RNA, 61 nt, Human
ugugauucaauuuaguuaaaggaugauauagagaaaauacauuauuuagcauuauuucuuc

SEQ ID NO: 23302 - RNA, 61 nt, Human
uuaccuuaucaaaugaaauauuacagcaccuagaaaauaauuuaguuuugcuugcuuccau

SEQ ID NO: 23303 - RNA, 61 nt, Human
cacuuuuaaaggaacagcuugauugcaaaggagaaaauagauaagcaaugaauuuaucucc

SEQ ID NO: 23304 - RNA, 61 nt, Human
cacguauuuaagagccugaauauuccagguaagaaaauauaaaaugagguuuauuuuauuu

SEQ ID NO: 23305 - RNA, 61 nt, Human
ucauugaaauaaaaacaaagucuaccucugaagaaaauauugggauaaagugaaaguucca

SEQ ID NO: 23306 - RNA, 61 nt, Human
acuauuguuuucuaauugaaauugucuauaaagaaaauacuugcaauauauuuuuccuuua

SEQ ID NO: 23307 - RNA, 61 nt, Human
cuguuacugagaauaaugaaaaucauauuucagaaaauauuaccauguaaauauguacaua

SEQ ID NO: 23308 - RNA, 61 nt, Human
aggcaagauacaugugaauaaggcaaaagccagaaaauagcccuuauucaugaugcuguua

SEQ ID NO: 23309 - RNA, 61 nt, Human
aaugaugaaauuucaacuacauacaaggaggagaaaauaagaacccagucauaacagagga

SEQ ID NO: 23310 - RNA, 61 nt, Human
aagauuaagacaaagaacauaucaaaucaacagaaaauauaccuuggugccaccaacccau

SEQ ID NO: 23311 - RNA, 61 nt, Human
guagaaugaaaugagucagggagcuucaguuagaaaauaaaguugaggcaguuuuugugaa

SEQ ID NO: 23312 - RNA, 61 nt, Human
ggcuauugcccuauaccugccaaucacccaaagaaaauaauagcuucugagaaagcucaau

SEQ ID NO: 23313 - RNA, 61 nt, Human
ggaauuuuacagagucaaaguaggcagaauaagaaaauaguucuucaggagggccgaccuu

SEQ ID NO: 23314 - RNA, 61 nt, Human
gccacuuugucguguuuguuuuaacuucuaaagaaaauauguuucagcauuauaagaaagg

SEQ ID NO: 23315 - RNA, 61 nt, Human
uguugguccugaguauuuugcaaaugcacagagaaaauaaaacuaaacuccuuguuuauuu

SEQ ID NO: 23316 - RNA, 61 nt, Human
ucuggugaugggguuuagcaacuuugauggaagaaaauauuaggcuauaaauguccuaagg

SEQ ID NO: 23317 - RNA, 61 nt, Human
gaguggagacucuguuucaaaaaaacagaaaagaaaauauaguuugauucuucauuuuuuu

SEQ ID NO: 23318 - RNA, 61 nt, Human
ucaugauuaauguguauuuacuguacuaauuagaaaauauaguuugaggccgggcacggug

SEQ ID NO: 23319 - RNA, 61 nt, Human
aaagacuguuaggcauuugugcuacuuuguuagaaaauacugaguggaauaacuuguuaga

SEQ ID NO: 23320 - RNA, 61 nt, Human
cauucugacugguuggcugcccuggaaggcaagaaaauagauuuauuuuuuuucacagggc

SEQ ID NO: 23321 - RNA, 61 nt, Human
uuuuuccuuaugcaaaucauacuccugcccaagaaaauacaguaguuccccuuaucugagc

SEQ ID NO: 23322 - RNA, 61 nt, Human
uucccaaacuucuucccaucauagcacauguagaaaauaauauuuuuauggcacacuggga

SEQ ID NO: 23323 - RNA, 61 nt, Human
cuaaauaucaagauggcuauaugcuaaaaagagaaaauauggucaagucuaaaauggcuaa

SEQ ID NO: 23324 - RNA, 61 nt, Human
ucauaugcuucccagagaagcucauuuaguuagaaaauaaggcaaguuuugaagccugcua

SEQ ID NO: 23325 - RNA, 61 nt, Human
cuguauuuacaucuguauauacacuaugauuagaaaauaugcaagaaauuguuuuuccaug

SEQ ID NO: 23326 - RNA, 61 nt, Human
auuuuaucucauuugagaucaugguagguuaagaaaauaugccuguugaugaaagcuaaaa

SEQ ID NO: 23327 - RNA, 61 nt, Human
uuguuuuguuuuguaaaaaugauaaaacuucagaaaauaaaaugucaguguugaauaauuu

SEQ ID NO: 23328 - RNA, 61 nt, Human
augacuauucaguggcuaacuuggguuaggaagaaaauaauuagguauuuucuccaaaugu

SEQ ID NO: 23329 - RNA, 61 nt, Human
cuucguuaauuuguucagccacaauuuauugagaaaauauucugugucaagcacugugggu

SEQ ID NO: 23330 - RNA, 61 nt, Human
uauuauucuccuaaacgaaugccuagcauagagaaaauacuuaauacacauuuguugacuu

SEQ ID NO: 23331 - RNA, 61 nt, Human
uuguguuuauauguauaaaaauaggagcaaaagaaaauacucugggaauagucauacugac

SEQ ID NO: 23332 - RNA, 61 nt, Human
uuauuagcaugucauuuguacauaaacuaguagaaaauagcaguuuuaaaaguuuucuauu

SEQ ID NO: 23333 - RNA, 61 nt, Human
cuacagaguuaauuuccuuuguauuuuuuuaagaaaauauuaaaaaucaacggucucaaau

SEQ ID NO: 23334 - RNA, 61 nt, Human
uuaaacuuaaaagccuagaaauuuccuagaaagaaaauaggagacaucucagagcaauuug

SEQ ID NO: 23335 - RNA, 61 nt, Human
gaaauaauugugcacaucuggcagugacuguagaaaauacgaaauauauauuucucgccaa

SEQ ID NO: 23336 - RNA, 61 nt, Human
gaaauuggcacaucccuuuaaaaauaacaacagaaaauacaacuccugggaaaaaaggugc

SEQ ID NO: 23337 - RNA, 61 nt, Human
gaauaaauauaaaaugaauaacuauuaagguagaaaauauucucagaacauucuagaggag

SEQ ID NO: 23338 - RNA, 61 nt, Human
ugauuuauauuuaguuauuauauuuaggaauagaaaauagaauuaaauaauuuaacuugau

SEQ ID NO: 23339 - RNA, 61 nt, Human
aaucauuuaagaguuccuguaacaguuaugcagaaaauacuaaaacccaucaggcaagauc

SEQ ID NO: 23340 - RNA, 61 nt, Human
uuaaaaaccgaauuucaucauuuaucuaaagagaaaauaugcagaauaacuggucuuguua

SEQ ID NO: 23341 - RNA, 61 nt, Human
cuuaaaauuuuuucccaccaagguauuccaaagaaaauauuaaggucuccccuuuuucuau

SEQ ID NO: 23342 - RNA, 61 nt, Human
auaguguggauuauuaaauaucuaguuuggaagaaaauaauuuauauaaauuauuguaaau

SEQ ID NO: 23343 - RNA, 61 nt, Human
aaaggagugugcucaugccauuuccagaccaagaaaauacauuuauuauuugcuaauuauc

SEQ ID NO: 23344 - RNA, 61 nt, Human
uacuuggaaugguguguuuuacagucuaccuagaaaauagauggacaauauuuuucaacug

SEQ ID NO: 23345 - RNA, 61 nt, Human
gggagcucuccaaagaaacugguugguuuuaagaaaauaguuucaagaaguucaacuauau

SEQ ID NO: 23346 - RNA, 61 nt, Human
uacuucauuguguuguacuggaugcaaagcuagaaaauauugcaauaaaugagaccgauga

SEQ ID NO: 23347 - RNA, 61 nt, Human
acacuuuuaguagucauagugaagcaggucuagaaaauaagccuuuggcagggaaaaaggg

SEQ ID NO: 23348 - RNA, 61 nt, Human
gucguguaagaaggaugcuggucagagcugcagaaaauaugaggcaauuaaaagucuuuag

SEQ ID NO: 23349 - RNA, 61 nt, Human
ugccuuccacaauuaaagaauacucauagaaagaaaauaaucauaaaucauauuugauuaa

SEQ ID NO: 23350 - RNA, 61 nt, Human
ccagccucaaaaauauuuuuuaaaagaaaagagaaaauaauucuucugucaaaggagguua

SEQ ID NO: 23351 - RNA, 61 nt, Human
ucccaccccagccaaaaauauauaaaaaacaagaaaauaacaaauuaaccgcaaacuauca

SEQ ID NO: 23352 - RNA, 61 nt, Human
uaaauuaacaugaaauacuucauuuugauugagaaaauaaaaucagauuuuuucaaaguca

SEQ ID NO: 23353 - RNA, 61 nt, Human
uaugcauaugcguaagaacauuuuaaagccaagaaaauaucugucaaaccauuucuguuag

SEQ ID NO: 23354 - RNA, 61 nt, Human
ccuuucuccuuuuuacaaaaacaaacauagaagaaaauaaaugcacuuuauccacucccca

SEQ ID NO: 23355 - RNA, 61 nt, Human
agucccuuuuuguauguguuuuuauacuuuuagaaaauaaaaacuuuagauuaacucauag

SEQ ID NO: 23356 - RNA, 61 nt, Human
ccuaccucaggguugcuucaaggauuaaaugagaaaauaugucaacaauaaagaccugucu

SEQ ID NO: 23357 - RNA, 61 nt, Human
uuguuacauuguguacauucaaaaggaagagagaaaauauauaugauaaucauuuccacuu

SEQ ID NO: 23358 - RNA, 61 nt, Human
auuuaaacucccaguuguuuauuuucacaaaagaaaauaaaauugcaguugcaagaccuuu

SEQ ID NO: 23359 - RNA, 61 nt, Human
uccaaguaaaugucuuaauacaguuucaauuagaaaauaaaaugucucauacuugcacauu

SEQ ID NO: 23360 - RNA, 61 nt, Human
ccuaagauuucccagugguccgagcagaaucagaaaauacagcuacuucugccuuauggcu

SEQ ID NO: 23361 - RNA, 61 nt, Human
ucuagguucuguauuuuuuucuuaaauagcaagaaaauacagauugcuaguauagucaaca

SEQ ID NO: 23362 - RNA, 61 nt, Human
gcaauucuuucauugucuauuauuaugcuuaagaaaauauucaguuaauaaaaaacagagu

SEQ ID NO: 23363 - RNA, 61 nt, Human
uuuuccaauuuuagaaaaucaagcagguuagagaaaauagagaugaauuaggggacacugu

SEQ ID NO: 23364 - RNA, 61 nt, Human
auguuucugaagaauuuucaauguuguauauagaaaauacagaauuucauggugauaucag

SEQ ID NO: 23365 - RNA, 61 nt, Human
aggugauauucucuuugaauaaaccuauaauagaaaauagcagacaacauaaacaucuuug

SEQ ID NO: 23366 - RNA, 61 nt, Human
ccaagauucuuaaauuugccagcguuaaaguagaaaauaacauuucagaagagcacaauau

SEQ ID NO: 23367 - RNA, 61 nt, Human
ggaggaaaguuaaaaagaugagcaauagaguagaaaauauaucuuaaacuaguugaccuag

SEQ ID NO: 23368 - RNA, 61 nt, Human
guuuaaaacucugguaauuacuuguaacaguagaaaauagaagucauucuuauuuuagaaa

SEQ ID NO: 23369 - RNA, 61 nt, Human
auguggucuuuuuaaaaaauuguaacccucuagaaaauaucaaagaaaugaaccagacgug

SEQ ID NO: 23370 - RNA, 61 nt, Human
auguauauuuuguaaaucucccauuuuuguaagaaaauauauauuguauuuauacauuuuu

SEQ ID NO: 23371 - RNA, 61 nt, Human
cuaauucuuggucuauacuaagauguauuugagaaaauacauuugauuugauuuuguggcc

SEQ ID NO: 23372 - RNA, 61 nt, Human
ucuuuguggauggugucuccuuuacuaaauaagaaaauaacaaagcccuuauucucuuuuu

SEQ ID NO: 23373 - RNA, 61 nt, Human
cuucaggaacaccaguuaggaaaauagcuccagaaaauauagauauauuuuauuuuuauua

SEQ ID NO: 23374 - RNA, 61 nt, Human
cuaauuuuuuuauggaccauaaagguuuaaaagaaaauaggggcacaggcuguugagguuu

SEQ ID NO: 23375 - RNA, 61 nt, Human
uaaauaauaauaguuaaugaaggugugcuacagaaaauaaucugguguucuugcuaacuuu

SEQ ID NO: 23376 - RNA, 61 nt, Human
uaaaauaucuuuugaccuguggugcaaaagcagaaaauacagcuggauuggguuaugaaua

SEQ ID NO: 23377 - RNA, 61 nt, Human
uaguuuggguucauuucuauaacauuuuguaagaaaauaaaaguuugagcaccugauuaua

SEQ ID NO: 23378 - RNA, 61 nt, Human
uuuucuuuuuuacggaauucaucaucagagaagaaaauaacaaaaauggaagcaaacaaca

SEQ ID NO: 23379 - RNA, 61 nt, Human
cacacacaauacaagacauuuuuccuguuuuagaaaauauagcccuuguuuggauuacugc

SEQ ID NO: 23380 - RNA, 61 nt, Human
gagcauggguucauccuauucuuucgaaagaagaaaauaucauaaaaaugagugauaaaua

SEQ ID NO: 23381 - RNA, 61 nt, Human
ccacggaaaccgugacaacugccaugucacaagaaaauaccugccagucaacagguaccuc

SEQ ID NO: 23382 - RNA, 61 nt, Human
ccggaguagggggugggagagggaagaggagagaaaauacagggacuuugaaccuaggcca

SEQ ID NO: 23383 - RNA, 61 nt, Human
acuguguaaagacuugaagggacagaagugaagaaaauaagcugcaauuuuguacagauac

SEQ ID NO: 23384 - RNA, 61 nt, Human
auacuauugagaaaucuauggggaggauaugagaaaauaaauuccuucuaaaccacauugg

SEQ ID NO: 23385 - RNA, 61 nt, Human
cugacaauaagguuugacagaggggaacagaagaaaauaauaugauuuauuagcacaacgu

SEQ ID NO: 23386 - RNA, 61 nt, Human
auauuaacuuuuuucuauuuaucuuuauuauagaaaauaccuuagaauguucuugauagag

SEQ ID NO: 23387 - RNA, 61 nt, Human
gaucuuuagaaaacuucauacuguaugaauaagaaaauaaaauauuugaaacuugcuugaa

SEQ ID NO: 23388 - RNA, 61 nt, Human
aggaacuauaaaaacaaaaacuuguuacuaaagaaaauaucugaaaugugauaaguucuua

SEQ ID NO: 23389 - RNA, 61 nt, Human
gauuuauuuuucuuacuccacuaaacuauaaagaaaauaauuacuuagaaacuccauuuua

SEQ ID NO: 23390 - RNA, 61 nt, Human
auaugauacaaauccugcaaaagacaucaugagaaaauaccagcaguaucuaucaugaaug

SEQ ID NO: 23391 - RNA, 61 nt, Human
aaaaaaaaaaaaaagaaagaaauagcauugaagaaaauaccgcacaucagaggaaagcuua

SEQ ID NO: 23392 - RNA, 61 nt, Human
gguugaaucauuuuauuaaaaauacuuuuuaagaaaauaacuaugaacaucugaauauuaa

SEQ ID NO: 23393 - RNA, 61 nt, Human
aaaacagagucgcuuuugccuuuucaaaucaagaaaauaagugcucugucaaaagcacaaa

SEQ ID NO: 23394 - RNA, 61 nt, Human
uucaugggacuuuaaaaagaauaaguauuugagaaaauaucugguucacuuacacuacauu

SEQ ID NO: 23395 - RNA, 61 nt, Human
gcucucccuagcuucacaucuuguguuuuccagaaaauaaaaacagcagacuguccuuucu

SEQ ID NO: 23396 - RNA, 61 nt, Human
cgagugcuuucuguauuuaaauauuguaaaaagaaaauaaguuauaacuguuauaaagcag

SEQ ID NO: 23397 - RNA, 61 nt, Human
uucuaaaagauaaguguguuugcaaaaaaaaagaaaauaaauacauaaaaaagggacaagc

SEQ ID NO: 23398 - RNA, 61 nt, Human
cauuucacaaaagauggaauuugcccuuccuagaaaauaugacggagaaaagucugacuca

SEQ ID NO: 23399 - RNA, 61 nt, Human
uucuaugcaaaaucauagccaaaacuaguauagaaaauaauacgaaacuuuaaaaagcauu

SEQ ID NO: 23400 - RNA, 61 nt, Human
uuacagagaaucugaagcuauugauguuuccagaaaauauaaaugcaugauuuuauacaua

SEQ ID NO: 23401 - RNA, 61 nt, Human
uuuuccagacacaaggcugcuaaaccaauuaagaaaauaauuaauuucuuucaagcaacua

SEQ ID NO: 23402 - RNA, 61 nt, Human
gauuucauauccugagauagcucugcagauaagaaaauauuuaaauauaugacaaaaagua

SEQ ID NO: 23403 - RNA, 61 nt, Human
aacagcaacuccaucacuugagaaguauaauagaaaauagcuucuaaaucaaacuuccuuc

SEQ ID NO: 23404 - RNA, 61 nt, Human
uugcuguuuuuuugucuuuuuguuuuuuacuagaaaauaguucaguguaauauuaaguuag

SEQ ID NO: 23405 - RNA, 61 nt, Human
aaacaaacaacaacaacaaaauuauaaagguagaaaauaaaccuaaauugugucguaauua

SEQ ID NO: 23406 - RNA, 61 nt, Human
uugcugcuauucuggaauguguccauugaaaagaaaauaggcgcuuugucuccuacaaucu

SEQ ID NO: 23407 - RNA, 61 nt, Human
guaugaaaacaggaaaauaaaagagaaauuuagaaaauacagcucauuacaauaaaauugu

SEQ ID NO: 23408 - RNA, 61 nt, Human
augagauacuacacucauuuaaauauuuuuaagaaaauaaaaagcuuaagaaauuuaaaau

SEQ ID NO: 23409 - RNA, 61 nt, Human
cacauuuuucuacuauuugaccaaaaggaaaagaaaauaaagaagaacucuggaguggucu

SEQ ID NO: 23410 - RNA, 61 nt, Human
guuaugccuguugcaggcaaauguaaagucuagaaaauaaugcaaaugucacggcuacucu

SEQ ID NO: 23411 - RNA, 61 nt, Human
aucacacaguuuucaggcuccaucuguuuggagaaaauacauucugaagcauccccaauuc

SEQ ID NO: 23412 - RNA, 61 nt, Human
uuucaaacugguuuguauuuauuucaaaggaagaaaauauauugauucuuagaaaauaaac

SEQ ID NO: 23413 - RNA, 61 nt, Human
uauuucaaaggaagaaaauauauugauucuuagaaaauaaacugucaauuuagaauucuuu

SEQ ID NO: 23414 - RNA, 61 nt, Human
uaauagcauuuuuguaacuugccauccgcacagaaaauacgagaaaaucugcauguuugau

SEQ ID NO: 23415 - RNA, 61 nt, Human
cguucagucucuuguggcaauagcacuuugaagaaaauagagaauuuaauauauggugauu

SEQ ID NO: 23416 - RNA, 61 nt, Human
guacauuccacauuuuaauaaauuaaccacaagaaaauaaucccacauauacaaggucagg

SEQ ID NO: 23417 - RNA, 61 nt, Human
acucccuuugcuggcuugugcagugauacugagaaaauacaugaacagaaacugcccaggu

SEQ ID NO: 23418 - RNA, 61 nt, Human
cuuauuggggauaaacacuucaacuuuuggcagaaaauacuuuggauucuccccaagguca

SEQ ID NO: 23419 - RNA, 61 nt, Human
cuuuguuuaguaauagguaggaaaaugaagaagaaaauagaauguugcagaauguggaggg

SEQ ID NO: 23420 - RNA, 61 nt, Human
cauagagagguaagcauuaguggcacagcugagaaaauauaaaagguaguucugucucuau

SEQ ID NO: 23421 - RNA, 61 nt, Human
augaaaauguaguaguacaaccaguuguagcagaaaauauuccuguaauaccacugaguga

SEQ ID NO: 23422 - RNA, 61 nt, Human
uucuacuucuaagaaucauacucuacuucuaagaaaauaauuagaaguagacaaagauuaa

SEQ ID NO: 23423 - RNA, 61 nt, Human
uuauguaugugaaaguuacaaauugcuugaaagaaaauaugcaucuaauaaaaaacaccuu

SEQ ID NO: 23424 - RNA, 61 nt, Human
gcaaaaaagggacacaccccacuucgguaaaagaaaauagggaaaggccauaaacaaagac

SEQ ID NO: 23425 - RNA, 61 nt, Human
agugaggucauccuugaaaaguggcagaaaaagaaaauagcagagauggguccagugcagu

SEQ ID NO: 23426 - RNA, 61 nt, Human
uuuauggaggaauuagucacaaaugacuuguagaaaauacugucauauaguucauuucauc

SEQ ID NO: 23427 - RNA, 61 nt, Human
uuacuuucaaaaauaagcuagaauauauuaaagaaaauagaaaaaauuaccuuaaauauau

SEQ ID NO: 23428 - RNA, 61 nt, Human
uuuaauguguuuaaauugguggggcaccagcagaaaauauucuagcucagcuuuacucuuc

SEQ ID NO: 23429 - RNA, 61 nt, Human
uucuuucuuucuaaaauagauuggucugagaagaaaauaaguaauuugaggccauuuggaa

SEQ ID NO: 23430 - RNA, 61 nt, Human
ccagcaguccugaauccuuccugaagaguucagaaaauagaugugguauugcucugaggac

SEQ ID NO: 23431 - RNA, 61 nt, Human
guggcuaugaggauugauugggcugauguguagaaaauauguaaugcagggcuuguccugg

SEQ ID NO: 23432 - RNA, 61 nt, Human
uauggucccuuaucuccuaucuucccucuugagaaaauacacgcuuucugcauguauuaga

SEQ ID NO: 23433 - RNA, 61 nt, Human
ggagaaguucuguaugugaggaaggaaaaaaagaaaauaaaaguguguuugaaaaauauua

SEQ ID NO: 23434 - RNA, 61 nt, Human
uaacuuucuaguuuagaaaaaaaucaaaccaagaaaauagugaguuaaaaaaauaauagaa

SEQ ID NO: 23435 - RNA, 61 nt, Human
aaugaaagcaauuuuaugugugccugaagcaagaaaauagcguuuuugguuuuaucucaua

SEQ ID NO: 23436 - RNA, 61 nt, Human
uuauccuuaauugugacuaagauggaaaucuagaaaauauucaugcuucuaaguuucugca

SEQ ID NO: 23437 - RNA, 61 nt, Human
gcuagauuacccaaagaaauagaucaguuggagaaaauacaaaacaauucaaagcucuuaa

SEQ ID NO: 23438 - RNA, 61 nt, Human
uagguauuuaucaacugcagauguuauugaaagaaaauaaaauucagucucaagaguaaac

SEQ ID NO: 23439 - RNA, 61 nt, Human
uaaaauaucuuccuuuggggaaguuuauuugagaaaauauaauaaaagaaaaaaguaaagg

SEQ ID NO: 23440 - RNA, 61 nt, Human
aagaaggugaaaagauaaccugcagaaugggagaaaauauuugcgagucauauauaugaua

SEQ ID NO: 23441 - RNA, 61 nt, Human
aaguuauuccaugugaugcuugugagaauugagaaaauaugcauggaaauauccagaugaa

SEQ ID NO: 23442 - RNA, 61 nt, Human
acuaaggagaaaugacuuuuauaacauuuugagaaaauaauaaagcauuuaucuaaagauu

SEQ ID NO: 23443 - RNA, 61 nt, Human
acaauucuaauaaccuucccucaaaaugcagagaaaauauaaguugucucuuuauauaaau

SEQ ID NO: 23444 - RNA, 61 nt, Human
ugagagguuggaaauguagcugcuuuucuuuagaaaauauguagcugucaucauuugguac

SEQ ID NO: 23445 - RNA, 61 nt, Human
guuucuuucuuucucuguaaucugcuaugaaagaaaauaacaaaugaaaauaaauguguac

SEQ ID NO: 23446 - RNA, 61 nt, Human
gguugggugcuuauuuaucuguuugccaugcagaaaauaucuugcacaaaauuaccucugu

SEQ ID NO: 23447 - RNA, 61 nt, Human
aaaccuacgagggaggaacaccugaucuuacagaaaauaccaccucgagaugggugcuggu

SEQ ID NO: 23448 - RNA, 61 nt, Human
uccuuuggccaaaagcugaagggaguuacugagaaaauaguuaacaauuacugucaggugu

SEQ ID NO: 23449 - RNA, 61 nt, Human
aauugaggaauauuuauuaaaauaccuguaaagaaaauagugaaucacuguagcaauggcu

SEQ ID NO: 23450 - RNA, 61 nt, Human
accagcauuuguguuagccagcucacagagaagaaaauaacuugcaguaguuuuauaauaa

SEQ ID NO: 23451 - RNA, 61 nt, Human
uuucuccacuauagccaacacucagucaagcagaaaauacaaauccccccaaaacuuugag

SEQ ID NO: 23452 - RNA, 61 nt, Human
aaaucuuagaguaaauuuuagucuuaaagccagaaaauaaguuuauagccaucuagauauu

SEQ ID NO: 23453 - RNA, 61 nt, Human
cuaguucucugaagaacugauguuauuacaaagaaaauacaugcccaugaccaaauauuca

SEQ ID NO: 23454 - RNA, 61 nt, Human
uauugcaggucaauauaauacugccagagacagaaaauacccccuuaucagucccuuagug

SEQ ID NO: 23455 - RNA, 61 nt, Human
gcagauuuuuugaguucccaauacguuucauagaaaauaaguaagaacuauuuuuaaaaua

SEQ ID NO: 23456 - RNA, 61 nt, Human
uuuuagccuuucuccagaacuaaggcauuaaagaaaauagcaaauauuaaaaaauaaaacu

SEQ ID NO: 23457 - RNA, 61 nt, Human
aaagucagauggaaagagcaacugaaguccuagaaaauagaaauguaauuuuaaacuauuc

SEQ ID NO: 23458 - RNA, 61 nt, Human
ccucaggauguuucagccaaacaagaagagaagaaaauauuguugaaauuaacaaugauca

SEQ ID NO: 23459 - RNA, 61 nt, Human
auaauuuuuauuaacuuugagauucuuauacagaaaauaguugcaaggguaagguaauuaa

SEQ ID NO: 23460 - RNA, 61 nt, Human
uuuugcuuuguuuccuuuuuuagaaaguucuagaaaauaggaaaacgaaaaauuucauuga

SEQ ID NO: 23461 - RNA, 61 nt, Human
augucuugcaaugugcuguaaucacaagaggagaaaauaacuuguuuccuugaucugucag

SEQ ID NO: 23462 - RNA, 61 nt, Human
aaacccaccauguauggaagagcaagaaaagagaaaauauuaaaacgaggagagagaaaaa

SEQ ID NO: 23463 - RNA, 58 nt, Human
agacaacauacagguucuaacagagagaagaaaauauauuagugcuuuuuuuuuuuca

SEQ ID NO: 23464 - RNA, 61 nt, Human
aucauaaaacaaaucccucauccugacaggaagaaaauagaacagcucauagcucgagccg

SEQ ID NO: 23465 - RNA, 61 nt, Human
aacuuuggauauuauauguuucugggagaagagaaaauacuucaccuauugggaugccaau

SEQ ID NO: 23466 - RNA, 61 nt, Human
uguaauaugaacuaggaacgcauuuacuaugagaaaauauggcucuuaagcaguguaagag

SEQ ID NO: 23467 - RNA, 61 nt, Human
gaauauuuuaaguauugcaucuguauaaguaagaaaauauuuugucuaaaaugccucagug

SEQ ID NO: 23468 - RNA, 61 nt, Human
gcugcaugagauaaucacuugggagcuuuggagaaaauagcaguaccaagggaucucacca

SEQ ID NO: 23469 - RNA, 61 nt, Human
aucaaugccuaugaauucuucuaauacgugaagaaaauaguuugaguagcagcagugcuau

SEQ ID NO: 23470 - RNA, 61 nt, Human
auuauaaauguaauuucuguugaaagacuucagaaaauauaggccuuuaaagugaagaaga

SEQ ID NO: 23471 - RNA, 56 nt, Human
gcaacgauaaauacucuuaggaagagagaaaauaagguuucauaaguuuguacuug

SEQ ID NO: 23472 - RNA, 61 nt, Human
gugauauaguauagauaaaagaaugaguaaaagaaaauacaagaauucuaaagaaaguugg

SEQ ID NO: 23473 - RNA, 61 nt, Human
agcacacauaccuuuauuuugggaauuuaugagaaaauauagaaaaccacagaucagggau

SEQ ID NO: 23474 - RNA, 61 nt, Human
cauuaaauuuaagauaugcaaauuuauguagagaaaauaaauguuauauacccuauaaucu

SEQ ID NO: 23475 - RNA, 61 nt, Human
gcaguagguuaaaauucuauuaaacaaauauagaaaauauuuuguuuauaauuggccuggu

SEQ ID NO: 23476 - RNA, 61 nt, Human
cgagauuacaaugcucuagaaucagcauauaagaaaauaaaugauaucugcauguugaauu

SEQ ID NO: 23477 - RNA, 61 nt, Human
uccauuuucaaggugcagaacaaggagugaaagaaaauauaagaagaaaaaaauccccuac

SEQ ID NO: 23478 - RNA, 61 nt, Human
uacauguuauuaaacucuuuaaauaugucauagaaaauaauacaaucauguaaugagucuu

SEQ ID NO: 23479 - RNA, 61 nt, Human
aauauuaauuuuuccacuucaguuuuauucuagaaaauacccuuuuuagaaauccaguuuu

SEQ ID NO: 23480 - RNA, 61 nt, Human
uugacagacuauuugcuaauguauaaugugcagaaaauauuuaauaucaaaagaaaauuga

SEQ ID NO: 23481 - RNA, 61 nt, Human
uugauaauuguguaccuuaagauauugaaggagaaaauagauaauuuacaagauauuauua

SEQ ID NO: 23482 - RNA, 61 nt, Human
uaaaaaguuaacaugauacgaaacugugauuagaaaauaucuggucuggaugugauuagua

SEQ ID NO: 23483 - RNA, 61 nt, Human
auugaaaaaucguacagucauuucaagaauaagaaaauaaaauuuucucuuugucugaacc

SEQ ID NO: 23484 - RNA, 61 nt, Human
uuuugcagcucuguuuuucugcacacucaauagaaaauauugugggucugagaugcccuuu

SEQ ID NO: 23485 - RNA, 61 nt, Human
cagaugacugcaaguucagggagcguuuucaagaaaauagcuauaauaccuaugccucagc

SEQ ID NO: 23486 - RNA, 61 nt, Human
guggcugggauaugauggguuagaagcaaggagaaaauauaaggacuuuuugauggaauua

SEQ ID NO: 23487 - RNA, 61 nt, Human
uucaaaauuuaaagccaugcuaaaauuaaaaagaaaauauuaaauuacacaauuacacuug

SEQ ID NO: 23488 - RNA, 61 nt, Human
uuaagguaaacaaagcuaacugucgacuaccagaaaauacuuucaacauaaaugaacucuc

SEQ ID NO: 23489 - RNA, 61 nt, Human
uuugaauguuuuaagauaggagagacuuagcagaaaauacuuggcuugccagggccacguu

SEQ ID NO: 23490 - RNA, 61 nt, Human
augguuggguguguccuuucuggugaccaugagaaaauaauaugucuugaugaagucuuuu

SEQ ID NO: 23491 - RNA, 61 nt, Human
auggugccuaaaaugccagcuauugccaagaagaaaauaguugaugucugucaauaacugu

SEQ ID NO: 23492 - RNA, 61 nt, Human
uauauuuuagaaauuuguuaaugagaguaaaagaaaauaaauguguauagcucaguuugga

SEQ ID NO: 23493 - RNA, 61 nt, Human
acgaagaaaguacauauguuaacuauaaugcagaaaauauauuaauuaaugaaacugucuc

SEQ ID NO: 23494 - RNA, 61 nt, Human
gucuuuuauuauaggauuaguaagauauacaagaaaauaaccaccguguugugaaaaagug

SEQ ID NO: 23495 - RNA, 61 nt, Human
gguuagacaugcuugaccaaaaauguucagaagaaaauauguaccuggucccuaauuaagc

SEQ ID NO: 23496 - RNA, 61 nt, Human
gauaaugcuaauacaaauauacacauugcacagaaaauacacauuuacuguccaauuuaaa

SEQ ID NO: 23497 - RNA, 61 nt, Human
cagcauauuaguaugcuguuuuauuugcugaagaaaauacugucuucuauuuuuaaugaua

SEQ ID NO: 23498 - RNA, 61 nt, Human
uuuauuuuacauuuaaauucccacagcaaauagaaaauaauuuaucauacuuguacaauua

SEQ ID NO: 23499 - RNA, 61 nt, Human
uuuugcuuuuugaagcuguauuuuuaaguuaagaaaauauauuuuugguauaacuuuuaug

SEQ ID NO: 23500 - RNA, 61 nt, Human
ucacucacgguuuugaaaguucaaaccacagagaaaauauuuauaacaugcaaaaaauaaa

SEQ ID NO: 23501 - RNA, 61 nt, Human
aacaaaacagauaugcuuacucuaguuaaaaagaaaauaaaucucaugucagacccagaaa

SEQ ID NO: 23502 - RNA, 61 nt, Human
gaaacaaugguuccuuaguuuugcacugggaagaaaauauuuuguaaaagaauguuuauuu

SEQ ID NO: 23503 - RNA, 61 nt, Human
uagauuuuuggaacgaaaaaggguaaguauaagaaaauauugcaaacacauuaaaacaguu

SEQ ID NO: 23504 - RNA, 61 nt, Human
augaucaucuaaugaaagccaguuacaccucagaaaauaugauuccaaaaaaauuaaaacu

SEQ ID NO: 23505 - RNA, 61 nt, Human
auuuacagugauagaacaaaagaggauuaguagaaaauacauuauuagaauauaaaaaaug

SEQ ID NO: 23506 - RNA, 61 nt, Human
uauuuuuuuucuaaauguacauaauuagaaaagaaaauaacaauaggaagcuauguguauc

SEQ ID NO: 23507 - RNA, 61 nt, Human
cauaaaauaacaauguuuccaaaugcaacuaagaaaauacucauagugaguacgcucuaug

SEQ ID NO: 23508 - RNA, 61 nt, Human
aauugaccuuaauuuguuuuccagaaucaaaagaaaauaaaauauaaauuuugaaacuaug

SEQ ID NO: 23509 - RNA, 61 nt, Human
gucucaaaaaaaaaaaaaaaaaaaggagagaagaaaauaaagaaggcuaauauauaauuuu

SEQ ID NO: 23510 - RNA, 61 nt, Human
aguuucuagcauuaaacaaauaaacaaggggagaaaauaaaacucaaggacugaaaaucag

SEQ ID NO: 23511 - RNA, 61 nt, Human
aucgcuauucuuucaccugucaauauuaauaagaaaauagucucaucucacuuaaaugagg

SEQ ID NO: 23512 - RNA, 61 nt, Human
acagggaaaaaaucucaucuucuuuuccaguagaaaauaguuugugaaaugaugagggcau

SEQ ID NO: 23513 - RNA, 61 nt, Human
augaaaacccuagacuugugaccugaaauaaagaaaauacguuagaagagcacuguagaaa

SEQ ID NO: 23514 - RNA, 61 nt, Human
uucuuccugauaugauaacuaggucuccaagagaaaauagaaaggcugcuuuagugccuua

SEQ ID NO: 23515 - RNA, 61 nt, Human
ucacagccucguagagcuucacagcuacuccagaaaauaggguuaugugugucauucauga

SEQ ID NO: 23516 - RNA, 61 nt, Human
aaggcuauuugccagcauauauuaauauuuuagaaaauauuccuuuuguaauacugaauau

SEQ ID NO: 23517 - RNA, 61 nt, Human
augguguuuauuuucuuucuuauaacugcagagaaaauauccugacuaaaaaaaauucauu

SEQ ID NO: 23518 - RNA, 61 nt, Human
uguuuuaagaaacugcuuaguccaccacugaagaaaauauccagaaauuauuuucauuuua

SEQ ID NO: 23519 - RNA, 61 nt, Human
augcucaugaccaacacauacacgucauagaagaaaauaguggugcuucuuucugaucucu

SEQ ID NO: 23520 - RNA, 61 nt, Human
aaacagagcagugaccacuuccuguaaguaaagaaaauauaauccuauauugagcuucagu

SEQ ID NO: 23521 - RNA, 61 nt, Human
uguguucagaagauguuguuuugccaguauuagaaaauacugugagccgggcaugguggcu

SEQ ID NO: 23522 - RNA, 61 nt, Human
gacuuucuuuuuuuguaaagcaaauuacuuaagaaaauacaauucacuugaauuugacaaa

SEQ ID NO: 23523 - RNA, 61 nt, Human
ugugugcuuuauaguguuuacuaaagugacaagaaaauauaccauuugacacacuauagau

SEQ ID NO: 23524 - RNA, 61 nt, Human
gcacucugucuucuuugcuagagaaguggagagaaaauacaaaagguaaagcaguugagau

SEQ ID NO: 23525 - RNA, 61 nt, Human
ugcuuugaguuuuuauauuccuuacacaaaaagaaaauacauaugcagucuagucagacaa

SEQ ID NO: 23526 - RNA, 61 nt, Human
auuuuuguauagcugauaagauucucuguagagaaaauacuuuuaaaaaaugcagguugua

SEQ ID NO: 23527 - RNA, 61 nt, Human
caccuuuugcauuauuucuuauguuuugaaaagaaaauagcuuuuuauacuuuuuaguuuu

SEQ ID NO: 23528 - RNA, 61 nt, Human
aacaugagauacucuuuguuuuguacauacuagaaaauacagcuaucuucugaugagcaau

SEQ ID NO: 23529 - RNA, 61 nt, Human
uaguguucuguguaguuauugcuuagucugcagaaaauaaugacuuagaugagaugucuga

SEQ ID NO: 23530 - RNA, 61 nt, Human
aaugugaaaggaccuuuugucacagcacuucagaaaauacacaacagccccuucugccccc

SEQ ID NO: 23531 - RNA, 61 nt, Human
uuuugucuuuguaauuuacagaaguuauuggagaaaauaaacuuguuucauuuugcauuuc

SEQ ID NO: 23532 - RNA, 61 nt, Human
aagaaaauggagaaaugaaauauuuuaugaaagaaaauaauaacaauuauucaauaaucua

SEQ ID NO: 23533 - RNA, 61 nt, Human
auccuucaagucugugguuuugaugcagagaagaaaauaguuuugauuuuugaguuuuuaa

SEQ ID NO: 23534 - RNA, 61 nt, Human
auggggauauuugauguuuucagaaagaggaagaaaauaugguccaaauuaaauuuuccaa

SEQ ID NO: 23535 - RNA, 61 nt, Human
gaugacuuuguggccaucuuguuauugaguaagaaaauaaagcauggacaucaugaaaaua

SEQ ID NO: 23536 - RNA, 61 nt, Human
gaaaaagagagagcagggugggguaaggaggagaaaauaaaccaacaauuaggucugcauu

SEQ ID NO: 23537 - RNA, 61 nt, Human
uaaaaccacuaauuguuccguuaagcuucacagaaaauaaaaccucuauuacuagacauuu

SEQ ID NO: 23538 - RNA, 61 nt, Human
caaucaugucagucugcuuagaaauaacagaagaaaauagaauugacauugaaaucuagga

SEQ ID NO: 23539 - RNA, 61 nt, Human
uauguuuguaaucuguaaaugaacacauggcagaaaauaaccccugauugguaggaucaua

SEQ ID NO: 23540 - RNA, 61 nt, Human
aaaaaaaaaagcauuuaacuugcaccaagcaagaaaauauaaauacaguuaacugcauuaa

SEQ ID NO: 23541 - RNA, 61 nt, Human
uguuugaacauuuuaauuugugugaugauguagaaaauauaauuuuaguuuguacauaaac

SEQ ID NO: 23542 - RNA, 61 nt, Human
cucugcuauuucucuugcuggaacuguugaaagaaaauauauagaaugaucuauugcucau

SEQ ID NO: 23543 - RNA, 61 nt, Human
ugcuugucuuaaaauaaugaacacuacagauagaaaauaugauauauugcuguuaucaauc

SEQ ID NO: 23544 - RNA, 61 nt, Human
auuuuuuugucuuucaaugcaguuuuuuggaagaaaauauuuuuaaauggacaauggacug

SEQ ID NO: 23545 - RNA, 61 nt, Human
ugacuguggguuuuauuuuguauucugguuaagaaaauaauguauugaguuacugucaagu

SEQ ID NO: 23546 - RNA, 61 nt, Human
aguuuaugugugugaugugacuuaacuaugcagaaaauauuuaaguuggauguacuuguuu

SEQ ID NO: 23547 - RNA, 61 nt, Human
cagagcuuugguaauuacaugaauaaaauuaagaaaauagccauauacaaucaaauacacu

SEQ ID NO: 23548 - RNA, 61 nt, Human
auguaaaauacucuccagaucuaccauuaauagaaaauaaacuaaaccuuauauuuuauuu

SEQ ID NO: 23549 - RNA, 61 nt, Human
uuuacgaaaaucuuagauuuuguuuagaaugagaaaauauacaauuagaauuauuuuagaa

SEQ ID NO: 23550 - RNA, 61 nt, Human
aaacuuauuucucauaucaacuuagucaauaagaaaauauauucuuucaaaggaacauugu

SEQ ID NO: 23551 - RNA, 61 nt, Human
uuaucugaguguuccacaguuguaugucaaaagaaaauaaaauucaaauauuuaaaacgga

SEQ ID NO: 23552 - RNA, 61 nt, Human
acacgauccucuuucugggcauuccuaggggagaaaauaaaauuuguaauguucuagagau

SEQ ID NO: 23553 - RNA, 61 nt, Human
uaagaugugcaaggagauuuaaugauuucaaagaaaauaaugguucuuuguuuuuaauguu

SEQ ID NO: 23554 - RNA, 61 nt, Human
cgauauuuccaauccuggcuacuuuucuuagagaaaauaaguccuuuuuuucuggccuugc

SEQ ID NO: 23555 - RNA, 61 nt, Human
ugcauacacacacacacacagccacacacacagaaaauauacuguaaagaaagagagaaaa

SEQ ID NO: 23556 - RNA, 61 nt, Human
cacacacagaaaauauacuguaaagaaagagagaaaauaaaaaguuaaaaaguuaaaaaaa

SEQ ID NO: 23557 - RNA, 61 nt, Human
cagagcuuguagcuggacagagucaaaaagaagaaaauacgguuucaggcuuucuugcaga

SEQ ID NO: 23558 - RNA, 61 nt, Human
cauuaaauauaaaauacauaaaagaauguacagaaaauagcuuuuauugaguaauauuaca

SEQ ID NO: 23559 - RNA, 61 nt, Human
uccaccaauaucauguguagauauuauguauagaaaauaaaauaaauuauggcucuaacuu

SEQ ID NO: 23560 - RNA, 61 nt, Human
uggaaaacaaagaaacagacacaaugcacacagaaaauauuagauauggagagauuauuca

SEQ ID NO: 23561 - RNA, 61 nt, Human
cacaacacacaagggagagaacccccagaugagaaaauaggaaggagcaaucauuuguaga

SEQ ID NO: 23562 - RNA, 61 nt, Human
gccaauuagcuucuacuaaccacgguucaacagaaaauaaauguguauuugugaauaacaa

SEQ ID NO: 23563 - RNA, 61 nt, Human
guucuuacaaaugaaccuucggaucuaugaaagaaaauauaguagggggacuaaggaacau

SEQ ID NO: 23564 - RNA, 61 nt, Human
ggaguguaaaucuucaugauguuguaauucaagaaaauaggcacuuucucugaaagaccug

SEQ ID NO: 23565 - RNA, 61 nt, Human
ccaguuuucuuuaugaugauacaguguuaaaagaaaauaaauuacaauugaucugucaucc

SEQ ID NO: 23566 - RNA, 61 nt, Human
uauucauauuuguggauuuccuaaaagccucagaaaauacgacugacuaggcagcaaagac

SEQ ID NO: 23567 - RNA, 61 nt, Human
uaucuuuacaaaguguuuaaaguuugaacauagaaaauaaucucucugcuuaauuguuaac

SEQ ID NO: 23568 - RNA, 61 nt, Human
guaggcagagugcucacuuugaauugcuaauagaaaauaaugcacaguguccucaggauau

SEQ ID NO: 23569 - RNA, 61 nt, Human
agcaggaaaucaaaggaguggguggaaugagagaaaauaugcaaagagaucauuuuuaagu

SEQ ID NO: 23570 - RNA, 61 nt, Human
guugauuucaagauuauaaauacucaugaucagaaaauaguacuuauuagcaauuaaaggg

SEQ ID NO: 23571 - RNA, 61 nt, Human
aaagauucucaguuaccaaacgucuccaccuagaaaauaaaaauacauuaagaugugcuuu

SEQ ID NO: 23572 - RNA, 61 nt, Human
ucuaaaaacuucaaguguuugauuaaaauagagaaaauaauuuuuaaaauaauagauaaaa

SEQ ID NO: 23573 - RNA, 61 nt, Human
cugugacuuaggugaauuuucaauuuaagguagaaaauaaguuuuuaggagguuuguaaaa

SEQ ID NO: 23574 - RNA, 61 nt, Human
uaugaccaaauccugccucauuaauucaagcagaaaauauccuggcagggaaucuggcuua

SEQ ID NO: 23575 - RNA, 61 nt, Human
gaauuuucuuaugaauccacucuacuuggguagaaaauauuuuaucucuagugauugcaua

SEQ ID NO: 23576 - RNA, 61 nt, Human
uucguccauguuucucacauugcuguauuuuagaaaauagggguuaagacugauaacaacc

SEQ ID NO: 23577 - RNA, 61 nt, Human
cuccaugugcccuuuuuagggaagcuguuggagaaaauacuccagcaaaaugaaggaguac

SEQ ID NO: 23578 - RNA, 61 nt, Human
cagaugccuuugagaaaugaaugaaguagagagaaaauaaaagaaaaaccagccaggcaca

SEQ ID NO: 23579 - RNA, 61 nt, Human
caggaugcaaggucuauuaucccaacagaagagaaaauauuuuuauauuuaaggauuaugc

SEQ ID NO: 23580 - RNA, 61 nt, Human
uaaaauuuaacauuuagauuuacuuaauuguagaaaauacaaauguaaaacuuacacaugg

SEQ ID NO: 23581 - RNA, 61 nt, Human
uugguuuucuucuagauagcagcugucccaaagaaaauauuucuucuuugucuguuaagau

SEQ ID NO: 23582 - RNA, 61 nt, Human
cuauacucaacuggauauguguauguaaauuagaaaauacauaccuauccagacauaaaug

SEQ ID NO: 23583 - RNA, 61 nt, Human
aauuuuugaaaucacuacuguuaccuguuauagaaaauaguguuggcuuagucuagucucu

SEQ ID NO: 23584 - RNA, 61 nt, Human
gucucccaguuaagaagagucuccauuuuccagaaaauacagcuaagcaagaaaaauaucu

SEQ ID NO: 23585 - RNA, 61 nt, Human
augggaagagcaacaguaacuccaaagugucagaaaauaguuaacauucaaaaaacuuguu

SEQ ID NO: 23586 - RNA, 61 nt, Human
uucauagugucuguauguaaacugaacuugaagaaaauauauugaaauuaaagcuguauaa

SEQ ID NO: 23587 - RNA, 61 nt, Human
gcuauuccccaacccaccuccagauaaugugagaaaauagccaugucaguauguaggaacu

SEQ ID NO: 23588 - RNA, 61 nt, Human
aaaacaaguuaaaaacugaauguacugauuuagaaaauauauauaaauauauauuguuaaa

SEQ ID NO: 23589 - RNA, 61 nt, Human
uuggccaaguuuugcuuguugugugcuugaaagaaaauaucucugaccaacuucuguauuc

SEQ ID NO: 23590 - RNA, 61 nt, Human
agggauuuauaauuuuaaaacaaauaugcacagaaaauaaacauuucuuaaaauauauucu

SEQ ID NO: 23591 - RNA, 61 nt, Human
gcaugaaugaaccugauacacaauuaugaccagaaaauauggcuccaugaaggugcuacuu

SEQ ID NO: 23592 - RNA, 61 nt, Human
ucuguuuuauguguuuugauuacuagugagcagaaaauaacauacccuguauucaaaauua

SEQ ID NO: 23593 - RNA, 61 nt, Human
ugcauauacaaaaaaaaucauuuuaaagccaagaaaauaucugucaaaccauuucugucag

SEQ ID NO: 23594 - RNA, 61 nt, Human
auguugagaacuaaggauauucuuuagcaagagaaaauauuuuccccuuauccccacugcu

SEQ ID NO: 23595 - RNA, 61 nt, Human
uuuugauaaauggaucaguuuuaggacuuucagaaaauaaaagaucgcucuugaaaagcug

SEQ ID NO: 23596 - RNA, 61 nt, Human
gcaguagagugauaggacauucuaugcuuacagaaaauauagccaugauugaaaucaaaua

SEQ ID NO: 23597 - RNA, 61 nt, Human
gcauaccacgccacaggguuagaaccaacgaagaaaauaaaaugagggugcccagcuuaua

SEQ ID NO: 23598 - RNA, 61 nt, Human
aaaagcaagaaaaugcagauagagaaaaagaagaaaauaaaacuggaguauuuccacaacc

SEQ ID NO: 23599 - RNA, 61 nt, Human
gaagaggucccaaauuuggaguaaagaugggagaaaauaaauaugugcuauuuccuuggcg

SEQ ID NO: 23600 - RNA, 61 nt, Human
caagugugcaaauuaugacugcgugagccuuagaaaauaaaauguauaaagggcaacacau

SEQ ID NO: 23601 - RNA, 61 nt, Human
gcaguauuuaaagcuuaagcuuucaggaaaaagaaaauaagaauucagugugugcaugaca

SEQ ID NO: 23602 - RNA, 61 nt, Human
uuuagcuuuguguuguaugcuaguuuaaaaaagaaaauauguaauauaauguaaaaaaaaa

SEQ ID NO: 23603 - RNA, 61 nt, Human
gagcagaagcuccuugguuuaaccagcacagagaaaauaauauaaaucccauaagggcaga

SEQ ID NO: 23604 - RNA, 61 nt, Human
ugggaagaaauacauuuccuaauguauuuauagaaaauaaaaauauuuuuaugugccuuuu

SEQ ID NO: 23605 - RNA, 61 nt, Human
cagaauuacuaagcauguggcauaaauuuggagaaaauaauaugacuagaaaaauuagugu

SEQ ID NO: 23606 - RNA, 61 nt, Human
uggugccucaguuuccugaccuaugaaacagagaaaauaaaagcacuuauuuauuguuguu

SEQ ID NO: 23607 - RNA, 61 nt, Human
cuuucccucuguuuccugaccuaugaaacagagaaaauaacaucacuuauuuauuguuguu

SEQ ID NO: 23608 - RNA, 61 nt, Human
acugucuuuguugauucuaacuuguaaauaaagaaaauauuauucaaguuuugaguuaccu

SEQ ID NO: 23609 - RNA, 61 nt, Human
gcgcccaggccacgugucccgaucugggauuagaaaauauggguccauuccuuucuagaaa

SEQ ID NO: 23610 - RNA, 61 nt, Human
auauuaaacaucaucugcauuuuacuugccuagaaaauacacgguaacuuuucugccuugc

SEQ ID NO: 23611 - RNA, 61 nt, Human
cagccugggcaacagagcgagacuucaucucagaaaauaaaaaauaggggccaggcacagu

SEQ ID NO: 23612 - RNA, 61 nt, Human
uugucauguuucaaauaaagagaacugaaguagaaaauagaaaugccaguaaacaacauaa

SEQ ID NO: 23613 - RNA, 61 nt, Human
caauaaagaucauaaauaaauguuucuuucaagaaaauauauuuggauggccuuuuuaaag

SEQ ID NO: 23614 - RNA, 61 nt, Human
uuuaaauauauauauauaugauggcuuuggaagaaaauaugcugcuguaaauuaggaaagg

SEQ ID NO: 23615 - RNA, 61 nt, Human
cuaaaauugcaacuucuaaacacaaauaaaaagaaaauauuuauaggaggaaaugauuaau

SEQ ID NO: 23616 - RNA, 61 nt, Human
augguaaaguugguaaaaggcaacuuucagaagaaaauaaugugcuuuagaaaaaaaauuc

SEQ ID NO: 23617 - RNA, 61 nt, Human
ccaauaugcuaaaaguuaaauaugguauuuaagaaaauagucauguaugcaauugagaaag

SEQ ID NO: 23618 - RNA, 61 nt, Human
ucaguuuuauucucauguaccuaaguuguggagaaaauaauugcauccuauaaacugccug

SEQ ID NO: 23619 - RNA, 61 nt, Human
cacccaguuauggaauguccagaguucucgaagaaaauaaaugacuuuaggaagagguaua

SEQ ID NO: 23620 - RNA, 61 nt, Human
cuggaaagugggacccucugaguggguggucagaaaauacccaugcugaugaaaugaccua

SEQ ID NO: 23621 - RNA, 61 nt, Human
uuauacuuguuacccuucacaauaccacaugagaaaauaucugagacaaaauguauacaaa

SEQ ID NO: 23622 - RNA, 61 nt, Human
caguugcggucuuauuuuugacuuaaguuuuagaaaauauucauguaguuuagaguggaaa

SEQ ID NO: 23623 - RNA, 61 nt, Human
guacaaauuggucaaguugcaauuauuuaugagaaaauaaugauaaauguaaaauaucuaa

SEQ ID NO: 23624 - RNA, 61 nt, Human
gaaucuaagagcacgcaauauauaauuuuaaagaaaauauucuauuugguagaauacaaau

SEQ ID NO: 23625 - RNA, 61 nt, Human
guuuuaugcuauuccuguguucuccaaaacaagaaaauaaaaagacaugacuuauucucug

SEQ ID NO: 23626 - RNA, 61 nt, Human
uauagacccaauaacaacuaaaccuuucaaaagaaaauauuuucuauuaugaauguugauu

SEQ ID NO: 23627 - RNA, 61 nt, Human
agaaaauguuauuuagaaaaucauaagaaagagaaaauauauuuacuauucauuaaaugga

SEQ ID NO: 23628 - RNA, 61 nt, Human
cagugaauucaagaccaaauacaauaucgggagaaaauacaaacucccuguguuuaagaau

SEQ ID NO: 23629 - RNA, 61 nt, Human
acaucuggaugugaacuuucauguaugauccagaaaauagguacgguuuuaaaauauuuua

SEQ ID NO: 23630 - RNA, 61 nt, Human
ucaugaggaacacuacuuaaugcagugggaaagaaaauauuucagaggagaauuuuuucuu

SEQ ID NO: 23631 - RNA, 61 nt, Human
auucagucuggacuucaaaucacuugucuucagaaaauaaaagauuuguuccacccgggug

SEQ ID NO: 23632 - RNA, 61 nt, Human
uguuuagcugaaguucauauuauuuaaguaaagaaaauauuucaguuuuauaacagacuuu

SEQ ID NO: 23633 - RNA, 61 nt, Human
auauuucagguggauauuucuaaguauuacuagaaaauacguuugaaagcuuuaucuuauu

SEQ ID NO: 23634 - RNA, 61 nt, Human
gggaagggaaaaaagugugaaaggaugaugaagaaaauaauuuuacuauuucuuuuaaaag

SEQ ID NO: 23635 - RNA, 61 nt, Human
uccuguucacugaauauuccggguaauugaaagaaaauauaauggaugggcuccauuaaaa

SEQ ID NO: 23636 - RNA, 61 nt, Human
uugguauuuggauaucuguuagaugcuacuaagaaaauagagaugagcuuucuuuuuaaag

SEQ ID NO: 23637 - RNA, 61 nt, Human
gauaaaaagacauucuuccaaaaagauuuucagaaaauauuauguguuuccauauuuuaua

SEQ ID NO: 23638 - RNA, 61 nt, Human
uuuuccaaaauaauuuuaagaaaucaaagagagaaaauaaagaccuugcuuaugauugcag

SEQ ID NO: 23639 - RNA, 61 nt, Human
cgacugugaggaaaagcagagggaaugugaaagaaaauaagagaauccacgggauuugaug

SEQ ID NO: 23640 - RNA, 61 nt, Human
auguagacacuugagaaauguuucuguuugaagaaaauagagggagaaacagaagucuuaa

SEQ ID NO: 23641 - RNA, 61 nt, Human
cuaugucaccuuacuacagaauccagcagucagaaaauaacacaaaaaaugccgagguuug

SEQ ID NO: 23642 - RNA, 61 nt, Human
cacucgcuuaugcuacuuaaucagaaucuugagaaaauagaccauaaugauucccuguugu

SEQ ID NO: 23643 - RNA, 61 nt, Human
aacauggcuacuuucuaagcuacaaaccauuagaaaauaacucaaaaagauggcagaggca

SEQ ID NO: 23644 - RNA, 61 nt, Human
ccuuucauuuuuagaugccagcucuuuuuaaagaaaauagaaaugauuuagauuaaacaag

SEQ ID NO: 23645 - RNA, 61 nt, Human
uauugcucuuuaguaaagaaaggcacaagaaagaaaauauccagcucucuuguguuaucuc

SEQ ID NO: 23646 - RNA, 61 nt, Human
cacagauaguaguaaaaauucugaguaacugagaaaauaaucaguuggaaaugauuagaua

SEQ ID NO: 23647 - RNA, 61 nt, Human
cauuccauuuguuccuuuagcaaucaaccccagaaaauauuaaaaugggaucauacacaga

SEQ ID NO: 23648 - RNA, 61 nt, Human
ugcuaggaugaggcaggcccaguccuccuccagaaaauaagacaggccacaggagggcaga

SEQ ID NO: 23649 - RNA, 61 nt, Human
uggcucaagaauuacuccgaagucagucugcagaaaauaaauauuuaguaugacaugacac

SEQ ID NO: 23650 - RNA, 61 nt, Human
ucaaagugauuuugaaaaucucuaauggcucagaaaauaaaaacauccaguuuguggauga

SEQ ID NO: 23651 - RNA, 61 nt, Human
guucucugcuguccuaagaacuucaguguagagaaaauaagacuucuggugcugcuggggu

SEQ ID NO: 23652 - RNA, 61 nt, Human
gucaguuuagcauuacauugucuugagcaccagaaaauaaaauccauauauuaauaaaaac

SEQ ID NO: 23653 - RNA, 61 nt, Human
ccuucucuguggucacuguguuggauuuggaagaaaauauaaguagauguuaaggucagug

SEQ ID NO: 23654 - RNA, 61 nt, Human
gacucuuaauaagaccugcacggauggaaacagaaaauauucacaauguauguguguaugu

SEQ ID NO: 23655 - RNA, 61 nt, Human
guuuuucuaauacuuuauagggcccaacuucagaaaauacuucgcuuuuuucuuuuuaugc

SEQ ID NO: 23656 - RNA, 61 nt, Human
uuuccuguuaacaagcuggcagcaaagcuucagaaaauauauaugcaagcacaacuugaag

SEQ ID NO: 23657 - RNA, 61 nt, Human
uagguuaccauuuuauaacucuauugccauaagaaaauacacucuaaaaucuugauuugaa

SEQ ID NO: 23658 - RNA, 61 nt, Human
cuuuuauguuuucucuguuugugauacaauuagaaaauauaaaaucacaguagauuuuauu

SEQ ID NO: 23659 - RNA, 61 nt, Human
agcauacaaucucagaaacuuagaagcaaguagaaaauaauugguugauguaaacgaaagu

SEQ ID NO: 23660 - RNA, 61 nt, Human
gaggggaugaaucggaacgauagucucaugcagaaaauagugagauuaagaucauccuuau

SEQ ID NO: 23661 - RNA, 61 nt, Human
uuacucacucuggauagcuaggugauuauucagaaaauacgguuacauagcuauuuauaag

SEQ ID NO: 23662 - RNA, 61 nt, Human
cagucucaccaauuucagaaaaucauuaaaaagaaaauauugaaaggaaaauguuuucuuu

SEQ ID NO: 23663 - RNA, 61 nt, Human
ggaaauaugcaauguuauuuugguagcucuaagaaaauaucuugcaagcuccaccuucacu

SEQ ID NO: 23664 - RNA, 61 nt, Human
gcucugcuaucacugaauuacauuuaucugaagaaaauaguacaacuuaauggauuagcuu

SEQ ID NO: 23665 - RNA, 61 nt, Human
ucacuucauuguaccccaugaccugagguaaagaaaauaauuuucaaauugcagacuuccu

SEQ ID NO: 23666 - RNA, 61 nt, Human
gaaugggaaagucaauggaagauuaugcagaagaaaauagaagagguacacuuuaauuugu

SEQ ID NO: 23667 - RNA, 61 nt, Human
aaugauggcuggaucauuuaaaguucuuuuuagaaaauaacauaagccaaagacucaagug

SEQ ID NO: 23668 - RNA, 61 nt, Human
acuuauguucacagaaccguaucagcgaccaagaaaauaggacugucagaagcugccaguu

SEQ ID NO: 23669 - RNA, 61 nt, Human
aguuuucaaauugcagcaaauauacuguaugagaaaauauuaauacagauuaaaagccuuu

SEQ ID NO: 23670 - RNA, 61 nt, Human
uuacuguauaaaauuaguuggaagccauguaagaaaauaacaucugaaaauucuugaacuu

SEQ ID NO: 23671 - RNA, 61 nt, Human
aacugacauuugcuuuuuuucaagaccuaauagaaaauaagaaagcccauaauguauuuag

SEQ ID NO: 23672 - RNA, 61 nt, Human
ucauagugacuucagaaaauuuggaaaauacagaaaauauagggaagaauaaaauuaaccc

SEQ ID NO: 23673 - RNA, 61 nt, Human
aaaugugaaaaaacauuauuuuuucaaagcaagaaaauaauuuacugcccucuuacauaau

SEQ ID NO: 23674 - RNA, 61 nt, Human
aaacuagucaaaaaugcuaaaauaauuugggagaaaauauuuuuuaaguaguguuauaguu

SEQ ID NO: 23675 - RNA, 61 nt, Human
uaauauugauuauauuuuuaacaggaauuuaagaaaauauuacuggaauuaaaaauauaua

SEQ ID NO: 23676 - RNA, 61 nt, Human
uuucuccaaaucugggagaauuuucaaaauaagaaaauaaccuuuauaugauauacuauga

SEQ ID NO: 23677 - RNA, 61 nt, Human
uauauauuugcuaguuaucuaauguuuuaaaagaaaauauaccucauuuagguuugaauug

SEQ ID NO: 23678 - RNA, 61 nt, Human
ucuuuuuuccccucauaaccuuguuuuugguagaaaauaagcuagagaaauuaagccaucg

SEQ ID NO: 23679 - RNA, 61 nt, Human
aaauccaacuucugugcaaaauuuuaguaucagaaaauacgagauuugcaggggaaacauc

SEQ ID NO: 23680 - RNA, 61 nt, Human
ggguaaaaagucuucucagaaaaacaaugucagaaaauaacagcgugcugcuuagaaauac

SEQ ID NO: 23681 - RNA, 61 nt, Human
uuuuaucaagguuuuccaugguuaaguuuggagaaaauaccacacaaaacaaugaauugcc

SEQ ID NO: 23682 - RNA, 61 nt, Human
cuuauuuuccuuuuacuauacagcuuggcagagaaaauaaauaucaucaaauaagauacag

SEQ ID NO: 23683 - RNA, 61 nt, Human
uuuaucagggaaacuaagauucuuuuaaauuagaaaauauucucuauuugaauuauuucug

SEQ ID NO: 23684 - RNA, 61 nt, Human
aagggcacucuaugaauugauuuauugucuaagaaaauaacaccacaaguagggaaauugu

SEQ ID NO: 23685 - RNA, 61 nt, Human
aaagugacugcaacaaauaaaccuucuacugagaaaauacaucacagauagaagauuaucu

SEQ ID NO: 23686 - RNA, 61 nt, Human
auuuuuuucccuuuagcauugcaugugaauaagaaaauaauguuuaaagaaaaaaaaaaaa

SEQ ID NO: 23687 - RNA, 61 nt, Human
uauaguauaagaaucuauuuuggagaaaaaaagaaaauaugagggucucgaagcaugauuu

SEQ ID NO: 23688 - RNA, 61 nt, Human
cuuucugguuaaaaaaaggaaaaaccaucuaagaaaauauauauguauguauguguguaua

SEQ ID NO: 23689 - RNA, 61 nt, Human
cucuuuggaguuggaauuucauuauauguuaagaaaauaaaggaaaaugacuuguaagguc

SEQ ID NO: 23690 - RNA, 61 nt, Human
ccagggguccgcugccccauguguccuggugagaaaauauaugccuggcacagcuuuugua

SEQ ID NO: 23691 - RNA, 61 nt, Human
uauugugaaagguguacuuugugcucauuucagaaaauaaaacacaaccuuucucuugaug

SEQ ID NO: 23692 - RNA, 61 nt, Human
agguuaaaaaacuuuaguaacuuguuuguauagaaaauaguaacaaggacuauuuucuauu

SEQ ID NO: 23693 - RNA, 61 nt, Human
gcaucuagggcggagaggcugcacuugugagagaaaauacuauuucaagucauauucugcg

SEQ ID NO: 23694 - RNA, 61 nt, Human
cccauccaauuuaucaaggaagaaaugguucagaaaauauuuucagccuacaguuauguuc

SEQ ID NO: 23695 - RNA, 61 nt, Human
uauaaaugcaauuuuugucaagagaucuuucagaaaauauaagccuuuaaagugaagaaga

SEQ ID NO: 23696 - RNA, 61 nt, Human
ugugaaaacauuuuuuaaaaaacuacagcuuagaaaauaccagaggccucauacuaaaaua

SEQ ID NO: 23697 - RNA, 61 nt, Human
uugcugaguauagaaucagaaugcugaguauagaaaauaauuuaaaacuaaaguugguagg

SEQ ID NO: 23698 - RNA, 61 nt, Human
uuaauaaaaugcaauuaccgucaaaucuuucagaaaauauaagccuuuaauacgaggaaga

SEQ ID NO: 23699 - RNA, 61 nt, Human
uuuauuuguaaauuauuugcccuggaguuuuagaaaauaguuucugaauuuuaaacuugcu

SEQ ID NO: 23700 - RNA, 61 nt, Human
cauuguaugcauuuugauuuuuccuacuuuaagaaaauaaaauaauuuaauuuuacauuag

SEQ ID NO: 23701 - RNA, 61 nt, Human
aauguccuguauaaauguuuuuacugcuuuuagaaaauaaagaaaaaaaacuugguucaug

SEQ ID NO: 23702 - RNA, 61 nt, Human
uuuucaaguaucuuauuaaaggaggcauucuagaaaauaugaauuaguuuccaaaugccuu

SEQ ID NO: 23703 - RNA, 61 nt, Human
caacaguguagaauucuugaaaaguuaacguagaaaauauccaaaaagcaguauuucuaga

SEQ ID NO: 23704 - RNA, 61 nt, Human
gggcucacuaauaucaccaguauuauuaccaagaaaauauugaguuuaccugauuaaacuu

SEQ ID NO: 23705 - RNA, 61 nt, Human
uuaagaagacugcauuauauuuauuacuguaagaaaauaucacuugucaauaaaauccaua

SEQ ID NO: 23706 - RNA, 61 nt, Human
uugaaacaagauaacugagaauuuaaaaauaagaaaauacauaagaccauaacagccaaca

SEQ ID NO: 23707 - RNA, 61 nt, Human
ccccauccccaugcccucaucccgaccucuuagaaaauaaauacaaguuugaacaggcuuc

SEQ ID NO: 23708 - RNA, 61 nt, Human
aaauuugaggauuuuuuugccaauaguuuauagaaaauauaugaaccaaagugauuugagu

SEQ ID NO: 23709 - RNA, 61 nt, Human
ugcuugcaaggauuuggagauguaaacaugaagaaaauauaguuacugccugcaaagaauu

SEQ ID NO: 23710 - RNA, 61 nt, Human
gaccagaaaccacaaauugacuuuuuuucuuagaaaauauuucuauuugcgguaaauauag

SEQ ID NO: 23711 - RNA, 61 nt, Human
aaagguuaaguaugccaguaguuuacaaaacagaaaauacuuaacuaggaguaggaggcuu

SEQ ID NO: 23712 - RNA, 61 nt, Human
gaaguaaacuugauuuuuuuuuuuugucacaagaaaauauuaagaguuauuguugcaguuc

SEQ ID NO: 23713 - RNA, 61 nt, Human
aaugcauuuuucaucuauaaaaugucaugaaagaaaauaaagguagugaaauauggacaaa

SEQ ID NO: 23714 - RNA, 61 nt, Human
gugagcacaagguaagucauaaagaauaaugagaaaauaaaucuaugcuggugcagcugag

SEQ ID NO: 23715 - RNA, 61 nt, Human
guggacucuguuccuuuauguaaacauguaaagaaaauaagucagcgaaaaaaaugaaacc

SEQ ID NO: 23716 - RNA, 61 nt, Human
auuaauauaaauuuaaacaacauggcuuguuagaaaauaugcuaauugcuauggucucauu

SEQ ID NO: 23717 - RNA, 61 nt, Human
ugucuauuguauauauaaucuauaugauuaaagaaaauaugcauaaucagacaagcuugaa

SEQ ID NO: 23718 - RNA, 61 nt, Human
gacauaaagaaaauccuacuuauagaaaaggagaaaauaauuaaacagucuucauuuuuaa

SEQ ID NO: 23719 - RNA, 61 nt, Human
caaguaauggcacaauucuucggaugacugcagaaaauaguguuuuguaguucaacaacuc

SEQ ID NO: 23720 - RNA, 61 nt, Human
caagugaccuguacugcuuggggacuauuggagaaaauaagguggaguccuacuuguuuaa

SEQ ID NO: 23721 - RNA, 61 nt, Human
uuuuaugaaacauguucauuacagaaacaugagaaaauagagauaaguaaaaagaauaaaa

SEQ ID NO: 23722 - RNA, 61 nt, Human
agucacuuccucacauggaaggcagcuuuucagaaaauaacagacauugcucguuucucau

SEQ ID NO: 23723 - RNA, 61 nt, Human
guauagaaacuacagaauauuuacccuggaaagaaaauauuggaauguuauuauaaacucu

SEQ ID NO: 23724 - RNA, 61 nt, Human
ggauuuucaaagaauggagguugcugcacucagaaaauaauucagaucauguuuaugcauu

SEQ ID NO: 23725 - RNA, 61 nt, Human
guguagauuaaaugaguuuuuaaagcacuuuagaaaauauaagggagaaaaugauuucuua

SEQ ID NO: 23726 - RNA, 61 nt, Human
uguagaauauguauuaaucauucuacauuaaagaaaauaaugguucuuacuggaaugucua

SEQ ID NO: 23727 - RNA, 61 nt, Human
uuuucaugauuuuuaugagcacagacuuucaagaaaauacuugaaaauaaauuacauugcc

SEQ ID NO: 23728 - RNA, 61 nt, Human
aucaauaucacaauagauuucucaagguaagagaaaauaagcucaugagaugacauucacc

SEQ ID NO: 23729 - RNA, 61 nt, Human
gcaauagucuccaagucaauauaaauucuacagaaaauaguguucuuuuucuccagaaaaa

SEQ ID NO: 23730 - RNA, 61 nt, Human
aaguacuaauuaaaugcuaacauaggaaguuagaaaauacuaauaacuuuuauuacucagc

SEQ ID NO: 23731 - RNA, 61 nt, Human
uauuucagaaauuucccaugaaacuaaaaauagaaaauaagauauacaaguuaauucggua

SEQ ID NO: 23732 - RNA, 61 nt, Human
acugacauuuuguaaucaagaaaagugauauagaaaauauguaggagacuguuaaaauugg

SEQ ID NO: 23733 - RNA, 61 nt, Human
ugugucaaauuauaauuauaaaagguacagcagaaaauauaccauguuuuuauauagguuc

SEQ ID NO: 23734 - RNA, 61 nt, Human
caauuuguugauuaagugaucaacaaccugaagaaaauaucaauuuuuaauugacaaagac

SEQ ID NO: 23735 - RNA, 61 nt, Human
uccacuuuugucacaauucauuuuuauuaauagaaaauaaacacuuauuccaguuucaaag

SEQ ID NO: 23736 - RNA, 61 nt, Human
agcaaaaaucaaauagcaaaggacacuagccagaaaauacagugugugugugugcaccugu

SEQ ID NO: 23737 - RNA, 61 nt, Human
auacaagccauaggcucacagaaaaagaaaaagaaaauaaaaauuaaauuaaaaaaaaaga

SEQ ID NO: 23738 - RNA, 61 nt, Human
guaaacccuauaauuaugaagcgauugcuugagaaaauaacauauaaacauagaauagaau

SEQ ID NO: 23739 - RNA, 61 nt, Human
agugcccuaaaaugguguucuuaugaccugcagaaaauauuuacacauauuuccaaauauu

SEQ ID NO: 23740 - RNA, 61 nt, Human
aauagcaauaaaacauaaucacucuauuugaagaaaauaucuuguuuucugccaauagauu

SEQ ID NO: 23741 - RNA, 61 nt, Human
ucuucuugcaauauuuuaaauauuguauuugagaaaauaaacaucugagucauucacuuuu

SEQ ID NO: 23742 - RNA, 61 nt, Human
caccaguccaaauggcuauuauaaaaaugucagaaaauaacagaugcuggugagguugugg

SEQ ID NO: 23743 - RNA, 61 nt, Human
ucuuuucaguuggagagaauugggcuaagauagaaaauaacaugauuuguuccuuauuaaa

SEQ ID NO: 23744 - RNA, 61 nt, Human
cauauugcugugaaugcuuuaucuuggagauagaaaauauaaugauaaauucaucaugugu

SEQ ID NO: 23745 - RNA, 61 nt, Human
uauuagagaauuugcagacuaagaauuuaugagaaaauauauguauucaguagugcaggca

SEQ ID NO: 23746 - RNA, 61 nt, Human
uuucaucugacaaucugcuucaagaaaucucagaaaauaugauaacauuuuaacuuucauu

SEQ ID NO: 23747 - RNA, 61 nt, Human
uagaacuuuaccaucaccagccguaguugauagaaaauauuaguuucagaauuacccuccu

SEQ ID NO: 23748 - RNA, 61 nt, Human
uauuuuucucaagcugcuuucaggagcuagcagaaaauaacucaaaguugaagacucugga

SEQ ID NO: 23749 - RNA, 61 nt, Human
aucuaacaucuuggggggaaagaauauuuugagaaaauaguugcagaaagcacuggaaaua

SEQ ID NO: 23750 - RNA, 61 nt, Human
aggaaucuauuucuuucuccugaaacaauuuagaaaauaguuauccauugacuagaaauua

SEQ ID NO: 23751 - RNA, 61 nt, Human
aaaauuauaaauguuaaaaggaaguuauugaagaaaauaaaagaaauuauguuauauuauc

SEQ ID NO: 23752 - RNA, 61 nt, Human
ugaaaauuacacauuuuauaauuuuuagaugagaaaauaccacuagcagaauagcuuugug

SEQ ID NO: 23753 - RNA, 61 nt, Human
gaaguaauaauuggagguaaaguuuccuuagagaaaauaauuuuauucugcuuuguccaau

SEQ ID NO: 23754 - RNA, 61 nt, Human
cauaugguuugcacuguauaguagcuuuuaaagaaaauagucacaauacagaaaagcauuu

SEQ ID NO: 23755 - RNA, 61 nt, Human
ucauauuuuguugugcacuagugcaauuccaagaaaauaucacuguaaugagucagugaag

SEQ ID NO: 23756 - RNA, 61 nt, Human
aacuugacaaaugugccaaagaucaacagacagaaaauaucauccuguguauuuacuuguc

SEQ ID NO: 23757 - RNA, 61 nt, Human
gggccagagaucaguagagagcagcugaagaagaaaauaggguccaggagaggaaucugca

SEQ ID NO: 23758 - RNA, 61 nt, Human
gaaagcauauugcccggugaugaaaaggaucagaaaauauacacuauauuuauuagagaag

SEQ ID NO: 23759 - RNA, 61 nt, Human
aauacacuuuacgugaauacagucuaagugaagaaaauaaauaaaaggaagagguuuauaa

SEQ ID NO: 23760 - RNA, 61 nt, Human
uugagugugccaguccuaggaccuuucuacgagaaaauaaaccuuguauaaaguaaguguu

SEQ ID NO: 23761 - RNA, 61 nt, Human
caaaccugcauauugugauuuuaauuugaccagaaaauaugauauauauguauaauuucac

SEQ ID NO: 23762 - RNA, 61 nt, Human
cuagagaacaauaauaaaauaauucuuuuucagaaaauauuuaauuucuucauaaaaauaa

SEQ ID NO: 23763 - RNA, 61 nt, Human
guuguauaaaaguaggugauucuguauuuaaagaaaauauuacuguuacauauacugcuug

SEQ ID NO: 23764 - RNA, 61 nt, Human
aaagcuguggucuuuccauguggagacugauagaaaauaauuuugucccaagucuuauuug

SEQ ID NO: 23765 - RNA, 61 nt, Human
uuaaauuuuaauaacagguucaccagcugguagaaaauagagacacaugaugauuugcauu

SEQ ID NO: 23766 - RNA, 61 nt, Human
auuuaccuuuuugcuuauuuuacaaauauuaagaaaauauucuaacauuugauaauuuuga

SEQ ID NO: 23767 - RNA, 61 nt, Human
uuguacagucaaggcaguucuccauuuuauuagaaaauacaaguugcuaagcacuuaggac

SEQ ID NO: 23768 - RNA, 61 nt, Human
caaagugaaaucuuagagaagcuaaaaggaaagaaaauaaaucuaucaaaauuacccuaaa

SEQ ID NO: 23769 - RNA, 61 nt, Human
gccgacacuucaacaauagggaaaaaaagguagaaaauaucccuacugacaguaacuaccu

SEQ ID NO: 23770 - RNA, 61 nt, Human
gugcauuuucaauacuuguaaacuggaaaucagaaaauauuuacuaugaacaggaaaaucu

SEQ ID NO: 23771 - RNA, 61 nt, Human
ugcuuguuaauuacauaauaugugaugcucuagaaaauagucacaaguauuaauaaugccu

SEQ ID NO: 23772 - RNA, 61 nt, Human
uaauuucgguacaucuuaugguuuaaagaguagaaaauaagaugaaauauccuaaaauaua

SEQ ID NO: 23773 - RNA, 61 nt, Human
aaucucacagauguaaggacucaaguguagaagaaaauauccccuucuuacaaaaagaaau

SEQ ID NO: 23774 - RNA, 61 nt, Human
caguuccugguuccucuuguguuugacacuaagaaaauagcaagagugugaaaucucagau

SEQ ID NO: 23775 - RNA, 61 nt, Human
gaugaagguggguauuggggguggcugugaaagaaaauaauggagaaucacuuuucuagac

SEQ ID NO: 23776 - RNA, 61 nt, Human
gauucuaaauaaauaggggcuuauacaaaaaagaaaauaaaaagccauauauacugcaaag

SEQ ID NO: 23777 - RNA, 61 nt, Human
acugaauuuaacuacuaagaauaaauaaagaagaaaauaaccuuaaucucuuguauuuguu

SEQ ID NO: 23778 - RNA, 61 nt, Human
uugcuuuaaaauuaaccuuugugcaauaccaagaaaauagcucuuuaaaagaaugucuuug

SEQ ID NO: 23779 - RNA, 61 nt, Human
uccacuaugccuuaaugguuuccuccauuugagaaaauaaagcuauucacauuguuaagaa

SEQ ID NO: 23780 - RNA, 61 nt, Human
auuauauucuguuuauuaugacaaaugaaagagaaaauauauauuuuuaauggaaaguuug

SEQ ID NO: 23781 - RNA, 61 nt, Human
agauuaucggcuauaagagaauaagaauugcagaaaauaacagugaagugauugaaacuuu

SEQ ID NO: 23782 - RNA, 61 nt, Human
uuuauagagagugaauuauggguauuuuuucagaaaauauugucaucugauauacacauaa

SEQ ID NO: 23783 - RNA, 61 nt, Human
gaaguucaaauuucaggaaccaaggacugccagaaaauauuagccucuacauuacgcaugc

SEQ ID NO: 23784 - RNA, 61 nt, Human
cuagucagucauacaacuauaacuacuauagagaaaauaaaauuuuuuccuuuuuuuuuuu

SEQ ID NO: 23785 - RNA, 61 nt, Human
ucauaacuuccuguacuugaagucuaaaagcagaaaauaaaggaagcaaguuuucuuccau

SEQ ID NO: 23786 - RNA, 61 nt, Human
uuaagcaaaucuaguuuuguauaauaaaauaagaaaauagcaauaaacuucuuuucagcaa

SEQ ID NO: 23787 - RNA, 61 nt, Human
ccaacuaaacccagaacucaaacuuaacauuagaaaauaagguccagggccggacacagug

SEQ ID NO: 23788 - RNA, 61 nt, Human
acuugccaaucaaaaaaugacaaucaauuugagaaaauagaaauagauauuuuuaaauaaa

SEQ ID NO: 23789 - RNA, 61 nt, Human
aggcaacucugaacugaacauuugcuuugucagaaaauaucuuuuuuuuuacuuugaaguu

SEQ ID NO: 23790 - RNA, 61 nt, Human
gcuuuugucuuuuucaugacauggcacauagagaaaauauuuuuuucuagcacacaagagc

SEQ ID NO: 23791 - RNA, 61 nt, Human
agccaacagaaacaaaaccuagcauagggauagaaaauaccaugcacgugugcagccccac

SEQ ID NO: 23792 - RNA, 61 nt, Human
uuuguguuuuuuucuggaacuacuucaagugagaaaauaaaaaaaaauggugacaaagcug

SEQ ID NO: 23793 - RNA, 61 nt, Human
ugcuucugcucugggccgguggguggcucucagaaaauacuugcugcuggcaaaaggccug

SEQ ID NO: 23794 - RNA, 61 nt, Human
ucagugaugcccucuucuuguuugaaacaaaagaaaauaaugcauuguguuuuuuaaaaag

SEQ ID NO: 23795 - RNA, 61 nt, Human
acuuaccaugacuuugcuccuuccuuuccugagaaaauauuuccacuggauuuuuuccacc

SEQ ID NO: 23796 - RNA, 61 nt, Human
aguugguuugguuugcaguaacgcugcaacuagaaaauauaugcacuucaggcuuguugaa

SEQ ID NO: 23797 - RNA, 61 nt, Human
guucuggguccauguacucagauaaacaugaagaaaauaagcaaagaaaaauggagacugg

SEQ ID NO: 23798 - RNA, 61 nt, Human
gaaaaguuaaaaaaaguuacaugucauuuggagaaaauacguaaucagaaauuugugcaua

SEQ ID NO: 23799 - RNA, 61 nt, Human
auuaauguuuagauuuuucauuugguguguaagaaaauauucuuuguaugauuguaguuuc

SEQ ID NO: 23800 - RNA, 61 nt, Human
guagcuaguguuaggaagugaaccuaaaauaagaaaauauaaugaucuguguuuaucauua

SEQ ID NO: 23801 - RNA, 61 nt, Human
aaacugccaacuuugcacaaguuuccagaaaagaaaauacaauuagucacucaacauaacc

SEQ ID NO: 23802 - RNA, 61 nt, Human
acaacccaccccgcuuucguaguuuucauuuagaaaauagagcuuuuaaaaauguccugcc

SEQ ID NO: 23803 - RNA, 61 nt, Human
aaccuccauuuucaaacugaagcacagggacagaaaauauauuucuaguuaucacuuaagc

SEQ ID NO: 23804 - RNA, 61 nt, Human
uacuaacuaauaagaucuuuuuuucagaaacagaaaauaguuccuugaguacuuccuucuu

SEQ ID NO: 23805 - RNA, 61 nt, Human
ucuggugccacaacuguuuauccuuuuuugaagaaaauaagggaacagaaaugccuuuuug

SEQ ID NO: 23806 - RNA, 50 nt, Human
ucucucagaagaacucauaaagaaaauacaagaguggagagaagcucuuc

SEQ ID NO: 23807 - RNA, 61 nt, Human
caaaacaccuguaacuaaaaaagugaagauaagaaaauacucuuaaagcugaguauuuccu

SEQ ID NO: 23808 - RNA, 61 nt, Human
auauugauuguaugucuacugugcugcauuaagaaaauaaaauuucuauauaccaaaaaug

SEQ ID NO: 23809 - RNA, 61 nt, Human
uagacugguagugagcagcaaaugccuuucaagaaaauagguggcagcuucacuccauguc

SEQ ID NO: 23810 - RNA, 61 nt, Human
acagcacgucuucagggugugguuucuaagcagaaaauagcaaauguuuauauugaauaaa

SEQ ID NO: 23811 - RNA, 61 nt, Human
aguuaugaagcaaauuaaaauggaaaauacaagaaaauagaaccaauuagguugaaaaugc

SEQ ID NO: 23812 - RNA, 61 nt, Human
ccagucaacucuaagaagacuagauauuccuagaaaauaaagaagcaaaucucuuuaccgg

SEQ ID NO: 23813 - RNA, 61 nt, Human
ucagcuccccaugcuccagaauacccacccaagaaaauaauaggcuuuaaaacaauaucgg

SEQ ID NO: 23814 - RNA, 61 nt, Human
uauuaacaacugugaauaugagaaauacagaagaaaauaauaagcccucuauacauaaaug

SEQ ID NO: 23815 - RNA, 61 nt, Human
acuuuuccuauaauuaguugauauacuaaugagaaaauauacuagccuggccaugccaaua

SEQ ID NO: 23816 - RNA, 61 nt, Human
uauauguaaaaaauguuaacaggaaaaugagagaaaauaaagcagcugaggauacaaaugu

SEQ ID NO: 23817 - RNA, 61 nt, Human
ggucaccaggaccugaccucuuugaaggaucagaaaauacuucccugaaggacugacauuu

SEQ ID NO: 23818 - RNA, 61 nt, Human
gaguauuacaaaaacauggccuuugcuugaaagaaaauaccaaggaacaggaaacugauca

SEQ ID NO: 23819 - RNA, 61 nt, Human
acaauacauucuguguauauuauuuuaaugaagaaaauaaauugauuacuggcauuggaac

SEQ ID NO: 23820 - RNA, 61 nt, Human
aaaaacuuuaaugaauuaggauaacaagaagagaaaauaaagguaaaaacacuauuaccug

SEQ ID NO: 23821 - RNA, 61 nt, Human
ugcuaagagaagugaauaaucuuucuuugguagaaaauaggcugagauauaaggugauauu

SEQ ID NO: 23822 - RNA, 61 nt, Human
ugaguuagaagcuuuuuaucccuuccucucaagaaaauauucuuucacccugucucucaaa

SEQ ID NO: 23823 - RNA, 61 nt, Human
gaaaguuuaauguuuuuauuaggagauuuaaagaaaauaaaggucuacaauaucuuuaggu

SEQ ID NO: 23824 - RNA, 61 nt, Human
gccaaggaauucuguggcugugcugcguuucagaaaauaacccccagaggccuugggcugu

SEQ ID NO: 23825 - RNA, 61 nt, Human
gagguucauugccagggcaggagguauuuccagaaaauacucaugccuguguucuguuccu

SEQ ID NO: 23826 - RNA, 61 nt, Human
gggugguuuauaaagccuguaaacacaccuaagaaaauaaacauuuuacaaaugagcuuuu

SEQ ID NO: 23827 - RNA, 61 nt, Human
uucacuggccacaguuguuugaugcauuaaaagaaaauaaaaaaaagaaaaaagagaaaag

SEQ ID NO: 23828 - RNA, 61 nt, Human
uuaccuuuuguuuuuccuuggaccuaaacagagaaaauaaugcuuauguaucugaagaaaa

SEQ ID NO: 23829 - RNA, 61 nt, Human
cuuggagagggaaaauuaagcuauacuuuuaagaaaauaaauauuuccauuuaaaugucuu

SEQ ID NO: 23830 - RNA, 61 nt, Human
gaaaugauaccaagucucuaccaucucuuucagaaaauaaaagcagagauaacacuuccca

SEQ ID NO: 23831 - RNA, 61 nt, Human
auggacccauugaggauaacuauaaaauuacagaaaauauuuaaaugcaacuuauugcuau

SEQ ID NO: 23832 - RNA, 61 nt, Human
gagccugaaucaucucauguaccugacaguaagaaaauacucuggcuggucucaguggcuc

SEQ ID NO: 23833 - RNA, 61 nt, Human
aaagucuguuuuuaagcaaauggguaauaguagaaaauagguuagaaucuauggcuugauu

SEQ ID NO: 23834 - RNA, 61 nt, Human
uuauuauuaaagcacaaaauaaccuauuguuagaaaauauguguuuuuauaaaugaaugua

SEQ ID NO: 23835 - RNA, 61 nt, Human
auaauuaaaugaauugugaaauggauguuuaagaaaauauaggcuuaaaaaguaaaucuau

SEQ ID NO: 23836 - RNA, 61 nt, Human
gaauuucuucaacaucauacuuaaacauuacagaaaauagaaauacaaacaagguugguac

SEQ ID NO: 23837 - RNA, 61 nt, Human
uauuuucauggucauuugcauguaguaagccagaaaauauucaaagagauuuugaaaacca

SEQ ID NO: 23838 - RNA, 61 nt, Human
aaaaagaaagaaaaaccugcauauuuuguacagaaaauaucaaccucuucccuuuuguuua

SEQ ID NO: 23839 - RNA, 61 nt, Human
uuaauuuauuuauuuuuugaaaagaagagacagaaaauaccuuauuaucugcagggacuca

SEQ ID NO: 23840 - RNA, 61 nt, Human
caacaagagcgaaacugucucaaaaaaaagaagaaaauaaauaaauaaaaaucagagcaca

SEQ ID NO: 23841 - RNA, 61 nt, Human
aaaaggaaauaacuuuaaaacuauucucaagagaaaauauucaaagcaugaaauauguugc

SEQ ID NO: 23842 - RNA, 61 nt, Human
accucacaugcaggucuagggugaggauugaagaaaauaguggugaugagggcuuuaacca

SEQ ID NO: 23843 - RNA, 61 nt, Human
ccgggauuccucugcugccauuugaauuagaagaaaauaauuuauaugcaugcacaggaag

SEQ ID NO: 23844 - RNA, 61 nt, Human
gcaagagaaagacaacuguucugcggguuggagaaaauacaauuuuuuuuuuuuuuuuuga

SEQ ID NO: 23845 - RNA, 61 nt, Human
auuacaggcguuagccacugcgcccggcccgagaaaauacaguuuuaaaaagagaaagcuu

SEQ ID NO: 23846 - RNA, 61 nt, Human
aucuuagcuguuuuuuauguuaacaguuauuagaaaauauaugucuguguguguuauucca

SEQ ID NO: 23847 - RNA, 61 nt, Human
gaucuucagaaaaacuacccugugacuaugaagaaaauauauauugcuagcccaaaaaucc

SEQ ID NO: 23848 - RNA, 61 nt, Human
caaugcuuagagaaauauccuuuccuuaaaaagaaaauaacuuuuauauuuagaguacaua

SEQ ID NO: 23849 - RNA, 61 nt, Human
ggcgguugaaauagucccacauguggucaucagaaaauaagccauuccucauaccaauaua

SEQ ID NO: 23850 - RNA, 61 nt, Human
gugaacacccaugaaccuacuacccagguuaagaaaauaaaugucaccagguacuugagaa

SEQ ID NO: 23851 - RNA, 61 nt, Human
gaaaaccuaguuuuagugaaaaaugcuguaaagaaaauagaaaugcgauagagugcuggca

SEQ ID NO: 23852 - RNA, 61 nt, Human
auuuuuaagcuuuuaguucaagguuauauucagaaaauauuucccaguauaaugauacauc

SEQ ID NO: 23853 - RNA, 61 nt, Human
uaaaaggaaaaacuugauauuuaucagucugagaaaauauuuuuuucuaaagaaggcaguc

SEQ ID NO: 23854 - RNA, 61 nt, Human
uuuauguuuagauagggcugggcaaggaaaaagaaaauaaagacaaccauauuuagcagug

SEQ ID NO: 23855 - RNA, 61 nt, Human
gacccaaagcuugacauuuaccuaauguaugagaaaauauuaccaauuaacaauaaagaau

SEQ ID NO: 23856 - RNA, 61 nt, Human
cauccauguccugagaaaaagucugugguuuagaaaauauguccaugguugcccacaguca

SEQ ID NO: 23857 - RNA, 61 nt, Human
uuggaugacuuuaaugcuacauuuuaaaaaaagaaaauaaaguaauaauauaacucaaaau

SEQ ID NO: 23858 - RNA, 61 nt, Human
augggauuuuccccccacuggucugcauaaaagaaaauaaaaugacauaaaagggagcacu

SEQ ID NO: 23859 - RNA, 61 nt, Human
aaggguauaauuuuguaggucauaugauugaagaaaauauuauuuuaacaauguaaagcaa

SEQ ID NO: 23860 - RNA, 61 nt, Human
uauaagguuuaaguaauuugguuuaauaaucagaaaauauucaauacaguguuggauauuc

SEQ ID NO: 23861 - RNA, 61 nt, Human
caaccucagcccacucucagucaaggagggcagaaaauaaaagaugacaucacugccagag

SEQ ID NO: 23862 - RNA, 61 nt, Human
ugcacagagaugacagucaauauuacaauagagaaaauacaguacuuaaaaauguucaaau

SEQ ID NO: 23863 - RNA, 61 nt, Human
uuuucuaaugaacacauauacuuuuguaaucagaaaauauuaaaugcauguauuuuucaaa

SEQ ID NO: 23864 - RNA, 61 nt, Human
cuguacauccacaaaaauaugcaauggauguagaaaauaaaauucaagaaaagaacguuga

SEQ ID NO: 23865 - RNA, 61 nt, Human; identical to SEQ ID NO: 23829

SEQ ID NO: 23866 - RNA, 61 nt, Human
gaaaugauaccaagucuguacugucucuuucagaaaauaaaagcagggauaacacuuccca

SEQ ID NO: 23867 - RNA, 61 nt, Human
aaaggaaucauuucuauuucuccuccaugggagaaaauagauaagaguagaaacugcaggg

SEQ ID NO: 23868 - RNA, 61 nt, Human
ucuuuagucaaaucucugcauuguuucaugcagaaaauaaagauacaauuaaggcugacau

SEQ ID NO: 23869 - RNA, 58 nt, Human
aauccacuggagcgucuugaaagguuuuagaaaauauuuggcuguagucucaaauuuu

SEQ ID NO: 23870 - RNA, 61 nt, Human
uuuguguuucagccauguauuugcagcugagagaaaauaaucauucuuauuucaugaaaau

SEQ ID NO: 23871 - RNA, 61 nt, Human
ggccagaaaauauuguauugcuuggcagaaaagaaaauaaggucuaaaggaaaguagcaca

SEQ ID NO: 23872 - RNA, 61 nt, Human
gacauuaucgcauuaucuuggcauaauggccagaaaauauuguauugcuuggcagaaaaga

SEQ ID NO: 23873 - RNA, 61 nt, Human
aacaaauauuuuaaaggugcaaaauaccauuagaaaauacuauuugaaauggacauuaucg

SEQ ID NO: 23874 - RNA, 61 nt, Human
ugaugccaaacauuauaccuuagaacauugaagaaaauauuccuaagcugaugcuggcuaa

SEQ ID NO: 23875 - RNA, 61 nt, Human
gguggaugucagaucugguagguugcagcagagaaaauaaaugugccuugagagaccacuc

SEQ ID NO: 23876 - RNA, 61 nt, Human
uugguucuguauucauaaacacuuuccacauagaaaauagauuaguauuaccuguggcacc

SEQ ID NO: 23877 - RNA, 61 nt, Human
cugugggucaccaacaggcuguuuacaaagcagaaaauaucaucaccaucauaaccuuucu

SEQ ID NO: 23878 - RNA, 61 nt, Human
uagcauuuuaaauuauuuuuauuuauuagaaagaaaauauauuuuuucuuuucauugucaa

SEQ ID NO: 23879 - RNA, 61 nt, Human
gguggaaacguuaggauaagcaagaauugccagaaaauaaaguagacagaucuuucucuuu

SEQ ID NO: 23880 - RNA, 61 nt, Human
gggaauuuugaacaccucuuuaaauacagcuagaaaauaaaaccaauuuguaaagccacau

SEQ ID NO: 23881 - RNA, 61 nt, Human
ggcucccagcucacccuuuuuuuuuaaaguaagaaaauaguugcuaccgauagggacuuug

SEQ ID NO: 23882 - RNA, 55 nt, Human
ucaaccuagagacuaugugaagaaaagaaaauaaucagauuucaguuuucccuau

SEQ ID NO: 23883 - RNA, 61 nt, Human
ccagcagcuccaugagccacacagauauccuagaaaauauuccuuucucacacagggcuuc

SEQ ID NO: 23884 - RNA, 61 nt, Human
aacagcauccuuuuuuuuaaaagagagaauuagaaaauauuaaauccugcauguaauauau

SEQ ID NO: 23885 - RNA, 61 nt, Human
gccuuauccuauagaggcauuuguaauauggagaaaauaauuuuucauuuuugcucauuua

SEQ ID NO: 23886 - RNA, 61 nt, Human
gguccaaaauuguaauggagucuguauuagaagaaaauaaggguaaaaucaggcugaacug

SEQ ID NO: 23887 - RNA, 61 nt, Human
gcguugaauagauguguauuuccuccccugcagaaaauaagcacagaaaauuauaauguag

SEQ ID NO: 23888 - RNA, 61 nt, Human
uuaaauuucacaaagucaugaggguaaauggagaaaauauuucugggauuacaaugaaugu

SEQ ID NO: 23889 - RNA, 61 nt, Human
caaagagcugcugcuuugccaaccuaagcaaagaaaauacggcuucucuugcauuauuuuc

SEQ ID NO: 23890 - RNA, 61 nt, Human
aacacauuugccuaucuucuuacccugaaacagaaaauaaauauugugcuuuaugugguag

SEQ ID NO: 23891 - RNA, 61 nt, Human
uggggaagguagaaaguucauuucaucacuuagaaaauaugucuucucaagaacaaaacug

SEQ ID NO: 23892 - RNA, 61 nt, Human
cauguugaauagaguauacuggauuggugaaagaaaauaauaauaaugagcaucuaagugg

SEQ ID NO: 23893 - RNA, 61 nt, Human
uuacaaagaaaaccggauuuucaguagcugaagaaaauauggcacuguaaguuaaaaccca

SEQ ID NO: 23894 - RNA, 61 nt, Human
gacggauuucacauccacaggacggucuugaagaaaauaacacuguguauauuauuuuaaa

SEQ ID NO: 23895 - RNA, 61 nt, Human
gacccaagccaaacagaaacaauaacccucgagaaaauaggucaacaaucuguugugggga

SEQ ID NO: 23896 - RNA, 61 nt, Human
aagugagccacuggaaagaaagcaaaacaagagaaaauaaaugaguuguuugacauaauuu

SEQ ID NO: 23897 - RNA, 61 nt, Human
uuuucucucagaauagaaagaaaacacaaagagaaaauaugaacaauauaaagcacuuaaa

SEQ ID NO: 23898 - RNA, 61 nt, Human
caugacuaccuuugagcuaaugacugucuccagaaaauaacugugccccaagaagugcucc

SEQ ID NO: 23899 - RNA, 61 nt, Human
cucucugcagagcccuguuucuaauugugguagaaaauauugagacagagcauuugccaug

SEQ ID NO: 23900 - RNA, 61 nt, Human
guaaaacaugucaagauuuuuccaccaagcuagaaaauaaaaaacuuaguucuaccacauc

SEQ ID NO: 23901 - RNA, 61 nt, Human
cagacauuuauuuucuccucucccuugaauaagaaaauaaguuuuccauuccuaugaacug

SEQ ID NO: 23902 - RNA, 61 nt, Human
auggauuauuugucagcccgauuauuugcaaagaaaauauacaauuaucaagcagagacca

SEQ ID NO: 23903 - RNA, 61 nt, Human
aauaaaauuuucuacaucaaaguaagacuugagaaaauaaacuuauguguauauauguuua

SEQ ID NO: 23904 - RNA, 61 nt, Human
aauacuuuuaaauuuuuccuucaugcucuagagaaaauaauuuuauuuuuaaauaaacgcc

SEQ ID NO: 23905 - RNA, 61 nt, Human
uccuauauaaaacuaaauuugcuaucuguguagaaaauaauuucaugacauuuacaaucag

SEQ ID NO: 23906 - RNA, 61 nt, Human
uagccaucugcuaucagcaucauuauguaaaagaaaauauauuuuagccccuaaaauuagg

SEQ ID NO: 23907 - RNA, 61 nt, Human
guagcccaaaauagagaaagauuagauaaagagaaaauaaguauccaucagagacaguauc

SEQ ID NO: 23908 - RNA, 61 nt, Human
ucaggacuauuccuagacacuagcaaaaucuagaaaauaaauaacaaggcugggugcggug

SEQ ID NO: 23909 - RNA, 61 nt, Human
uuaauuagugaaaaauucaugaauaccauagagaaaauauuuuagaauuuaauguuucuua

SEQ ID NO: 23910 - RNA, 61 nt, Human
uuuguuuuuuguuauuuaugaccuuguuuaaagaaaauaaauaucucccaaccuuuauugg

SEQ ID NO: 23911 - RNA, 61 nt, Human
guuuauggggcuagaagagcgagaaaauucaagaaaauaaauguagcuggugggagacuuu

SEQ ID NO: 23912 - RNA, 61 nt, Human
caucugugaacucuacagcaaauuauauuuuagaaaauacuuugugaggccgggcauggug

SEQ ID NO: 23913 - RNA, 61 nt, Human
guaaacuggcagaaaaccaggaaucagagaaagaaaauauaauuuaacuuuaaagauguaa

SEQ ID NO: 23914 - RNA, 61 nt, Human
gacauuuaaauagaaaguugugugccccuauagaaaauauuugagaauuucuuauacuauc

SEQ ID NO: 23915 - RNA, 61 nt, Human
guuuguccucccuuaauuuugccucaacacaagaaaauaaguuuuauguccauuuuuguuc

SEQ ID NO: 23916 - RNA, 61 nt, Human
auaauuuuuuauuuucauaggaugaaguuagagaaaauauucagcuguacacacaaagucu

SEQ ID NO: 23917 - RNA, 61 nt, Human
gaggccuuuaaauacauuccaugcccuccccagaaaauagucugugggagucaguugccuu

SEQ ID NO: 23918 - RNA, 61 nt, Human
aaacuuucuguuuucuggggucugggaaaauagaaaauaagauuucaaauauuaaauaagc

SEQ ID NO: 23919 - RNA, 61 nt, Human
aggcuguggccucagggcgccucccagugccagaaaauaaaguccuuuuggauucugcugg

SEQ ID NO: 23920 - RNA, 61 nt, Human
caaaaaaauagguuaaguuucagugccagcuagaaaauacugcuuucugccaucgauuggg

SEQ ID NO: 23921 - RNA, 61 nt, Human
uacccucgaugcccuuauuugugaguuaaagagaaaauaucauaaaugguauacucuuaag

SEQ ID NO: 23922 - RNA, 61 nt, Human
gaacgagacuccuaaucaaaaaaaaaacacaagaaaauagagugaggcuuuuuuaccguau

SEQ ID NO: 23923 - RNA, 61 nt, Human
ugcuaauggagaagaaaacagggggucugggagaaaauagagaacaugauagcaaaaucua

SEQ ID NO: 23924 - RNA, 61 nt, Human
cauagcaaggccuaauguuagcuuuagcuuuagaaaauaacaguuugugaacuuacuuccc

SEQ ID NO: 23925 - RNA, 61 nt, Human
uuaauuuguauuuuaguaguauuuucuuaguagaaaauauuuguggaaucagauaaaacua

SEQ ID NO: 23926 - RNA, 61 nt, Human
guauaaacaaauuauguauuuacuuacuaauagaaaauauagguaauuuggggaaauuuau

SEQ ID NO: 23927 - RNA, 61 nt, Human
ucuauuuuaaaaugugauuuucuauaacugaagaaaauaucuugcuaauuuuaccuaaugu

SEQ ID NO: 23928 - RNA, 61 nt, Human
uucaaguuguaaaaaugaaagugacuuuaaaagaaaauaggggaugguccaggaucuccac

SEQ ID NO: 23929 - RNA, 61 nt, Human
augagcauucucuuguuuuaauguuggugucagaaaauaaauaugaaacauuaaguccaaa

SEQ ID NO: 23930 - RNA, 61 nt, Human
ggauuacaggcgugagccaccgugcccggccagaaaauacauucuuuacagcaaauguuau

SEQ ID NO: 23931 - RNA, 61 nt, Human
uuuauuuuuggcuuauuccaagggguaagccagaaaauagaaaugauuauuucugauuaau

SEQ ID NO: 23932 - RNA, 61 nt, Human
acauuuauaggaggaaaaaaaucacuuugggagaaaauaaaauucaacucaagcauaaagc

SEQ ID NO: 23933 - RNA, 61 nt, Human
ggucagcaacaacaaagaaaaagacaauuacagaaaauaagcaagauuuggaaaggaagua

SEQ ID NO: 23934 - RNA, 61 nt, Human
ggugagguugaugggaagacuuccuucccaaagaaaauagauccuccaugcaggaucuagg

SEQ ID NO: 23935 - RNA, 61 nt, Human
ugguuggaucaaggacucauuccugccuuggagaaaauacuucaaccagagcagggagccu

SEQ ID NO: 23936 - RNA, 61 nt, Human
gccuccaccacagaacuagacuuguuuuuuaagaaaauauauauuauauauagagagaauu

SEQ ID NO: 23937 - RNA, 61 nt, Human
ucugcauuggaggugcccuauaaaccagaagagaaaauacugaaagcacaggggcagggac

SEQ ID NO: 23938 - RNA, 61 nt, Human
acccauuaggcaugccuaauauuuaggcaagagaaaauaaaccaagauagauccauuugga

SEQ ID NO: 23939 - RNA, 61 nt, Human
agcagaaauaaaaaggaagaaaauguagauuagaaaauaagacuucugagaaaaaguucaa

SEQ ID NO: 23940 - RNA, 61 nt, Human
ugcaugacuauuauuuaucuucuuuuaguguagaaaauaauuuuuuacaaaaagucacuuu

SEQ ID NO: 23941 - RNA, 61 nt, Human
auagacuuauuuuuaaauuguaccaaucacaagaaaauaauggcaauaauuaucaaaacuu

SEQ ID NO: 23942 - RNA, 61 nt, Human
uuaaaucaaagaacauuuauguaaccagaucagaaaauacagcugaaaauuuauauucagu

SEQ ID NO: 23943 - RNA, 61 nt, Human
aaacaaccuagacaguacccuuggccuuuacagaaaauauggugcuguuuucuacccuugg

SEQ ID NO: 23944 - RNA, 61 nt, Human
cacuuuuucucuuccacuuccaauuaugaagagaaaauauuuguucaggguuguccccccg

SEQ ID NO: 23945 - RNA, 61 nt, Human
gauuuagaaaaacaaaugauuaguuaaaaaaagaaaauauacauuuguugguaacuaaugu

SEQ ID NO: 23946 - RNA, 61 nt, Human
aaaaaaucauucacccaauuugaagcauagaagaaaauaguugcugagguuuuuuaauaac

SEQ ID NO: 23947 - RNA, 61 nt, Human
aaaaaccuguggguugugcuaauuucuguccagaaaauaggguggacagaagcuugugggg

SEQ ID NO: 23948 - RNA, 61 nt, Human
aaggacuuuccugcuagauauuucuggaaggagaaaauacaacaugucauuuaucaacguc

SEQ ID NO: 23949 - RNA, 61 nt, Human
guuaacacauuaaagagucugauuuuguugaagaaaauauuugcaauaaauucaagacucu

SEQ ID NO: 23950 - RNA, 61 nt, Human
agcucaacucucucccaaccucaccauggaaagaaaauaauuaugaaugccacugaggcac

SEQ ID NO: 23951 - RNA, 61 nt, Human
ugucugcccagagaaauaaguaauuuauauaagaaaauaaauuucauaaauaaauugccuu

SEQ ID NO: 23952 - RNA, 61 nt, Human
auggacucucuuugugacaaagauauucaacagaaaauauugacccugcauugcaaaacac

SEQ ID NO: 23953 - RNA, 61 nt, Human
cauaugucuccgauuuagaugguuauucucuagaaaauaguauuuaaagacauuuuaugaa

SEQ ID NO: 23954 - RNA, 61 nt, Human
uuuuuuuuuuuuuccuauuggaucuuccuggagaaaauacuuuuuuuuuuuuuuuuuuuga

SEQ ID NO: 23955 - RNA, 61 nt, Human
uuguauucguguuugcauuauuaauuugaauagaaaauaaucacauuuucaacccauuuau

SEQ ID NO: 23956 - RNA, 61 nt, Human
aauaagauuuaauucacaucaaauaaaauuuagaaaauaaaauuuaacucacacugcccag

SEQ ID NO: 23957 - RNA, 61 nt, Human
uaaaguaugugguuauaugcagugaaacugcagaaaauacuccugguugaggaguuuucac

SEQ ID NO: 23958 - RNA, 61 nt, Human
ccuucauaugaucacucaucuugaguuaauuagaaaauaccugaguucacgugcuaaaguc

SEQ ID NO: 23959 - RNA, 61 nt, Human
accaaaaugaaaagguggacuguagauugggagaaaauauuugcaaaccguuaucugguaa

SEQ ID NO: 23960 - RNA, 61 nt, Human
cuacuuucacauuuauuuaaauuuuugugaaagaaaauacaguuuuaaaggcuauaggaau

SEQ ID NO: 23961 - RNA, 61 nt, Human
uuuucuaaauauauguauauauacaguacauagaaaauagaacuuuuauuuugugaccuaa

SEQ ID NO: 23962 - RNA, 61 nt, Human
cauccuucaguauaggagaugagggaaugagagaaaauauuuuuugaagaagcauuucugu

SEQ ID NO: 23963 - RNA, 60 nt, Human
auuccaauaaaaguguuugauuccuaagaaagaaaauauuuuuguggacaugcauaaaaa

SEQ ID NO: 23964 - RNA, 61 nt, Human
aaaagugaaugacguuuguuuagccaguaggagaaaauaaauaaauaaauaaaucccuucg

SEQ ID NO: 23965 - RNA, 61 nt, Human
uagaaguuuaagaaaaguuuccguuugcacaagaaaauaacgcuugggcauuaaaugaaug

SEQ ID NO: 23966 - RNA, 61 nt, Human
gaucuacugugauguugucuucaaaggcaggagaaaauaauguucacaauaaaaugugcua

SEQ ID NO: 23967 - RNA, 61 nt, Human
aguuuugauccaaaaucuaaaacuuaaagucagaaaauaauuaaaauuuuucuuguagaaa

SEQ ID NO: 23968 - RNA, 61 nt, Human
uucaguuccaugugccucccaaauaaaaaacagaaaauaaguaguuuuugugaauugacuu

SEQ ID NO: 23969 - RNA, 61 nt, Human
gccuuugagaauaaacucauaaggucuaccaagaaaauaaauguuaugauguuucaguugg

SEQ ID NO: 23970 - RNA, 61 nt, Human
uugguggugaggaggaagaacaaauaauagaagaaaauaaaaaugagauagaagaaaagua

SEQ ID NO: 23971 - RNA, 61 nt, Human
uggagauaaauuaauaguagaugugguucccagaaaauauaaucaaaauucaaagauuuuu

SEQ ID NO: 23972 - RNA, 61 nt, Human
ucuccaggugaugcccaaggcacagggcugcagaaaauaaaccuccagauuccaccaacac

SEQ ID NO: 23973 - RNA, 61 nt, Human
ugguuuguacaauguacaauuguuucauuucagaaaauaaaaauuucaaaucaugaauacc

SEQ ID NO: 23974 - RNA, 61 nt, Human
aggacccgguaggccugagccucaacucuucagaaaauaguguuuuuaauauuccucuuca

SEQ ID NO: 23975 - RNA, 61 nt, Human
ucagaaaauaguguuuuuaauauuccucuucagaaaauaguguuuuuaauauuccgagcua

SEQ ID NO: 23976 - RNA, 61 nt, Human
uauaggauaauuuuuaauauggugaccuuacagaaaauauuucccaaacauccuuuucauc

SEQ ID NO: 23977 - RNA, 61 nt, Human
uguaguuugagauagugauuaagugcuaugaagaaaauaaacuagggugaugauuuuagug

SEQ ID NO: 23978 - RNA, 61 nt, Human
ucgagcuuuaaaguccauaauuguuaucuucagaaaauauuauuugaccuacaguaugucc

SEQ ID NO: 23979 - RNA, 61 nt, Human
acuauuauauaaccuauacacaagauacaggagaaaauaugcuugauuuuuauuuggcagg

SEQ ID NO: 23980 - RNA, 61 nt, Human
cuggacacacaaggaauucacaacuccccaaagaaaauacaucuggaugaccugccuagca

SEQ ID NO: 23981 - RNA, 61 nt, Human
cacaaauaaaauacaacuguucaauggaaauagaaaauaaacaccauaaaagagagaagag

SEQ ID NO: 23982 - RNA, 61 nt, Human
cuaaguuaaugucuaagauaauggggaaaauagaaaauaacauuauuaaguguaaaaccag

SEQ ID NO: 23983 - RNA, 61 nt, Human
acaaaaaaaauuuguauguaaacugaaaauaagaaaauacauuagcaagcuuaaugguuau

SEQ ID NO: 23984 - RNA, 61 nt, Human
caaccacucugguaaucuagaauucaguggcagaaaauaaauaagaagauaacuuccuuca

SEQ ID NO: 23985 - RNA, 61 nt, Human
cauuaaaguauauuuaacucauaauuuuugcagaaaauaugcuauauauuaggcaagaaua

SEQ ID NO: 23986 - RNA, 61 nt, Human
auauaucaagauuuggguacuuuauuuuaguagaaaauauauaucuuuuacauauguaugu

SEQ ID NO: 23987 - RNA, 61 nt, Human
acaaauaauuuucuuaaaagucuaagauagcagaaaauacaguaaaaacacaggagaagaa

SEQ ID NO: 23988 - RNA, 61 nt, Human
uaaugaugucugacaugcuauuuuuguagggagaaaauaugugcuaaugauauuuugaguu

SEQ ID NO: 23989 - RNA, 61 nt, Human
uacuaggguauugaauaaaucuagucuuacuagaaaauaaaaggagcuguuuuguggcuuu

SEQ ID NO: 23990 - RNA, 61 nt, Human
cuucaacuccuuuuggcaagaaaacuguaacagaaaauaaauuuugaauguguacuuaagu

SEQ ID NO: 23991 - RNA, 61 nt, Human
aaaagucaaacauugugaucuauaaaugcacagaaaauacuuuguaaaaaguagcauccuu

SEQ ID NO: 23992 - RNA, 61 nt, Human
cuauaauagcaauaaaaguuagacgaaguguagaaaauaaaauaaauuucauaauguuagu

SEQ ID NO: 23993 - RNA, 61 nt, Human
auuaaggaaguauaugaucugacuuuucagaagaaaauaaacaaaugcauuauguaagguc

SEQ ID NO: 23994 - RNA, 61 nt, Human
ccuacugcaaaaagauuguccaaaaugccuaagaaaauacuccucugaugcauuuagccuu

SEQ ID NO: 23995 - RNA, 61 nt, Human
uucaauauuuacaauaauaggaugaucuacaagaaaauaaguuucuuuuugcaaauuuuua

SEQ ID NO: 23996 - RNA, 61 nt, Human
uucuccugggucugcagaagguugggaauuuagaaaauaaggcuguucuuucauauuuuaa

SEQ ID NO: 23997 - RNA, 61 nt, Human
agaaaauauguaaccacaucuuaguggcccaagaaaauacaggccugaagggauaagauug

SEQ ID NO: 23998 - RNA, 61 nt, Human
auuguuuugcaaacguucuaggagaugugagagaaaauauguaaccacaucuuaguggccc

SEQ ID NO: 23999 - RNA, 61 nt, Human
agagccagguggaaugccauaaaucacacugagaaaauauuucuggcaaacagcuccucuu

SEQ ID NO: 24000 - RNA, 61 nt, Human
cucauuuaauauucaugcuuuugugccuuuaagaaaauauuuuuugucauuuuuuguguua

SEQ ID NO: 24001 - RNA, 61 nt, Human
aacauuuacaaaaagagcaaaacuaagugauagaaaauauuucacacauguucuuauagau

SEQ ID NO: 24002 - RNA, 61 nt, Human
caaacaggaggauaacgaccugaagaaaaugagaaaauaaaauauuucuuaauuguaauca

SEQ ID NO: 24003 - RNA, 61 nt, Human
uuagccaaugaaauguaaauaaacuuuggacagaaaauagcaauguauuuuuuuaauauaa

SEQ ID NO: 24004 - RNA, 61 nt, Human
gauaccuguugguccacaucaucuuuucagaagaaaauaaaagcauuuaauugccaauggg

SEQ ID NO: 24005 - RNA, 61 nt, Human
auucuacaaacugcucucaaguuaccaaggaagaaaauacacgacaaccacuuauggcucu

SEQ ID NO: 24006 - RNA, 61 nt, Human
uauuuacauacagcucuauauauauaaaaaaagaaaauaugaauauuacguaucagugcau

SEQ ID NO: 24007 - RNA, 61 nt, Human
gugugagacuucucucacuggccuugaaauaagaaaauauugaacauuuuaauauuaaaaa

SEQ ID NO: 24008 - RNA, 61 nt, Human
uugcuuaccuuaagaauugcccaaaaaugaaagaaaauaugagcuuuucaguuaaacauac

SEQ ID NO: 24009 - RNA, 61 nt, Human
uuuguuuuguuuuguucuuaagaacauaccaagaaaauaccagugaauuguuggauaugaa

SEQ ID NO: 24010 - RNA, 61 nt, Human
uacuuguaacaugaaaguaguagaugcugccagaaaauaguguccucaauauuuuaaaaca

SEQ ID NO: 24011 - RNA, 61 nt, Human
ucaacaaaauggucauccaaacucaaacuugagaaaauaucuugcuuucaaauuggcacug

SEQ ID NO: 24012 - RNA, 61 nt, Human
ucauuuugaaaauauguacuguauaacauuaagaaaauauuuaacucccuguaacaaguuc

SEQ ID NO: 24013 - RNA, 61 nt, Human
uuggaagccaauuugguccuuuaauaaguaaagaaaauaauauguuuaaaaauguaaaugu

SEQ ID NO: 24014 - RNA, 61 nt, Human
ccuuugauuaguauguguuacauauaaagacagaaaauaaaguauaaaucaagagcuuaaa

SEQ ID NO: 24015 - RNA, 61 nt, Human
ugcugugggugaaauuuugauuugagguauuagaaaauauuuuugugccgaacaauacauu

SEQ ID NO: 24016 - RNA, 61 nt, Human
augguaucuaauuaauaacuagucugacaucagaaaauaaaauugaggcugauuuuuaaaa

SEQ ID NO: 24017 - RNA, 61 nt, Human
gugaaaacaagugucaaaauuccucauauagagaaaauaauuuugaguuuagaguauuauc

SEQ ID NO: 24018 - RNA, 61 nt, Human
accugcaaaaaauacuuuuucuaaugaggagagaaaauauauguauuuuuauauaauaucu

SEQ ID NO: 24019 - RNA, 61 nt, Human
uugcacuucuaaaauucagccuuguucauucagaaaauaaggauggauuuugugaauaauu

SEQ ID NO: 24020 - RNA, 61 nt, Human
aggacuuaaaacaaaccuugugcucuuuucaagaaaauagagaucuuaugucaaguucuac

SEQ ID NO: 24021 - RNA, 61 nt, Human
aaacugagacuauggacauucaaaucaugggagaaaauaauuuuguagauuauguuccauu

SEQ ID NO: 24022 - RNA, 61 nt, Human
agagaauuguuugcaaguuuuggguuuuauuagaaaauauuugaaaguauuuuuauuaaug

SEQ ID NO: 24023 - RNA, 61 nt, Human
uuuuuucucauuuaaaauaaaaaaggaagaaagaaaauaauuuuccuuguaaaaucgggcc

SEQ ID NO: 24024 - RNA, 61 nt, Human
ccauuucauagaugaaaauagugaagcccacagaaaauaaguagcuccuccacagguugua

SEQ ID NO: 24025 - RNA, 61 nt, Human
uacuuuauuaaaacuaaaucugaaauggaauagaaaauagaauggauuacauacagauggu

SEQ ID NO: 24026 - RNA, 61 nt, Human
aaugacuauucuaaauauuaauguauuaaaaagaaaauacaacaaaauguauauuuagaca

SEQ ID NO: 24027 - RNA, 61 nt, Human
aaagugugacacaguuuuuaaauuuagauguagaaaauaaugaauuaaugagauuggugaa

SEQ ID NO: 24028 - RNA, 61 nt, Human
gggaggccggcgcagcgcagagcgggcucgaagaaaauaauucucuauuauuuuuauuacc

SEQ ID NO: 24029 - RNA, 61 nt, Human
uuuuggagaacuugucaaauuacagccaaugagaaaauaaggaccuagcauacuguggaga

SEQ ID NO: 24030 - RNA, 61 nt, Human
ugaauuuuaaacuuuuugcaugcuucuauguagaaaauaaucaaaugauaauagauacuua

SEQ ID NO: 24031 - RNA, 61 nt, Human
uggaguuagccuccugugguaaaggaauugaagaaaauauaacaccuuacacccuuuuuca

SEQ ID NO: 24032 - RNA, 61 nt, Human
uuccuguaaaguacaauccaacucaucaaguagaaaauaagcaugcaucauugaaaagaga

SEQ ID NO: 24033 - RNA, 61 nt, Human
uguuuggucuauuuccaaaaaccugagggggagaaaauacuuugcuuuugccuuaacacau

SEQ ID NO: 24034 - RNA, 61 nt, Human
aaugugaaacauuuagugaauacaguaaaggagaaaauaaaauuguuagcauucuacccag

SEQ ID NO: 24035 - RNA, 51 nt, Human
accauauuaauagcaauuaaaagaaaauagaauguggccacuuauuucacu

SEQ ID NO: 24036 - RNA, 61 nt, Human
uauggacauggaaauauuuauauaauuuuauagaaaauaaccuuuuagauggucaaagugu

SEQ ID NO: 24037 - RNA, 61 nt, Human
cuuuuauaggcuugaaaucauccaucacauaagaaaauagaaaucauauuaaaagugaauu

SEQ ID NO: 24038 - RNA, 61 nt, Human
guauacuagaguuuaggaaaaugaaaauuuuagaaaauauguuuugucacccuguugguca

SEQ ID NO: 24039 - RNA, 61 nt, Human
auucauucuacuuuuucaaaugauaugcuguagaaaauauuccuugaagaugugagauuua

SEQ ID NO: 24040 - RNA, 61 nt, Human
ggguuacagaugcauauguccaauauaaaauagaaaauauauuaacguuugaaauuaaacu

SEQ ID NO: 24041 - RNA, 61 nt, Human
auuuuaucauauguucuaaaagagaaggaagagaaaauacuacuuucucaaaauggaagcc

SEQ ID NO: 24042 - RNA, 61 nt, Human
gauccauuauuuccccugaaggcuucuuguuagaaaauaguacaguuacaaccaauaggaa

SEQ ID NO: 24043 - RNA, 61 nt, Human
uuuaagugccaauuaauuuaucagacuaaauagaaaauauuugagccauuacugaauucac

SEQ ID NO: 24044 - RNA, 61 nt, Human
uagugcuuuuauauucauuuccuugcauuuaagaaaauaugaaagcuuaaggaauuaugug

SEQ ID NO: 24045 - RNA, 61 nt, Human
cuaaguaccuccuacacauuucccaucaaucagaaaauagacagguacacuaaagggaccc

SEQ ID NO: 24046 - RNA, 61 nt, Human
acaauaguuuuuaucuaauaaaagcacugcaagaaaauaggguagaauuguuacagcugga

SEQ ID NO: 24047 - RNA, 61 nt, Human
aaaauuaaauugaaacaaaaugucccaacuaagaaaauauauagagcauuuuauuuuuuuu

SEQ ID NO: 24048 - RNA, 61 nt, Human
uuaaauaaaccagagaucugaucuucaagcaagaaaauaagcaguguuguacuugugaauu

SEQ ID NO: 24049 - RNA, 61 nt, Human
cuuucccucaaccagcccuuaacuagaacacagaaaauaaaaccaagacuggaaggucccc

SEQ ID NO: 24050 - RNA, 61 nt, Human
cccucaucugggaauagggaaggcaccuugcagaaaauaugagcaauuugauauuaacuaa

SEQ ID NO: 24051 - RNA, 61 nt, Human
agcaaagucuucagaugcgauccuguguaggagaaaauacccuucuggugccccaugaaaa

SEQ ID NO: 24052 - RNA, 61 nt, Human
agagauaauugucuaguuagggggcagcuggagaaaauaagcuaaguuugcaauaacagag

SEQ ID NO: 24053 - RNA, 61 nt, Human
cauuaaaguaacuuuuuuaacuaugagaauuagaaaauaagggacaacagggguuaaaaau

SEQ ID NO: 24054 - RNA, 61 nt, Human
acauuuuagaaguggagagugcaucauauguagaaaauaaauauucagacguggcucauua

SEQ ID NO: 24055 - RNA, 61 nt, Human
ccauacgcucauagucacauauggaauuuugagaaaauaaagcaugcugucuuuaggaauu

SEQ ID NO: 24056 - RNA, 61 nt, Human
agauguuggcuuauuguaaaaauaaaguuaaagaaaauaauguauguauugguaaugaugu

SEQ ID NO: 24057 - RNA, 61 nt, Human
aucauagagugugaauuucuauuugggaaggagaaaauacaagagaaaauuauaauguaaa

SEQ ID NO: 24058 - RNA, 61 nt, Human
uaccacuuccuaaauauccaucuuuggugaaagaaaauagugugguaagaguacccaugau

SEQ ID NO: 24059 - RNA, 61 nt, Human
cuuuguuauauuuuagugauccacaagauugagaaaauauuauauaguuagauaauaacau

SEQ ID NO: 24060 - RNA, 61 nt, Human
gaccucaucauuaauaagugaagaauacaucagaaaauaaaauauucacucuccauuagaa

SEQ ID NO: 24061 - RNA, 61 nt, Human
ggaaauauuuucaagauaauguuccuuaggaagaaaauaacauucuuggguugagggaagg

SEQ ID NO: 24062 - RNA, 61 nt, Human
auaacagauccuuucaaaagaagaguuuuagagaaaauaaauuuaacuuuaaccacaguga

SEQ ID NO: 24063 - RNA, 61 nt, Human
uaaagaguuccguuugccuuucaauuuuuagagaaaauaaagacugcauucaucucauugu

SEQ ID NO: 24064 - RNA, 61 nt, Human
cgaugaauugcuuuuuugacuuagaagcugaagaaaauagacauagccggcauaucucaug

SEQ ID NO: 24065 - RNA, 61 nt, Human
ucuuaaaauggaaugagaauguuguuuuaaaagaaaauagcaaaacaacaaaaaagcaaac

SEQ ID NO: 24066 - RNA, 61 nt, Human
guuuuaaucucccuugucccucagaauaagcagaaaauauaacugcagcuguaugucguag

SEQ ID NO: 24067 - RNA, 61 nt, Human
ggacaguggaggcagcuggaauggcaagugcagaaaauaggaacaguucuauacagugcuc

SEQ ID NO: 24068 - RNA, 61 nt, Human
cauucugaaaaauaacauucucagaauccacagaaaauauacuuaguuacuacugaagaua

SEQ ID NO: 24069 - RNA, 61 nt, Human
ccgggcccgccaguucuuuuccggauucuguagaaaauacauacuuccugugccauaccaa

SEQ ID NO: 24070 - RNA, 61 nt, Human
ucagaggaaugcuuuuagcagaaaacaggaaagaaaauaucccuuaaaaauuuuuuuugaa

SEQ ID NO: 24071 - RNA, 61 nt, Human
uaaacgcaguaguuuuuuuaaaaggggagauagaaaauaaaugguuuuguuggagugcauu

SEQ ID NO: 24072 - RNA, 57 nt, Human
cgaacucugauucugcauaguaaaaugagaaaauaugauuccugggauuuuuaccau

SEQ ID NO: 24073 - RNA, 61 nt, Human
auuuuaaaaaaggaaucaauagaugcuuugaagaaaauaaaacuuauacaguugauugaaa

SEQ ID NO: 24074 - RNA, 61 nt, Human
uuaaugugcucuuuguaaaaugaaauuguaaagaaaauaccaguguuucucaucccauuga

SEQ ID NO: 24075 - RNA, 61 nt, Human
uauuaucuuuccacgaaauggauauauuucuagaaaauauauauuuacuaccauaauuucu

SEQ ID NO: 24076 - RNA, 61 nt, Human
gcucucuagucucugaaaagcaaaaaaagugagaaaauaauuucuucagagauaacuucaa

SEQ ID NO: 24077 - RNA, 61 nt, Human
uauacaggcuaugaaaaccauuuuaaaggaaagaaaauauguaaauucuauugagcaaaau

SEQ ID NO: 24078 - RNA, 61 nt, Human
auguuuggaugcagcagcugaauauauccagagaaaauaaacuuaagauuacuggccuuug

SEQ ID NO: 24079 - RNA, 61 nt, Human
aaguaauuaauaguguuggaagauguaggugagaaaauauuccugaaaguagaacugaaag

SEQ ID NO: 24080 - RNA, 61 nt, Human
agaaaggggagccaaggcuuuauacgucuaaagaaaauauucaguagcugaauccgcccag

SEQ ID NO: 24081 - RNA, 61 nt, Human
auacuaaguuacagaggaugcauccaaguagagaaaauaauauguggguuaagauacaucc

SEQ ID NO: 24082 - RNA, 61 nt, Human
gagaaacaggcugacacuauucucuuugauuagaaaauaaacucauaaaacucauaauguu

SEQ ID NO: 24083 - RNA, 61 nt, Human
ucauuuuucuaaaggggcagaggccucuuuuagaaaauaauaaaaugcaaugugugugauu

SEQ ID NO: 24084 - RNA, 61 nt, Human
caugaagcaugaauuauuuucauauaaauauagaaaauagagaaaaggcuaugccuguaau

SEQ ID NO: 24085 - RNA, 61 nt, Human
aaggccuucaguuuauuuccacuauuuucaaagaaaauagauuagguuugcgggggucuga

SEQ ID NO: 24086 - RNA, 61 nt, Human
ggccgcaagccccaaauggaaaacuguuuuuagaaaauaugaugauuuuugauugcuuuug

SEQ ID NO: 24087 - RNA, 61 nt, Human
ugcacuugguaccaugcuuuaccucauuucaagaaaauaugcuuaacagagaggaaaaaaa

SEQ ID NO: 24088 - RNA, 61 nt, Human
ucauuguucccaucccuuuuuuguguguuucagaaaauagugaacuugauuccccugcuuc

SEQ ID NO: 24089 - RNA, 61 nt, Human
caucuugaaguauuauuucacauugaaaagaagaaaauauauugauaacuauagauguuau

SEQ ID NO: 24090 - RNA, 61 nt, Human
auucagguuugaucaaggugugaauaacugaagaaaauaacuugcuggcuauauaggaaaa

SEQ ID NO: 24091 - RNA, 61 nt, Human
gggagggcgcauacccgagacgauuguaugaagaaaauauggaggaacuguuacauguucg

SEQ ID NO: 24092 - RNA, 61 nt, Human
cucaaagauuagguauauauuuaaauggaagagaaaauauuuuuaugggagaaaaauacau

SEQ ID NO: 24093 - RNA, 61 nt, Human
guggagguugauauuauuaauaguguuaugcagaaaauaugaauggcagggaggggcagag

SEQ ID NO: 24094 - RNA, 61 nt, Human
cccucagugaaguagcaauaggcuguaaucaagaaaauaugccauuuauagagauaagaua

SEQ ID NO: 24095 - RNA, 61 nt, Human
uuaaaguuagaauauauuugaaugcauggguagaaaauaucauauuuuaaaacuauguaua

SEQ ID NO: 24096 - RNA, 61 nt, Human
agugugaauucacugaauguuuauagacaaaagaaaauacacacuaaaacuaaucuucauu

SEQ ID NO: 24097 - RNA, 61 nt, Human
cuccuauuuuuaaauuuauuaugcaaauuuuagaaaauaaaauuugcucuaguuacacacc

SEQ ID NO: 24098 - RNA, 61 nt, Human
aacuuguuuuuuuaacgucagccagauauuuagaaaauaaccucaaaaguguuuauauggu

SEQ ID NO: 24099 - RNA, 61 nt, Human
gagagaucccaucucuaaaaaauaaaauauaagaaaauaaaacuuaggggauauacagauu

SEQ ID NO: 24100 - RNA, 61 nt, Human
gaaaauguuauaagagcuuuguaaauauuucagaaaauaugggauaaaugccugaauuugg

SEQ ID NO: 24101 - RNA, 61 nt, Human
gaagggguuccuuuuccauugcucaguuuuuagaaaauaauucucaucuuuuuucuaaaga

SEQ ID NO: 24102 - RNA, 61 nt, Human
augauuuguaaaagccgucauggggucaauaagaaaauaggggugauggagggggagaagc

SEQ ID NO: 24103 - RNA, 61 nt, Human
ccucggccugggauuucagagcuggaaauauagaaaauaucuagcccaaagccuucauuuu

SEQ ID NO: 24104 - RNA, 61 nt, Human
cagccguggccuaggcccaaacucugcucugagaaaauaaauaucuguaccaccugucaua

SEQ ID NO: 24105 - RNA, 61 nt, Human
ucaagguuaaaacacaaaugacagauauggaagaaaauauuugcagcacauaaaaaaauca

SEQ ID NO: 24106 - RNA, 61 nt, Human
uuuaugaauguggagaauucuacauugaaacagaaaauaccugggaaugaagauuaaaaau

SEQ ID NO: 24107 - RNA, 61 nt, Human
aaagagaauagaaaacacgcaugagauauucagaaaauacuagccuagaaauauagagcau

SEQ ID NO: 24108 - RNA, 61 nt, Human
agaguuguacuuuuaaaaaaauuaacgggaaagaaaauaacuuugugaagccaguguauuc

SEQ ID NO: 24109 - RNA, 61 nt, Human
ggucuaccuuaaccaaggcacuuucuuaagcagaaaauauuguugagguuaccuuugcugc

SEQ ID NO: 24110 - RNA, 61 nt, Human
uguuaucauucuuauaacauuguauguuaauagaaaauauauuugcauaauaugcauauau

SEQ ID NO: 24111 - RNA, 61 nt, Human
aggaacacauaaguaaguugcuuuggugccaagaaaauaaaaaagcuauuaucaggucucc

SEQ ID NO: 24112 - RNA, 61 nt, Human
uggugguuucagaaauguguuaucacccagaagaaaauaguggugugauuuggggauauuu

SEQ ID NO: 24113 - RNA, 61 nt, Human
uauaguuguagccuuacaacuuacaggcaucagaaaauaaguaaucaaauuagguaccugg

SEQ ID NO: 24114 - RNA, 61 nt, Human
gguuugcuucuauuacuuuucuuugacauaaagaaaauaacuucugcuagguauuacucuc

SEQ ID NO: 24115 - RNA, 61 nt, Human
augagacccuaucucaaaaacaaaaaggaaaagaaaauauacaugaugggauuccuauugu

SEQ ID NO: 24116 - RNA, 61 nt, Human
uucuguugagggcaaaauauuauaaaucuauagaaaauaaacuguuugacuugaaucauuu

SEQ ID NO: 24117 - RNA, 61 nt, Human
aaauauuauguuugugaacuaucuaagcaugagaaaauacaaagcuuucuuuguaucuggc

SEQ ID NO: 24118 - RNA, 61 nt, Human
aaaucugaaaaaaaagaaagcaaggauacuaagaaaauagaagguaaagaugagaagaaug

SEQ ID NO: 24119 - RNA, 61 nt, Human
ucaaucuuagacucuggccucaaaaauuguaagaaaauaaacuucugucuuuuaagccacc

SEQ ID NO: 24120 - RNA, 61 nt, Human
ucuuuuuggcuugugcugggauuuaagaauuagaaaauaaaaauaagcagaaauuaaaaaa

SEQ ID NO: 24121 - RNA, 61 nt, Human
aaccacacacaccagaaaaacaaaagacagcagaaaauaaccagguauucuuagagcuaua

SEQ ID NO: 24122 - RNA, 61 nt, Human
guauuuaauaucaauggacugagucugauucagaaaauaauuguaauguucauauucaaua

SEQ ID NO: 24123 - RNA, 61 nt, Human
gagcccagguaugagaaagaaaaaaccacuaagaaaauaccucccugggaggaugagcugg

SEQ ID NO: 24124 - RNA, 61 nt, Human
uaaccaguaaacacucuguaguaaccauuacagaaaauacuucugccuuaaaaaauaugau

SEQ ID NO: 24125 - RNA, 61 nt, Human
uaaugcuaaaaaaggccuaauaaaaugcccaagaaaauauucagugcauuuauagagaagg

SEQ ID NO: 24126 - RNA, 61 nt, Human
caucagaaaaugggauaaacauacauuucacagaaaauaaucaagacuugcucugcagcca

SEQ ID NO: 24127 - RNA, 61 nt, Human
guauaucauauuguaaaguaucauacugccaagaaaauaacuccuagaaaggcauuaucuc

SEQ ID NO: 24128 - RNA, 61 nt, Human
augggcuaguacuugagguguucacugauugagaaaauacccgugagguaugggacucuga

SEQ ID NO: 24129 - RNA, 61 nt, Human
ugaucuugggcuuucagcccccaaaggugugagaaaauaaacuucgguugauaaacugcug

SEQ ID NO: 24130 - RNA, 61 nt, Human
ggacccugccaaguggcaccugauuuacucuagaaaauaaaaguagaaaauacugagucca

SEQ ID NO: 24131 - RNA, 61 nt, Human
uggcaccugauuuacucuagaaaauaaaaguagaaaauacugaguccagcuguguuguuug

SEQ ID NO: 24132 - RNA, 61 nt, Human
agaaccuguugaaaugugaauuaagaagcuaagaaaauauuucuuagcaacauuuucuuuu

SEQ ID NO: 24133 - RNA, 61 nt, Human
gccuggaugacaagcaagacccucccuccaaagaaaauaaagcucaaaauaaaauaugauu

SEQ ID NO: 24134 - RNA, 61 nt, Human
uuuuccaucaccgagagagagagacagagagagaaaauaaacuaccccuccuauucagaag

SEQ ID NO: 24135 - RNA, 61 nt, Human
ggccguuuugaugaccucgaaggucacaggcagaaaauaggagcaggauuuccccugggga

SEQ ID NO: 24136 - RNA, 61 nt, Human
cauccuaaugcuuacucugguuguuacacaaagaaaauauuggggucacuggcgagcccac

SEQ ID NO: 24137 - RNA, 61 nt, Human
uugguuuuguauuuuauuuacagaguuuuacagaaaauaaaaaagcaaaaugucuuuccua

SEQ ID NO: 24138 - RNA, 61 nt, Human
aaggcuggaccacucaguuauuauugcuauuagaaaauaauauaucauguuuacuuuuguu

SEQ ID NO: 24139 - RNA, 61 nt, Human
ccacugucuugugucagaacuuuuacaguacagaaaauaacagaauagccuucuguaauga

SEQ ID NO: 24140 - RNA, 61 nt, Human
auuugguugaaacagacuguugcuugauuuuagaaaauacacaaaaacccauauuucugaa

SEQ ID NO: 24141 - RNA, 61 nt, Human
uaucgaugcaugccacaacaugggugaaccuagaaaauacugaucuaaaugcaagaagcca

SEQ ID NO: 24142 - RNA, 61 nt, Human
caaggacacauugaauacguugugaccauccagaaaauaaaugcugaggggacacagucac

SEQ ID NO: 24143 - RNA, 61 nt, Human
uaaagcaguugaaagaauuuauucagcaaccagaaaauaagcugguaaguauaguauguuu

SEQ ID NO: 24144 - RNA, 61 nt, Human; identical to SEQ ID NO: 24143

SEQ ID NO: 24145 - RNA, 61 nt, Human
uuauaagaaaaaucauaaaugcauauaaaauagaaaauauuuggagauugcuuaucugaaa

SEQ ID NO: 24146 - RNA, 61 nt, Human
uucuggccaguguuuaaaacuucaguuucacagaaaauaaggcacccaucugucugccaac

SEQ ID NO: 24147 - RNA, 61 nt, Human
cucaggaauuugucuaacacauuucaaggauagaaaauacuucacugccgggcaugguggc

SEQ ID NO: 24148 - RNA, 61 nt, Human
ccauagagccugaaaucaucuuuguuggcucagaaaauaccuuagcuucacucagcuggac

SEQ ID NO: 24149 - RNA, 61 nt, Human
cuuagagcuuggaacaagggggaauaaacccagaaaauacaguuaaacagauggcuguguc

SEQ ID NO: 24150 - RNA, 61 nt, Human
cuggugcugaaaggaaggauggauaacgaggagaaaauaaaacugugaggcucaaggcugg

SEQ ID NO: 24151 - RNA, 61 nt, Human
gagaucaugcauuuagauuuauauuuuugccagaaaauacaagguuauaauaaaacuaaga

SEQ ID NO: 24152 - RNA, 61 nt, Human
aaaauagcuuuguuuuguaccaacaggaauuagaaaauauaaugaaaagauuucguuccca

SEQ ID NO: 24153 - RNA, 61 nt, Human
gaacaaaguuuaccagaaagcaguugagacaagaaaauaagagcucaggaugagggaaaag

SEQ ID NO: 24154 - RNA, 61 nt, Human
aaaauggggcaguggacugacaggcugacauagaaaauaaacuuugcccaaucacaacuug

SEQ ID NO: 24155 - RNA, 61 nt, Human
aaggccguuucuuuguuucugagcauaaagaagaaaauaaaucuuuuacuaagcaugagug

SEQ ID NO: 24156 - RNA, 61 nt, Human
ucuccagauuuagcauccugcagagccaccgagaaaauaaaaaagcugggcuuggaggcug

SEQ ID NO: 24157 - RNA, 61 nt, Human
gggagcccugaaaaauuaggggggaaaugggagaaaauaaugugacauuucaaaaacagca

SEQ ID NO: 24158 - RNA, 61 nt, Human
auugaaaaacuaaagcaaauucuuuauaggaagaaaauaugggaauuugauuacacauaga

SEQ ID NO: 24159 - RNA, 61 nt, Human
caauaauuuuuaaaucauaccaaaaauaguaagaaaauaugcaaacacucugugaucaaac

SEQ ID NO: 24160 - RNA, 61 nt, Human
cacagacccuacccuuuccccuagcccaguuagaaaauaagucugggccggcggcgguggc

SEQ ID NO: 24161 - RNA, 61 nt, Human
caggaugcccaguuaaguuugaauuucagauagaaaauaauuuuagaauaaauauguucua

SEQ ID NO: 24162 - RNA, 61 nt, Human
gaaugcaauaguaggacugcugacauuuugcagaaaauacauuuuauuuaaaaucuccuac

SEQ ID NO: 24163 - RNA, 61 nt, Human
uagccaaagccauaaaaaaccugcaacguagagaaaauaaugcagauacccugacuagcca

SEQ ID NO: 24164 - RNA, 61 nt, Human
acauggauuuuggcagggcgggggggguucuagaaaauauaguuccuauaauaaaauggca

SEQ ID NO: 24165 - RNA, 61 nt, Human
uuauuuaaugcuugcaacgacucucugagguagaaaauauuguuaauuccguucaggaucc

SEQ ID NO: 24166 - RNA, 61 nt, Human
aauauuuucuugcaucaguauuggcuagaaaagaaaauaaauaaaaccaaguuaauuuagu

SEQ ID NO: 24167 - RNA, 61 nt, Human
acuuugcaccacuuuuguuacaagguacgguagaaaauagugaagucaguuuccucucauc

SEQ ID NO: 24168 - RNA, 61 nt, Human
uugaaccgccgguucauuuugcaccuuauucagaaaauagagcaucauacucaccgagucu

SEQ ID NO: 24169 - RNA, 61 nt, Human
aaaauaaaauauaaaaagaaagagaaagaaaagaaaauaguuccaauuuaucaugccaaau

SEQ ID NO: 24170 - RNA, 61 nt, Human
uccacaaaaagucauggcaauaaugguguaaagaaaauaguuucuuggguauuuguaacgu

SEQ ID NO: 24171 - RNA, 61 nt, Human
cuacgaauucuaucuuugggaauuuauccuaagaaaauacuuaaggauuuaguuagugaua

SEQ ID NO: 24172 - RNA, 61 nt, Human
aacaaaccacaacauugccugcaugucuaaaagaaaauaugggccuggugugguggcucac

SEQ ID NO: 24173 - RNA, 61 nt, Human
ccaacagaguaaaguggaaggaaguuuauucagaaaauaaaggaguaucacagcucuuuua

SEQ ID NO: 24174 - RNA, 61 nt, Human
ucugguugaaaucaagguuaggaugcaacugagaaaauaaaagacugcacuuuggagaggc

SEQ ID NO: 24175 - RNA, 61 nt, Human
ccaugucaccauugagaugaagauauacaacagaaaauaguggcuguguuuggaagcuuca

SEQ ID NO: 24176 - RNA, 61 nt, Human
uugcaccuaguaaagcagggccgagacagaaagaaaauagauucucaacgagauuucacug

SEQ ID NO: 24177 - RNA, 61 nt, Human
uaaugaacccaugagaaaugucauauaucuuagaaaauaguuguguguaucuuucugagga

SEQ ID NO: 24178 - RNA, 61 nt, Human
guuauugguuuuuuuguauagaccaaagcaaagaaaauaaaaauaacacagaugcguugga

SEQ ID NO: 24179 - RNA, 60 nt, Human
cagaugaugaagaaagaggaacgggcuuggaagaaaauaaucaagaagagcaaagcaugg

SEQ ID NO: 24180 - RNA, 61 nt, Human
aaugagguagaugaauauucugguucuucagagaaaauagacuuacuggccagugauccuc

SEQ ID NO: 24181 - RNA, 61 nt, Human
gccuaccugaccaucucuuuagcugucaccaagaaaauaaaccccacugucucucuagcuu

SEQ ID NO: 24182 - RNA, 61 nt, Human
aagaaaaagaacaaaaaauauauaucacucuagaaaauaaaucucuccugugucuuauucu

SEQ ID NO: 24183 - RNA, 61 nt, Human
uugauuuuucauucaaguaaauauagccauaagaaaauaucugcuauacaggaaaaccagu

SEQ ID NO: 24184 - RNA, 61 nt, Human
guacauacaaaauucuuccaaaagagagaggagaaaauacagcucugauggcaucaaacgg

SEQ ID NO: 24185 - RNA, 61 nt, Human
aacaaaagucucauucauaagaggucuuagaagaaaauaaccaguuaaccugauuucaauu

SEQ ID NO: 24186 - RNA, 61 nt, Human
cuggcuaacacggugaaacaccgucucuaccagaaaauacaaaaaauuagccaggcgcggu

SEQ ID NO: 24187 - RNA, 61 nt, Human
uaugauuuauuggguuucuuaaaaaucuugaagaaaauaauaaaauuuaucucacaauaag

SEQ ID NO: 24188 - RNA, 61 nt, Human
aauuuugcaaguuuaauuugauuuauuucagagaaaauagaaaaaacaauguuagaagguu

SEQ ID NO: 24189 - RNA, 61 nt, Human
cagaagaaaaguugcuuuucaaagaggaagaagaaaauagcagcaagaaauaucucuuucu

SEQ ID NO: 24190 - RNA, 61 nt, Human
gacacaaaccauguguucugauuuuugguucagaaaauauugaaacugugaguuguuuuuu

SEQ ID NO: 24191 - RNA, 61 nt, Human
auguuguuacaucuuccaaggaugucagauuagaaaauagcaucccaccucuggguaucug

SEQ ID NO: 24192 - RNA, 61 nt, Human
gagauuauaaucaguuuguuuucaagauaauagaaaauaagguccaugagaauagaaguua

SEQ ID NO: 24193 - RNA, 61 nt, Human
uauucauacuaggauagaaaauuuuggaaucagaaaauagauccaguguuuagcuacauac

SEQ ID NO: 24194 - RNA, 61 nt, Human
ucaugguguuagaguugcaaacuuuuuagcaagaaaauauggauuuccucauuucaguucc

SEQ ID NO: 24195 - RNA, 61 nt, Human
ucaagcacuccuaccuuaauuauugcacuagagaaaauaaauuccaaauuaggaaguguuu

SEQ ID NO: 24196 - RNA, 61 nt, Human
gucaacaacauacugccacuaugaaguaauaagaaaauaaaaaguuaaaaaauguaacaga

SEQ ID NO: 24197 - RNA, 61 nt, Human
uuaauuauguacacaaaaauauuuuccuuguagaaaauaguuuuccagacacuuagccuuc

SEQ ID NO: 24198 - RNA, 61 nt, Human
gcaaaaauagaaaauuauuuguuaaauucagagaaaauaugugaaguuuacaaaggaacca

SEQ ID NO: 24199 - RNA, 61 nt, Human
agcgggaaaaggagaggaaacuacugccuuuagaaaauauaaguaaagugauuaaagugcu

SEQ ID NO: 24200 - RNA, 61 nt, Human
uagagccuacuuuuauuuugguuaaagaaaaagaaaauaucaauaauucaauuuugugucu

SEQ ID NO: 24201 - RNA, 61 nt, Human
uaaaugacucacaacauuauaaacaguugugagaaaauauuucacauuaucaaagcuguac

SEQ ID NO: 24202 - RNA, 61 nt, Human
auauguccuuauggggaugggugccacaaauagaaaauaugaccagaucagggacuugaau

SEQ ID NO: 24203 - RNA, 61 nt, Human
uugcaaccucugguauacuguuauguucuggagaaaauauucaaagaucugccaaauacug

SEQ ID NO: 24204 - RNA, 61 nt, Human
uguuuuucuuuaucuacaaaauuauguguuaagaaaauaccauucauagcaugaagauuag

SEQ ID NO: 24205 - RNA, 61 nt, Human
gucgugcacucuuuggaugauucgcaacagaagaaaauaugccaugaucagcucucccuuc

SEQ ID NO: 24206 - RNA, 61 nt, Human
acaguaugucacagucaugcacauucaagagagaaaauauaacaaguucuuuuaugagcaa

SEQ ID NO: 24207 - RNA, 61 nt, Human
uaaggugaaauuuaugguauuugagugugcaagaaaauauauuuuuaaagcuuucauuuuu

SEQ ID NO: 24208 - RNA, 61 nt, Human
uuuccuuuuaccuaauuugaauaugcauuugagaaaauaagaggauaaaggauggcuaaga

SEQ ID NO: 24209 - RNA, 61 nt, Human
cuuagucucuugcuaguugaaaucaaauaaaagaaaauauauacccaguugguuucucuac

SEQ ID NO: 24210 - RNA, 61 nt, Human
acaagcagggcuaauuccaaaaagcaaggcuagaaaauagcccugugaggucaagacaauu

SEQ ID NO: 24211 - RNA, 61 nt, Human
uuauucuuuauuuugggaccuucuguguaaaagaaaauauuaccuaaauugguuagauaca

SEQ ID NO: 24212 - RNA, 61 nt, Human
cacuuuuauuuuucuugcugggguugaggagagaaaauauagaauuccuggauaagaccaa

SEQ ID NO: 24213 - RNA, 61 nt, Human
aaugcuauuccuucaagccuguuuugcaggcagaaaauaccagcagugucauuuagggguu

SEQ ID NO: 24214 - RNA, 61 nt, Human
acucaggcuggcagaggggcuggugcccuggagaaaauaaagagaaggcuggagagaagcc

SEQ ID NO: 24215 - RNA, 61 nt, Human
ucaggcuggugugggaugcagccggccgaugagaaaauaaagccauauugaaugaucgcca

SEQ ID NO: 24216 - RNA, 61 nt, Human
agaaucguaucccaaagcccucccauggccuagaaaauaaauaaguuauuguuugucuuag

SEQ ID NO: 24217 - RNA, 61 nt, Human
agccucaugcauagcgggucauguagucucuagaaaauacauaaccugauggaaauguaga

SEQ ID NO: 24218 - RNA, 61 nt, Human
ugaccgugcugaacagacccccccacacgagagaaaauaaaggagcaauaaagucacgaga

SEQ ID NO: 24219 - RNA, 61 nt, Human
cagucuuaaauuuuuaaaaauauguaauuuuagaaaauaauuuaaaagguuuuguuucagu

SEQ ID NO: 24220 - RNA, 61 nt, Human
agcaucuucccuggauggcuggaggaacuccagaaaauauccaucuucuuuuuguggcugc

SEQ ID NO: 24221 - RNA, 61 nt, Human
cugccuguguucuccgagggccuucauuuaaagaaaauaaggguguuuuggguuuuucucu

SEQ ID NO: 24222 - RNA, 61 nt, Human
uauaagugcaauuacugucaaaagaucuuucagaaaauauaagcuuuuuuagugaagagua

SEQ ID NO: 24223 - RNA, 61 nt, Human
gauaagugcaauuacugccaaaagaucuuucagaaaauauuauccuuuaaagugaaggaga

SEQ ID NO: 24224 - RNA, 61 nt, Human
gaauauucuacuaaaugagaguucugaguauagaaaauaaaacuaaaguugguagaaaaau

SEQ ID NO: 24225 - RNA, 61 nt, Human
agacauuacacuaaaucagagugcugaguauagaaaauaauacaaacagauuugucuaaac

SEQ ID NO: 24226 - RNA, 61 nt, Human
auuuccuuggcuuuaguuuuauaucauauuuagaaaauaauaaugaaaagcauccccaaaa

SEQ ID NO: 24227 - RNA, 61 nt, Human
uucauuuccaauuaaauacuaaacauuuuauagaaaauauuucuaaaauuuuaucacggau

SEQ ID NO: 24228 - RNA, 61 nt, Human
cacaaugauuauaaguauuaaucuccauaagagaaaauauuuaugaacuauauuucucauu

SEQ ID NO: 24229 - RNA, 61 nt, Human
auugcugggaauauuugacucuccguauuggagaaaauaaaauuacaacauuacgacauac

SEQ ID NO: 24230 - RNA, 61 nt, Human
auuugaaaagccaaacugugaaaccauugggagaaaauagaugauauugucuaugacguug

SEQ ID NO: 24231 - RNA, 61 nt, Human
aguucucauuaaauuuaggaaaauucacacuagaaaauaaagcuguuaauguaacaguugu

SEQ ID NO: 24232 - RNA, 61 nt, Human
cuucaugaaacuguccaccaagaucaagcagagaaaauaauuaauuucaugggacuaaaug

SEQ ID NO: 24233 - RNA, 61 nt, Human
ccugggcgacagagugagacucccucucaaaagaaaauaaaaauaaaaauaaacuggccag

SEQ ID NO: 24234 - RNA, 61 nt, Human
ugggaaugcaaagcuugagcugcucugcaagagaaaauaagcaggacagaggauuugcucu

SEQ ID NO: 24235 - RNA, 61 nt, Human
acuuuuucuacuauccuugcuaaguuuucauagaaaauaaggaacaaagagaaacuuguaa

SEQ ID NO: 24236 - RNA, 61 nt, Human
ucuaagguacaccugacaaaggaacucucauagaaaauauaaagaaucccucaaguugaaa

SEQ ID NO: 24237 - RNA, 61 nt, Human
cuaugcccagcugcacagcuuacccucaaacagaaaauaaugaagccuucuuccucccagg

SEQ ID NO: 24238 - RNA, 61 nt, Human
cuaaaguaaguuaaaagauuaugauaaacucagaaaauaaacacagagaaggaaucucauu

SEQ ID NO: 24239 - RNA, 61 nt, Human
aauucacacaagagaaaggccuuaugaaugcagaaaauaugucaucuuguucauccucaua

SEQ ID NO: 24240 - RNA, 61 nt, Human
ucuucuguuuacuaucgcugagaucauuaucagaaaauagucuggccgggcaugguguaau

SEQ ID NO: 24241 - RNA, 61 nt, Human
cucaagaugguuuucaaaaaaauuuuuuuaaagaaaauaauuguauacgugucaacacagc

SEQ ID NO: 24242 - RNA, 61 nt, Human
aagaaacaaaccaccucuacauauuauggaaagaaaauauuuuugucgauucuuauucuuu

SEQ ID NO: 24243 - RNA, 61 nt, Human
gaauuguuuaauuauuuguacuuuucaugccagaaaauaaaaguucagaaucuuaaggccu

SEQ ID NO: 24244 - RNA, 61 nt, Human
aaaaaacacaaaaaaagacaaaaaaaaaaaaagaaaauauuuuggcagguuauguuuacca

SEQ ID NO: 24245 - RNA, 61 nt, Human
auagggggauguuuuuccaggacaagugaagagaaaauauuaaaacuagaauauucaacuc

SEQ ID NO: 24246 - RNA, 61 nt, Human
uauaaauuuaauuacugucaaaaaguauuucagaaaauauaagcuuuuaaaguauuuauuu

SEQ ID NO: 24247 - RNA, 61 nt, Human
agguauuuuacuaaaucagagugcugaguauagaaaauaaucuaaaacuaaaauugguaaa

SEQ ID NO: 24248 - RNA, 61 nt, Human
cauaagugcaacuacugucaaaauaucuuuaagaaaauauaagcuuuuaaagugaagagua

SEQ ID NO: 24249 - RNA, 61 nt, Human
cauacauaucuuuaaagcacaugacaacauuagaaaauauuuucacuccuuaaaaaaaaaa

SEQ ID NO: 24250 - RNA, 61 nt, Human
cucaagauuuuuuuugucagaggcuccaaauagaaaauaagaaaagguuuucuucauucau

SEQ ID NO: 24251 - RNA, 61 nt, Human
uaccaaggcuuugauugggauguuauauuugagaaaauacagagaaugauagauuaacgga

SEQ ID NO: 24252 - RNA, 61 nt, Human
aauagggcccagcaauuacugaagaaagugaagaaaauaccuauaauuaggacaaauacuu

SEQ ID NO: 24253 - RNA, 61 nt, Human
ccagauaaauuaagucaaacauuugguuuccagaaaauaaagacaaauagagaagguuaga

SEQ ID NO: 24254 - RNA, 61 nt, Human
ucuugguuggaagcugcagcuggcccaagaaagaaaauaaaaaacaacacuuuugcaugag

SEQ ID NO: 24255 - RNA, 61 nt, Human
cacaaaaaugggagaaaaugcaaacaugagcagaaaauauuuucccacugguguguagccu

SEQ ID NO: 24256 - RNA, 61 nt, Human
ugugucagagaaaacauguacaaaacauuugagaaaauauuuuaggacauuaugucuaaaa

SEQ ID NO: 24257 - RNA, 61 nt, Human
gugugggagaauuagagaauuuauuugugucagaaaauacuccagaacaaccaccccauau

SEQ ID NO: 24258 - RNA, 61 nt, Human
guucaguaagacuucucccacauuauuuacuagaaaauaucaucuuagaagaaaccccaug

SEQ ID NO: 24259 - RNA, 61 nt, Human
gagugucuuugcagauucagccuaaaagcaaagaaaauauuucccuaaaauauuugcaaau

SEQ ID NO: 24260 - RNA, 61 nt, Human
aaaguaaucauuuuaggucuuaaagacuucaagaaaauacagguuaucaauuuauuuuaaa

SEQ ID NO: 24261 - RNA, 61 nt, Human
acagcuuagcuugguuuugcuuauucaaaagagaaaauaacuacacauggaaaugaaacua

SEQ ID NO: 24262 - RNA, 61 nt, Human
ccucuccccacuuuuuuuaaaaauuuuaaccagaaaauaaagauaguuaaauccuaagaua

SEQ ID NO: 24263 - RNA, 61 nt, Human
uguuuuuuuucucauuugauuuugcuugugcagaaaauaguuuccagcacauggauugauc

SEQ ID NO: 24264 - RNA, 61 nt, Human
gauuuaugaaauuaaauuaagagauaauguaagaaaauacauuuuuuugguucuauauaau

SEQ ID NO: 24265 - RNA, 61 nt, Human
auaaaugcugacagauuuccaagaacuaccaagaaaauacaagagauauccaaugcuugau

SEQ ID NO: 24266 - RNA, 61 nt, Human
ugaauacaaaugcacucccaaagugguuuuaagaaaauaaaaagauuauccuuccucuuug

SEQ ID NO: 24267 - RNA, 61 nt, Human
acuaaggaauucugcagcuugcagauguuuaagaaaauaauggccagauuuuuuggguccu

SEQ ID NO: 24268 - RNA, 61 nt, Human
gaagaaggaucuuaggcauucuuaaaauucaagaaaauaaaacuaagcucuuugagaacug

SEQ ID NO: 24269 - RNA, 61 nt, Human
uuaaaccagaauaaacauuaaaaacuauugcagaaaauaguggauuuuggauuccaaacau

SEQ ID NO: 24270 - RNA, 61 nt, Human
cugacaggccacugcaucucagauucaggggagaaaauaaguugucaccuccccuucaaag

SEQ ID NO: 24271 - RNA, 61 nt, Human
gauugguuuuguuuuauaccauaugggaugaagaaaauagaaaugucaguagaacucauug

SEQ ID NO: 24272 - RNA, 61 nt, Human
uauguuugggugggaagggaagagagggauaagaaaauaccuuucuuccuuguaaacucca

SEQ ID NO: 24273 - RNA, 61 nt, Human
uuuuguucuuuugaagaauagagugguauuuagaaaauaaauugcauugcaaagcucuuau

SEQ ID NO: 24274 - RNA, 61 nt, Human
cugaguaggaaaugaaauacuagauuagacuagaaaauaaggaauaaaucgauuuuacuuu

SEQ ID NO: 24275 - RNA, 61 nt, Human
acaguucugaaggaaguuagggaggaagccaagaaaauaucuauugugauuaaagguagca

SEQ ID NO: 24276 - RNA, 61 nt, Human
aauuauuugaugggccugccaugugaaaaccagaaaauaaccucguacucacaagccagug

SEQ ID NO: 24277 - RNA, 61 nt, Human
uuuuucuucuauuaaaauauaacauugugaaagaaaauaaaauuuaugcuauucuuugcuu

SEQ ID NO: 24278 - RNA, 61 nt, Human
gguggcaaagugagacccugucuccaaaaaaagaaaauagagcuuuauaagcagagagaag

SEQ ID NO: 24279 - RNA, 61 nt, Human
aaaagaaaauagagcuuuauaagcagagagaagaaaauaaucaucuaagaccaucucucca

SEQ ID NO: 24280 - RNA, 61 nt, Human
uucugcuggaauuugcaaucacugaagucauagaaaauagguaacuaucuaauuagagaaa

SEQ ID NO: 24281 - RNA, 61 nt, Human
cauuacugcauccccaguaaugaaaguacuuagaaaauaauuauugaaugaaugaaaucua

SEQ ID NO: 24282 - RNA, 61 nt, Human
caggacuggccgccccugcugugggggguucagaaaauaaaaugccgcgcagcccuugcca

SEQ ID NO: 24283 - RNA, 61 nt, Human
agaugccagauaucccauacagaauuagcagagaaaauacacacaggcuucuauucaaauu

SEQ ID NO: 24284 - RNA, 61 nt, Human
ucuuggaaaaaauuuuaagaaucaaaaauaaagaaaauaaaaaaugcauacaguuaaacau

SEQ ID NO: 24285 - RNA, 61 nt, Human
acacaaauuucaaucaaauacuuuuguguauagaaaauauguauaguagguagauagaaaa

SEQ ID NO: 24286 - RNA, 61 nt, Human
uuccuuuaagaaaaaccacagggaccaagaaagaaaauauaacaguuugauuucugucaua

SEQ ID NO: 24287 - RNA, 61 nt, Human
uuaagaaauuugagcagaauuuaaaaaagaaagaaaauaaauuguuuuucccaaaguaugu

SEQ ID NO: 24288 - RNA, 61 nt, Human
uucuuuuacaaaagaauauuacauauuugagagaaaauauuucuauuaaugguuuaauuuc

SEQ ID NO: 24289 - RNA, 61 nt, Human
uauuuaugcccuuauaucccaaaaaugucuuagaaaauaaaaauucugggccuuacuuguu

SEQ ID NO: 24290 - RNA, 61 nt, Human
uaaucaauggauauccuucaguagugaaugcagaaaauaaaaauacacagguaauuuagua

SEQ ID NO: 24291 - RNA, 61 nt, Human
accuguuagcagguucuuguuucauaaagguagaaaauaaauacagacaacaucuacugag

SEQ ID NO: 24292 - RNA, 61 nt, Human
acgaaugagaagacaaguuuggacauagcccagaaaauaugcuauuauuucauagaagaga

SEQ ID NO: 24293 - RNA, 61 nt, Human
agagaaggaauaaauuugucaaaacuaggugagaaaauagagcauugugggaaaaacugag

SEQ ID NO: 24294 - RNA, 61 nt, Human
caaguuaugaaauaaaacugagagauaauggagaaaauaauuuuuauggguuuuuuugguu

SEQ ID NO: 24295 - RNA, 61 nt, Human
auuugcugguuguuuauuuuuugguacaaccagaaaauagugugggauauugaauuauggg

SEQ ID NO: 24296 - RNA, 61 nt, Human
aaauugccaaaauauauuaaaaaaaaaaaagagaaaauacugaaaccacagacagugcaaa

SEQ ID NO: 24297 - RNA, 61 nt, Human
uuaagaaauaauuuuagauuugugcucuagcagaaaauaacucuguacccaucaaucuuau

SEQ ID NO: 24298 - RNA, 61 nt, Human
aauuccugaauguuucagagaaacaggaaucagaaaauagcagauaucauguaggaaagag

SEQ ID NO: 24299 - RNA, 61 nt, Human
ccuguagcugacuuuagccacccacaaguacagaaaauaauccagucccucauagcacugg

SEQ ID NO: 24300 - RNA, 61 nt, Human
auggugggguuuucugcuuuguuuuuauuuaagaaaauaaacacgacauauuuaaagaagg

SEQ ID NO: 24301 - RNA, 61 nt, Human
auuggaugaaagucaaagguugucuacuuuaagaaaauaaaauacccugaauggagcccag

SEQ ID NO: 24302 - RNA, 61 nt, Human
uuuuuuguucuguuuuguuuuguuuucuuugagaaaauaaggacuuuguguucauuugaag

SEQ ID NO: 24303 - RNA, 61 nt, Human
cuugugaaucaagggucaggccuuugagcucagaaaauaucccuccuguugggagagggcg

SEQ ID NO: 24304 - RNA, 61 nt, Human
gaauacaauguccuuccauagcaugggaagaagaaaauaaacaucuccuuuccaacagcug

SEQ ID NO: 24305 - RNA, 61 nt, Human
aaagaaacuugcuucccuuagccuuuguucuagaaaauaaacuugugcacuuugaccucug

SEQ ID NO: 24306 - RNA, 61 nt, Human
ccgccugggauuuuguuuugucuguucccuaagaaaauauauuuucauuccugcaaacaca

SEQ ID NO: 24307 - RNA, 61 nt, Human
guacuguaccuaucuucagcaagaaugcaaaagaaaauauuuucaauauauauaccuggaa

SEQ ID NO: 24308 - RNA, 61 nt, Human
ccuacgguaacuagaucuaauauauaucaucagaaaauauauauuguauguuuacucuuau

SEQ ID NO: 24309 - RNA, 61 nt, Human
aaauagaaaacccaacucaaccugcuuaagcagaaaauaaauuuauugauucaaguuugga

SEQ ID NO: 24310 - RNA, 61 nt, Human
ugcggacaauuaguauucaaaguuuauuuucagaaaauaaaauaauaaaagcccaggguau

SEQ ID NO: 24311 - RNA, 61 nt, Human
aaaguggaaugagguaagaagauacagcuacagaaaauaguugcguguaugggagaacagu

SEQ ID NO: 24312 - RNA, 61 nt, Human
gauaucugcacauaaaauuauuauuaccugaagaaaauaaggcugcauuuugaaauguuaa

SEQ ID NO: 24313 - RNA, 61 nt, Human
ucaguucccaauugacaagucacagacugggagaaaauauuugcaaaucguguaucugaca

SEQ ID NO: 24314 - RNA, 61 nt, Human
ucugacuaguucagacugccacgccaaccccagaaaauaccccacaugccagaaaagugaa

SEQ ID NO: 24315 - RNA, 61 nt, Human
aaguugaugagcuucucucuacaacauuucuagaaaauagaaaaaaaagcacagagaaaug

SEQ ID NO: 24316 - RNA, 61 nt, Human
gauaugcuuacuuacuaucaguuuaugauguagaaaauauauuuuguaauuauaagaaaac

SEQ ID NO: 24317 - RNA, 61 nt, Human
acauuuaaaauuuauguuuuaugucaauaaaagaaaauauacuuuauugugacuucaacua

SEQ ID NO: 24318 - RNA, 61 nt, Human
aaauaaggagaaaagagaaugggagagugagagaaaauaaaaaaggcaaaagggagagaga

SEQ ID NO: 24319 - RNA, 61 nt, Human
aaguaaaugauuugggaacugacaaugugucagaaaauauauguucauuuaucauuuuaaa

SEQ ID NO: 24320 - RNA, 61 nt, Human
accaugccccuagaaauaauuccuaaucuuuagaaaauagggcagagaaacauuauuuuac

SEQ ID NO: 24321 - RNA, 61 nt, Human
auucuguuuuuuugugagaacuuaguaaacaagaaaauacucuugagugaaaugcaaugua

SEQ ID NO: 24322 - RNA, 61 nt, Human
aggcagagugugaaaaacgugagagaggaagagaaaauagauuuaccugauuccucuuuaa

SEQ ID NO: 24323 - RNA, 61 nt, Human
auauauaccaguucaaguccuuuuaggaagaagaaaauaccuaauuuauguaaaauuuaaa

SEQ ID NO: 24324 - RNA, 61 nt, Human
accaacuuaauuuucuuccauagcaaaacugagaaaauaccuuguuucaguauaacacuaa

SEQ ID NO: 24325 - RNA, 61 nt, Human
acauuuuacuuuuaauuauguaaauuugguuagaaaauaauaauaaaugguuagugcuauu

SEQ ID NO: 24326 - RNA, 61 nt, Human
aagaaauuucuuacauguauauuucuuauguagaaaauacuguuucuacucauucaaagca

SEQ ID NO: 24327 - RNA, 61 nt, Human
aauacccagagccacuaaaucuuuuuuuacuagaaaauaauugggguccauaugaaagucu

SEQ ID NO: 24328 - RNA, 61 nt, Human
cauuaguaucuguggcuuaaaauggcaaaaaagaaaauauccuugaguuuguaaucuaguu

SEQ ID NO: 24329 - RNA, 61 nt, Human
uuaucuuacaaaguguauuuuauaaaauuaaagaaaauaaaauuaagaauguucucaauca

SEQ ID NO: 24330 - RNA, 61 nt, Human
ucgaaauguuagguaaucauuuagaaaggacagaaaauauuuaaaguggcucauagguaau

SEQ ID NO: 24331 - RNA, 61 nt, Human
auuuaugugugugaauaacaucuuggcaugcagaaaauaauuuuggcugcuuugaacagga

SEQ ID NO: 24332 - RNA, 61 nt, Human
uaccaaggacaauuuauuaaucaauugacuuagaaaauagggggagaaaucauucauugga

SEQ ID NO: 24333 - RNA, 61 nt, Human
aguuuugcaacaguaccuguguuguuauuucagaaaauauuauuucucucuuuuuaacuac

SEQ ID NO: 24334 - RNA, 61 nt, Human
aguuccucauucauuuuuauauugaccacuaagaaaauaauucaucagcauuaucucauag

SEQ ID NO: 24335 - RNA, 61 nt, Human
cccgcuauguggauaacucuucuuuuuaaaaagaaaauagagaauagcaaaucuucaugau

SEQ ID NO: 24336 - RNA, 61 nt, Human
acuuuuaaaaaugacacauauuuaaacacuuagaaaauaaaguuaacacuuacugaagugc

SEQ ID NO: 24337 - RNA, 61 nt, Human
cgagaaaacaauaacgauaaaagacagugaaagaaaauaacgauaaaagacagugaaagaa

SEQ ID NO: 24338 - RNA, 61 nt, Human
gugaaagaaaauaacgauaaaagacagugaaagaaaauaacaauaaaagacaaggaaaaaa

SEQ ID NO: 24339 - RNA, 61 nt, Human
uccaaaaguagccaugcccuuuucucaggauagaaaauauguuuuggcauuugaagcauuu

SEQ ID NO: 24340 - RNA, 61 nt, Human
uuguagcaacaucauaaaaucaagaguaucaagaaaauaaaugagcauagcaaugcuacuc

SEQ ID NO: 24341 - RNA, 61 nt, Human
uaacaugaggcccauucuucacucuguuugaagaaaauagucaguguucuuaguagugggu

SEQ ID NO: 24342 - RNA, 61 nt, Human
ucaucucacaugcauuuuauaguuuuggggaagaaaauaucauggggaggucuaccuucag

SEQ ID NO: 24343 - RNA, 61 nt, Human
caucugauguuucauauuuaaguguauuuaaagaaaauaaacaccauuauucaagccauau

SEQ ID NO: 24344 - RNA, 61 nt, Human
uuguuguauguaaauguuaauuucaugguauagaaaauauaagaugauaaagauaucauua

SEQ ID NO: 24345 - RNA, 61 nt, Human
guaaagaaaucagauacaaacuacugcaauuagaaaauaaaauaugaacaacuuucaacaa

SEQ ID NO: 24346 - RNA, 61 nt, Human
uuccuauaauacagugcuauaagcuaugcacagaaaauaaaauguuugaaauccaagaaua

SEQ ID NO: 24347 - RNA, 61 nt, Human
cagggcuuaugaaauguaauuaaauuuauuaagaaaauagaugaaaaauuaggguacacag

SEQ ID NO: 24348 - RNA, 61 nt, Human
acuugcaucagcugccuccagaacaauuuuaagaaaauaacaaagauguuuagaagaaauc

SEQ ID NO: 24349 - RNA, 61 nt, Human
gagagcccuagaaagcugcugugaucccaguagaaaauaugucccagaaaugucaugagau

SEQ ID NO: 24350 - RNA, 61 nt, Human
uaucacaaaaauggcaacaucuuuuacauaaagaaaauaaguuuguaagugauauuucuua

SEQ ID NO: 24351 - RNA, 61 nt, Human
acuaauaguuuuuugauuaaaaaugugaacaagaaaauacuaaaauaaaaauccuuucgau

SEQ ID NO: 24352 - RNA, 61 nt, Human
aaaaaccaguacccuugagccuuaaucagcaagaaaauaacucuggcucauacaguguaga

SEQ ID NO: 24353 - RNA, 61 nt, Human
guuucaguuuguuuuccguucuguuuuaaacagaaaauaaaaggaguguaagcuccuuuuc

SEQ ID NO: 24354 - RNA, 61 nt, Human
auacauucuuuuugcucuaaaauauuuaugaagaaaauacuuaaauguuauguauauggug

SEQ ID NO: 24355 - RNA, 61 nt, Human
cuauuucagaaguuuaaauauuaagcaugacagaaaauauguauuaacacuacucaaagca

SEQ ID NO: 24356 - RNA, 61 nt, Human
ucuuuuagaauaugggaguaagaugagcuagagaaaauaaccuggucucacugugguugcc

SEQ ID NO: 24357 - RNA, 61 nt, Human
guauuuccuugauugcgguauauguacuacuagaaaauaccaaauggauauauuuucuuua

SEQ ID NO: 24358 - RNA, 61 nt, Human
aguuacuuuucaguuaauuauuccuuuaaaaagaaaauacagcagaaccucacuguagcau

SEQ ID NO: 24359 - RNA, 61 nt, Human
ccaagcccuucccauaaaacacaacugcugaagaaaauagcagacguuuccccucucucua

SEQ ID NO: 24360 - RNA, 61 nt, Human
uaacaacugauggugaaucuuaccgagcuguagaaaauaaaaaauuccucuccaaacaugg

SEQ ID NO: 24361 - RNA, 61 nt, Human
uccaaucacuuaguagccccucaaaguaguuagaaaauaaacagauuuuuccaguguugau

SEQ ID NO: 24362 - RNA, 61 nt, Human
uuuuaucugguucuuaaauguuuguuacuacagaaaauaaaacugcgcuacuauuccaagu

SEQ ID NO: 24363 - RNA, 61 nt, Human
ccaugcugaguuagguaggugggcgcugcccagaaaauauauuucaauaaaagagagaagc

SEQ ID NO: 24364 - RNA, 61 nt, Human
ggaggaggacggcuuacauguuuguuucuguagaaaauaaaacugagcuacgauuccgugu

SEQ ID NO: 24365 - RNA, 61 nt, Human
ggaggaggacggcuuacauguuuguuucuguagaaaauaaagcugagcuacgauuccgugu

SEQ ID NO: 24366 - RNA, 61 nt, Human
aguaccauugucacugcaauaaguggguuuuagaaaauaagugugaaaagaaucagguguu

SEQ ID NO: 24367 - RNA, 61 nt, Human
accaacuugauuuucuuccauagcaaaacugagaaaauaccuuguuucaguauaacacuaa

SEQ ID NO: 24368 - RNA, 61 nt, Human; identical to SEQ ID NO: 24325

SEQ ID NO: 24369 - RNA, 61 nt, Human
uaaacucuggagcccauaauaucuacauaaaagaaaauauaaacugacuaauauugucaag

SEQ ID NO: 24370 - RNA, 64 nt, Human
ucuguguauauauagaagguagaaaugaaaagugagaaaauauuugaaagggauuauauuaauu

SEQ ID NO: 24371 - RNA, 64 nt, Human
aaaugucacguuuccauaucuccugcuggaaaucagaaaauauaauaaaauugcacaaaaaaaa

SEQ ID NO: 24372 - RNA, 64 nt, Human
uuucucuacuguaaagugauuuuguuugcagguaagaaaauaauagaugacucaccacaccucu

SEQ ID NO: 24373 - RNA, 64 nt, Human
guagcuugucuuuuccacaugauuugucugugaaagaaaauaauuuugagaucguuuuaucuau

SEQ ID NO: 24374 - RNA, 64 nt, Human
gauagcauuuauuucugugcccuuaaacccauuuagaaaauaacuacaaaguaaaaauguagag

SEQ ID NO: 24375 - RNA, 64 nt, Human
uuaacccaaaacuuuaauaaugugucuguaaccaagaaaauauugauagcaucauccuaaugaa

SEQ ID NO: 24376 - RNA, 64 nt, Human
ccugagauggaaacagcaacuuguacaguggcugagaaaauaggauauaguuuugauuuuuuua

SEQ ID NO: 24377 - RNA, 64 nt, Human
cagaguugcccagaacccuaaauuuauucauaagagaaaauauugauuaauuauuggucauucc

SEQ ID NO: 24378 - RNA, 64 nt, Human
guggaaauaaaccuuuauguacuuaaaguuauacagaaaauagaauaaaguuaauaccaaacuu

SEQ ID NO: 24379 - RNA, 64 nt, Human
auuguauauaauaguauagucaccaucaagauguagaaaauagaaaauaggcuaggcacagugg

SEQ ID NO: 24380 - RNA, 64 nt, Human
auaauaguauagucaccaucaagauguagaaaauagaaaauaggcuaggcacaguggcucacgc

SEQ ID NO: 24381 - RNA, 64 nt, Human
gaccaagggccauaucccaagugacuuuguacccagaaaauaacagcuguucaauaaaugugua

SEQ ID NO: 24382 - RNA, 64 nt, Human
uaaauugcuagacagucgugccauucacaaagucagaaaauacagcaggaagagacagcuuuua

SEQ ID NO: 24383 - RNA, 64 nt, Human
gacuaagcuaaaaaugaaugaaaaugguggcuaaagaaaauagggacucugaagaugucgaaau

SEQ ID NO: 24384 - RNA, 64 nt, Human
cuuguuuggcuguucauguagucacggugcucucagaaaauauauuaacgcagucuuguaggca

SEQ ID NO: 24385 - RNA, 64 nt, Human
gacaaacuuuuuugacucuuucuggaaaagggaaagaaaauagucuuccuucuuucuugggcaa

SEQ ID NO: 24386 - RNA, 64 nt, Human
aacugagauaauacacaggugauaaacaguuucgagaaaauaaaaauuggcuagaaucucaagu

SEQ ID NO: 24387 - RNA, 64 nt, Human
agaaaguauucaagauguuacaaaauuuacauuuagaaaauauuguaguauuugaauacuguca

SEQ ID NO: 24388 - RNA, 64 nt, Human
gagaacuacuuaaaggaaugguuuuuauguuaggagaaaauacaauacaccacuuuuuucucac

SEQ ID NO: 24389 - RNA, 64 nt, Human
cuuccaguggaaagaaaggaggaagggagaauugagaaaauauauuagucuauuauuuuagagu

SEQ ID NO: 24390 - RNA, 64 nt, Human
auauaauugucauuaaaauaauuuuaaagagugaagaaaauauugugaaaagcucuugguugca

SEQ ID NO: 24391 - RNA, 64 nt, Human
ccaaaugccaugaauugccacuguguguuuauguagaaaauacaaauaaaaguuauuuugaugg

SEQ ID NO: 24392 - RNA, 64 nt, Human
aaacguuggugaaaguuauaaccuccugccugggagaaaauauacaucaccuaaaaugaacuua

SEQ ID NO: 24393 - RNA, 64 nt, Human
agugggcaaaugucauuguuaccucuguguguuaagaaaauaaaaauauuuucuaaaggucugu

SEQ ID NO: 24394 - RNA, 64 nt, Human
uaugaacauuuuucuuuuauuguuuuaucuucacagaaaauaaaagguguuaauuugcuuuuua

SEQ ID NO: 24395 - RNA, 64 nt, Human
gcuuaauguaugauuuucgagcuucuguaugcuaagaaaauaggugugaaaaacugguguucug

SEQ ID NO: 24396 - RNA, 64 nt, Human
aaauuagaaaaccaaaaaucaugaacauucuaagagaaaauaaauauagaauuuaaaaaauuau

SEQ ID NO: 24397 - RNA, 64 nt, Human
aguauaaaauuuuucacugcaaaaaaauuucaguagaaaauaaggaugcagggccaguuacaau

SEQ ID NO: 24398 - RNA, 64 nt, Human
aaaagaaaauguuacuuagaaaaucauaaggaagagaaaauauauuuacuguguuuaucaauac

SEQ ID NO: 24399 - RNA, 64 nt, Human
ggagggcaaauucaccagcaggggcuaggaauuuagaaaauauacuguaauucagacacucagc

SEQ ID NO: 24400 - RNA, 64 nt, Human
ccccaugaaauguaaauacuguaucauaaguagaagaaaauaauuuuuguuuucuaaaaaugca

SEQ ID NO: 24401 - RNA, 64 nt, Human
ggcuaguuaguucuuggagcagcugcuuuugaggagaaaauauauagcuuuggacacgaggaag

SEQ ID NO: 24402 - RNA, 64 nt, Human
uuuguuuuauuuuaucaaacauuaagcuuuuuuaagaaaauaauugggcagugaaauaaaugua

SEQ ID NO: 24403 - RNA, 64 nt, Human
aauuagaggaauuuaaagaggaaaaaaauuacaaagaaaauaauaaaaguguuuguacguuuuc

SEQ ID NO: 24404 - RNA, 64 nt, Human
ucucuauaauagaauucuguuuauagaauaagggagaaaauaauccagucuucacuggguuccc

SEQ ID NO: 24405 - RNA, 64 nt, Human
gcuuaugcuaacccauuuauaauugguaaaaaucagaaaauacaagauuuacauaaaggucauu

SEQ ID NO: 24406 - RNA, 64 nt, Human
acagucuguaguauuugaaggguuugggggagggagaaaauauuaaugggaaaggcauucagaa

SEQ ID NO: 24407 - RNA, 64 nt, Human
auguacauagggaacuuaguucugggccauguacagaaaauaucacuguaauauaccaaaagga

SEQ ID NO: 24408 - RNA, 64 nt, Human
ucccucagccugcacuuacucuucuauuaagaccagaaaauaaaauaauuuuccguugagucac

SEQ ID NO: 24409 - RNA, 64 nt, Human
acuugguauuuuccuggcuuucguuuaauacaauagaaaauaaaguauuacaccgaauacuugc

SEQ ID NO: 24410 - RNA, 64 nt, Human
cauuuugaaucccucuuccucacuuuuuuuucuaagaaaauaaacauuuuacuguuuuuaugga

SEQ ID NO: 24411 - RNA, 64 nt, Human
caaauauugucacaaguaaauagcaaucaaaaggagaaaauaacuuuuguauuuuuuuaaugug

SEQ ID NO: 24412 - RNA, 64 nt, Human
uuaaaggaagaaauauuuucaaauucuuaauccaagaaaauacugaguuggaaucuuagacuuc

SEQ ID NO: 24413 - RNA, 64 nt, Human
gguuaaauuagcauuacuuaaaauuuguuucuuuagaaaauaaaugcagguuauaaaugugugu

SEQ ID NO: 24414 - RNA, 64 nt, Human
cagacuaaggccuccuuucucugaccucccaggaagaaaauagcuucuccuacagugauucaug

SEQ ID NO: 24415 - RNA, 64 nt, Human
uuuuuuucuuguguucuaguuuccauaauaggagagaaaauauagaaauauaugcaaaaauuau

SEQ ID NO: 24416 - RNA, 64 nt, Human
ugggcuugcugacuuagccaaagaagaguuaagaagaaaauacacacaaguauacagacuguuc

SEQ ID NO: 24417 - RNA, 64 nt, Human
aucuagucaggggaaaagacugcauuuaggagauagaaaauaguuuggauuacuuaaaggaaua

SEQ ID NO: 24418 - RNA, 64 nt, Human
cuauggaaagaacgucucauacugacauaaaugaagaaaauauguguaucuaguagagcuuguu

SEQ ID NO: 24419 - RNA, 64 nt, Human
uguacucaaugguaucauuacaauuuucuguaagagaaaauauuacuuauuuauccuaguauuc

SEQ ID NO: 24420 - RNA, 64 nt, Human
aaacagaaaguguauucaaauuuuaucaguuuaaagaaaauaaagcugugauaaauacuguaau

SEQ ID NO: 24421 - RNA, 64 nt, Human
ccuugaaaauguaauuuuccagaaaaacaccuaaagaaaauaaaacauggacaugccuaguaaa

SEQ ID NO: 24422 - RNA, 64 nt, Human
agauugacaaacuuaugauagagauggauggaacagaaaauaaaucuaaauuuggugcaaaugc

SEQ ID NO: 24423 - RNA, 64 nt, Human
acuacagcuauaccucacaauaagaaugaaucucagaaaauauuaaggaaaaaagcaaguuuga

SEQ ID NO: 24424 - RNA, 64 nt, Human
cauauacacaugccuucuauauauuguaacuuaaagaaaauacuuauaaaaagacuucauuuuu

SEQ ID NO: 24425 - RNA, 64 nt, Human
ggagcacuaaaaccaaaauacauguauuauuuauagaaaauauuuucuguuuuaaucuuuucuu

SEQ ID NO: 24426 - RNA, 64 nt, Human
gauagauuuuauuuuuaaguguccucagcauugcagaaaauaacauuguaauagcaaguaaagg

SEQ ID NO: 24427 - RNA, 64 nt, Human
uuuucuuuggggaucacuauagggaauauuguauagaaaauaucuucaagaaaagauaggacca

SEQ ID NO: 24428 - RNA, 64 nt, Human
guuguaaaauuuuggaaaacccuggaaauuauagagaaaauaaacauaaucuauacucccaaca

SEQ ID NO: 24429 - RNA, 64 nt, Human
ccuugcucuuguggagcuuagagguugguggggaagaaaauaggcaugcaccaaggaauuguac

SEQ ID NO: 24430 - RNA, 64 nt, Human
guuuuaucuguuuuauauuuuaaaagauucugccagaaaauaaaaccagaccuuguucuaaagc

SEQ ID NO: 24431 - RNA, 64 nt, Human
ccugaccaauauggugaaacccugucucuacuaaagaaaauacaaaaauuagccgggcguggug

SEQ ID NO: 24432 - RNA, 64 nt, Human
uacuugguuucuuauaaaaugauuaaaugaauagagaaaauauuaauuuucaaggggaaaaaac

SEQ ID NO: 24433 - RNA, 64 nt, Human
ccauucagauaaguggaacuauugaguuacauaaagaaaauagauuugcauuugucaggcagac

SEQ ID NO: 24434 - RNA, 64 nt, Human
guaguuuucagaaaagccuuuggaaaucuggaucagaaaauagauaccaugguuugugcaauua

SEQ ID NO: 24435 - RNA, 64 nt, Human
cugcuggggccucaguuuccccaucuguaacuugagaaaauagaacuagaucuguaaagucugg

SEQ ID NO: 24436 - RNA, 64 nt, Human
ugcagcacaugaugccagaaauagcacugaaucaagaaaauagccauugcggagcugcccucuu

SEQ ID NO: 24437 - RNA, 64 nt, Human
guuuuguuucugaaaauuccagaaaggauauuuaagaaaauacaauaaacuauuggaaaguacu

SEQ ID NO: 24438 - RNA, 64 nt, Human
ggaaauuauuauucauugaagaaugcaguggccaagaaaauaucaaauguagauuguuaacgcu

SEQ ID NO: 24439 - RNA, 64 nt, Human
cugaaagauuggauuuucuauaacaccuuguguaagaaaauaaaaaacuugaucuaacugaaaa

SEQ ID NO: 24440 - RNA, 64 nt, Human
uggauuuuaagcccagacuucaguggacccagauagaaaauauaaagucucugaucuauaggcc

SEQ ID NO: 24441 - RNA, 64 nt, Human
aauguugauuuacuuauaacuagacgucuaugugagaaaauauauguauacauauauaugauau

SEQ ID NO: 24442 - RNA, 64 nt, Human
ugaugugauucaauuuaguuaaaggaugauauagagaaaauacauuauuuagcauuauuucuuc

SEQ ID NO: 24443 - RNA, 64 nt, Human
uuguuaccuuaucaaaugaaauauuacagcaccuagaaaauaauuuaguuuugcuugcuuccau

SEQ ID NO: 24444 - RNA, 64 nt, Human
ucucacuuuuaaaggaacagcuugauugcaaaggagaaaauagauaagcaaugaauuuaucucc

SEQ ID NO: 24445 - RNA, 64 nt, Human
gcucacguauuuaagagccugaauauuccagguaagaaaauauaaaaugagguuuauuuuauuu

SEQ ID NO: 24446 - RNA, 64 nt, Human
aacucauugaaauaaaaacaaagucuaccucugaagaaaauauugggauaaagugaaaguucca

SEQ ID NO: 24447 - RNA, 64 nt, Human
uaaacuauuguuuucuaauugaaauugucuauaaagaaaauacuugcaauauauuuuuccuuua

SEQ ID NO: 24448 - RNA, 64 nt, Human
augcuguuacugagaauaaugaaaaucauauuucagaaaauauuaccauguaaauauguacaua

SEQ ID NO: 24449 - RNA, 64 nt, Human
aaaaggcaagauacaugugaauaaggcaaaagccagaaaauagcccuuauucaugaugcuguua

SEQ ID NO: 24450 - RNA, 64 nt, Human
cauaaugaugaaauuucaacuacauacaaggaggagaaaauaagaacccagucauaacagagga

SEQ ID NO: 24451 - RNA, 64 nt, Human
gcuaagauuaagacaaagaacauaucaaaucaacagaaaauauaccuuggugccaccaacccau

SEQ ID NO: 24452 - RNA, 64 nt, Human
gcaguagaaugaaaugagucagggagcuucaguuagaaaauaaaguugaggcaguuuuugugaa

SEQ ID NO: 24453 - RNA, 64 nt, Human
acuggcuauugcccuauaccugccaaucacccaaagaaaauaauagcuucugagaaagcucaau

SEQ ID NO: 24454 - RNA, 64 nt, Human
uugggaauuuuacagagucaaaguaggcagaauaagaaaauaguucuucaggagggccgaccuu

SEQ ID NO: 24455 - RNA, 64 nt, Human
caggccacuuugucguguuuguuuuaacuucuaaagaaaauauguuucagcauuauaagaaagg

SEQ ID NO: 24456 - RNA, 64 nt, Human
uuauguugguccugaguauuuugcaaaugcacagagaaaauaaaacuaaacuccuuguuuauuu

SEQ ID NO: 24457 - RNA, 64 nt, Human
uauucuggugaugggguuuagcaacuuugauggaagaaaauauuaggcuauaaauguccuaagg

SEQ ID NO: 24458 - RNA, 64 nt, Human
acagaguggagacucuguuucaaaaaaacagaaaagaaaauauaguuugauucuucauuuuuuu

SEQ ID NO: 24459 - RNA, 64 nt, Human
gugucaugauuaauguguauuuacuguacuaauuagaaaauauaguuugaggccgggcacggug

SEQ ID NO: 24460 - RNA, 64 nt, Human
uccaaagacuguuaggcauuugugcuacuuuguuagaaaauacugaguggaauaacuuguuaga

SEQ ID NO: 24461 - RNA, 64 nt, Human
aggcauucugacugguuggcugcccuggaaggcaagaaaauagauuuauuuuuuuucacagggc

SEQ ID NO: 24462 - RNA, 64 nt, Human
auuuuuuuccuuaugcaaaucauacuccugcccaagaaaauacaguaguuccccuuaucugagc

SEQ ID NO: 24463 - RNA, 64 nt, Human
guuuucccaaacuucuucccaucauagcacauguagaaaauaauauuuuuauggcacacuggga

SEQ ID NO: 24464 - RNA, 64 nt, Human
caccuaaauaucaagauggcuauaugcuaaaaagagaaaauauggucaagucuaaaauggcuaa

SEQ ID NO: 24465 - RNA, 64 nt, Human
uauucauaugcuucccagagaagcucauuuaguuagaaaauaaggcaaguuuugaagccugcua

SEQ ID NO: 24466 - RNA, 64 nt, Human
acucuguauuuacaucuguauauacacuaugauuagaaaauaugcaagaaauuguuuuuccaug

SEQ ID NO: 24467 - RNA, 64 nt, Human
gauauuuuaucucauuugagaucaugguagguuaagaaaauaugccuguugaugaaagcuaaaa

SEQ ID NO: 24468 - RNA, 64 nt, Human
auuuuguuuuguuuuguaaaaaugauaaaacuucagaaaauaaaaugucaguguugaauaauuu

SEQ ID NO: 24469 - RNA, 64 nt, Human
gagaugacuauucaguggcuaacuuggguuaggaagaaaauaauuagguauuuucuccaaaugu

SEQ ID NO: 24470 - RNA, 64 nt, Human
augcuucguuaauuuguucagccacaauuuauugagaaaauauucugugucaagcacugugggu

SEQ ID NO: 24471 - RNA, 64 nt, Human
aucuauuauucuccuaaacgaaugccuagcauagagaaaauacuuaauacacauuuguugacuu

SEQ ID NO: 24472 - RNA, 64 nt, Human
uuauuguguuuauauguauaaaaauaggagcaaaagaaaauacucugggaauagucauacugac

SEQ ID NO: 24473 - RNA, 64 nt, Human
uuauuauuagcaugucauuuguacauaaacuaguagaaaauagcaguuuuaaaaguuuucuauu

SEQ ID NO: 24474 - RNA, 64 nt, Human
gaccuacagaguuaauuuccuuuguauuuuuuuaagaaaauauuaaaaaucaacggucucaaau

SEQ ID NO: 24475 - RNA, 64 nt, Human
uuuuuaaacuuaaaagccuagaaauuuccuagaaagaaaauaggagacaucucagagcaauuug

SEQ ID NO: 24476 - RNA, 64 nt, Human
ucugaaauaauugugcacaucuggcagugacuguagaaaauacgaaauauauauuucucgccaa

SEQ ID NO: 24477 - RNA, 64 nt, Human
ucagaaauuggcacaucccuuuaaaaauaacaacagaaaauacaacuccugggaaaaaaggugc

SEQ ID NO: 24478 - RNA, 64 nt, Human
uuugaauaaauauaaaaugaauaacuauuaagguagaaaauauucucagaacauucuagaggag

SEQ ID NO: 24479 - RNA, 64 nt, Human
cagugauuuauauuuaguuauuauauuuaggaauagaaaauagaauuaaauaauuuaacuugau

SEQ ID NO: 24480 - RNA, 64 nt, Human
gagaaucauuuaagaguuccuguaacaguuaugcagaaaauacuaaaacccaucaggcaagauc

SEQ ID NO: 24481 - RNA, 64 nt, Human
uuuuuaaaaaccgaauuucaucauuuaucuaaagagaaaauaugcagaauaacuggucuuguua

SEQ ID NO: 24482 - RNA, 64 nt, Human
auucuuaaaauuuuuucccaccaagguauuccaaagaaaauauuaaggucuccccuuuuucuau

SEQ ID NO: 24483 - RNA, 64 nt, Human
agaauaguguggauuauuaaauaucuaguuuggaagaaaauaauuuauauaaauuauuguaaau

SEQ ID NO: 24484 - RNA, 64 nt, Human
cugaaaggagugugcucaugccauuuccagaccaagaaaauacauuuauuauuugcuaauuauc

SEQ ID NO: 24485 - RNA, 64 nt, Human
aauuacuuggaaugguguguuuuacagucuaccuagaaaauagauggacaauauuuuucaacug

SEQ ID NO: 24486 - RNA, 64 nt, Human
guugggagcucuccaaagaaacugguugguuuuaagaaaauaguuucaagaaguucaacuauau

SEQ ID NO: 24487 - RNA, 64 nt, Human
uaauacuucauuguguuguacuggaugcaaagcuagaaaauauugcaauaaaugagaccgauga

SEQ ID NO: 24488 - RNA, 64 nt, Human
uguacacuuuuaguagucauagugaagcaggucuagaaaauaagccuuuggcagggaaaaaggg

SEQ ID NO: 24489 - RNA, 64 nt, Human
uuugucguguaagaaggaugcuggucagagcugcagaaaauaugaggcaauuaaaagucuuuag

SEQ ID NO: 24490 - RNA, 64 nt, Human
aacugccuuccacaauuaaagaauacucauagaaagaaaauaaucauaaaucauauuugauuaa

SEQ ID NO: 24491 - RNA, 64 nt, Human
ugcccagccucaaaaauauuuuuuaaaagaaaagagaaaauaauucuucugucaaaggagguua

SEQ ID NO: 24492 - RNA, 64 nt, Human
cacucccaccccagccaaaaauauauaaaaaacaagaaaauaacaaauuaaccgcaaacuauca

SEQ ID NO: 24493 - RNA, 64 nt, Human
gucuaaauuaacaugaaauacuucauuuugauugagaaaauaaaaucagauuuuuucaaaguca

SEQ ID NO: 24494 - RNA, 64 nt, Human
uucuaugcauaugcguaagaacauuuuaaagccaagaaaauaucugucaaaccauuucuguuag

SEQ ID NO: 24495 - RNA, 64 nt, Human
cuuccuuucuccuuuuuacaaaaacaaacauagaagaaaauaaaugcacuuuauccacucccca

SEQ ID NO: 24496 - RNA, 64 nt, Human
auaagucccuuuuuguauguguuuuuauacuuuuagaaaauaaaaacuuuagauuaacucauag

SEQ ID NO: 24497 - RNA, 64 nt, Human
aaaccuaccucaggguugcuucaaggauuaaaugagaaaauaugucaacaauaaagaccugucu

SEQ ID NO: 24498 - RNA, 64 nt, Human
cucuuguuacauuguguacauucaaaaggaagagagaaaauauauaugauaaucauuuccacuu

SEQ ID NO: 24499 - RNA, 64 nt, Human
gcaauuuaaacucccaguuguuuauuuucacaaaagaaaauaaaauugcaguugcaagaccuuu

SEQ ID NO: 24500 - RNA, 64 nt, Human
gauuccaaguaaaugucuuaauacaguuucaauuagaaaauaaaaugucucauacuugcacauu

SEQ ID NO: 24501 - RNA, 64 nt, Human
accccuaagauuucccagugguccgagcagaaucagaaaauacagcuacuucugccuuauggcu

SEQ ID NO: 24502 - RNA, 64 nt, Human
augucuagguucuguauuuuuuucuuaaauagcaagaaaauacagauugcuaguauagucaaca

SEQ ID NO: 24503 - RNA, 64 nt, Human
agugcaauucuuucauugucuauuauuaugcuuaagaaaauauucaguuaauaaaaaacagagu

SEQ ID NO: 24504 - RNA, 64 nt, Human
cuuuuuuccaauuuuagaaaaucaagcagguuagagaaaauagagaugaauuaggggacacugu

SEQ ID NO: 24505 - RNA, 64 nt, Human
caaauguuucugaagaauuuucaauguuguauauagaaaauacagaauuucauggugauaucag

SEQ ID NO: 24506 - RNA, 64 nt, Human
uauaggugauauucucuuugaauaaaccuauaauagaaaauagcagacaacauaaacaucuuug

SEQ ID NO: 24507 - RNA, 64 nt, Human
augccaagauucuuaaauuugccagcguuaaaguagaaaauaacauuucagaagagcacaauau

SEQ ID NO: 24508 - RNA, 64 nt, Human
aguggaggaaaguuaaaaagaugagcaauagaguagaaaauauaucuuaaacuaguugaccuag

SEQ ID NO: 24509 - RNA, 64 nt, Human
uuuguuuaaaacucugguaauuacuuguaacaguagaaaauagaagucauucuuauuuuagaaa

SEQ ID NO: 24510 - RNA, 64 nt, Human
agcauguggucuuuuuaaaaaauuguaacccucuagaaaauaucaaagaaaugaaccagacgug

SEQ ID NO: 24511 - RNA, 64 nt, Human
aguauguauauuuuguaaaucucccauuuuuguaagaaaauauauauuguauuuauacauuuuu

SEQ ID NO: 24512 - RNA, 64 nt, Human
aaacuaauucuuggucuauacuaagauguauuugagaaaauacauuugauuugauuuuguggcc

SEQ ID NO: 24513 - RNA, 64 nt, Human
ucaucuuuguggauggugucuccuuuacuaaauaagaaaauaacaaagcccuuauucucuuuuu

SEQ ID NO: 24514 - RNA, 64 nt, Human
aaccuucaggaacaccaguuaggaaaauagcuccagaaaauauagauauauuuuauuuuuauua

SEQ ID NO: 24515 - RNA, 64 nt, Human
uaucuaauuuuuuuauggaccauaaagguuuaaaagaaaauaggggcacaggcuguugagguuu

SEQ ID NO: 24516 - RNA, 64 nt, Human
aguuaaauaauaauaguuaaugaaggugugcuacagaaaauaaucugguguucuugcuaacuuu

SEQ ID NO: 24517 - RNA, 64 nt, Human
uuuuaaaauaucuuuugaccuguggugcaaaagcagaaaauacagcuggauuggguuaugaaua

SEQ ID NO: 24518 - RNA, 64 nt, Human
guuuaguuuggguucauuucuauaacauuuuguaagaaaauaaaaguuugagcaccugauuaua

SEQ ID NO: 24519 - RNA, 64 nt, Human
acuuuuucuuuuuuacggaauucaucaucagagaagaaaauaacaaaaauggaagcaaacaaca

SEQ ID NO: 24520 - RNA, 64 nt, Human
acacacacacaauacaagacauuuuuccuguuuuagaaaauauagcccuuguuuggauuacugc

SEQ ID NO: 24521 - RNA, 64 nt, Human
uuugagcauggguucauccuauucuuucgaaagaagaaaauaucauaaaaaugagugauaaaua

SEQ ID NO: 24522 - RNA, 64 nt, Human
cagccacggaaaccgugacaacugccaugucacaagaaaauaccugccagucaacagguaccuc

SEQ ID NO: 24523 - RNA, 64 nt, Human
uuaccggaguagggggugggagagggaagaggagagaaaauacagggacuuugaaccuaggcca

SEQ ID NO: 24524 - RNA, 64 nt, Human
auuacuguguaaagacuugaagggacagaagugaagaaaauaagcugcaauuuuguacagauac

SEQ ID NO: 24525 - RNA, 64 nt, Human
auuauacuauugagaaaucuauggggaggauaugagaaaauaaauuccuucuaaaccacauugg

SEQ ID NO: 24526 - RNA, 64 nt, Human
aggcugacaauaagguuugacagaggggaacagaagaaaauaauaugauuuauuagcacaacgu

SEQ ID NO: 24527 - RNA, 64 nt, Human
uguauauuaacuuuuuucuauuuaucuuuauuauagaaaauaccuuagaauguucuugauagag

SEQ ID NO: 24528 - RNA, 64 nt, Human
ugggaucuuuagaaaacuucauacuguaugaauaagaaaauaaaauauuugaaacuugcuugaa

SEQ ID NO: 24529 - RNA, 64 nt, Human
accaggaacuauaaaaacaaaaacuuguuacuaaagaaaauaucugaaaugugauaaguucuua

SEQ ID NO: 24530 - RNA, 64 nt, Human
uuagauuuauuuuucuuacuccacuaaacuauaaagaaaauaauuacuuagaaacuccauuuua

SEQ ID NO: 24531 - RNA, 64 nt, Human
cauauaugauacaaauccugcaaaagacaucaugagaaaauaccagcaguaucuaucaugaaug

SEQ ID NO: 24532 - RNA, 64 nt, Human
aaaaaaaaaaaaaaaaagaaagaaauagcauugaagaaaauaccgcacaucagaggaaagcuua

SEQ ID NO: 24533 - RNA, 64 nt, Human
uaagguugaaucauuuuauuaaaaauacuuuuuaagaaaauaacuaugaacaucugaauauuaa

SEQ ID NO: 24534 - RNA, 64 nt, Human
acaaaaacagagucgcuuuugccuuuucaaaucaagaaaauaagugcucugucaaaagcacaaa

SEQ ID NO: 24535 - RNA, 64 nt, Human
aauuucaugggacuuuaaaaagaauaaguauuugagaaaauaucugguucacuuacacuacauu

SEQ ID NO: 24536 - RNA, 64 nt, Human
caagcucucccuagcuucacaucuuguguuuuccagaaaauaaaaacagcagacuguccuuucu

SEQ ID NO: 24537 - RNA, 64 nt, Human
uggcgagugcuuucuguauuuaaauauuguaaaaagaaaauaaguuauaacuguuauaaagcag

SEQ ID NO: 24538 - RNA, 64 nt, Human
aaauucuaaaagauaaguguguuugcaaaaaaaaagaaaauaaauacauaaaaaagggacaagc

SEQ ID NO: 24539 - RNA, 64 nt, Human
acccauuucacaaaagauggaauuugcccuuccuagaaaauaugacggagaaaagucugacuca

SEQ ID NO: 24540 - RNA, 64 nt, Human
uaauucuaugcaaaaucauagccaaaacuaguauagaaaauaauacgaaacuuuaaaaagcauu

SEQ ID NO: 24541 - RNA, 64 nt, Human
auuuuacagagaaucugaagcuauugauguuuccagaaaauauaaaugcaugauuuuauacaua

SEQ ID NO: 24542 - RNA, 64 nt, Human
ugcuuuuccagacacaaggcugcuaaaccaauuaagaaaauaauuaauuucuuucaagcaacua

SEQ ID NO: 24543 - RNA, 64 nt, Human
uaugauuucauauccugagauagcucugcagauaagaaaauauuuaaauauaugacaaaaagua

SEQ ID NO: 24544 - RNA, 64 nt, Human
acuaacagcaacuccaucacuugagaaguauaauagaaaauagcuucuaaaucaaacuuccuuc

SEQ ID NO: 24545 - RNA, 64 nt, Human
uuguugcuguuuuuuugucuuuuuguuuuuuacuagaaaauaguucaguguaauauuaaguuag

SEQ ID NO: 24546 - RNA, 64 nt, Human
caaaaacaaacaacaacaacaaaauuauaaagguagaaaauaaaccuaaauugugucguaauua

SEQ ID NO: 24547 - RNA, 64 nt, Human
ugauugcugcuauucuggaauguguccauugaaaagaaaauaggcgcuuugucuccuacaaucu

SEQ ID NO: 24548 - RNA, 64 nt, Human
acuguaugaaaacaggaaaauaaaagagaaauuuagaaaauacagcucauuacaauaaaauugu

SEQ ID NO: 24549 - RNA, 64 nt, Human
aagaugagauacuacacucauuuaaauauuuuuaagaaaauaaaaagcuuaagaaauuuaaaau

SEQ ID NO: 24550 - RNA, 64 nt, Human
agucacauuuuucuacuauuugaccaaaaggaaaagaaaauaaagaagaacucuggaguggucu

SEQ ID NO: 24551 - RNA, 64 nt, Human
cauguuaugccuguugcaggcaaauguaaagucuagaaaauaaugcaaaugucacggcuacucu

SEQ ID NO: 24552 - RNA, 64 nt, Human
aaaaucacacaguuuucaggcuccaucuguuuggagaaaauacauucugaagcauccccaauuc

SEQ ID NO: 24553 - RNA, 64 nt, Human
accuuucaaacugguuuguauuuauuucaaaggaagaaaauauauugauucuuagaaaauaaac

SEQ ID NO: 24554 - RNA, 64 nt, Human
auuuauuucaaaggaagaaaauauauugauucuuagaaaauaaacugucaauuuagaauucuuu

SEQ ID NO: 24555 - RNA, 64 nt, Human
ugauaauagcauuuuuguaacuugccauccgcacagaaaauacgagaaaaucugcauguuugau

SEQ ID NO: 24556 - RNA, 64 nt, Human
uaucguucagucucuuguggcaauagcacuuugaagaaaauagagaauuuaauauauggugauu

SEQ ID NO: 24557 - RNA, 64 nt, Human
aauguacauuccacauuuuaauaaauuaaccacaagaaaauaaucccacauauacaaggucagg

SEQ ID NO: 24558 - RNA, 64 nt, Human
uagacucccuuugcuggcuugugcagugauacugagaaaauacaugaacagaaacugcccaggu

SEQ ID NO: 24559 - RNA, 64 nt, Human
uaacuuauuggggauaaacacuucaacuuuuggcagaaaauacuuuggauucuccccaagguca

SEQ ID NO: 24560 - RNA, 64 nt, Human
aaccuuuguuuaguaauagguaggaaaaugaagaagaaaauagaauguugcagaauguggaggg

SEQ ID NO: 24561 - RNA, 64 nt, Human
aagcauagagagguaagcauuaguggcacagcugagaaaauauaaaagguaguucugucucuau

SEQ ID NO: 24562 - RNA, 64 nt, Human
aaaaugaaaauguaguaguacaaccaguuguagcagaaaauauuccuguaauaccacugaguga

SEQ ID NO: 24563 - RNA, 64 nt, Human
uaauucuacuucuaagaaucauacucuacuucuaagaaaauaauuagaaguagacaaagauuaa

SEQ ID NO: 24564 - RNA, 64 nt, Human
uucuuauguaugugaaaguuacaaauugcuugaaagaaaauaugcaucuaauaaaaaacaccuu

SEQ ID NO: 24565 - RNA, 64 nt, Human
gcugcaaaaaagggacacaccccacuucgguaaaagaaaauagggaaaggccauaaacaaagac

SEQ ID NO: 24566 - RNA, 64 nt, Human
agaagugaggucauccuugaaaaguggcagaaaaagaaaauagcagagauggguccagugcagu

SEQ ID NO: 24567 - RNA, 64 nt, Human
agauuuauggaggaauuagucacaaaugacuuguagaaaauacugucauauaguucauuucauc

SEQ ID NO: 24568 - RNA, 64 nt, Human
cauuuacuuucaaaaauaagcuagaauauauuaaagaaaauagaaaaaauuaccuuaaauauau

SEQ ID NO: 24569 - RNA, 64 nt, Human
aaauuuaauguguuuaaauugguggggcaccagcagaaaauauucuagcucagcuuuacucuuc

SEQ ID NO: 24570 - RNA, 64 nt, Human
uuuuucuuucuuucuaaaauagauuggucugagaagaaaauaaguaauuugaggccauuuggaa

SEQ ID NO: 24571 - RNA, 64 nt, Human
uggccagcaguccugaauccuuccugaagaguucagaaaauagaugugguauugcucugaggac

SEQ ID NO: 24572 - RNA, 64 nt, Human
gguguggcuaugaggauugauugggcugauguguagaaaauauguaaugcagggcuuguccugg

SEQ ID NO: 24573 - RNA, 64 nt, Human
ccuuauggucccuuaucuccuaucuucccucuugagaaaauacacgcuuucugcauguauuaga

SEQ ID NO: 24574 - RNA, 64 nt, Human
uguggagaaguucuguaugugaggaaggaaaaaaagaaaauaaaaguguguuugaaaaauauua

SEQ ID NO: 24575 - RNA, 64 nt, Human
cuuuaacuuucuaguuuagaaaaaaaucaaaccaagaaaauagugaguuaaaaaaauaauagaa

SEQ ID NO: 24576 - RNA, 64 nt, Human
aucaaugaaagcaauuuuaugugugccugaagcaagaaaauagcguuuuugguuuuaucucaua

SEQ ID NO: 24577 - RNA, 64 nt, Human
ucuuuauccuuaauugugacuaagauggaaaucuagaaaauauucaugcuucuaaguuucugca

SEQ ID NO: 24578 - RNA, 64 nt, Human
auugcuagauuacccaaagaaauagaucaguuggagaaaauacaaaacaauucaaagcucuuaa

SEQ ID NO: 24579 - RNA, 64 nt, Human
agcuagguauuuaucaacugcagauguuauugaaagaaaauaaaauucagucucaagaguaaac

SEQ ID NO: 24580 - RNA, 64 nt, Human
ucuuaaaauaucuuccuuuggggaaguuuauuugagaaaauauaauaaaagaaaaaaguaaagg

SEQ ID NO: 24581 - RNA, 64 nt, Human
aucaagaaggugaaaagauaaccugcagaaugggagaaaauauuugcgagucauauauaugaua

SEQ ID NO: 24582 - RNA, 64 nt, Human
gacaaguuauuccaugugaugcuugugagaauugagaaaauaugcauggaaauauccagaugaa

SEQ ID NO: 24583 - RNA, 64 nt, Human
uguacuaaggagaaaugacuuuuauaacauuuugagaaaauaauaaagcauuuaucuaaagauu

SEQ ID NO: 24584 - RNA, 64 nt, Human
uucacaauucuaauaaccuucccucaaaaugcagagaaaauauaaguugucucuuuauauaaau

SEQ ID NO: 24585 - RNA, 64 nt, Human
ggaugagagguuggaaauguagcugcuuuucuuuagaaaauauguagcugucaucauuugguac

SEQ ID NO: 24586 - RNA, 64 nt, Human
gagguuucuuucuuucucuguaaucugcuaugaaagaaaauaacaaaugaaaauaaauguguac

SEQ ID NO: 24587 - RNA, 64 nt, Human
caggguugggugcuuauuuaucuguuugccaugcagaaaauaucuugcacaaaauuaccucugu

SEQ ID NO: 24588 - RNA, 64 nt, Human
ucuaaaccuacgagggaggaacaccugaucuuacagaaaauaccaccucgagaugggugcuggu

SEQ ID NO: 24589 - RNA, 64 nt, Human
uguuccuuuggccaaaagcugaagggaguuacugagaaaauaguuaacaauuacugucaggugu

SEQ ID NO: 24590 - RNA, 64 nt, Human
uagaauugaggaauauuuauuaaaauaccuguaaagaaaauagugaaucacuguagcaauggcu

SEQ ID NO: 24591 - RNA, 64 nt, Human
cuuaccagcauuuguguuagccagcucacagagaagaaaauaacuugcaguaguuuuauaauaa

SEQ ID NO: 24592 - RNA, 64 nt, Human
cccuuucuccacuauagccaacacucagucaagcagaaaauacaaauccccccaaaacuuugag

SEQ ID NO: 24593 - RNA, 64 nt, Human
agaaaaucuuagaguaaauuuuagucuuaaagccagaaaauaaguuuauagccaucuagauauu

SEQ ID NO: 24594 - RNA, 64 nt, Human
cagcuaguucucugaagaacugauguuauuacaaagaaaauacaugcccaugaccaaauauuca

SEQ ID NO: 24595 - RNA, 64 nt, Human
uuuuauugcaggucaauauaauacugccagagacagaaaauacccccuuaucagucccuuagug

SEQ ID NO: 24596 - RNA, 64 nt, Human
gcugcagauuuuuugaguucccaauacguuucauagaaaauaaguaagaacuauuuuuaaaaua

SEQ ID NO: 24597 - RNA, 64 nt, Human
agauuuuagccuuucuccagaacuaaggcauuaaagaaaauagcaaauauuaaaaaauaaaacu

SEQ ID NO: 24598 - RNA, 64 nt, Human
uuaaaagucagauggaaagagcaacugaaguccuagaaaauagaaauguaauuuuaaacuauuc

SEQ ID NO: 24599 - RNA, 64 nt, Human
aaaccucaggauguuucagccaaacaagaagagaagaaaauauuguugaaauuaacaaugauca

SEQ ID NO: 24600 - RNA, 64 nt, Human
uguauaauuuuuauuaacuuugagauucuuauacagaaaauaguugcaaggguaagguaauuaa

SEQ ID NO: 24601 - RNA, 64 nt, Human
uguuuuugcuuuguuuccuuuuuuagaaaguucuagaaaauaggaaaacgaaaaauuucauuga

SEQ ID NO: 24602 - RNA, 64 nt, Human
aaaaugucuugcaaugugcuguaaucacaagaggagaaaauaacuuguuuccuugaucugucag

SEQ ID NO: 24603 - RNA, 64 nt, Human
uuuaaacccaccauguauggaagagcaagaaaagagaaaauauuaaaacgaggagagagaaaaa

SEQ ID NO: 24604 - RNA, 58 nt, Human; identical to SEQ ID NO: 23463

SEQ ID NO: 24605 - RNA, 64 nt, Human
ugcaucauaaaacaaaucccucauccugacaggaagaaaauagaacagcucauagcucgagccg

SEQ ID NO: 24606 - RNA, 64 nt, Human
gaaaacuuuggauauuauauguuucugggagaagagaaaauacuucaccuauugggaugccaau

SEQ ID NO: 24607 - RNA, 64 nt, Human
uucuguaauaugaacuaggaacgcauuuacuaugagaaaauauggcucuuaagcaguguaagag

SEQ ID NO: 24608 - RNA, 64 nt, Human
agagaauauuuuaaguauugcaucuguauaaguaagaaaauauuuugucuaaaaugccucagug

SEQ ID NO: 24609 - RNA, 64 nt, Human
ucggcugcaugagauaaucacuugggagcuuuggagaaaauagcaguaccaagggaucucacca

SEQ ID NO: 24610 - RNA, 64 nt, Human
accaucaaugccuaugaauucuucuaauacgugaagaaaauaguuugaguagcagcagugcuau

SEQ ID NO: 24611 - RNA, 64 nt, Human
aacauuauaaauguaauuucuguugaaagacuucagaaaauauaggccuuuaaagugaagaaga

SEQ ID NO: 24612 - RNA, 56 nt, Human; identical to SEQ ID NO: 23471

SEQ ID NO: 24613 - RNA, 64 nt, Human
gcagugauauaguauagauaaaagaaugaguaaaagaaaauacaagaauucuaaagaaaguugg

SEQ ID NO: 24614 - RNA, 64 nt, Human
ugaagcacacauaccuuuauuuugggaauuuaugagaaaauauagaaaaccacagaucagggau

SEQ ID NO: 24615 - RNA, 64 nt, Human
uugcauuaaauuuaagauaugcaaauuuauguagagaaaauaaauguuauauacccuauaaucu

SEQ ID NO: 24616 - RNA, 64 nt, Human
acugcaguagguuaaaauucuauuaaacaaauauagaaaauauuuuguuuauaauuggccuggu

SEQ ID NO: 24617 - RNA, 64 nt, Human
cgucgagauuacaaugcucuagaaucagcauauaagaaaauaaaugauaucugcauguugaauu

SEQ ID NO: 24618 - RNA, 64 nt, Human
auauccauuuucaaggugcagaacaaggagugaaagaaaauauaagaagaaaaaaauccccuac

SEQ ID NO: 24619 - RNA, 64 nt, Human
uuauacauguuauuaaacucuuuaaauaugucauagaaaauaauacaaucauguaaugagucuu

SEQ ID NO: 24620 - RNA, 64 nt, Human
auaaauauuaauuuuuccacuucaguuuuauucuagaaaauacccuuuuuagaaauccaguuuu

SEQ ID NO: 24621 - RNA, 64 nt, Human
uuuuugacagacuauuugcuaauguauaaugugcagaaaauauuuaauaucaaaagaaaauuga

SEQ ID NO: 24622 - RNA, 64 nt, Human
gcuuugauaauuguguaccuuaagauauugaaggagaaaauagauaauuuacaagauauuauua

SEQ ID NO: 24623 - RNA, 64 nt, Human
gcuuaaaaaguuaacaugauacgaaacugugauuagaaaauaucuggucuggaugugauuagua

SEQ ID NO: 24624 - RNA, 64 nt, Human
aacauugaaaaaucguacagucauuucaagaauaagaaaauaaaauuuucucuuugucugaacc

SEQ ID NO: 24625 - RNA, 64 nt, Human
ugauuuugcagcucuguuuuucugcacacucaauagaaaauauugugggucugagaugcccuuu

SEQ ID NO: 24626 - RNA, 64 nt, Human
ucacagaugacugcaaguucagggagcguuuucaagaaaauagcuauaauaccuaugccucagc

SEQ ID NO: 24627 - RNA, 64 nt, Human
uugguggcugggauaugauggguuagaagcaaggagaaaauauaaggacuuuuugauggaauua

SEQ ID NO: 24628 - RNA, 64 nt, Human
aauuucaaaauuuaaagccaugcuaaaauuaaaaagaaaauauuaaauuacacaauuacacuug

SEQ ID NO: 24629 - RNA, 64 nt, Human
ucuuuaagguaaacaaagcuaacugucgacuaccagaaaauacuuucaacauaaaugaacucuc

SEQ ID NO: 24630 - RNA, 64 nt, Human
agauuugaauguuuuaagauaggagagacuuagcagaaaauacuuggcuugccagggccacguu

SEQ ID NO: 24631 - RNA, 64 nt, Human
aaaaugguuggguguguccuuucuggugaccaugagaaaauaauaugucuugaugaagucuuuu

SEQ ID NO: 24632 - RNA, 64 nt, Human
gucauggugccuaaaaugccagcuauugccaagaagaaaauaguugaugucugucaauaacugu

SEQ ID NO: 24633 - RNA, 64 nt, Human
aaguauauuuuagaaauuuguuaaugagaguaaaagaaaauaaauguguauagcucaguuugga

SEQ ID NO: 24634 - RNA, 64 nt, Human
gacacgaagaaaguacauauguuaacuauaaugcagaaaauauauuaauuaaugaaacugucuc

SEQ ID NO: 24635 - RNA, 64 nt, Human
acugucuuuuauuauaggauuaguaagauauacaagaaaauaaccaccguguugugaaaaagug

SEQ ID NO: 24636 - RNA, 64 nt, Human
uaugguuagacaugcuugaccaaaaauguucagaagaaaauauguaccuggucccuaauuaagc

SEQ ID NO: 24637 - RNA, 64 nt, Human
guagauaaugcuaauacaaauauacacauugcacagaaaauacacauuuacuguccaauuuaaa

SEQ ID NO: 24638 - RNA, 64 nt, Human
uagcagcauauuaguaugcuguuuuauuugcugaagaaaauacugucuucuauuuuuaaugaua

SEQ ID NO: 24639 - RNA, 64 nt, Human
guauuuauuuuacauuuaaauucccacagcaaauagaaaauaauuuaucauacuuguacaauua

SEQ ID NO: 24640 - RNA, 64 nt, Human
aaauuuugcuuuuugaagcuguauuuuuaaguuaagaaaauauauuuuugguauaacuuuuaug

SEQ ID NO: 24641 - RNA, 64 nt, Human
aaaucacucacgguuuugaaaguucaaaccacagagaaaauauuuauaacaugcaaaaaauaaa

SEQ ID NO: 24642 - RNA, 64 nt, Human
ucaaacaaaacagauaugcuuacucuaguuaaaaagaaaauaaaucucaugucagacccagaaa

SEQ ID NO: 24643 - RNA, 64 nt, Human
auagaaacaaugguuccuuaguuuugcacugggaagaaaauauuuuguaaaagaauguuuauuu

SEQ ID NO: 24644 - RNA, 64 nt, Human
ggauagauuuuuggaacgaaaaaggguaaguauaagaaaauauugcaaacacauuaaaacaguu

SEQ ID NO: 24645 - RNA, 64 nt, Human
aguaugaucaucuaaugaaagccaguuacaccucagaaaauaugauuccaaaaaaauuaaaacu

SEQ ID NO: 24646 - RNA, 64 nt, Human
gaaauuuacagugauagaacaaaagaggauuaguagaaaauacauuauuagaauauaaaaaaug

SEQ ID NO: 24647 - RNA, 64 nt, Human
uuguauuuuuuuucuaaauguacauaauuagaaaagaaaauaacaauaggaagcuauguguauc

SEQ ID NO: 24648 - RNA, 64 nt, Human
ugccauaaaauaacaauguuuccaaaugcaacuaagaaaauacucauagugaguacgcucuaug

SEQ ID NO: 24649 - RNA, 64 nt, Human
cagaauugaccuuaauuuguuuuccagaaucaaaagaaaauaaaauauaaauuuugaaacuaug

SEQ ID NO: 24650 - RNA, 64 nt, Human
ccugucucaaaaaaaaaaaaaaaaaaaggagagaagaaaauaaagaaggcuaauauauaauuuu

SEQ ID NO: 24651 - RNA, 64 nt, Human
uacaguuucuagcauuaaacaaauaaacaaggggagaaaauaaaacucaaggacugaaaaucag

SEQ ID NO: 24652 - RNA, 64 nt, Human
ugcaucgcuauucuuucaccugucaauauuaauaagaaaauagucucaucucacuuaaaugagg

SEQ ID NO: 24653 - RNA, 64 nt, Human
gcaacagggaaaaaaucucaucuucuuuuccaguagaaaauaguuugugaaaugaugagggcau

SEQ ID NO: 24654 - RNA, 64 nt, Human
cccaugaaaacccuagacuugugaccugaaauaaagaaaauacguuagaagagcacuguagaaa

SEQ ID NO: 24655 - RNA, 64 nt, Human
uuguucuuccugauaugauaacuaggucuccaagagaaaauagaaaggcugcuuuagugccuua

SEQ ID NO: 24656 - RNA, 64 nt, Human
accucacagccucguagagcuucacagcuacuccagaaaauaggguuaugugugucauucauga

SEQ ID NO: 24657 - RNA, 64 nt, Human
cacaaggcuauuugccagcauauauuaauauuuuagaaaauauuccuuuuguaauacugaauau

SEQ ID NO: 24658 - RNA, 64 nt, Human
aucaugguguuuauuuucuuucuuauaacugcagagaaaauauccugacuaaaaaaaauucauu

SEQ ID NO: 24659 - RNA, 64 nt, Human
ucuuguuuuaagaaacugcuuaguccaccacugaagaaaauauccagaaauuauuuucauuuua

SEQ ID NO: 24660 - RNA, 64 nt, Human
agcaugcucaugaccaacacauacacgucauagaagaaaauaguggugcuucuuucugaucucu

SEQ ID NO: 24661 - RNA, 64 nt, Human
ggaaaacagagcagugaccacuuccuguaaguaaagaaaauauaauccuauauugagcuucagu

SEQ ID NO: 24662 - RNA, 64 nt, Human
guuuguguucagaagauguuguuuugccaguauuagaaaauacugugagccgggcaugguggcu

SEQ ID NO: 24663 - RNA, 64 nt, Human
ggugacuuucuuuuuuuguaaagcaaauuacuuaagaaaauacaauucacuugaauuugacaaa

SEQ ID NO: 24664 - RNA, 64 nt, Human
aaaugugugcuuuauaguguuuacuaaagugacaagaaaauauaccauuugacacacuauagau

SEQ ID NO: 24665 - RNA, 64 nt, Human
ggagcacucugucuucuuugcuagagaaguggagagaaaauacaaaagguaaagcaguugagau

SEQ ID NO: 24666 - RNA, 64 nt, Human
auuugcuuugaguuuuuauauuccuuacacaaaaagaaaauacauaugcagucuagucagacaa

SEQ ID NO: 24667 - RNA, 64 nt, Human
cagauuuuuguauagcugauaagauucucuguagagaaaauacuuuuaaaaaaugcagguugua

SEQ ID NO: 24668 - RNA, 64 nt, Human
uaacaccuuuugcauuauuucuuauguuuugaaaagaaaauagcuuuuuauacuuuuuaguuuu

SEQ ID NO: 24669 - RNA, 64 nt, Human
uagaacaugagauacucuuuguuuuguacauacuagaaaauacagcuaucuucugaugagcaau

SEQ ID NO: 24670 - RNA, 64 nt, Human
ccauaguguucuguguaguuauugcuuagucugcagaaaauaaugacuuagaugagaugucuga

SEQ ID NO: 24671 - RNA, 64 nt, Human
agaaaugugaaaggaccuuuugucacagcacuucagaaaauacacaacagccccuucugccccc

SEQ ID NO: 24672 - RNA, 64 nt, Human
guauuuugucuuuguaauuuacagaaguuauuggagaaaauaaacuuguuucauuuugcauuuc

SEQ ID NO: 24673 - RNA, 63 nt, Human
aaaagaaaauggagaaaugaaauauuuuaugaaagaaaauaauaacaauuauucaauaaucua

SEQ ID NO: 24674 - RNA, 64 nt, Human
aacauccuucaagucugugguuuugaugcagagaagaaaauaguuuugauuuuugaguuuuuaa

SEQ ID NO: 24675 - RNA, 64 nt, Human
uguauggggauauuugauguuuucagaaagaggaagaaaauaugguccaaauuaaauuuuccaa

SEQ ID NO: 24676 - RNA, 64 nt, Human
uuagaugacuuuguggccaucuuguuauugaguaagaaaauaaagcauggacaucaugaaaaua

SEQ ID NO: 24677 - RNA, 64 nt, Human
agagaaaaagagagagcagggugggguaaggaggagaaaauaaaccaacaauuaggucugcauu

SEQ ID NO: 24678 - RNA, 64 nt, Human
auauaaaaccacuaauuguuccguuaagcuucacagaaaauaaaaccucuauuacuagacauuu

SEQ ID NO: 24679 - RNA, 64 nt, Human
aaucaaucaugucagucugcuuagaaauaacagaagaaaauagaauugacauugaaaucuagga

SEQ ID NO: 24680 - RNA, 64 nt, Human
uuuuauguuuguaaucuguaaaugaacacauggcagaaaauaaccccugauugguaggaucaua

SEQ ID NO: 24681 - RNA, 64 nt, Human
aauaaaaaaaaaagcauuuaacuugcaccaagcaagaaaauauaaauacaguuaacugcauuaa

SEQ ID NO: 24682 - RNA, 64 nt, Human
ugauguuugaacauuuuaauuugugugaugauguagaaaauauaauuuuaguuuguacauaaac

SEQ ID NO: 24683 - RNA, 64 nt, Human
auacucugcuauuucucuugcuggaacuguugaaagaaaauauauagaaugaucuauugcucau

SEQ ID NO: 24684 - RNA, 64 nt, Human
uauugcuugucuuaaaauaaugaacacuacagauagaaaauaugauauauugcuguuaucaauc

SEQ ID NO: 24685 - RNA, 64 nt, Human
agaauuuuuuugucuuucaaugcaguuuuuuggaagaaaauauuuuuaaauggacaauggacug

SEQ ID NO: 24686 - RNA, 64 nt, Human
gugugacuguggguuuuauuuuguauucugguuaagaaaauaauguauugaguuacugucaagu

SEQ ID NO: 24687 - RNA, 64 nt, Human
uaaaguuuaugugugugaugugacuuaacuaugcagaaaauauuuaaguuggauguacuuguuu

SEQ ID NO: 24688 - RNA, 64 nt, Human
auacagagcuuugguaauuacaugaauaaaauuaagaaaauagccauauacaaucaaauacacu

SEQ ID NO: 24689 - RNA, 64 nt, Human
gaaauguaaaauacucuccagaucuaccauuaauagaaaauaaacuaaaccuuauauuuuauuu

SEQ ID NO: 24690 - RNA, 64 nt, Human
aaauuuacgaaaaucuuagauuuuguuuagaaugagaaaauauacaauuagaauuauuuuagaa

SEQ ID NO: 24691 - RNA, 64 nt, Human
aagaaacuuauuucucauaucaacuuagucaauaagaaaauauauucuuucaaaggaacauugu

SEQ ID NO: 24692 - RNA, 64 nt, Human
agauuaucugaguguuccacaguuguaugucaaaagaaaauaaaauucaaauauuuaaaacgga

SEQ ID NO: 24693 - RNA, 64 nt, Human
ggaacacgauccucuuucugggcauuccuaggggagaaaauaaaauuuguaauguucuagagau

SEQ ID NO: 24694 - RNA, 64 nt, Human
acuuaagaugugcaaggagauuuaaugauuucaaagaaaauaaugguucuuuguuuuuaauguu

SEQ ID NO: 24695 - RNA, 64 nt, Human
ucucgauauuuccaauccuggcuacuuuucuuagagaaaauaaguccuuuuuuucuggccuugc

SEQ ID NO: 24696 - RNA, 64 nt, Human
acaugcauacacacacacacacagccacacacacagaaaauauacuguaaagaaagagagaaaa

SEQ ID NO: 24697 - RNA, 64 nt, Human
ccacacacacagaaaauauacuguaaagaaagagagaaaauaaaaaguuaaaaaguuaaaaaaa

SEQ ID NO: 24698 - RNA, 64 nt, Human
cagcagagcuuguagcuggacagagucaaaaagaagaaaauacgguuucaggcuuucuugcaga

SEQ ID NO: 24699 - RNA, 64 nt, Human
uagcauuaaauauaaaauacauaaaagaauguacagaaaauagcuuuuauugaguaauauuaca

SEQ ID NO: 24700 - RNA, 64 nt, Human
ucauccaccaauaucauguguagauauuauguauagaaaauaaaauaaauuauggcucuaacuu

SEQ ID NO: 24701 - RNA, 64 nt, Human
uuauggaaaacaaagaaacagacacaaugcacacagaaaauauuagauauggagagauuauuca

SEQ ID NO: 24702 - RNA, 64 nt, Human
gcacacaacacacaagggagagaacccccagaugagaaaauaggaaggagcaaucauuuguaga

SEQ ID NO: 24703 - RNA, 64 nt, Human
acugccaauuagcuucuacuaaccacgguucaacagaaaauaaauguguauuugugaauaacaa

SEQ ID NO: 24704 - RNA, 64 nt, Human
cguguucuuacaaaugaaccuucggaucuaugaaagaaaauauaguagggggacuaaggaacau

SEQ ID NO: 24705 - RNA, 64 nt, Human
uuuggaguguaaaucuucaugauguuguaauucaagaaaauaggcacuuucucugaaagaccug

SEQ ID NO: 24706 - RNA, 64 nt, Human
auaccaguuuucuuuaugaugauacaguguuaaaagaaaauaaauuacaauugaucugucaucc

SEQ ID NO: 24707 - RNA, 64 nt, Human
auauauucauauuuguggauuuccuaaaagccucagaaaauacgacugacuaggcagcaaagac

SEQ ID NO: 24708 - RNA, 64 nt, Human
aauuaucuuuacaaaguguuuaaaguuugaacauagaaaauaaucucucugcuuaauuguuaac

SEQ ID NO: 24709 - RNA, 64 nt, Human
uccguaggcagagugcucacuuugaauugcuaauagaaaauaaugcacaguguccucaggauau

SEQ ID NO: 24710 - RNA, 64 nt, Human
uacagcaggaaaucaaaggaguggguggaaugagagaaaauaugcaaagagaucauuuuuaagu

SEQ ID NO: 24711 - RNA, 64 nt, Human
agaguugauuucaagauuauaaauacucaugaucagaaaauaguacuuauuagcaauuaaaggg

SEQ ID NO: 24712 - RNA, 64 nt, Human
ugaaaagauucucaguuaccaaacgucuccaccuagaaaauaaaaauacauuaagaugugcuuu

SEQ ID NO: 24713 - RNA, 64 nt, Human
uuuucuaaaaacuucaaguguuugauuaaaauagagaaaauaauuuuuaaaauaauagauaaaa

SEQ ID NO: 24714 - RNA, 64 nt, Human
gugcugugacuuaggugaauuuucaauuuaagguagaaaauaaguuuuuaggagguuuguaaaa

SEQ ID NO: 24715 - RNA, 64 nt, Human
agguaugaccaaauccugccucauuaauucaagcagaaaauauccuggcagggaaucuggcuua

SEQ ID NO: 24716 - RNA, 64 nt, Human
uuagaauuuucuuaugaauccacucuacuuggguagaaaauauuuuaucucuagugauugcaua

SEQ ID NO: 24717 - RNA, 64 nt, Human
gcuuucguccauguuucucacauugcuguauuuuagaaaauagggguuaagacugauaacaacc

SEQ ID NO: 24718 - RNA, 64 nt, Human
uaccuccaugugcccuuuuuagggaagcuguuggagaaaauacuccagcaaaaugaaggaguac

SEQ ID NO: 24719 - RNA, 64 nt, Human
uuucagaugccuuugagaaaugaaugaaguagagagaaaauaaaagaaaaaccagccaggcaca

SEQ ID NO: 24720 - RNA, 64 nt, Human
uuccaggaugcaaggucuauuaucccaacagaagagaaaauauuuuuauauuuaaggauuaugc

SEQ ID NO: 24721 - RNA, 64 nt, Human
uguuaaaauuuaacauuuagauuuacuuaauuguagaaaauacaaauguaaaacuuacacaugg

SEQ ID NO: 24722 - RNA, 64 nt, Human
accuugguuuucuucuagauagcagcugucccaaagaaaauauuucuucuuugucuguuaagau

SEQ ID NO: 24723 - RNA, 64 nt, Human
ugucuauacucaacuggauauguguauguaaauuagaaaauacauaccuauccagacauaaaug

SEQ ID NO: 24724 - RNA, 64 nt, Human
uaaaauuuuugaaaucacuacuguuaccuguuauagaaaauaguguuggcuuagucuagucucu

SEQ ID NO: 24725 - RNA, 64 nt, Human
uaugucucccaguuaagaagagucuccauuuuccagaaaauacagcuaagcaagaaaaauaucu

SEQ ID NO: 24726 - RNA, 64 nt, Human
gaaaugggaagagcaacaguaacuccaaagugucagaaaauaguuaacauucaaaaaacuuguu

SEQ ID NO: 24727 - RNA, 64 nt, Human
guguucauagugucuguauguaaacugaacuugaagaaaauauauugaaauuaaagcuguauaa

SEQ ID NO: 24728 - RNA, 64 nt, Human
cgcgcuauuccccaacccaccuccagauaaugugagaaaauagccaugucaguauguaggaacu

SEQ ID NO: 24729 - RNA, 64 nt, Human
aaaaaaacaaguuaaaaacugaauguacugauuuagaaaauauauauaaauauauauuguuaaa

SEQ ID NO: 24730 - RNA, 64 nt, Human
guauuggccaaguuuugcuuguugugugcuugaaagaaaauaucucugaccaacuucuguauuc

SEQ ID NO: 24731 - RNA, 64 nt, Human
cucagggauuuauaauuuuaaaacaaauaugcacagaaaauaaacauuucuuaaaauauauucu

SEQ ID NO: 24732 - RNA, 64 nt, Human
uuagcaugaaugaaccugauacacaauuaugaccagaaaauauggcuccaugaaggugcuacuu

SEQ ID NO: 24733 - RNA, 64 nt, Human
aagucuguuuuauguguuuugauuacuagugagcagaaaauaacauacccuguauucaaaauua

SEQ ID NO: 24734 - RNA, 64 nt, Human
cuaugcauauacaaaaaaaaucauuuuaaagccaagaaaauaucugucaaaccauuucugucag

SEQ ID NO: 24735 - RNA, 64 nt, Human
uuuauguugagaacuaaggauauucuuuagcaagagaaaauauuuuccccuuauccccacugcu

SEQ ID NO: 24736 - RNA, 64 nt, Human
aucuuuugauaaauggaucaguuuuaggacuuucagaaaauaaaagaucgcucuugaaaagcug

SEQ ID NO: 24737 - RNA, 64 nt, Human
cuugcaguagagugauaggacauucuaugcuuacagaaaauauagccaugauugaaaucaaaua

SEQ ID NO: 24738 - RNA, 64 nt, Human
acagcauaccacgccacaggguuagaaccaacgaagaaaauaaaaugagggugcccagcuuaua

SEQ ID NO: 24739 - RNA, 64 nt, Human
uagaaaagcaagaaaaugcagauagagaaaaagaagaaaauaaaacuggaguauuuccacaacc

SEQ ID NO: 24740 - RNA, 64 nt, Human
gaggaagaggucccaaauuuggaguaaagaugggagaaaauaaauaugugcuauuuccuuggcg

SEQ ID NO: 24741 - RNA, 64 nt, Human
uuacaagugugcaaauuaugacugcgugagccuuagaaaauaaaauguauaaagggcaacacau

SEQ ID NO: 24742 - RNA, 64 nt, Human
auugcaguauuuaaagcuuaagcuuucaggaaaaagaaaauaagaauucagugugugcaugaca

SEQ ID NO: 24743 - RNA, 64 nt, Human
caguuuagcuuuguguuguaugcuaguuuaaaaaagaaaauauguaauauaauguaaaaaaaaa

SEQ ID NO: 24744 - RNA, 64 nt, Human
aaagagcagaagcuccuugguuuaaccagcacagagaaaauaauauaaaucccauaagggcaga

SEQ ID NO: 24745 - RNA, 64 nt, Human
gguugggaagaaauacauuuccuaauguauuuauagaaaauaaaaauauuuuuaugugccuuuu

SEQ ID NO: 24746 - RNA, 64 nt, Human
ucucagaauuacuaagcauguggcauaaauuuggagaaaauaauaugacuagaaaaauuagugu

SEQ ID NO: 24747 - RNA, 64 nt, Human
ucuuggugccucaguuuccugaccuaugaaacagagaaaauaaaagcacuuauuuauuguuguu

SEQ ID NO: 24748 - RNA, 64 nt, Human
gcacuuucccucuguuuccugaccuaugaaacagagaaaauaacaucacuuauuuauuguuguu

SEQ ID NO: 24749 - RNA, 64 nt, Human
uggacugucuuuguugauucuaacuuguaaauaaagaaaauauuauucaaguuuugaguuaccu

SEQ ID NO: 24750 - RNA, 64 nt, Human
ucugcgcccaggccacgugucccgaucugggauuagaaaauauggguccauuccuuucuagaaa

SEQ ID NO: 24751 - RNA, 64 nt, Human
cugauauuaaacaucaucugcauuuuacuugccuagaaaauacacgguaacuuuucugccuugc

SEQ ID NO: 24752 - RNA, 64 nt, Human
cuccagccugggcaacagagcgagacuucaucucagaaaauaaaaaauaggggccaggcacagu

SEQ ID NO: 24753 - RNA, 64 nt, Human
auuuugucauguuucaaauaaagagaacugaaguagaaaauagaaaugccaguaaacaacauaa

SEQ ID NO: 24754 - RNA, 64 nt, Human
caccaauaaagaucauaaauaaauguuucuuucaagaaaauauauuuggauggccuuuuuaaag

SEQ ID NO: 24755 - RNA, 64 nt, Human
guguuuaaauauauauauauaugauggcuuuggaagaaaauaugcugcuguaaauuaggaaagg

SEQ ID NO: 24756 - RNA, 64 nt, Human
uaccuaaaauugcaacuucuaaacacaaauaaaaagaaaauauuuauaggaggaaaugauuaau

SEQ ID NO: 24757 - RNA, 64 nt, Human
uugaugguaaaguugguaaaaggcaacuuucagaagaaaauaaugugcuuuagaaaaaaaauuc

SEQ ID NO: 24758 - RNA, 64 nt, Human
acuccaauaugcuaaaaguuaaauaugguauuuaagaaaauagucauguaugcaauugagaaag

SEQ ID NO: 24759 - RNA, 64 nt, Human
auaucaguuuuauucucauguaccuaaguuguggagaaaauaauugcauccuauaaacugccug

SEQ ID NO: 24760 - RNA, 64 nt, Human
acacacccaguuauggaauguccagaguucucgaagaaaauaaaugacuuuaggaagagguaua

SEQ ID NO: 24761 - RNA, 64 nt, Human
cugcuggaaagugggacccucugaguggguggucagaaaauacccaugcugaugaaaugaccua

SEQ ID NO: 24762 - RNA, 64 nt, Human
auauuauacuuguuacccuucacaauaccacaugagaaaauaucugagacaaaauguauacaaa

SEQ ID NO: 24763 - RNA, 64 nt, Human
acucaguugcggucuuauuuuugacuuaaguuuuagaaaauauucauguaguuuagaguggaaa

SEQ ID NO: 24764 - RNA, 64 nt, Human
gguguacaaauuggucaaguugcaauuauuuaugagaaaauaaugauaaauguaaaauaucuaa

SEQ ID NO: 24765 - RNA, 64 nt, Human
caugaaucuaagagcacgcaauauauaauuuuaaagaaaauauucuauuugguagaauacaaau

SEQ ID NO: 24766 - RNA, 64 nt, Human
gagguuuuaugcuauuccuguguucuccaaaacaagaaaauaaaaagacaugacuuauucucug

SEQ ID NO: 24767 - RNA, 64 nt, Human
cguuauagacccaauaacaacuaaaccuuucaaaagaaaauauuuucuauuaugaauguugauu

SEQ ID NO: 24768 - RNA, 64 nt, Human
uagagaaaauguuauuuagaaaaucauaagaaagagaaaauauauuuacuauucauuaaaugga

SEQ ID NO: 24769 - RNA, 64 nt, Human
guccagugaauucaagaccaaauacaauaucgggagaaaauacaaacucccuguguuuaagaau

SEQ ID NO: 24770 - RNA, 64 nt, Human
aagacaucuggaugugaacuuucauguaugauccagaaaauagguacgguuuuaaaauauuuua

SEQ ID NO: 24771 - RNA, 64 nt, Human
gucucaugaggaacacuacuuaaugcagugggaaagaaaauauuucagaggagaauuuuuucuu

SEQ ID NO: 24772 - RNA, 64 nt, Human
gccauucagucuggacuucaaaucacuugucuucagaaaauaaaagauuuguuccacccgggug

SEQ ID NO: 24773 - RNA, 64 nt, Human
aacuguuuagcugaaguucauauuauuuaaguaaagaaaauauuucaguuuuauaacagacuuu

SEQ ID NO: 24774 - RNA, 64 nt, Human
ccaauauuucagguggauauuucuaaguauuacuagaaaauacguuugaaagcuuuaucuuauu

SEQ ID NO: 24775 - RNA, 64 nt, Human
agagggaagggaaaaaagugugaaaggaugaugaagaaaauaauuuuacuauuucuuuuaaaag

SEQ ID NO: 24776 - RNA, 64 nt, Human
auguccuguucacugaauauuccggguaauugaaagaaaauauaauggaugggcuccauuaaaa

SEQ ID NO: 24777 - RNA, 64 nt, Human
uucuugguauuuggauaucuguuagaugcuacuaagaaaauagagaugagcuuucuuuuuaaag

SEQ ID NO: 24778 - RNA, 64 nt, Human
gaagauaaaaagacauucuuccaaaaagauuuucagaaaauauuauguguuuccauauuuuaua

SEQ ID NO: 24779 - RNA, 64 nt, Human
uauuuuuccaaaauaauuuuaagaaaucaaagagagaaaauaaagaccuugcuuaugauugcag

SEQ ID NO: 24780 - RNA, 64 nt, Human
agccgacugugaggaaaagcagagggaaugugaaagaaaauaagagaauccacgggauuugaug

SEQ ID NO: 24781 - RNA, 64 nt, Human
aacauguagacacuugagaaauguuucuguuugaagaaaauagagggagaaacagaagucuuaa

SEQ ID NO: 24782 - RNA, 64 nt, Human
uagcuaugucaccuuacuacagaauccagcagucagaaaauaacacaaaaaaugccgagguuug

SEQ ID NO: 24783 - RNA, 64 nt, Human
ccacacucgcuuaugcuacuuaaucagaaucuugagaaaauagaccauaaugauucccuguugu

SEQ ID NO: 24784 - RNA, 64 nt, Human
gaaaacauggcuacuuucuaagcuacaaaccauuagaaaauaacucaaaaagauggcagaggca

SEQ ID NO: 24785 - RNA, 64 nt, Human
uuuccuuucauuuuuagaugccagcucuuuuuaaagaaaauagaaaugauuuagauuaaacaag

SEQ ID NO: 24786 - RNA, 64 nt, Human
uuuuauugcucuuuaguaaagaaaggcacaagaaagaaaauauccagcucucuuguguuaucuc

SEQ ID NO: 24787 - RNA, 64 nt, Human
aaacacagauaguaguaaaaauucugaguaacugagaaaauaaucaguuggaaaugauuagaua

SEQ ID NO: 24788 - RNA, 64 nt, Human
aaucauuccauuuguuccuuuagcaaucaaccccagaaaauauuaaaaugggaucauacacaga

SEQ ID NO: 24789 - RNA, 64 nt, Human
agaugcuaggaugaggcaggcccaguccuccuccagaaaauaagacaggccacaggagggcaga

SEQ ID NO: 24790 - RNA, 64 nt, Human
uccuggcucaagaauuacuccgaagucagucugcagaaaauaaauauuuaguaugacaugacac

SEQ ID NO: 24791 - RNA, 64 nt, Human
aaaucaaagugauuuugaaaaucucuaauggcucagaaaauaaaaacauccaguuuguggauga

SEQ ID NO: 24792 - RNA, 64 nt, Human
uggguucucugcuguccuaagaacuucaguguagagaaaauaagacuucuggugcugcuggggu

SEQ ID NO: 24793 - RNA, 64 nt, Human
uuugucaguuuagcauuacauugucuugagcaccagaaaauaaaauccauauauuaauaaaaac

SEQ ID NO: 24794 - RNA, 64 nt, Human
uagccuucucuguggucacuguguuggauuuggaagaaaauauaaguagauguuaaggucagug

SEQ ID NO: 24795 - RNA, 64 nt, Human
caggacucuuaauaagaccugcacggauggaaacagaaaauauucacaauguauguguguaugu

SEQ ID NO: 24796 - RNA, 64 nt, Human
auuguuuuucuaauacuuuauagggcccaacuucagaaaauacuucgcuuuuuucuuuuuaugc

SEQ ID NO: 24797 - RNA, 64 nt, Human
ucuuuuccuguuaacaagcuggcagcaaagcuucagaaaauauauaugcaagcacaacuugaag

SEQ ID NO: 24798 - RNA, 64 nt, Human
ucauagguuaccauuuuauaacucuauugccauaagaaaauacacucuaaaaucuugauuugaa

SEQ ID NO: 24799 - RNA, 64 nt, Human
ucccuuuuauguuuucucuguuugugauacaauuagaaaauauaaaaucacaguagauuuuauu

SEQ ID NO: 24800 - RNA, 64 nt, Human
uacagcauacaaucucagaaacuuagaagcaaguagaaaauaauugguugauguaaacgaaagu

SEQ ID NO: 24801 - RNA, 64 nt, Human
auugaggggaugaaucggaacgauagucucaugcagaaaauagugagauuaagaucauccuuau

SEQ ID NO: 24802 - RNA, 64 nt, Human
uguuuacucacucuggauagcuaggugauuauucagaaaauacgguuacauagcuauuuauaag

SEQ ID NO: 24803 - RNA, 64 nt, Human
ugacagucucaccaauuucagaaaaucauuaaaaagaaaauauugaaaggaaaauguuuucuuu

SEQ ID NO: 24804 - RNA, 64 nt, Human
gaaggaaauaugcaauguuauuuugguagcucuaagaaaauaucuugcaagcuccaccuucacu

SEQ ID NO: 24805 - RNA, 64 nt, Human
agagcucugcuaucacugaauuacauuuaucugaagaaaauaguacaacuuaauggauuagcuu

SEQ ID NO: 24806 - RNA, 64 nt, Human
aauucacuucauuguaccccaugaccugagguaaagaaaauaauuuucaaauugcagacuuccu

SEQ ID NO: 24807 - RNA, 64 nt, Human
aaggaaugggaaagucaauggaagauuaugcagaagaaaauagaagagguacacuuuaauuugu

SEQ ID NO: 24808 - RNA, 64 nt, Human
ugcaaugauggcuggaucauuuaaaguucuuuuuagaaaauaacauaagccaaagacucaagug

SEQ ID NO: 24809 - RNA, 64 nt, Human
cugacuuauguucacagaaccguaucagcgaccaagaaaauaggacugucagaagcugccaguu

SEQ ID NO: 24810 - RNA, 64 nt, Human
cggaguuuucaaauugcagcaaauauacuguaugagaaaauauuaauacagauuaaaagccuuu

SEQ ID NO: 24811 - RNA, 64 nt, Human
aacuuacuguauaaaauuaguuggaagccauguaagaaaauaacaucugaaaauucuugaacuu

SEQ ID NO: 24812 - RNA, 64 nt, Human
auuaacugacauuugcuuuuuuucaagaccuaauagaaaauaagaaagcccauaauguauuuag

SEQ ID NO: 24813 - RNA, 64 nt, Human
caaucauagugacuucagaaaauuuggaaaauacagaaaauauagggaagaauaaaauuaaccc

SEQ ID NO: 24814 - RNA, 64 nt, Human
uuaaaaugugaaaaaacauuauuuuuucaaagcaagaaaauaauuuacugcccucuuacauaau

SEQ ID NO: 24815 - RNA, 64 nt, Human
auuaaacuagucaaaaaugcuaaaauaauuugggagaaaauauuuuuuaaguaguguuauaguu

SEQ ID NO: 24816 - RNA, 64 nt, Human
cuuuaauauugauuauauuuuuaacaggaauuuaagaaaauauuacuggaauuaaaaauauaua

SEQ ID NO: 24817 - RNA, 64 nt, Human
ggauuucuccaaaucugggagaauuuucaaaauaagaaaauaaccuuuauaugauauacuauga

SEQ ID NO: 24818 - RNA, 64 nt, Human
uauuauauauuugcuaguuaucuaauguuuuaaaagaaaauauaccucauuuagguuugaauug

SEQ ID NO: 24819 - RNA, 64 nt, Human
agcucuuuuuuccccucauaaccuuguuuuugguagaaaauaagcuagagaaauuaagccaucg

SEQ ID NO: 24820 - RNA, 64 nt, Human
uugaaauccaacuucugugcaaaauuuuaguaucagaaaauacgagauuugcaggggaaacauc

SEQ ID NO: 24821 - RNA, 64 nt, Human
ccuggguaaaaagucuucucagaaaaacaaugucagaaaauaacagcgugcugcuuagaaauac

SEQ ID NO: 24822 - RNA, 64 nt, Human
cauuuuuaucaagguuuuccaugguuaaguuuggagaaaauaccacacaaaacaaugaauugcc

SEQ ID NO: 24823 - RNA, 64 nt, Human
ugacuuauuuuccuuuuacuauacagcuuggcagagaaaauaaauaucaucaaauaagauacag

SEQ ID NO: 24824 - RNA, 64 nt, Human
aacuuuaucagggaaacuaagauucuuuuaaauuagaaaauauucucuauuugaauuauuucug

SEQ ID NO: 24825 - RNA, 64 nt, Human
uuaaagggcacucuaugaauugauuuauugucuaagaaaauaacaccacaaguagggaaauugu

SEQ ID NO: 24826 - RNA, 64 nt, Human
uaaaaagugacugcaacaaauaaaccuucuacugagaaaauacaucacagauagaagauuaucu

SEQ ID NO: 24827 - RNA, 64 nt, Human
uuuauuuuuuucccuuuagcauugcaugugaauaagaaaauaauguuuaaagaaaaaaaaaaaa

SEQ ID NO: 24828 - RNA, 64 nt, Human
cacuauaguauaagaaucuauuuuggagaaaaaaagaaaauaugagggucucgaagcaugauuu

SEQ ID NO: 24829 - RNA, 64 nt, Human
uuucuuucugguuaaaaaaaggaaaaaccaucuaagaaaauauauauguauguauguguguaua

SEQ ID NO: 24830 - RNA, 64 nt, Human
ugucucuuuggaguuggaauuucauuauauguuaagaaaauaaaggaaaaugacuuguaagguc

SEQ ID NO: 24831 - RNA, 64 nt, Human
acaccagggguccgcugccccauguguccuggugagaaaauauaugccuggcacagcuuuugua

SEQ ID NO: 24832 - RNA, 64 nt, Human
uguuauugugaaagguguacuuugugcucauuucagaaaauaaaacacaaccuuucucuugaug

SEQ ID NO: 24833 - RNA, 64 nt, Human
cacagguuaaaaaacuuuaguaacuuguuuguauagaaaauaguaacaaggacuauuuucuauu

SEQ ID NO: 24834 - RNA, 64 nt, Human
caugcaucuagggcggagaggcugcacuugugagagaaaauacuauuucaagucauauucugcg

SEQ ID NO: 24835 - RNA, 64 nt, Human
caccccauccaauuuaucaaggaagaaaugguucagaaaauauuuucagccuacaguuauguuc

SEQ ID NO: 24836 - RNA, 64 nt, Human
cauuauaaaugcaauuuuugucaagagaucuuucagaaaauauaagccuuuaaagugaagaaga

SEQ ID NO: 24837 - RNA, 64 nt, Human
auuugugaaaacauuuuuuaaaaaacuacagcuuagaaaauaccagaggccucauacuaaaaua

SEQ ID NO: 24838 - RNA, 64 nt, Human
acauugcugaguauagaaucagaaugcugaguauagaaaauaauuuaaaacuaaaguugguagg

SEQ ID NO: 24839 - RNA, 64 nt, Human
uacuuaauaaaaugcaauuaccgucaaaucuuucagaaaauauaagccuuuaauacgaggaaga

SEQ ID NO: 24840 - RNA, 64 nt, Human
uacuuuauuuguaaauuauuugcccuggaguuuuagaaaauaguuucugaauuuuaaacuugcu

SEQ ID NO: 24841 - RNA, 64 nt, Human
aaacauuguaugcauuuugauuuuuccuacuuuaagaaaauaaaauaauuuaauuuuacauuag

SEQ ID NO: 24842 - RNA, 64 nt, Human
cauaauguccuguauaaauguuuuuacugcuuuuagaaaauaaagaaaaaaaacuugguucaug

SEQ ID NO: 24843 - RNA, 64 nt, Human
uuuuuuucaaguaucuuauuaaaggaggcauucuagaaaauaugaauuaguuuccaaaugccuu

SEQ ID NO: 24844 - RNA, 64 nt, Human
uuacaacaguguagaauucuugaaaaguuaacguagaaaauauccaaaaagcaguauuucuaga

SEQ ID NO: 24845 - RNA, 64 nt, Human
cuugggcucacuaauaucaccaguauuauuaccaagaaaauauugaguuuaccugauuaaacuu

SEQ ID NO: 24846 - RNA, 64 nt, Human
cucuuaagaagacugcauuauauuuauuacuguaagaaaauaucacuugucaauaaaauccaua

SEQ ID NO: 24847 - RNA, 64 nt, Human
ccuuugaaacaagauaacugagaauuuaaaaauaagaaaauacauaagaccauaacagccaaca

SEQ ID NO: 24848 - RNA, 64 nt, Human
cauccccauccccaugcccucaucccgaccucuuagaaaauaaauacaaguuugaacaggcuuc

SEQ ID NO: 24849 - RNA, 64 nt, Human
uguaaauuugaggauuuuuuugccaauaguuuauagaaaauauaugaaccaaagugauuugagu

SEQ ID NO: 24850 - RNA, 64 nt, Human
acuugcuugcaaggauuuggagauguaaacaugaagaaaauauaguuacugccugcaaagaauu

SEQ ID NO: 24851 - RNA, 64 nt, Human
guagaccagaaaccacaaauugacuuuuuuucuuagaaaauauuucuauuugcgguaaauauag

SEQ ID NO: 24852 - RNA, 64 nt, Human
ugaaaagguuaaguaugccaguaguuuacaaaacagaaaauacuuaacuaggaguaggaggcuu

SEQ ID NO: 24853 - RNA, 64 nt, Human
auugaaguaaacuugauuuuuuuuuuuugucacaagaaaauauuaagaguuauuguugcaguuc

SEQ ID NO: 24854 - RNA, 64 nt, Human
gcaaaugcauuuuucaucuauaaaaugucaugaaagaaaauaaagguagugaaauauggacaaa

SEQ ID NO: 24855 - RNA, 64 nt, Human
auggugagcacaagguaagucauaaagaauaaugagaaaauaaaucuaugcuggugcagcugag

SEQ ID NO: 24856 - RNA, 64 nt, Human
uauguggacucuguuccuuuauguaaacauguaaagaaaauaagucagcgaaaaaaaugaaacc

SEQ ID NO: 24857 - RNA, 64 nt, Human
aucauuaauauaaauuuaaacaacauggcuuguuagaaaauaugcuaauugcuauggucucauu

SEQ ID NO: 24858 - RNA, 64 nt, Human
ucuugucuauuguauauauaaucuauaugauuaaagaaaauaugcauaaucagacaagcuugaa

SEQ ID NO: 24859 - RNA, 64 nt, Human
uuggacauaaagaaaauccuacuuauagaaaaggagaaaauaauuaaacagucuucauuuuuaa

SEQ ID NO: 24860 - RNA, 64 nt, Human
ucacaaguaauggcacaauucuucggaugacugcagaaaauaguguuuuguaguucaacaacuc

SEQ ID NO: 24861 - RNA, 64 nt, Human
cuucaagugaccuguacugcuuggggacuauuggagaaaauaagguggaguccuacuuguuuaa

SEQ ID NO: 24862 - RNA, 64 nt, Human
uuguuuuaugaaacauguucauuacagaaacaugagaaaauagagauaaguaaaaagaauaaaa

SEQ ID NO: 24863 - RNA, 64 nt, Human
auuagucacuuccucacauggaaggcagcuuuucagaaaauaacagacauugcucguuucucau

SEQ ID NO: 24864 - RNA, 64 nt, Human
uuaguauagaaacuacagaauauuuacccuggaaagaaaauauuggaauguuauuauaaacucu

SEQ ID NO: 24865 - RNA, 64 nt, Human
uuaggauuuucaaagaauggagguugcugcacucagaaaauaauucagaucauguuuaugcauu

SEQ ID NO: 24866 - RNA, 64 nt, Human
aauguguagauuaaaugaguuuuuaaagcacuuuagaaaauauaagggagaaaaugauuucuua

SEQ ID NO: 24867 - RNA, 64 nt, Human
ccuuguagaauauguauuaaucauucuacauuaaagaaaauaaugguucuuacuggaaugucua

SEQ ID NO: 24868 - RNA, 64 nt, Human
aacuuuucaugauuuuuaugagcacagacuuucaagaaaauacuugaaaauaaauuacauugcc

SEQ ID NO: 24869 - RNA, 64 nt, Human
gccaucaauaucacaauagauuucucaagguaagagaaaauaagcucaugagaugacauucacc

SEQ ID NO: 24870 - RNA, 64 nt, Human
gaagcaauagucuccaagucaauauaaauucuacagaaaauaguguucuuuuucuccagaaaaa

SEQ ID NO: 24871 - RNA, 64 nt, Human
auaaaguacuaauuaaaugcuaacauaggaaguuagaaaauacuaauaacuuuuauuacucagc

SEQ ID NO: 24872 - RNA, 64 nt, Human
uauuauuucagaaauuucccaugaaacuaaaaauagaaaauaagauauacaaguuaauucggua

SEQ ID NO: 24873 - RNA, 64 nt, Human
auuacugacauuuuguaaucaagaaaagugauauagaaaauauguaggagacuguuaaaauugg

SEQ ID NO: 24874 - RNA, 64 nt, Human
auuugugucaaauuauaauuauaaaagguacagcagaaaauauaccauguuuuuauauagguuc

SEQ ID NO: 24875 - RNA, 64 nt, Human
aaacaauuuguugauuaagugaucaacaaccugaagaaaauaucaauuuuuaauugacaaagac

SEQ ID NO: 24876 - RNA, 64 nt, Human
gaguccacuuuugucacaauucauuuuuauuaauagaaaauaaacacuuauuccaguuucaaag

SEQ ID NO: 24877 - RNA, 64 nt, Human
uagagcaaaaaucaaauagcaaaggacacuagccagaaaauacagugugugugugugcaccugu

SEQ ID NO: 24878 - RNA, 64 nt, Human
ucaauacaagccauaggcucacagaaaaagaaaaagaaaauaaaaauuaaauuaaaaaaaaaga

SEQ ID NO: 24879 - RNA, 64 nt, Human
uuuguaaacccuauaauuaugaagcgauugcuugagaaaauaacauauaaacauagaauagaau

SEQ ID NO: 24880 - RNA, 64 nt, Human
uacagugcccuaaaaugguguucuuaugaccugcagaaaauauuuacacauauuuccaaauauu

SEQ ID NO: 24881 - RNA, 64 nt, Human
caaaauagcaauaaaacauaaucacucuauuugaagaaaauaucuuguuuucugccaauagauu

SEQ ID NO: 24882 - RNA, 64 nt, Human
augucuucuugcaauauuuuaaauauuguauuugagaaaauaaacaucugagucauucacuuuu

SEQ ID NO: 24883 - RNA, 64 nt, Human
ucacaccaguccaaauggcuauuauaaaaaugucagaaaauaacagaugcuggugagguugugg

SEQ ID NO: 24884 - RNA, 64 nt, Human
cauucuuuucaguuggagagaauugggcuaagauagaaaauaacaugauuuguuccuuauuaaa

SEQ ID NO: 24885 - RNA, 64 nt, Human
auucauauugcugugaaugcuuuaucuuggagauagaaaauauaaugauaaauucaucaugugu

SEQ ID NO: 24886 - RNA, 64 nt, Human
ucauauuagagaauuugcagacuaagaauuuaugagaaaauauauguauucaguagugcaggca

SEQ ID NO: 24887 - RNA, 64 nt, Human
gaguuucaucugacaaucugcuucaagaaaucucagaaaauaugauaacauuuuaacuuucauu

SEQ ID NO: 24888 - RNA, 64 nt, Human
auauagaacuuuaccaucaccagccguaguugauagaaaauauuaguuucagaauuacccuccu

SEQ ID NO: 24889 - RNA, 64 nt, Human
uuuuauuuuucucaagcugcuuucaggagcuagcagaaaauaacucaaaguugaagacucugga

SEQ ID NO: 24890 - RNA, 64 nt, Human
cuuaucuaacaucuuggggggaaagaauauuuugagaaaauaguugcagaaagcacuggaaaua

SEQ ID NO: 24891 - RNA, 64 nt, Human
gagaggaaucuauuucuuucuccugaaacaauuuagaaaauaguuauccauugacuagaaauua

SEQ ID NO: 24892 - RNA, 64 nt, Human
uagaaaauuauaaauguuaaaaggaaguuauugaagaaaauaaaagaaauuauguuauauuauc

SEQ ID NO: 24893 - RNA, 64 nt, Human
auaugaaaauuacacauuuuauaauuuuuagaugagaaaauaccacuagcagaauagcuuugug

SEQ ID NO: 24894 - RNA, 64 nt, Human
gcagaaguaauaauuggagguaaaguuuccuuagagaaaauaauuuuauucugcuuuguccaau

SEQ ID NO: 24895 - RNA, 64 nt, Human
gcacauaugguuugcacuguauaguagcuuuuaaagaaaauagucacaauacagaaaagcauuu

SEQ ID NO: 24896 - RNA, 64 nt, Human
ucaucauauuuuguugugcacuagugcaauuccaagaaaauaucacuguaaugagucagugaag

SEQ ID NO: 24897 - RNA, 64 nt, Human
uccaacuugacaaaugugccaaagaucaacagacagaaaauaucauccuguguauuuacuuguc

SEQ ID NO: 24898 - RNA, 64 nt, Human
gcugggccagagaucaguagagagcagcugaagaagaaaauaggguccaggagaggaaucugca

SEQ ID NO: 24899 - RNA, 64 nt, Human
ccagaaagcauauugcccggugaugaaaaggaucagaaaauauacacuauauuuauuagagaag

SEQ ID NO: 24900 - RNA, 64 nt, Human
guaaauacacuuuacgugaauacagucuaagugaagaaaauaaauaaaaggaagagguuuauaa

SEQ ID NO: 24901 - RNA, 64 nt, Human
gaauugagugugccaguccuaggaccuuucuacgagaaaauaaaccuuguauaaaguaaguguu

SEQ ID NO: 24902 - RNA, 64 nt, Human
auucaaaccugcauauugugauuuuaauuugaccagaaaauaugauauauauguauaauuucac

SEQ ID NO: 24903 - RNA, 64 nt, Human
uugcuagagaacaauaauaaaauaauucuuuuucagaaaauauuuaauuucuucauaaaaauaa

SEQ ID NO: 24904 - RNA, 64 nt, Human
uaaguuguauaaaaguaggugauucuguauuuaaagaaaauauuacuguuacauauacugcuug

SEQ ID NO: 24905 - RNA, 64 nt, Human
auuaaagcuguggucuuuccauguggagacugauagaaaauaauuuugucccaagucuuauuug

SEQ ID NO: 24906 - RNA, 64 nt, Human
cuuuuaaauuuuaauaacagguucaccagcugguagaaaauagagacacaugaugauuugcauu

SEQ ID NO: 24907 - RNA, 64 nt, Human
uauauuuaccuuuuugcuuauuuuacaaauauuaagaaaauauucuaacauuugauaauuuuga

SEQ ID NO: 24908 - RNA, 64 nt, Human
gcuuuguacagucaaggcaguucuccauuuuauuagaaaauacaaguugcuaagcacuuaggac

SEQ ID NO: 24909 - RNA, 64 nt, Human
auacaaagugaaaucuuagagaagcuaaaaggaaagaaaauaaaucuaucaaaauuacccuaaa

SEQ ID NO: 24910 - RNA, 64 nt, Human
guggccgacacuucaacaauagggaaaaaaagguagaaaauaucccuacugacaguaacuaccu

SEQ ID NO: 24911 - RNA, 64 nt, Human
cuugugcauuuucaauacuuguaaacuggaaaucagaaaauauuuacuaugaacaggaaaaucu

SEQ ID NO: 24912 - RNA, 64 nt, Human
uccugcuuguuaauuacauaauaugugaugcucuagaaaauagucacaaguauuaauaaugccu

SEQ ID NO: 24913 - RNA, 64 nt, Human
aaauaauuucgguacaucuuaugguuuaaagaguagaaaauaagaugaaauauccuaaaauaua

SEQ ID NO: 24914 - RNA, 64 nt, Human
ugaaaucucacagauguaaggacucaaguguagaagaaaauauccccuucuuacaaaaagaaau

SEQ ID NO: 24915 - RNA, 64 nt, Human
aaacaguuccugguuccucuuguguuugacacuaagaaaauagcaagagugugaaaucucagau

SEQ ID NO: 24916 - RNA, 64 nt, Human
guggaugaagguggguauuggggguggcugugaaagaaaauaauggagaaucacuuuucuagac

SEQ ID NO: 24917 - RNA, 64 nt, Human
auagauucuaaauaaauaggggcuuauacaaaaaagaaaauaaaaagccauauauacugcaaag

SEQ ID NO: 24918 - RNA, 64 nt, Human
uagacugaauuuaacuacuaagaauaaauaaagaagaaaauaaccuuaaucucuuguauuuguu

SEQ ID NO: 24919 - RNA, 64 nt, Human
ggauugcuuuaaaauuaaccuuugugcaauaccaagaaaauagcucuuuaaaagaaugucuuug

SEQ ID NO: 24920 - RNA, 64 nt, Human
ugauccacuaugccuuaaugguuuccuccauuugagaaaauaaagcuauucacauuguuaagaa

SEQ ID NO: 24921 - RNA, 64 nt, Human
aaaauuauauucuguuuauuaugacaaaugaaagagaaaauauauauuuuuaauggaaaguuug

SEQ ID NO: 24922 - RNA, 64 nt, Human
ugaagauuaucggcuauaagagaauaagaauugcagaaaauaacagugaagugauugaaacuuu

SEQ ID NO: 24923 - RNA, 64 nt, Human
uuauuuauagagagugaauuauggguauuuuuucagaaaauauugucaucugauauacacauaa

SEQ ID NO: 24924 - RNA, 64 nt, Human
uaugaaguucaaauuucaggaaccaaggacugccagaaaauauuagccucuacauuacgcaugc

SEQ ID NO: 24925 - RNA, 64 nt, Human
auucuagucagucauacaacuauaacuacuauagagaaaauaaaauuuuuuccuuuuuuuuuuu

SEQ ID NO: 24926 - RNA, 64 nt, Human
guuucauaacuuccuguacuugaagucuaaaagcagaaaauaaaggaagcaaguuuucuuccau

SEQ ID NO: 24927 - RNA, 64 nt, Human
guuuuaagcaaaucuaguuuuguauaauaaaauaagaaaauagcaauaaacuucuuuucagcaa

SEQ ID NO: 24928 - RNA, 64 nt, Human
ugcccaacuaaacccagaacucaaacuuaacauuagaaaauaagguccagggccggacacagug

SEQ ID NO: 24929 - RNA, 64 nt, Human
ugaacuugccaaucaaaaaaugacaaucaauuugagaaaauagaaauagauauuuuuaaauaaa

SEQ ID NO: 24930 - RNA, 64 nt, Human
aucaggcaacucugaacugaacauuugcuuugucagaaaauaucuuuuuuuuuacuuugaaguu

SEQ ID NO: 24931 - RNA, 64 nt, Human
agugcuuuugucuuuuucaugacauggcacauagagaaaauauuuuuuucuagcacacaagagc

SEQ ID NO: 24932 - RNA, 64 nt, Human
gacagccaacagaaacaaaaccuagcauagggauagaaaauaccaugcacgugugcagccccac

SEQ ID NO: 24933 - RNA, 64 nt, Human
gguuuuguguuuuuuucuggaacuacuucaagugagaaaauaaaaaaaaauggugacaaagcug

SEQ ID NO: 24934 - RNA, 64 nt, Human
uccugcuucugcucugggccgguggguggcucucagaaaauacuugcugcuggcaaaaggccug

SEQ ID NO: 24935 - RNA, 64 nt, Human
uguucagugaugcccucuucuuguuugaaacaaaagaaaauaaugcauuguguuuuuuaaaaag

SEQ ID NO: 24936 - RNA, 64 nt, Human
uuaacuuaccaugacuuugcuccuuccuuuccugagaaaauauuuccacuggauuuuuuccacc

SEQ ID NO: 24937 - RNA, 64 nt, Human
aaaaguugguuugguuugcaguaacgcugcaacuagaaaauauaugcacuucaggcuuguugaa

SEQ ID NO: 24938 - RNA, 64 nt, Human
aauguucuggguccauguacucagauaaacaugaagaaaauaagcaaagaaaaauggagacugg

SEQ ID NO: 24939 - RNA, 64 nt, Human
cuggaaaaguuaaaaaaaguuacaugucauuuggagaaaauacguaaucagaaauuugugcaua

SEQ ID NO: 24940 - RNA, 64 nt, Human
uuuauuaauguuuagauuuuucauuugguguguaagaaaauauucuuuguaugauuguaguuuc

SEQ ID NO: 24941 - RNA, 64 nt, Human
cuaguagcuaguguuaggaagugaaccuaaaauaagaaaauauaaugaucuguguuuaucauua

SEQ ID NO: 24942 - RNA, 64 nt, Human
acaaaacugccaacuuugcacaaguuuccagaaaagaaaauacaauuagucacucaacauaacc

SEQ ID NO: 24943 - RNA, 64 nt, Human
gccacaacccaccccgcuuucguaguuuucauuuagaaaauagagcuuuuaaaaauguccugcc

SEQ ID NO: 24944 - RNA, 64 nt, Human
uggaaccuccauuuucaaacugaagcacagggacagaaaauauauuucuaguuaucacuuaagc

SEQ ID NO: 24945 - RNA, 64 nt, Human
auauacuaacuaauaagaucuuuuuuucagaaacagaaaauaguuccuugaguacuuccuucuu

SEQ ID NO: 24946 - RNA, 64 nt, Human
acuucuggugccacaacuguuuauccuuuuuugaagaaaauaagggaacagaaaugccuuuuug

SEQ ID NO: 24947 - RNA, 50 nt, Human; identical to SEQ ID NO: 23806

SEQ ID NO: 24948 - RNA, 64 nt, Human
gagcaaaacaccuguaacuaaaaaagugaagauaagaaaauacucuuaaagcugaguauuuccu

SEQ ID NO: 24949 - RNA, 64 nt, Human
auaauauugauuguaugucuacugugcugcauuaagaaaauaaaauuucuauauaccaaaaaug

SEQ ID NO: 24950 - RNA, 64 nt, Human
ugguagacugguagugagcagcaaaugccuuucaagaaaauagguggcagcuucacuccauguc

SEQ ID NO: 24951 - RNA, 64 nt, Human
uagacagcacgucuucagggugugguuucuaagcagaaaauagcaaauguuuauauugaauaaa

SEQ ID NO: 24952 - RNA, 64 nt, Human
uuaaguuaugaagcaaauuaaaauggaaaauacaagaaaauagaaccaauuagguugaaaaugc

SEQ ID NO: 24953 - RNA, 64 nt, Human
ugaccagucaacucuaagaagacuagauauuccuagaaaauaaagaagcaaaucucuuuaccgg

SEQ ID NO: 24954 - RNA, 64 nt, Human
cuuucagcuccccaugcuccagaauacccacccaagaaaauaauaggcuuuaaaacaauaucgg

SEQ ID NO: 24955 - RNA, 64 nt, Human
acuuauuaacaacugugaauaugagaaauacagaagaaaauaauaagcccucuauacauaaaug

SEQ ID NO: 24956 - RNA, 64 nt, Human
aguacuuuuccuauaauuaguugauauacuaaugagaaaauauacuagccuggccaugccaaua

SEQ ID NO: 24957 - RNA, 64 nt, Human
uuauauauguaaaaaauguuaacaggaaaaugagagaaaauaaagcagcugaggauacaaaugu

SEQ ID NO: 24958 - RNA, 64 nt, Human
ggaggucaccaggaccugaccucuuugaaggaucagaaaauacuucccugaaggacugacauuu

SEQ ID NO: 24959 - RNA, 64 nt, Human
agggaguauuacaaaaacauggccuuugcuugaaagaaaauaccaaggaacaggaaacugauca

SEQ ID NO: 24960 - RNA, 64 nt, Human
cuaacaauacauucuguguauauuauuuuaaugaagaaaauaaauugauuacuggcauuggaac

SEQ ID NO: 24961 - RNA, 64 nt, Human
uauaaaaacuuuaaugaauuaggauaacaagaagagaaaauaaagguaaaaacacuauuaccug

SEQ ID NO: 24962 - RNA, 64 nt, Human
cuaugcuaagagaagugaauaaucuuucuuugguagaaaauaggcugagauauaaggugauauu

SEQ ID NO: 24963 - RNA, 64 nt, Human
agaugaguuagaagcuuuuuaucccuuccucucaagaaaauauucuuucacccugucucucaaa

SEQ ID NO: 24964 - RNA, 64 nt, Human
cuugaaaguuuaauguuuuuauuaggagauuuaaagaaaauaaaggucuacaauaucuuuaggu

SEQ ID NO: 24965 - RNA, 64 nt, Human
ggagccaaggaauucuguggcugugcugcguuucagaaaauaacccccagaggccuugggcugu

SEQ ID NO: 24966 - RNA, 64 nt, Human
acugagguucauugccagggcaggagguauuuccagaaaauacucaugccuguguucuguuccu

SEQ ID NO: 24967 - RNA, 64 nt, Human
ucagggugguuuauaaagccuguaaacacaccuaagaaaauaaacauuuuacaaaugagcuuuu

SEQ ID NO: 24968 - RNA, 64 nt, Human
ccuuucacuggccacaguuguuugaugcauuaaaagaaaauaaaaaaaagaaaaaagagaaaag

SEQ ID NO: 24969 - RNA, 64 nt, Human
ccuuuaccuuuuguuuuuccuuggaccuaaacagagaaaauaaugcuuauguaucugaagaaaa

SEQ ID NO: 24970 - RNA, 64 nt, Human
aaacuuggagagggaaaauuaagcuauacuuuuaagaaaauaaauauuuccauuuaaaugucuu

SEQ ID NO: 24971 - RNA, 64 nt, Human
guagaaaugauaccaagucucuaccaucucuuucagaaaauaaaagcagagauaacacuuccca

SEQ ID NO: 24972 - RNA, 64 nt, Human
agaauggacccauugaggauaacuauaaaauuacagaaaauauuuaaaugcaacuuauugcuau

SEQ ID NO: 24973 - RNA, 64 nt, Human
gaugagccugaaucaucucauguaccugacaguaagaaaauacucuggcuggucucaguggcuc

SEQ ID NO: 24974 - RNA, 64 nt, Human
cugaaagucuguuuuuaagcaaauggguaauaguagaaaauagguuagaaucuauggcuugauu

SEQ ID NO: 24975 - RNA, 64 nt, Human
ucauuauuauuaaagcacaaaauaaccuauuguuagaaaauauguguuuuuauaaaugaaugua

SEQ ID NO: 24976 - RNA, 64 nt, Human
aaaauaauuaaaugaauugugaaauggauguuuaagaaaauauaggcuuaaaaaguaaaucuau

SEQ ID NO: 24977 - RNA, 64 nt, Human
ugugaauuucuucaacaucauacuuaaacauuacagaaaauagaaauacaaacaagguugguac

SEQ ID NO: 24978 - RNA, 64 nt, Human
aaauauuuucauggucauuugcauguaguaagccagaaaauauucaaagagauuuugaaaacca

SEQ ID NO: 24979 - RNA, 64 nt, Human
uuaaaaaagaaagaaaaaccugcauauuuuguacagaaaauaucaaccucuucccuuuuguuua

SEQ ID NO: 24980 - RNA, 64 nt, Human
gacuuaauuuauuuauuuuuugaaaagaagagacagaaaauaccuuauuaucugcagggacuca

SEQ ID NO: 24981 - RNA, 64 nt, Human
gagcaacaagagcgaaacugucucaaaaaaaagaagaaaauaaauaaauaaaaaucagagcaca

SEQ ID NO: 24982 - RNA, 64 nt, Human
uacaaaaggaaauaacuuuaaaacuauucucaagagaaaauauucaaagcaugaaauauguugc

SEQ ID NO: 24983 - RNA, 64 nt, Human
ucuaccucacaugcaggucuagggugaggauugaagaaaauaguggugaugagggcuuuaacca

SEQ ID NO: 24984 - RNA, 64 nt, Human
acgccgggauuccucugcugccauuugaauuagaagaaaauaauuuauaugcaugcacaggaag

SEQ ID NO: 24985 - RNA, 64 nt, Human
uaagcaagagaaagacaacuguucugcggguuggagaaaauacaauuuuuuuuuuuuuuuuuga

SEQ ID NO: 24986 - RNA, 64 nt, Human
gggauuacaggcguuagccacugcgcccggcccgagaaaauacaguuuuaaaaagagaaagcuu

SEQ ID NO: 24987 - RNA, 64 nt, Human
gaaaucuuagcuguuuuuuauguuaacaguuauuagaaaauauaugucuguguguguuauucca

SEQ ID NO: 24988 - RNA, 64 nt, Human
caggaucuucagaaaaacuacccugugacuaugaagaaaauauauauugcuagcccaaaaaucc

SEQ ID NO: 24989 - RNA, 64 nt, Human
uaucaaugcuuagagaaauauccuuuccuuaaaaagaaaauaacuuuuauauuuagaguacaua

SEQ ID NO: 24990 - RNA, 64 nt, Human
uguggcgguugaaauagucccacauguggucaucagaaaauaagccauuccucauaccaauaua

SEQ ID NO: 24991 - RNA, 64 nt, Human
uaagugaacacccaugaaccuacuacccagguuaagaaaauaaaugucaccagguacuugagaa

SEQ ID NO: 24992 - RNA, 64 nt, Human
gcagaaaaccuaguuuuagugaaaaaugcuguaaagaaaauagaaaugcgauagagugcuggca

SEQ ID NO: 24993 - RNA, 64 nt, Human
aguauuuuuaagcuuuuaguucaagguuauauucagaaaauauuucccaguauaaugauacauc

SEQ ID NO: 24994 - RNA, 64 nt, Human
cucuaaaaggaaaaacuugauauuuaucagucugagaaaauauuuuuuucuaaagaaggcaguc

SEQ ID NO: 24995 - RNA, 64 nt, Human
uauuuuauguuuagauagggcugggcaaggaaaaagaaaauaaagacaaccauauuuagcagug

SEQ ID NO: 24996 - RNA, 64 nt, Human
agagacccaaagcuugacauuuaccuaauguaugagaaaauauuaccaauuaacaauaaagaau

SEQ ID NO: 24997 - RNA, 64 nt, Human
gcgcauccauguccugagaaaaagucugugguuuagaaaauauguccaugguugcccacaguca

SEQ ID NO: 24998 - RNA, 64 nt, Human
auguuggaugacuuuaaugcuacauuuuaaaaaaagaaaauaaaguaauaauauaacucaaaau

SEQ ID NO: 24999 - RNA, 64 nt, Human
ucuaugggauuuuccccccacuggucugcauaaaagaaaauaaaaugacauaaaagggagcacu

SEQ ID NO: 25000 - RNA, 64 nt, Human
aauaaggguauaauuuuguaggucauaugauugaagaaaauauuauuuuaacaauguaaagcaa

SEQ ID NO: 25001 - RNA, 64 nt, Human
aaguauaagguuuaaguaauuugguuuaauaaucagaaaauauucaauacaguguuggauauuc

SEQ ID NO: 25002 - RNA, 64 nt, Human
ucacaaccucagcccacucucagucaaggagggcagaaaauaaaagaugacaucacugccagag

SEQ ID NO: 25003 - RNA, 64 nt, Human
accugcacagagaugacagucaauauuacaauagagaaaauacaguacuuaaaaauguucaaau

SEQ ID NO: 25004 - RNA, 64 nt, Human
auuuuuucuaaugaacacauauacuuuuguaaucagaaaauauuaaaugcauguauuuuucaaa

SEQ ID NO: 25005 - RNA, 64 nt, Human
aaucuguacauccacaaaaauaugcaauggauguagaaaauaaaauucaagaaaagaacguuga

SEQ ID NO: 25006 - RNA, 64 nt, Human; identical to SEQ ID NO: 24970

SEQ ID NO: 25007 - RNA, 64 nt, Human
guagaaaugauaccaagucuguacugucucuuucagaaaauaaaagcagggauaacacuuccca

SEQ ID NO: 25008 - RNA, 64 nt, Human
aggaaaggaaucauuucuauuucuccuccaugggagaaaauagauaagaguagaaacugcaggg

SEQ ID NO: 25009 - RNA, 64 nt, Human
uagucuuuagucaaaucucugcauuguuucaugcagaaaauaaagauacaauuaaggcugacau

SEQ ID NO: 25010 - RNA, 58 nt, Human; identical to SEQ ID NO: 23869

SEQ ID NO: 25011 - RNA, 64 nt, Human
uacuuuguguuucagccauguauuugcagcugagagaaaauaaucauucuuauuucaugaaaau

SEQ ID NO: 25012 - RNA, 64 nt, Human
aauggccagaaaauauuguauugcuuggcagaaaagaaaauaaggucuaaaggaaaguagcaca

SEQ ID NO: 25013 - RNA, 64 nt, Human
auggacauuaucgcauuaucuuggcauaauggccagaaaauauuguauugcuuggcagaaaaga

SEQ ID NO: 25014 - RNA, 64 nt, Human
uugaacaaauauuuuaaaggugcaaaauaccauuagaaaauacuauuugaaauggacauuaucg

SEQ ID NO: 25015 - RNA, 64 nt, Human
uuuugaugccaaacauuauaccuuagaacauugaagaaaauauuccuaagcugaugcuggcuaa

SEQ ID NO: 25016 - RNA, 64 nt, Human
ggagguggaugucagaucugguagguugcagcagagaaaauaaaugugccuugagagaccacuc

SEQ ID NO: 25017 - RNA, 64 nt, Human
aaauugguucuguauucauaaacacuuuccacauagaaaauagauuaguauuaccuguggcacc

SEQ ID NO: 25018 - RNA, 64 nt, Human
gugcugugggucaccaacaggcuguuuacaaagcagaaaauaucaucaccaucauaaccuuucu

SEQ ID NO: 25019 - RNA, 64 nt, Human
cucuagcauuuuaaauuauuuuuauuuauuagaaagaaaauauauuuuuucuuuucauugucaa

SEQ ID NO: 25020 - RNA, 64 nt, Human
acugguggaaacguuaggauaagcaagaauugccagaaaauaaaguagacagaucuuucucuuu

SEQ ID NO: 25021 - RNA, 64 nt, Human
guagggaauuuugaacaccucuuuaaauacagcuagaaaauaaaaccaauuuguaaagccacau

SEQ ID NO: 25022 - RNA, 64 nt, Human
ucuggcucccagcucacccuuuuuuuuuaaaguaagaaaauaguugcuaccgauagggacuuug

SEQ ID NO: 25023 - RNA, 55 nt, Human; identical to SEQ ID NO: 23882

SEQ ID NO: 25024 - RNA, 64 nt, Human
cauccagcagcuccaugagccacacagauauccuagaaaauauuccuuucucacacagggcuuc

SEQ ID NO: 25025 - RNA, 64 nt, Human
uccaacagcauccuuuuuuuuaaaagagagaauuagaaaauauuaaauccugcauguaauauau

SEQ ID NO: 25026 - RNA, 64 nt, Human
ugggccuuauccuauagaggcauuuguaauauggagaaaauaauuuuucauuuuugcucauuua

SEQ ID NO: 25027 - RNA, 64 nt, Human
gaugguccaaaauuguaauggagucuguauuagaagaaaauaaggguaaaaucaggcugaacug

SEQ ID NO: 25028 - RNA, 64 nt, Human
guggcguugaauagauguguauuuccuccccugcagaaaauaagcacagaaaauuauaauguag

SEQ ID NO: 25029 - RNA, 64 nt, Human
cuguuaaauuucacaaagucaugaggguaaauggagaaaauauuucugggauuacaaugaaugu

SEQ ID NO: 25030 - RNA, 64 nt, Human
cugcaaagagcugcugcuuugccaaccuaagcaaagaaaauacggcuucucuugcauuauuuuc

SEQ ID NO: 25031 - RNA, 64 nt, Human
agaaacacauuugccuaucuucuuacccugaaacagaaaauaaauauugugcuuuaugugguag

SEQ ID NO: 25032 - RNA, 64 nt, Human
guauggggaagguagaaaguucauuucaucacuuagaaaauaugucuucucaagaacaaaacug

SEQ ID NO: 25033 - RNA, 64 nt, Human
gcacauguugaauagaguauacuggauuggugaaagaaaauaauaauaaugagcaucuaagugg

SEQ ID NO: 25034 - RNA, 64 nt, Human
uguuuacaaagaaaaccggauuuucaguagcugaagaaaauauggcacuguaaguuaaaaccca

SEQ ID NO: 25035 - RNA, 64 nt, Human
gaagacggauuucacauccacaggacggucuugaagaaaauaacacuguguauauuauuuuaaa

SEQ ID NO: 25036 - RNA, 64 nt, Human
acugacccaagccaaacagaaacaauaacccucgagaaaauaggucaacaaucuguugugggga

SEQ ID NO: 25037 - RNA, 64 nt, Human
cucaagugagccacuggaaagaaagcaaaacaagagaaaauaaaugaguuguuugacauaauuu

SEQ ID NO: 25038 - RNA, 64 nt, Human
uauuuuucucucagaauagaaagaaaacacaaagagaaaauaugaacaauauaaagcacuuaaa

SEQ ID NO: 25039 - RNA, 64 nt, Human
acacaugacuaccuuugagcuaaugacugucuccagaaaauaacugugccccaagaagugcucc

SEQ ID NO: 25040 - RNA, 64 nt, Human
ucucucucugcagagcccuguuucuaauugugguagaaaauauugagacagagcauuugccaug

SEQ ID NO: 25041 - RNA, 64 nt, Human
cuuguaaaacaugucaagauuuuuccaccaagcuagaaaauaaaaaacuuaguucuaccacauc

SEQ ID NO: 25042 - RNA, 64 nt, Human
caacagacauuuauuuucuccucucccuugaauaagaaaauaaguuuuccauuccuaugaacug

SEQ ID NO: 25043 - RNA, 64 nt, Human
gaaauggauuauuugucagcccgauuauuugcaaagaaaauauacaauuaucaagcagagacca

SEQ ID NO: 25044 - RNA, 64 nt, Human
aagaauaaaauuuucuacaucaaaguaagacuugagaaaauaaacuuauguguauauauguuua

SEQ ID NO: 25045 - RNA, 64 nt, Human
agaaauacuuuuaaauuuuuccuucaugcucuagagaaaauaauuuuauuuuuaaauaaacgcc

SEQ ID NO: 25046 - RNA, 64 nt, Human
caguccuauauaaaacuaaauuugcuaucuguguagaaaauaauuucaugacauuuacaaucag

SEQ ID NO: 25047 - RNA, 64 nt, Human
aaauagccaucugcuaucagcaucauuauguaaaagaaaauauauuuuagccccuaaaauuagg

SEQ ID NO: 25048 - RNA, 64 nt, Human
cagguagcccaaaauagagaaagauuagauaaagagaaaauaaguauccaucagagacaguauc

SEQ ID NO: 25049 - RNA, 64 nt, Human
caaucaggacuauuccuagacacuagcaaaaucuagaaaauaaauaacaaggcugggugcggug

SEQ ID NO: 25050 - RNA, 64 nt, Human
uuuuuaauuagugaaaaauucaugaauaccauagagaaaauauuuuagaauuuaauguuucuua

SEQ ID NO: 25051 - RNA, 64 nt, Human
uacuuuguuuuuuguuauuuaugaccuuguuuaaagaaaauaaauaucucccaaccuuuauugg

SEQ ID NO: 25052 - RNA, 64 nt, Human
ccaguuuauggggcuagaagagcgagaaaauucaagaaaauaaauguagcuggugggagacuuu

SEQ ID NO: 25053 - RNA, 64 nt, Human
gcucaucugugaacucuacagcaaauuauauuuuagaaaauacuuugugaggccgggcauggug

SEQ ID NO: 25054 - RNA, 64 nt, Human
gcaguaaacuggcagaaaaccaggaaucagagaaagaaaauauaauuuaacuuuaaagauguaa

SEQ ID NO: 25055 - RNA, 64 nt, Human
uuagacauuuaaauagaaaguugugugccccuauagaaaauauuugagaauuucuuauacuauc

SEQ ID NO: 25056 - RNA, 64 nt, Human
aauguuuguccucccuuaauuuugccucaacacaagaaaauaaguuuuauguccauuuuuguuc

SEQ ID NO: 25057 - RNA, 64 nt, Human
uuaauaauuuuuuauuuucauaggaugaaguuagagaaaauauucagcuguacacacaaagucu

SEQ ID NO: 25058 - RNA, 64 nt, Human
auagaggccuuuaaauacauuccaugcccuccccagaaaauagucugugggagucaguugccuu

SEQ ID NO: 25059 - RNA, 64 nt, Human
uaaaaacuuucuguuuucuggggucugggaaaauagaaaauaagauuucaaauauuaaauaagc

SEQ ID NO: 25060 - RNA, 64 nt, Human
aaaaggcuguggccucagggcgccucccagugccagaaaauaaaguccuuuuggauucugcugg

SEQ ID NO: 25061 - RNA, 64 nt, Human
ccucaaaaaaauagguuaaguuucagugccagcuagaaaauacugcuuucugccaucgauuggg

SEQ ID NO: 25062 - RNA, 64 nt, Human
guuuacccucgaugcccuuauuugugaguuaaagagaaaauaucauaaaugguauacucuuaag

SEQ ID NO: 25063 - RNA, 64 nt, Human
acagaacgagacuccuaaucaaaaaaaaaacacaagaaaauagagugaggcuuuuuuaccguau

SEQ ID NO: 25064 - RNA, 64 nt, Human
uacugcuaauggagaagaaaacagggggucugggagaaaauagagaacaugauagcaaaaucua

SEQ ID NO: 25065 - RNA, 64 nt, Human
uaccauagcaaggccuaauguuagcuuuagcuuuagaaaauaacaguuugugaacuuacuuccc

SEQ ID NO: 25066 - RNA, 64 nt, Human
gccuuaauuuguauuuuaguaguauuuucuuaguagaaaauauuuguggaaucagauaaaacua

SEQ ID NO: 25067 - RNA, 64 nt, Human
aaaguauaaacaaauuauguauuuacuuacuaauagaaaauauagguaauuuggggaaauuuau

SEQ ID NO: 25068 - RNA, 64 nt, Human
aaaucuauuuuaaaaugugauuuucuauaacugaagaaaauaucuugcuaauuuuaccuaaugu

SEQ ID NO: 25069 - RNA, 64 nt, Human
ggcuucaaguuguaaaaaugaaagugacuuuaaaagaaaauaggggaugguccaggaucuccac

SEQ ID NO: 25070 - RNA, 64 nt, Human
ggaaugagcauucucuuguuuuaauguuggugucagaaaauaaauaugaaacauuaaguccaaa

SEQ ID NO: 25071 - RNA, 64 nt, Human
cugggauuacaggcgugagccaccgugcccggccagaaaauacauucuuuacagcaaauguuau

SEQ ID NO: 25072 - RNA, 64 nt, Human
gguuuuauuuuuggcuuauuccaagggguaagccagaaaauagaaaugauuauuucugauuaau

SEQ ID NO: 25073 - RNA, 64 nt, Human
uuaacauuuauaggaggaaaaaaaucacuuugggagaaaauaaaauucaacucaagcauaaagc

SEQ ID NO: 25074 - RNA, 64 nt, Human
aagggucagcaacaacaaagaaaaagacaauuacagaaaauaagcaagauuuggaaaggaagua

SEQ ID NO: 25075 - RNA, 64 nt, Human
aauggugagguugaugggaagacuuccuucccaaagaaaauagauccuccaugcaggaucuagg

SEQ ID NO: 25076 - RNA, 64 nt, Human
cugugguuggaucaaggacucauuccugccuuggagaaaauacuucaaccagagcagggagccu

SEQ ID NO: 25077 - RNA, 62 nt, Human
cgccuccaccacagaacuagacuuguuuuuuaagaaaauauauauuauauauagagagaauu

SEQ ID NO: 25078 - RNA, 64 nt, Human
gggucugcauuggaggugcccuauaaaccagaagagaaaauacugaaagcacaggggcagggac

SEQ ID NO: 25079 - RNA, 64 nt, Human
gaaacccauuaggcaugccuaauauuuaggcaagagaaaauaaaccaagauagauccauuugga

SEQ ID NO: 25080 - RNA, 64 nt, Human
uagagcagaaauaaaaaggaagaaaauguagauuagaaaauaagacuucugagaaaaaguucaa

SEQ ID NO: 25081 - RNA, 64 nt, Human
gauugcaugacuauuauuuaucuucuuuuaguguagaaaauaauuuuuuacaaaaagucacuuu

SEQ ID NO: 25082 - RNA, 64 nt, Human
aacauagacuuauuuuuaaauuguaccaaucacaagaaaauaauggcaauaauuaucaaaacuu

SEQ ID NO: 25083 - RNA, 64 nt, Human
aauuuaaaucaaagaacauuuauguaaccagaucagaaaauacagcugaaaauuuauauucagu

SEQ ID NO: 25084 - RNA, 64 nt, Human
uauaaacaaccuagacaguacccuuggccuuuacagaaaauauggugcuguuuucuacccuugg

SEQ ID NO: 25085 - RNA, 64 nt, Human
guucacuuuuucucuuccacuuccaauuaugaagagaaaauauuuguucaggguuguccccccg

SEQ ID NO: 25086 - RNA, 64 nt, Human
acugauuuagaaaaacaaaugauuaguuaaaaaaagaaaauauacauuuguugguaacuaaugu

SEQ ID NO: 25087 - RNA, 64 nt, Human
gguaaaaaaucauucacccaauuugaagcauagaagaaaauaguugcugagguuuuuuaauaac

SEQ ID NO: 25088 - RNA, 64 nt, Human
aggaaaaaccuguggguugugcuaauuucuguccagaaaauaggguggacagaagcuugugggg

SEQ ID NO: 25089 - RNA, 64 nt, Human
ucuaaggacuuuccugcuagauauuucuggaaggagaaaauacaacaugucauuuaucaacguc

SEQ ID NO: 25090 - RNA, 64 nt, Human
accguuaacacauuaaagagucugauuuuguugaagaaaauauuugcaauaaauucaagacucu

SEQ ID NO: 25091 - RNA, 64 nt, Human
aagagcucaacucucucccaaccucaccauggaaagaaaauaauuaugaaugccacugaggcac

SEQ ID NO: 25092 - RNA, 64 nt, Human
ggcugucugcccagagaaauaaguaauuuauauaagaaaauaaauuucauaaauaaauugccuu

SEQ ID NO: 25093 - RNA, 64 nt, Human
aaaauggacucucuuugugacaaagauauucaacagaaaauauugacccugcauugcaaaacac

SEQ ID NO: 25094 - RNA, 64 nt, Human
uggcauaugucuccgauuuagaugguuauucucuagaaaauaguauuuaaagacauuuuaugaa

SEQ ID NO: 25095 - RNA, 64 nt, Human
cuuuuuuuuuuuuuuuccuauuggaucuuccuggagaaaauacuuuuuuuuuuuuuuuuuuuga

SEQ ID NO: 25096 - RNA, 64 nt, Human
acauuguauucguguuugcauuauuaauuugaauagaaaauaaucacauuuucaacccauuuau

SEQ ID NO: 25097 - RNA, 64 nt, Human
uuaaauaagauuuaauucacaucaaauaaaauuuagaaaauaaaauuuaacucacacugcccag

SEQ ID NO: 25098 - RNA, 64 nt, Human
uuguaaaguaugugguuauaugcagugaaacugcagaaaauacuccugguugaggaguuuucac

SEQ ID NO: 25099 - RNA, 64 nt, Human
uauccuucauaugaucacucaucuugaguuaauuagaaaauaccugaguucacgugcuaaaguc

SEQ ID NO: 25100 - RNA, 64 nt, Human
aucaccaaaaugaaaagguggacuguagauugggagaaaauauuugcaaaccguuaucugguaa

SEQ ID NO: 25101 - RNA, 64 nt, Human
ugccuacuuucacauuuauuuaaauuuuugugaaagaaaauacaguuuuaaaggcuauaggaau

SEQ ID NO: 25102 - RNA, 64 nt, Human
uauuuuucuaaauauauguauauauacaguacauagaaaauagaacuuuuauuuugugaccuaa

SEQ ID NO: 25103 - RNA, 64 nt, Human
auacauccuucaguauaggagaugagggaaugagagaaaauauuuuuugaagaagcauuucugu

SEQ ID NO: 25104 - RNA, 60 nt, Human; identical to SEQ ID NO: 23963

SEQ ID NO: 25105 - RNA, 64 nt, Human
aaaaaaagugaaugacguuuguuuagccaguaggagaaaauaaauaaauaaauaaaucccuucg

SEQ ID NO: 25106 - RNA, 64 nt, Human
uaauagaaguuuaagaaaaguuuccguuugcacaagaaaauaacgcuugggcauuaaaugaaug

SEQ ID NO: 25107 - RNA, 64 nt, Human
ugggaucuacugugauguugucuucaaaggcaggagaaaauaauguucacaauaaaaugugcua

SEQ ID NO: 25108 - RNA, 64 nt, Human
uguaguuuugauccaaaaucuaaaacuuaaagucagaaaauaauuaaaauuuuucuuguagaaa

SEQ ID NO: 25109 - RNA, 64 nt, Human
uuuuucaguuccaugugccucccaaauaaaaaacagaaaauaaguaguuuuugugaauugacuu

SEQ ID NO: 25110 - RNA, 64 nt, Human
auugccuuugagaauaaacucauaaggucuaccaagaaaauaaauguuaugauguuucaguugg

SEQ ID NO: 25111 - RNA, 64 nt, Human
cuuuugguggugaggaggaagaacaaauaauagaagaaaauaaaaaugagauagaagaaaagua

SEQ ID NO: 25112 - RNA, 64 nt, Human
caauggagauaaauuaauaguagaugugguucccagaaaauauaaucaaaauucaaagauuuuu

SEQ ID NO: 25113 - RNA, 64 nt, Human
gcaucuccaggugaugcccaaggcacagggcugcagaaaauaaaccuccagauuccaccaacac

SEQ ID NO: 25114 - RNA, 64 nt, Human
auaugguuuguacaauguacaauuguuucauuucagaaaauaaaaauuucaaaucaugaauacc

SEQ ID NO: 25115 - RNA, 64 nt, Human
gccaggacccgguaggccugagccucaacucuucagaaaauaguguuuuuaauauuccucuuca

SEQ ID NO: 25116 - RNA, 64 nt, Human
ucuucagaaaauaguguuuuuaauauuccucuucagaaaauaguguuuuuaauauuccgagcua

SEQ ID NO: 25117 - RNA, 64 nt, Human
agguauaggauaauuuuuaauauggugaccuuacagaaaauauuucccaaacauccuuuucauc

SEQ ID NO: 25118 - RNA, 64 nt, Human
uaauguaguuugagauagugauuaagugcuaugaagaaaauaaacuagggugaugauuuuagug

SEQ ID NO: 25119 - RNA, 64 nt, Human
augucgagcuuuaaaguccauaauuguuaucuucagaaaauauuauuugaccuacaguaugucc

SEQ ID NO: 25120 - RNA, 64 nt, Human
gguacuauuauauaaccuauacacaagauacaggagaaaauaugcuugauuuuuauuuggcagg

SEQ ID NO: 25121 - RNA, 64 nt, Human
uagcuggacacacaaggaauucacaacuccccaaagaaaauacaucuggaugaccugccuagca

SEQ ID NO: 25122 - RNA, 64 nt, Human
agacacaaauaaaauacaacuguucaauggaaauagaaaauaaacaccauaaaagagagaagag

SEQ ID NO: 25123 - RNA, 64 nt, Human
acacuaaguuaaugucuaagauaauggggaaaauagaaaauaacauuauuaaguguaaaaccag

SEQ ID NO: 25124 - RNA, 64 nt, Human
caaacaaaaaaaauuuguauguaaacugaaaauaagaaaauacauuagcaagcuuaaugguuau

SEQ ID NO: 25125 - RNA, 64 nt, Human
gagcaaccacucugguaaucuagaauucaguggcagaaaauaaauaagaagauaacuuccuuca

SEQ ID NO: 25126 - RNA, 64 nt, Human
cuucauuaaaguauauuuaacucauaauuuuugcagaaaauaugcuauauauuaggcaagaaua

SEQ ID NO: 25127 - RNA, 64 nt, Human
uauauauaucaagauuuggguacuuuauuuuaguagaaaauauauaucuuuuacauauguaugu

SEQ ID NO: 25128 - RNA, 64 nt, Human
acuacaaauaauuuucuuaaaagucuaagauagcagaaaauacaguaaaaacacaggagaagaa

SEQ ID NO: 25129 - RNA, 64 nt, Human
aauuaaugaugucugacaugcuauuuuuguagggagaaaauaugugcuaaugauauuuugaguu

SEQ ID NO: 25130 - RNA, 64 nt, Human
uuuuacuaggguauugaauaaaucuagucuuacuagaaaauaaaaggagcuguuuuguggcuuu

SEQ ID NO: 25131 - RNA, 64 nt, Human
auucuucaacuccuuuuggcaagaaaacuguaacagaaaauaaauuuugaauguguacuuaagu

SEQ ID NO: 25132 - RNA, 64 nt, Human
auaaaaagucaaacauugugaucuauaaaugcacagaaaauacuuuguaaaaaguagcauccuu

SEQ ID NO: 25133 - RNA, 64 nt, Human
gggcuauaauagcaauaaaaguuagacgaaguguagaaaauaaaauaaauuucauaauguuagu

SEQ ID NO: 25134 - RNA, 64 nt, Human
agcauuaaggaaguauaugaucugacuuuucagaagaaaauaaacaaaugcauuauguaagguc

SEQ ID NO: 25135 - RNA, 64 nt, Human
gaaccuacugcaaaaagauuguccaaaaugccuaagaaaauacuccucugaugcauuuagccuu

SEQ ID NO: 25136 - RNA, 64 nt, Human
uucuucaauauuuacaauaauaggaugaucuacaagaaaauaaguuucuuuuugcaaauuuuua

SEQ ID NO: 25137 - RNA, 64 nt, Human
gaguucuccugggucugcagaagguugggaauuuagaaaauaaggcuguucuuucauauuuuaa

SEQ ID NO: 25138 - RNA, 64 nt, Human
gagagaaaauauguaaccacaucuuaguggcccaagaaaauacaggccugaagggauaagauug

SEQ ID NO: 25139 - RNA, 64 nt, Human
ggaauuguuuugcaaacguucuaggagaugugagagaaaauauguaaccacaucuuaguggccc

SEQ ID NO: 25140 - RNA, 64 nt, Human
gagagagccagguggaaugccauaaaucacacugagaaaauauuucuggcaaacagcuccucuu

SEQ ID NO: 25141 - RNA, 64 nt, Human
acucucauuuaauauucaugcuuuugugccuuuaagaaaauauuuuuugucauuuuuuguguua

SEQ ID NO: 25142 - RNA, 64 nt, Human
uauaacauuuacaaaaagagcaaaacuaagugauagaaaauauuucacacauguucuuauagau

SEQ ID NO: 25143 - RNA, 64 nt, Human
aaucaaacaggaggauaacgaccugaagaaaaugagaaaauaaaauauuucuuaauuguaauca

SEQ ID NO: 25144 - RNA, 64 nt, Human
gaauuagccaaugaaauguaaauaaacuuuggacagaaaauagcaauguauuuuuuuaauauaa

SEQ ID NO: 25145 - RNA, 64 nt, Human
ucugauaccuguugguccacaucaucuuuucagaagaaaauaaaagcauuuaauugccaauggg

SEQ ID NO: 25146 - RNA, 64 nt, Human
uaaauucuacaaacugcucucaaguuaccaaggaagaaaauacacgacaaccacuuauggcucu

SEQ ID NO: 25147 - RNA, 64 nt, Human
ugcuauuuacauacagcucuauauauauaaaaaaagaaaauaugaauauuacguaucagugcau

SEQ ID NO: 25148 - RNA, 64 nt, Human
gcagugugagacuucucucacuggccuugaaauaagaaaauauugaacauuuuaauauuaaaaa

SEQ ID NO: 25149 - RNA, 64 nt, Human
aguuugcuuaccuuaagaauugcccaaaaaugaaagaaaauaugagcuuuucaguuaaacauac

SEQ ID NO: 25150 - RNA, 64 nt, Human
auuuuuguuuuguuuuguucuuaagaacauaccaagaaaauaccagugaauuguuggauaugaa

SEQ ID NO: 25151 - RNA, 64 nt, Human
gcuuacuuguaacaugaaaguaguagaugcugccagaaaauaguguccucaauauuuuaaaaca

SEQ ID NO: 25152 - RNA, 64 nt, Human
uuuucaacaaaauggucauccaaacucaaacuugagaaaauaucuugcuuucaaauuggcacug

SEQ ID NO: 25153 - RNA, 64 nt, Human
uguucauuuugaaaauauguacuguauaacauuaagaaaauauuuaacucccuguaacaaguuc

SEQ ID NO: 25154 - RNA, 64 nt, Human
gacuuggaagccaauuugguccuuuaauaaguaaagaaaauaauauguuuaaaaauguaaaugu

SEQ ID NO: 25155 - RNA, 64 nt, Human
uucccuuugauuaguauguguuacauauaaagacagaaaauaaaguauaaaucaagagcuuaaa

SEQ ID NO: 25156 - RNA, 64 nt, Human
uuuugcugugggugaaauuuugauuugagguauuagaaaauauuuuugugccgaacaauacauu

SEQ ID NO: 25157 - RNA, 64 nt, Human
caaaugguaucuaauuaauaacuagucugacaucagaaaauaaaauugaggcugauuuuuaaaa

SEQ ID NO: 25158 - RNA, 64 nt, Human
ggugugaaaacaagugucaaaauuccucauauagagaaaauaauuuugaguuuagaguauuauc

SEQ ID NO: 25159 - RNA, 64 nt, Human
ggaaccugcaaaaaauacuuuuucuaaugaggagagaaaauauauguauuuuuauauaauaucu

SEQ ID NO: 25160 - RNA, 64 nt, Human
ucauugcacuucuaaaauucagccuuguucauucagaaaauaaggauggauuuugugaauaauu

SEQ ID NO: 25161 - RNA, 64 nt, Human
uucaggacuuaaaacaaaccuugugcucuuuucaagaaaauagagaucuuaugucaaguucuac

SEQ ID NO: 25162 - RNA, 64 nt, Human
aaaaaacugagacuauggacauucaaaucaugggagaaaauaauuuuguagauuauguuccauu

SEQ ID NO: 25163 - RNA, 64 nt, Human
ccgagagaauuguuugcaaguuuuggguuuuauuagaaaauauuugaaaguauuuuuauuaaug

SEQ ID NO: 25164 - RNA, 64 nt, Human
uuuuuuuuucucauuuaaaauaaaaaaggaagaaagaaaauaauuuuccuuguaaaaucgggcc

SEQ ID NO: 25165 - RNA, 64 nt, Human
ucuccauuucauagaugaaaauagugaagcccacagaaaauaaguagcuccuccacagguugua

SEQ ID NO: 25166 - RNA, 64 nt, Human
uauuacuuuauuaaaacuaaaucugaaauggaauagaaaauagaauggauuacauacagauggu

SEQ ID NO: 25167 - RNA, 64 nt, Human
uagaaugacuauucuaaauauuaauguauuaaaaagaaaauacaacaaaauguauauuuagaca

SEQ ID NO: 25168 - RNA, 64 nt, Human
aggaaagugugacacaguuuuuaaauuuagauguagaaaauaaugaauuaaugagauuggugaa

SEQ ID NO: 25169 - RNA, 64 nt, Human
gcggggaggccggcgcagcgcagagcgggcucgaagaaaauaauucucuauuauuuuuauuacc

SEQ ID NO: 25170 - RNA, 64 nt, Human
ugcuuuuggagaacuugucaaauuacagccaaugagaaaauaaggaccuagcauacuguggaga

SEQ ID NO: 25171 - RNA, 64 nt, Human
aacugaauuuuaaacuuuuugcaugcuucuauguagaaaauaaucaaaugauaauagauacuua

SEQ ID NO: 25172 - RNA, 64 nt, Human
uuguggaguuagccuccugugguaaaggaauugaagaaaauauaacaccuuacacccuuuuuca

SEQ ID NO: 25173 - RNA, 64 nt, Human
gguuuccuguaaaguacaauccaacucaucaaguagaaaauaagcaugcaucauugaaaagaga

SEQ ID NO: 25174 - RNA, 64 nt, Human
auguguuuggucuauuuccaaaaaccugagggggagaaaauacuuugcuuuugccuuaacacau

SEQ ID NO: 25175 - RNA, 64 nt, Human
uuuaaugugaaacauuuagugaauacaguaaaggagaaaauaaaauuguuagcauucuacccag

SEQ ID NO: 25176 - RNA, 51 nt, Human; identical to SEQ ID NO: 24035

SEQ ID NO: 25177 - RNA, 64 nt, Human
auauauggacauggaaauauuuauauaauuuuauagaaaauaaccuuuuagauggucaaagugu

SEQ ID NO: 25178 - RNA, 64 nt, Human
agacuuuuauaggcuugaaaucauccaucacauaagaaaauagaaaucauauuaaaagugaauu

SEQ ID NO: 25179 - RNA, 64 nt, Human
guaguauacuagaguuuaggaaaaugaaaauuuuagaaaauauguuuugucacccuguugguca

SEQ ID NO: 25180 - RNA, 64 nt, Human
aguauucauucuacuuuuucaaaugauaugcuguagaaaauauuccuugaagaugugagauuua

SEQ ID NO: 25181 - RNA, 64 nt, Human
gagggguuacagaugcauauguccaauauaaaauagaaaauauauuaacguuugaaauuaaacu

SEQ ID NO: 25182 - RNA, 64 nt, Human
aauauuuuaucauauguucuaaaagagaaggaagagaaaauacuacuuucucaaaauggaagcc

SEQ ID NO: 25183 - RNA, 64 nt, Human
uaggauccauuauuuccccugaaggcuucuuguuagaaaauaguacaguuacaaccaauaggaa

SEQ ID NO: 25184 - RNA, 64 nt, Human
uauuuuaagugccaauuaauuuaucagacuaaauagaaaauauuugagccauuacugaauucac

SEQ ID NO: 25185 - RNA, 64 nt, Human
auuuagugcuuuuauauucauuuccuugcauuuaagaaaauaugaaagcuuaaggaauuaugug

SEQ ID NO: 25186 - RNA, 64 nt, Human
cggcuaaguaccuccuacacauuucccaucaaucagaaaauagacagguacacuaaagggaccc

SEQ ID NO: 25187 - RNA, 64 nt, Human
uuaacaauaguuuuuaucuaauaaaagcacugcaagaaaauaggguagaauuguuacagcugga

SEQ ID NO: 25188 - RNA, 64 nt, Human
ccaaaaauuaaauugaaacaaaaugucccaacuaagaaaauauauagagcauuuuauuuuuuuu

SEQ ID NO: 25189 - RNA, 64 nt, Human
auauuaaauaaaccagagaucugaucuucaagcaagaaaauaagcaguguuguacuugugaauu

SEQ ID NO: 25190 - RNA, 64 nt, Human
gcacuuucccucaaccagcccuuaacuagaacacagaaaauaaaaccaagacuggaaggucccc

SEQ ID NO: 25191 - RNA, 64 nt, Human
gcacccucaucugggaauagggaaggcaccuugcagaaaauaugagcaauuugauauuaacuaa

SEQ ID NO: 25192 - RNA, 64 nt, Human
uucagcaaagucuucagaugcgauccuguguaggagaaaauacccuucuggugccccaugaaaa

SEQ ID NO: 25193 - RNA, 64 nt, Human
auuagagauaauugucuaguuagggggcagcuggagaaaauaagcuaaguuugcaauaacagag

SEQ ID NO: 25194 - RNA, 64 nt, Human
auccauuaaaguaacuuuuuuaacuaugagaauuagaaaauaagggacaacagggguuaaaaau

SEQ ID NO: 25195 - RNA, 64 nt, Human
augacauuuuagaaguggagagugcaucauauguagaaaauaaauauucagacguggcucauua

SEQ ID NO: 25196 - RNA, 64 nt, Human
ucuccauacgcucauagucacauauggaauuuugagaaaauaaagcaugcugucuuuaggaauu

SEQ ID NO: 25197 - RNA, 64 nt, Human
gacagauguuggcuuauuguaaaaauaaaguuaaagaaaauaauguauguauugguaaugaugu

SEQ ID NO: 25198 - RNA, 64 nt, Human
aacaucauagagugugaauuucuauuugggaaggagaaaauacaagagaaaauuauaauguaaa

SEQ ID NO: 25199 - RNA, 64 nt, Human
auauaccacuuccuaaauauccaucuuuggugaaagaaaauagugugguaagaguacccaugau

SEQ ID NO: 25200 - RNA, 64 nt, Human
auccuuuguuauauuuuagugauccacaagauugagaaaauauuauauaguuagauaauaacau

SEQ ID NO: 25201 - RNA, 64 nt, Human
auugaccucaucauuaauaagugaagaauacaucagaaaauaaaauauucacucuccauuagaa

SEQ ID NO: 25202 - RNA, 64 nt, Human
uguggaaauauuuucaagauaauguuccuuaggaagaaaauaacauucuuggguugagggaagg

SEQ ID NO: 25203 - RNA, 64 nt, Human
ucuauaacagauccuuucaaaagaagaguuuuagagaaaauaaauuuaacuuuaaccacaguga

SEQ ID NO: 25204 - RNA, 64 nt, Human
uuguaaagaguuccguuugccuuucaauuuuuagagaaaauaaagacugcauucaucucauugu

SEQ ID NO: 25205 - RNA, 64 nt, Human
agucgaugaauugcuuuuuugacuuagaagcugaagaaaauagacauagccggcauaucucaug

SEQ ID NO: 25206 - RNA, 64 nt, Human
aagucuuaaaauggaaugagaauguuguuuuaaaagaaaauagcaaaacaacaaaaaagcaaac

SEQ ID NO: 25207 - RNA, 64 nt, Human
uauguuuuaaucucccuugucccucagaauaagcagaaaauauaacugcagcuguaugucguag

SEQ ID NO: 25208 - RNA, 64 nt, Human
uauggacaguggaggcagcuggaauggcaagugcagaaaauaggaacaguucuauacagugcuc

SEQ ID NO: 25209 - RNA, 64 nt, Human
ucacauucugaaaaauaacauucucagaauccacagaaaauauacuuaguuacuacugaagaua

SEQ ID NO: 25210 - RNA, 64 nt, Human
gggccgggcccgccaguucuuuuccggauucuguagaaaauacauacuuccugugccauaccaa

SEQ ID NO: 25211 - RNA, 64 nt, Human
agcucagaggaaugcuuuuagcagaaaacaggaaagaaaauaucccuuaaaaauuuuuuuugaa

SEQ ID NO: 25212 - RNA, 64 nt, Human
gacuaaacgcaguaguuuuuuuaaaaggggagauagaaaauaaaugguuuuguuggagugcauu

SEQ ID NO: 25213 - RNA, 57 nt, Human; identical to SEQ ID NO: 24072

SEQ ID NO: 25214 - RNA, 64 nt, Human
augauuuuaaaaaaggaaucaauagaugcuuugaagaaaauaaaacuuauacaguugauugaaa

SEQ ID NO: 25215 - RNA, 64 nt, Human
aguuuaaugugcucuuuguaaaaugaaauuguaaagaaaauaccaguguuucucaucccauuga

SEQ ID NO: 25216 - RNA, 64 nt, Human
uaauauuaucuuuccacgaaauggauauauuucuagaaaauauauauuuacuaccauaauuucu

SEQ ID NO: 25217 - RNA, 64 nt, Human
guugcucucuagucucugaaaagcaaaaaaagugagaaaauaauuucuucagagauaacuucaa

SEQ ID NO: 25218 - RNA, 64 nt, Human
gauuauacaggcuaugaaaaccauuuuaaaggaaagaaaauauguaaauucuauugagcaaaau

SEQ ID NO: 25219 - RNA, 64 nt, Human
auuauguuuggaugcagcagcugaauauauccagagaaaauaaacuuaagauuacuggccuuug

SEQ ID NO: 25220 - RNA, 64 nt, Human
caaaaguaauuaauaguguuggaagauguaggugagaaaauauuccugaaaguagaacugaaag

SEQ ID NO: 25221 - RNA, 64 nt, Human
augagaaaggggagccaaggcuuuauacgucuaaagaaaauauucaguagcugaauccgcccag

SEQ ID NO: 25222 - RNA, 64 nt, Human
cauauacuaaguuacagaggaugcauccaaguagagaaaauaauauguggguuaagauacaucc

SEQ ID NO: 25223 - RNA, 64 nt, Human
uuugagaaacaggcugacacuauucucuuugauuagaaaauaaacucauaaaacucauaauguu

SEQ ID NO: 25224 - RNA, 64 nt, Human
auuucauuuuucuaaaggggcagaggccucuuuuagaaaauaauaaaaugcaaugugugugauu

SEQ ID NO: 25225 - RNA, 64 nt, Human
uagcaugaagcaugaauuauuuucauauaaauauagaaaauagagaaaaggcuaugccuguaau

SEQ ID NO: 25226 - RNA, 64 nt, Human
uucaaggccuucaguuuauuuccacuauuuucaaagaaaauagauuagguuugcgggggucuga

SEQ ID NO: 25227 - RNA, 64 nt, Human
gagggccgcaagccccaaauggaaaacuguuuuuagaaaauaugaugauuuuugauugcuuuug

SEQ ID NO: 25228 - RNA, 64 nt, Human
cauugcacuugguaccaugcuuuaccucauuucaagaaaauaugcuuaacagagaggaaaaaaa

SEQ ID NO: 25229 - RNA, 64 nt, Human
aagucauuguucccaucccuuuuuuguguguuucagaaaauagugaacuugauuccccugcuuc

SEQ ID NO: 25230 - RNA, 64 nt, Human
gaucaucuugaaguauuauuucacauugaaaagaagaaaauauauugauaacuauagauguuau

SEQ ID NO: 25231 - RNA, 64 nt, Human
auaauucagguuugaucaaggugugaauaacugaagaaaauaacuugcuggcuauauaggaaaa

SEQ ID NO: 25232 - RNA, 64 nt, Human
aaggggagggcgcauacccgagacgauuguaugaagaaaauauggaggaacuguuacauguucg

SEQ ID NO: 25233 - RNA, 64 nt, Human
uuucucaaagauuagguauauauuuaaauggaagagaaaauauuuuuaugggagaaaaauacau

SEQ ID NO: 25234 - RNA, 64 nt, Human
gcuguggagguugauauuauuaauaguguuaugcagaaaauaugaauggcagggaggggcagag

SEQ ID NO: 25235 - RNA, 64 nt, Human
uuucccucagugaaguagcaauaggcuguaaucaagaaaauaugccauuuauagagauaagaua

SEQ ID NO: 25236 - RNA, 64 nt, Human
auuuuaaaguuagaauauauuugaaugcauggguagaaaauaucauauuuuaaaacuauguaua

SEQ ID NO: 25237 - RNA, 64 nt, Human
uucagugugaauucacugaauguuuauagacaaaagaaaauacacacuaaaacuaaucuucauu

SEQ ID NO: 25238 - RNA, 64 nt, Human
uuucuccuauuuuuaaauuuauuaugcaaauuuuagaaaauaaaauuugcucuaguuacacacc

SEQ ID NO: 25239 - RNA, 64 nt, Human
ggaaacuuguuuuuuuaacgucagccagauauuuagaaaauaaccucaaaaguguuuauauggu

SEQ ID NO: 25240 - RNA, 64 nt, Human
cuagagagaucccaucucuaaaaaauaaaauauaagaaaauaaaacuuaggggauauacagauu

SEQ ID NO: 25241 - RNA, 64 nt, Human
uuugaaaauguuauaagagcuuuguaaauauuucagaaaauaugggauaaaugccugaauuugg

SEQ ID NO: 25242 - RNA, 64 nt, Human
auugaagggguuccuuuuccauugcucaguuuuuagaaaauaauucucaucuuuuuucuaaaga

SEQ ID NO: 25243 - RNA, 64 nt, Human
cuuaugauuuguaaaagccgucauggggucaauaagaaaauaggggugauggagggggagaagc

SEQ ID NO: 25244 - RNA, 64 nt, Human
cucccucggccugggauuucagagcuggaaauauagaaaauaucuagcccaaagccuucauuuu

SEQ ID NO: 25245 - RNA, 64 nt, Human
gggcagccguggccuaggcccaaacucugcucugagaaaauaaauaucuguaccaccugucaua

SEQ ID NO: 25246 - RNA, 64 nt, Human
acaucaagguuaaaacacaaaugacagauauggaagaaaauauuugcagcacauaaaaaaauca

SEQ ID NO: 25247 - RNA, 64 nt, Human
cauuuuaugaauguggagaauucuacauugaaacagaaaauaccugggaaugaagauuaaaaau

SEQ ID NO: 25248 - RNA, 64 nt, Human
aagaaagagaauagaaaacacgcaugagauauucagaaaauacuagccuagaaauauagagcau

SEQ ID NO: 25249 - RNA, 64 nt, Human
guuagaguuguacuuuuaaaaaaauuaacgggaaagaaaauaacuuugugaagccaguguauuc

SEQ ID NO: 25250 - RNA, 64 nt, Human
cacggucuaccuuaaccaaggcacuuucuuaagcagaaaauauuguugagguuaccuuugcugc

SEQ ID NO: 25251 - RNA, 64 nt, Human
uuauguuaucauucuuauaacauuguauguuaauagaaaauauauuugcauaauaugcauauau

SEQ ID NO: 25252 - RNA, 64 nt, Human
agaaggaacacauaaguaaguugcuuuggugccaagaaaauaaaaaagcuauuaucaggucucc

SEQ ID NO: 25253 - RNA, 64 nt, Human
auuuggugguuucagaaauguguuaucacccagaagaaaauaguggugugauuuggggauauuu

SEQ ID NO: 25254 - RNA, 64 nt, Human
acuuauaguuguagccuuacaacuuacaggcaucagaaaauaaguaaucaaauuagguaccugg

SEQ ID NO: 25255 - RNA, 64 nt, Human
ccugguuugcuucuauuacuuuucuuugacauaaagaaaauaacuucugcuagguauuacucuc

SEQ ID NO: 25256 - RNA, 64 nt, Human
aaaaugagacccuaucucaaaaacaaaaaggaaaagaaaauauacaugaugggauuccuauugu

SEQ ID NO: 25257 - RNA, 64 nt, Human
uaguucuguugagggcaaaauauuauaaaucuauagaaaauaaacuguuugacuugaaucauuu

SEQ ID NO: 25258 - RNA, 64 nt, Human
uuuaaauauuauguuugugaacuaucuaagcaugagaaaauacaaagcuuucuuuguaucuggc

SEQ ID NO: 25259 - RNA, 64 nt, Human
gagaaaucugaaaaaaaagaaagcaaggauacuaagaaaauagaagguaaagaugagaagaaug

SEQ ID NO: 25260 - RNA, 64 nt, Human
accucaaucuuagacucuggccucaaaaauuguaagaaaauaaacuucugucuuuuaagccacc

SEQ ID NO: 25261 - RNA, 64 nt, Human
uucucuuuuuggcuugugcugggauuuaagaauuagaaaauaaaaauaagcagaaauuaaaaaa

SEQ ID NO: 25262 - RNA, 64 nt, Human
aaaaaccacacacaccagaaaaacaaaagacagcagaaaauaaccagguauucuuagagcuaua

SEQ ID NO: 25263 - RNA, 64 nt, Human
uuuguauuuaauaucaauggacugagucugauucagaaaauaauuguaauguucauauucaaua

SEQ ID NO: 25264 - RNA, 64 nt, Human
ggggagcccagguaugagaaagaaaaaaccacuaagaaaauaccucccugggaggaugagcugg

SEQ ID NO: 25265 - RNA, 64 nt, Human
aauuaaccaguaaacacucuguaguaaccauuacagaaaauacuucugccuuaaaaaauaugau

SEQ ID NO: 25266 - RNA, 64 nt, Human
uaauaaugcuaaaaaaggccuaauaaaaugcccaagaaaauauucagugcauuuauagagaagg

SEQ ID NO: 25267 - RNA, 64 nt, Human
uuacaucagaaaaugggauaaacauacauuucacagaaaauaaucaagacuugcucugcagcca

SEQ ID NO: 25268 - RNA, 64 nt, Human
guuguauaucauauuguaaaguaucauacugccaagaaaauaacuccuagaaaggcauuaucuc

SEQ ID NO: 25269 - RNA, 64 nt, Human
cacaugggcuaguacuugagguguucacugauugagaaaauacccgugagguaugggacucuga

SEQ ID NO: 25270 - RNA, 64 nt, Human
ccuugaucuugggcuuucagcccccaaaggugugagaaaauaaacuucgguugauaaacugcug

SEQ ID NO: 25271 - RNA, 64 nt, Human
uagggacccugccaaguggcaccugauuuacucuagaaaauaaaaguagaaaauacugagucca

SEQ ID NO: 25272 - RNA, 64 nt, Human
aaguggcaccugauuuacucuagaaaauaaaaguagaaaauacugaguccagcuguguuguuug

SEQ ID NO: 25273 - RNA, 64 nt, Human
cagagaaccuguugaaaugugaauuaagaagcuaagaaaauauuucuuagcaacauuuucuuuu

SEQ ID NO: 25274 - RNA, 64 nt, Human
acagccuggaugacaagcaagacccucccuccaaagaaaauaaagcucaaaauaaaauaugauu

SEQ ID NO: 25275 - RNA, 64 nt, Human
uauuuuuccaucaccgagagagagagacagagagagaaaauaaacuaccccuccuauucagaag

SEQ ID NO: 25276 - RNA, 64 nt, Human
cugggccguuuugaugaccucgaaggucacaggcagaaaauaggagcaggauuuccccugggga

SEQ ID NO: 25277 - RNA, 64 nt, Human
gggcauccuaaugcuuacucugguuguuacacaaagaaaauauuggggucacuggcgagcccac

SEQ ID NO: 25278 - RNA, 64 nt, Human
cccuugguuuuguauuuuauuuacagaguuuuacagaaaauaaaaaagcaaaaugucuuuccua

SEQ ID NO: 25279 - RNA, 64 nt, Human
uucaaggcuggaccacucaguuauuauugcuauuagaaaauaauauaucauguuuacuuuuguu

SEQ ID NO: 25280 - RNA, 64 nt, Human
cugccacugucuugugucagaacuuuuacaguacagaaaauaacagaauagccuucuguaauga

SEQ ID NO: 25281 - RNA, 64 nt, Human
aucauuugguugaaacagacuguugcuugauuuuagaaaauacacaaaaacccauauuucugaa

SEQ ID NO: 25282 - RNA, 64 nt, Human
aaguaucgaugcaugccacaacaugggugaaccuagaaaauacugaucuaaaugcaagaagcca

SEQ ID NO: 25283 - RNA, 64 nt, Human
ucucaaggacacauugaauacguugugaccauccagaaaauaaaugcugaggggacacagucac

SEQ ID NO: 25284 - RNA, 64 nt, Human
cuguaaagcaguugaaagaauuuauucagcaaccagaaaauaagcugguaaguauaguauguuu

SEQ ID NO: 25285 - RNA, 64 nt, Human; identical to SEQ ID NO: 25284

SEQ ID NO: 25286 - RNA, 64 nt, Human
ucuuuauaagaaaaaucauaaaugcauauaaaauagaaaauauuuggagauugcuuaucugaaa

SEQ ID NO: 25287 - RNA, 64 nt, Human
auuuucuggccaguguuuaaaacuucaguuucacagaaaauaaggcacccaucugucugccaac

SEQ ID NO: 25288 - RNA, 64 nt, Human
ccccucaggaauuugucuaacacauuucaaggauagaaaauacuucacugccgggcaugguggc

SEQ ID NO: 25289 - RNA, 64 nt, Human
gagccauagagccugaaaucaucuuuguuggcucagaaaauaccuuagcuucacucagcuggac

SEQ ID NO: 25290 - RNA, 64 nt, Human
aggcuuagagcuuggaacaagggggaauaaacccagaaaauacaguuaaacagauggcuguguc

SEQ ID NO: 25291 - RNA, 64 nt, Human
uuacuggugcugaaaggaaggauggauaacgaggagaaaauaaaacugugaggcucaaggcugg

SEQ ID NO: 25292 - RNA, 64 nt, Human
ccagagaucaugcauuuagauuuauauuuuugccagaaaauacaagguuauaauaaaacuaaga

SEQ ID NO: 25293 - RNA, 64 nt, Human
ccaaaaauagcuuuguuuuguaccaacaggaauuagaaaauauaaugaaaagauuucguuccca

SEQ ID NO: 25294 - RNA, 64 nt, Human
ggugaacaaaguuuaccagaaagcaguugagacaagaaaauaagagcucaggaugagggaaaag

SEQ ID NO: 25295 - RNA, 64 nt, Human
ugcaaaauggggcaguggacugacaggcugacauagaaaauaaacuuugcccaaucacaacuug

SEQ ID NO: 25296 - RNA, 64 nt, Human
gacaaggccguuucuuuguuucugagcauaaagaagaaaauaaaucuuuuacuaagcaugagug

SEQ ID NO: 25297 - RNA, 64 nt, Human
gcuucuccagauuuagcauccugcagagccaccgagaaaauaaaaaagcugggcuuggaggcug

SEQ ID NO: 25298 - RNA, 64 nt, Human
agcgggagcccugaaaaauuaggggggaaaugggagaaaauaaugugacauuucaaaaacagca

SEQ ID NO: 25299 - RNA, 64 nt, Human
cuuauugaaaaacuaaagcaaauucuuuauaggaagaaaauaugggaauuugauuacacauaga

SEQ ID NO: 25300 - RNA, 64 nt, Human
aaccaauaauuuuuaaaucauaccaaaaauaguaagaaaauaugcaaacacucugugaucaaac

SEQ ID NO: 25301 - RNA, 64 nt, Human
ccacacagacccuacccuuuccccuagcccaguuagaaaauaagucugggccggcggcgguggc

SEQ ID NO: 25302 - RNA, 64 nt, Human
agacaggaugcccaguuaaguuugaauuucagauagaaaauaauuuuagaauaaauauguucua

SEQ ID NO: 25303 - RNA, 64 nt, Human
gaugaaugcaauaguaggacugcugacauuuugcagaaaauacauuuuauuuaaaaucuccuac

SEQ ID NO: 25304 - RNA, 64 nt, Human
cuuuagccaaagccauaaaaaaccugcaacguagagaaaauaaugcagauacccugacuagcca

SEQ ID NO: 25305 - RNA, 64 nt, Human
gacacauggauuuuggcagggcgggggggguucuagaaaauauaguuccuauaauaaaauggca

SEQ ID NO: 25306 - RNA, 64 nt, Human
aguuuauuuaaugcuugcaacgacucucugagguagaaaauauuguuaauuccguucaggaucc

SEQ ID NO: 25307 - RNA, 64 nt, Human
ugaaauauuuucuugcaucaguauuggcuagaaaagaaaauaaauaaaaccaaguuaauuuagu

SEQ ID NO: 25308 - RNA, 64 nt, Human
aaaacuuugcaccacuuuuguuacaagguacgguagaaaauagugaagucaguuuccucucauc

SEQ ID NO: 25309 - RNA, 64 nt, Human
accuugaaccgccgguucauuuugcaccuuauucagaaaauagagcaucauacucaccgagucu

SEQ ID NO: 25310 - RNA, 64 nt, Human
aauaaaauaaaauauaaaaagaaagagaaagaaaagaaaauaguuccaauuuaucaugccaaau

SEQ ID NO: 25311 - RNA, 64 nt, Human
cuguccacaaaaagucauggcaauaaugguguaaagaaaauaguuucuuggguauuuguaacgu

SEQ ID NO: 25312 - RNA, 64 nt, Human
gaccuacgaauucuaucuuugggaauuuauccuaagaaaauacuuaaggauuuaguuagugaua

SEQ ID NO: 25313 - RNA, 64 nt, Human
aacaacaaaccacaacauugccugcaugucuaaaagaaaauaugggccuggugugguggcucac

SEQ ID NO: 25314 - RNA, 64 nt, Human
aagccaacagaguaaaguggaaggaaguuuauucagaaaauaaaggaguaucacagcucuuuua

SEQ ID NO: 25315 - RNA, 64 nt, Human
guuucugguugaaaucaagguuaggaugcaacugagaaaauaaaagacugcacuuuggagaggc

SEQ ID NO: 25316 - RNA, 64 nt, Human
uggccaugucaccauugagaugaagauauacaacagaaaauaguggcuguguuuggaagcuuca

SEQ ID NO: 25317 - RNA, 64 nt, Human
ggcuugcaccuaguaaagcagggccgagacagaaagaaaauagauucucaacgagauuucacug

SEQ ID NO: 25318 - RNA, 64 nt, Human
aauuaaugaacccaugagaaaugucauauaucuuagaaaauaguuguguguaucuuucugagga

SEQ ID NO: 25319 - RNA, 64 nt, Human
uugguuauugguuuuuuuguauagaccaaagcaaagaaaauaaaaauaacacagaugcguugga

SEQ ID NO: 25320 - RNA, 63 nt, Human
uuucagaugaugaagaaagaggaacgggcuuggaagaaaauaaucaagaagagcaaagcaugg

SEQ ID NO: 25321 - RNA, 64 nt, Human
cuaaaugagguagaugaauauucugguucuucagagaaaauagacuuacuggccagugauccuc

SEQ ID NO: 25322 - RNA, 64 nt, Human
gcagccuaccugaccaucucuuuagcugucaccaagaaaauaaaccccacugucucucuagcuu

SEQ ID NO: 25323 - RNA, 64 nt, Human
aaaaagaaaaagaacaaaaaauauauaucacucuagaaaauaaaucucuccugugucuuauucu

SEQ ID NO: 25324 - RNA, 64 nt, Human
ucuuugauuuuucauucaaguaaauauagccauaagaaaauaucugcuauacaggaaaaccagu

SEQ ID NO: 25325 - RNA, 64 nt, Human
uuuguacauacaaaauucuuccaaaagagagaggagaaaauacagcucugauggcaucaaacgg

SEQ ID NO: 25326 - RNA, 64 nt, Human
agaaacaaaagucucauucauaagaggucuuagaagaaaauaaccaguuaaccugauuucaauu

SEQ ID NO: 25327 - RNA, 64 nt, Human
auccuggcuaacacggugaaacaccgucucuaccagaaaauacaaaaaauuagccaggcgcggu

SEQ ID NO: 25328 - RNA, 64 nt, Human
cacuaugauuuauuggguuucuuaaaaaucuugaagaaaauaauaaaauuuaucucacaauaag

SEQ ID NO: 25329 - RNA, 64 nt, Human
acgaauuuugcaaguuuaauuugauuuauuucagagaaaauagaaaaaacaauguuagaagguu

SEQ ID NO: 25330 - RNA, 64 nt, Human
ggccagaagaaaaguugcuuuucaaagaggaagaagaaaauagcagcaagaaauaucucuuucu

SEQ ID NO: 25331 - RNA, 64 nt, Human
uuugacacaaaccauguguucugauuuuugguucagaaaauauugaaacugugaguuguuuuuu

SEQ ID NO: 25332 - RNA, 64 nt, Human
uucauguuguuacaucuuccaaggaugucagauuagaaaauagcaucccaccucuggguaucug

SEQ ID NO: 25333 - RNA, 64 nt, Human
ugggagauuauaaucaguuuguuuucaagauaauagaaaauaagguccaugagaauagaaguua

SEQ ID NO: 25334 - RNA, 64 nt, Human
auuuauucauacuaggauagaaaauuuuggaaucagaaaauagauccaguguuuagcuacauac

SEQ ID NO: 25335 - RNA, 64 nt, Human
uguucaugguguuagaguugcaaacuuuuuagcaagaaaauauggauuuccucauuucaguucc

SEQ ID NO: 25336 - RNA, 64 nt, Human
ccaucaagcacuccuaccuuaauuauugcacuagagaaaauaaauuccaaauuaggaaguguuu

SEQ ID NO: 25337 - RNA, 64 nt, Human
ugagucaacaacauacugccacuaugaaguaauaagaaaauaaaaaguuaaaaaauguaacaga

SEQ ID NO: 25338 - RNA, 64 nt, Human
ugauuaauuauguacacaaaaauauuuuccuuguagaaaauaguuuuccagacacuuagccuuc

SEQ ID NO: 25339 - RNA, 64 nt, Human
caugcaaaaauagaaaauuauuuguuaaauucagagaaaauaugugaaguuuacaaaggaacca

SEQ ID NO: 25340 - RNA, 64 nt, Human
gauagcgggaaaaggagaggaaacuacugccuuuagaaaauauaaguaaagugauuaaagugcu

SEQ ID NO: 25341 - RNA, 64 nt, Human
aucuagagccuacuuuuauuuugguuaaagaaaaagaaaauaucaauaauucaauuuugugucu

SEQ ID NO: 25342 - RNA, 64 nt, Human
ccguaaaugacucacaacauuauaaacaguugugagaaaauauuucacauuaucaaagcuguac

SEQ ID NO: 25343 - RNA, 64 nt, Human
cuuauauguccuuauggggaugggugccacaaauagaaaauaugaccagaucagggacuugaau

SEQ ID NO: 25344 - RNA, 64 nt, Human
aauuugcaaccucugguauacuguuauguucuggagaaaauauucaaagaucugccaaauacug

SEQ ID NO: 25345 - RNA, 64 nt, Human
aauuguuuuucuuuaucuacaaaauuauguguuaagaaaauaccauucauagcaugaagauuag

SEQ ID NO: 25346 - RNA, 64 nt, Human
cuggucgugcacucuuuggaugauucgcaacagaagaaaauaugccaugaucagcucucccuuc

SEQ ID NO: 25347 - RNA, 64 nt, Human
aauacaguaugucacagucaugcacauucaagagagaaaauauaacaaguucuuuuaugagcaa

SEQ ID NO: 25348 - RNA, 64 nt, Human
guguaaggugaaauuuaugguauuugagugugcaagaaaauauauuuuuaaagcuuucauuuuu

SEQ ID NO: 25349 - RNA, 64 nt, Human
uuauuuccuuuuaccuaauuugaauaugcauuugagaaaauaagaggauaaaggauggcuaaga

SEQ ID NO: 25350 - RNA, 64 nt, Human
agucuuagucucuugcuaguugaaaucaaauaaaagaaaauauauacccaguugguuucucuac

SEQ ID NO: 25351 - RNA, 64 nt, Human
aagacaagcagggcuaauuccaaaaagcaaggcuagaaaauagcccugugaggucaagacaauu

SEQ ID NO: 25352 - RNA, 64 nt, Human
guauuauucuuuauuuugggaccuucuguguaaaagaaaauauuaccuaaauugguuagauaca

SEQ ID NO: 25353 - RNA, 64 nt, Human
ccccacuuuuauuuuucuugcugggguugaggagagaaaauauagaauuccuggauaagaccaa

SEQ ID NO: 25354 - RNA, 64 nt, Human
ccaaaugcuauuccuucaagccuguuuugcaggcagaaaauaccagcagugucauuuagggguu

SEQ ID NO: 25355 - RNA, 64 nt, Human
uggacucaggcuggcagaggggcuggugcccuggagaaaauaaagagaaggcuggagagaagcc

SEQ ID NO: 25356 - RNA, 64 nt, Human
ggcucaggcuggugugggaugcagccggccgaugagaaaauaaagccauauugaaugaucgcca

SEQ ID NO: 25357 - RNA, 64 nt, Human
cccagaaucguaucccaaagcccucccauggccuagaaaauaaauaaguuauuguuugucuuag

SEQ ID NO: 25358 - RNA, 64 nt, Human
aaaagccucaugcauagcgggucauguagucucuagaaaauacauaaccugauggaaauguaga

SEQ ID NO: 25359 - RNA, 64 nt, Human
cccugaccgugcugaacagacccccccacacgagagaaaauaaaggagcaauaaagucacgaga

SEQ ID NO: 25360 - RNA, 64 nt, Human
aaucagucuuaaauuuuuaaaaauauguaauuuuagaaaauaauuuaaaagguuuuguuucagu

SEQ ID NO: 25361 - RNA, 64 nt, Human
uccagcaucuucccuggauggcuggaggaacuccagaaaauauccaucuucuuuuuguggcugc

SEQ ID NO: 25362 - RNA, 64 nt, Human
gcgcugccuguguucuccgagggccuucauuuaaagaaaauaaggguguuuuggguuuuucucu

SEQ ID NO: 25363 - RNA, 64 nt, Human
cauuauaagugcaauuacugucaaaagaucuuucagaaaauauaagcuuuuuuagugaagagua

SEQ ID NO: 25364 - RNA, 64 nt, Human
caugauaagugcaauuacugccaaaagaucuuucagaaaauauuauccuuuaaagugaaggaga

SEQ ID NO: 25365 - RNA, 64 nt, Human
uucgaauauucuacuaaaugagaguucugaguauagaaaauaaaacuaaaguugguagaaaaau

SEQ ID NO: 25366 - RNA, 64 nt, Human
uuuagacauuacacuaaaucagagugcugaguauagaaaauaauacaaacagauuugucuaaac

SEQ ID NO: 25367 - RNA, 64 nt, Human
aaaauuuccuuggcuuuaguuuuauaucauauuuagaaaauaauaaugaaaagcauccccaaaa

SEQ ID NO: 25368 - RNA, 64 nt, Human
ggauucauuuccaauuaaauacuaaacauuuuauagaaaauauuucuaaaauuuuaucacggau

SEQ ID NO: 25369 - RNA, 64 nt, Human
auacacaaugauuauaaguauuaaucuccauaagagaaaauauuuaugaacuauauuucucauu

SEQ ID NO: 25370 - RNA, 64 nt, Human
aaaauugcugggaauauuugacucuccguauuggagaaaauaaaauuacaacauuacgacauac

SEQ ID NO: 25371 - RNA, 64 nt, Human
ggaauuugaaaagccaaacugugaaaccauugggagaaaauagaugauauugucuaugacguug

SEQ ID NO: 25372 - RNA, 64 nt, Human
cuuaguucucauuaaauuuaggaaaauucacacuagaaaauaaagcuguuaauguaacaguugu

SEQ ID NO: 25373 - RNA, 64 nt, Human
cagcuucaugaaacuguccaccaagaucaagcagagaaaauaauuaauuucaugggacuaaaug

SEQ ID NO: 25374 - RNA, 64 nt, Human
cagccugggcgacagagugagacucccucucaaaagaaaauaaaaauaaaaauaaacuggccag

SEQ ID NO: 25375 - RNA, 64 nt, Human
aaaugggaaugcaaagcuugagcugcucugcaagagaaaauaagcaggacagaggauuugcucu

SEQ ID NO: 25376 - RNA, 64 nt, Human
uucacuuuuucuacuauccuugcuaaguuuucauagaaaauaaggaacaaagagaaacuuguaa

SEQ ID NO: 25377 - RNA, 64 nt, Human
ugcucuaagguacaccugacaaaggaacucucauagaaaauauaaagaaucccucaaguugaaa

SEQ ID NO: 25378 - RNA, 64 nt, Human
guccuaugcccagcugcacagcuuacccucaaacagaaaauaaugaagccuucuuccucccagg

SEQ ID NO: 25379 - RNA, 64 nt, Human
uagcuaaaguaaguuaaaagauuaugauaaacucagaaaauaaacacagagaaggaaucucauu

SEQ ID NO: 25380 - RNA, 64 nt, Human
gaaaauucacacaagagaaaggccuuaugaaugcagaaaauaugucaucuuguucauccucaua

SEQ ID NO: 25381 - RNA, 64 nt, Human
ggaucuucuguuuacuaucgcugagaucauuaucagaaaauagucuggccgggcaugguguaau

SEQ ID NO: 25382 - RNA, 64 nt, Human
ugccucaagaugguuuucaaaaaaauuuuuuuaaagaaaauaauuguauacgugucaacacagc

SEQ ID NO: 25383 - RNA, 64 nt, Human
aaaaagaaacaaaccaccucuacauauuauggaaagaaaauauuuuugucgauucuuauucuuu

SEQ ID NO: 25384 - RNA, 64 nt, Human
auggaauuguuuaauuauuuguacuuuucaugccagaaaauaaaaguucagaaucuuaaggccu

SEQ ID NO: 25385 - RNA, 64 nt, Human
aaaaaaaaacacaaaaaaagacaaaaaaaaaaaaagaaaauauuuuggcagguuauguuuacca

SEQ ID NO: 25386 - RNA, 64 nt, Human
uuuauagggggauguuuuuccaggacaagugaagagaaaauauuaaaacuagaauauucaacuc

SEQ ID NO: 25387 - RNA, 64 nt, Human
uauuauaaauuuaauuacugucaaaaaguauuucagaaaauauaagcuuuuaaaguauuuauuu

SEQ ID NO: 25388 - RNA, 64 nt, Human
uucagguauuuuacuaaaucagagugcugaguauagaaaauaaucuaaaacuaaaauugguaaa

SEQ ID NO: 25389 - RNA, 64 nt, Human
aaacauaagugcaacuacugucaaaauaucuuuaagaaaauauaagcuuuuaaagugaagagua

SEQ ID NO: 25390 - RNA, 64 nt, Human
uuucauacauaucuuuaaagcacaugacaacauuagaaaauauuuucacuccuuaaaaaaaaaa

SEQ ID NO: 25391 - RNA, 64 nt, Human
ccucucaagauuuuuuuugucagaggcuccaaauagaaaauaagaaaagguuuucuucauucau

SEQ ID NO: 25392 - RNA, 64 nt, Human
uauuaccaaggcuuugauugggauguuauauuugagaaaauacagagaaugauagauuaacgga

SEQ ID NO: 25393 - RNA, 64 nt, Human
cauaauagggcccagcaauuacugaagaaagugaagaaaauaccuauaauuaggacaaauacuu

SEQ ID NO: 25394 - RNA, 64 nt, Human
uggccagauaaauuaagucaaacauuugguuuccagaaaauaaagacaaauagagaagguuaga

SEQ ID NO: 25395 - RNA, 64 nt, Human
uuuucuugguuggaagcugcagcuggcccaagaaagaaaauaaaaaacaacacuuuugcaugag

SEQ ID NO: 25396 - RNA, 64 nt, Human
gagcacaaaaaugggagaaaaugcaaacaugagcagaaaauauuuucccacugguguguagccu

SEQ ID NO: 25397 - RNA, 64 nt, Human
uuuugugucagagaaaacauguacaaaacauuugagaaaauauuuuaggacauuaugucuaaaa

SEQ ID NO: 25398 - RNA, 64 nt, Human
uuggugugggagaauuagagaauuuauuugugucagaaaauacuccagaacaaccaccccauau

SEQ ID NO: 25399 - RNA, 64 nt, Human
agaguucaguaagacuucucccacauuauuuacuagaaaauaucaucuuagaagaaaccccaug

SEQ ID NO: 25400 - RNA, 64 nt, Human
gcugagugucuuugcagauucagccuaaaagcaaagaaaauauuucccuaaaauauuugcaaau

SEQ ID NO: 25401 - RNA, 64 nt, Human
agaaaaguaaucauuuuaggucuuaaagacuucaagaaaauacagguuaucaauuuauuuuaaa

SEQ ID NO: 25402 - RNA, 64 nt, Human
gacacagcuuagcuugguuuugcuuauucaaaagagaaaauaacuacacauggaaaugaaacua

SEQ ID NO: 25403 - RNA, 64 nt, Human
cacccucuccccacuuuuuuuaaaaauuuuaaccagaaaauaaagauaguuaaauccuaagaua

SEQ ID NO: 25404 - RNA, 64 nt, Human
accuguuuuuuuucucauuugauuuugcuugugcagaaaauaguuuccagcacauggauugauc

SEQ ID NO: 25405 - RNA, 64 nt, Human
agagauuuaugaaauuaaauuaagagauaauguaagaaaauacauuuuuuugguucuauauaau

SEQ ID NO: 25406 - RNA, 64 nt, Human
uggauaaaugcugacagauuuccaagaacuaccaagaaaauacaagagauauccaaugcuugau

SEQ ID NO: 25407 - RNA, 64 nt, Human
ucuugaauacaaaugcacucccaaagugguuuuaagaaaauaaaaagauuauccuuccucuuug

SEQ ID NO: 25408 - RNA, 64 nt, Human
aggacuaaggaauucugcagcuugcagauguuuaagaaaauaauggccagauuuuuuggguccu

SEQ ID NO: 25409 - RNA, 64 nt, Human
gaugaagaaggaucuuaggcauucuuaaaauucaagaaaauaaaacuaagcucuuugagaacug

SEQ ID NO: 25410 - RNA, 64 nt, Human
uuuuuaaaccagaauaaacauuaaaaacuauugcagaaaauaguggauuuuggauuccaaacau

SEQ ID NO: 25411 - RNA, 64 nt, Human
acucugacaggccacugcaucucagauucaggggagaaaauaaguugucaccuccccuucaaag

SEQ ID NO: 25412 - RNA, 64 nt, Human
cuagauugguuuuguuuuauaccauaugggaugaagaaaauagaaaugucaguagaacucauug

SEQ ID NO: 25413 - RNA, 64 nt, Human
agcuauguuugggugggaagggaagagagggauaagaaaauaccuuucuuccuuguaaacucca

SEQ ID NO: 25414 - RNA, 64 nt, Human
uguuuuuguucuuuugaagaauagagugguauuuagaaaauaaauugcauugcaaagcucuuau

SEQ ID NO: 25415 - RNA, 64 nt, Human
aaacugaguaggaaaugaaauacuagauuagacuagaaaauaaggaauaaaucgauuuuacuuu

SEQ ID NO: 25416 - RNA, 64 nt, Human
gucacaguucugaaggaaguuagggaggaagccaagaaaauaucuauugugauuaaagguagca

SEQ ID NO: 25417 - RNA, 64 nt, Human
guuaauuauuugaugggccugccaugugaaaaccagaaaauaaccucguacucacaagccagug

SEQ ID NO: 25418 - RNA, 64 nt, Human
guuuuuuucuucuauuaaaauauaacauugugaaagaaaauaaaauuuaugcuauucuuugcuu

SEQ ID NO: 25419 - RNA, 64 nt, Human
uuagguggcaaagugagacccugucuccaaaaaaagaaaauagagcuuuauaagcagagagaag

SEQ ID NO: 25420 - RNA, 64 nt, Human
aaaaaaagaaaauagagcuuuauaagcagagagaagaaaauaaucaucuaagaccaucucucca

SEQ ID NO: 25421 - RNA, 64 nt, Human
agcuucugcuggaauuugcaaucacugaagucauagaaaauagguaacuaucuaauuagagaaa

SEQ ID NO: 25422 - RNA, 64 nt, Human
auucauuacugcauccccaguaaugaaaguacuuagaaaauaauuauugaaugaaugaaaucua

SEQ ID NO: 25423 - RNA, 64 nt, Human
cagcaggacuggccgccccugcugugggggguucagaaaauaaaaugccgcgcagcccuugcca

SEQ ID NO: 25424 - RNA, 64 nt, Human
uggagaugccagauaucccauacagaauuagcagagaaaauacacacaggcuucuauucaaauu

SEQ ID NO: 25425 - RNA, 64 nt, Human
auuucuuggaaaaaauuuuaagaaucaaaaauaaagaaaauaaaaaaugcauacaguuaaacau

SEQ ID NO: 25426 - RNA, 64 nt, Human
aaaacacaaauuucaaucaaauacuuuuguguauagaaaauauguauaguagguagauagaaaa

SEQ ID NO: 25427 - RNA, 64 nt, Human
uguuuccuuuaagaaaaaccacagggaccaagaaagaaaauauaacaguuugauuucugucaua

SEQ ID NO: 25428 - RNA, 64 nt, Human
cacuuaagaaauuugagcagaauuuaaaaaagaaagaaaauaaauuguuuuucccaaaguaugu

SEQ ID NO: 25429 - RNA, 64 nt, Human
acuuucuuuuacaaaagaauauuacauauuugagagaaaauauuucuauuaaugguuuaauuuc

SEQ ID NO: 25430 - RNA, 64 nt, Human
auguauuuaugcccuuauaucccaaaaaugucuuagaaaauaaaaauucugggccuuacuuguu

SEQ ID NO: 25431 - RNA, 64 nt, Human
aauuaaucaauggauauccuucaguagugaaugcagaaaauaaaaauacacagguaauuuagua

SEQ ID NO: 25432 - RNA, 64 nt, Human
uuuaccuguuagcagguucuuguuucauaaagguagaaaauaaauacagacaacaucuacugag

SEQ ID NO: 25433 - RNA, 64 nt, Human
gauacgaaugagaagacaaguuuggacauagcccagaaaauaugcuauuauuucauagaagaga

SEQ ID NO: 25434 - RNA, 64 nt, Human
ggaagagaaggaauaaauuugucaaaacuaggugagaaaauagagcauugugggaaaaacugag

SEQ ID NO: 25435 - RNA, 64 nt, Human
ucucaaguuaugaaauaaaacugagagauaauggagaaaauaauuuuuauggguuuuuuugguu

SEQ ID NO: 25436 - RNA, 64 nt, Human
aucauuugcugguuguuuauuuuuugguacaaccagaaaauagugugggauauugaauuauggg

SEQ ID NO: 25437 - RNA, 64 nt, Human
agaaaauugccaaaauauauuaaaaaaaaaaaagagaaaauacugaaaccacagacagugcaaa

SEQ ID NO: 25438 - RNA, 64 nt, Human
ucauuaagaaauaauuuuagauuugugcucuagcagaaaauaacucuguacccaucaaucuuau

SEQ ID NO: 25439 - RNA, 64 nt, Human
cuuaauuccugaauguuucagagaaacaggaaucagaaaauagcagauaucauguaggaaagag

SEQ ID NO: 25440 - RNA, 64 nt, Human
caaccuguagcugacuuuagccacccacaaguacagaaaauaauccagucccucauagcacugg

SEQ ID NO: 25441 - RNA, 64 nt, Human
uuaauggugggguuuucugcuuuguuuuuauuuaagaaaauaaacacgacauauuuaaagaagg

SEQ ID NO: 25442 - RNA, 64 nt, Human
gggauuggaugaaagucaaagguugucuacuuuaagaaaauaaaauacccugaauggagcccag

SEQ ID NO: 25443 - RNA, 64 nt, Human
ggguuuuuuguucuguuuuguuuuguuuucuuugagaaaauaaggacuuuguguucauuugaag

SEQ ID NO: 25444 - RNA, 64 nt, Human
gcccuugugaaucaagggucaggccuuugagcucagaaaauaucccuccuguugggagagggcg

SEQ ID NO: 25445 - RNA, 64 nt, Human
gcggaauacaauguccuuccauagcaugggaagaagaaaauaaacaucuccuuuccaacagcug

SEQ ID NO: 25446 - RNA, 64 nt, Human
augaaagaaacuugcuucccuuagccuuuguucuagaaaauaaacuugugcacuuugaccucug

SEQ ID NO: 25447 - RNA, 64 nt, Human
auuccgccugggauuuuguuuugucuguucccuaagaaaauauauuuucauuccugcaaacaca

SEQ ID NO: 25448 - RNA, 64 nt, Human
aaaguacuguaccuaucuucagcaagaaugcaaaagaaaauauuuucaauauauauaccuggaa

SEQ ID NO: 25449 - RNA, 64 nt, Human
gacccuacgguaacuagaucuaauauauaucaucagaaaauauauauuguauguuuacucuuau

SEQ ID NO: 25450 - RNA, 64 nt, Human
ugcaaauagaaaacccaacucaaccugcuuaagcagaaaauaaauuuauugauucaaguuugga

SEQ ID NO: 25451 - RNA, 64 nt, Human
gacugcggacaauuaguauucaaaguuuauuuucagaaaauaaaauaauaaaagcccaggguau

SEQ ID NO: 25452 - RNA, 64 nt, Human
guuaaaguggaaugagguaagaagauacagcuacagaaaauaguugcguguaugggagaacagu

SEQ ID NO: 25453 - RNA, 64 nt, Human
ugagauaucugcacauaaaauuauuauuaccugaagaaaauaaggcugcauuuugaaauguuaa

SEQ ID NO: 25454 - RNA, 64 nt, Human
cugucaguucccaauugacaagucacagacugggagaaaauauuugcaaaucguguaucugaca

SEQ ID NO: 25455 - RNA, 64 nt, Human
gcuucugacuaguucagacugccacgccaaccccagaaaauaccccacaugccagaaaagugaa

SEQ ID NO: 25456 - RNA, 64 nt, Human
aguaaguugaugagcuucucucuacaacauuucuagaaaauagaaaaaaaagcacagagaaaug

SEQ ID NO: 25457 - RNA, 64 nt, Human
caugauaugcuuacuuacuaucaguuuaugauguagaaaauauauuuuguaauuauaagaaaac

SEQ ID NO: 25458 - RNA, 64 nt, Human
ccaacauuuaaaauuuauguuuuaugucaauaaaagaaaauauacuuuauugugacuucaacua

SEQ ID NO: 25459 - RNA, 64 nt, Human
aggaaauaaggagaaaagagaaugggagagugagagaaaauaaaaaaggcaaaagggagagaga

SEQ ID NO: 25460 - RNA, 64 nt, Human
uaaaaguaaaugauuugggaacugacaaugugucagaaaauauauguucauuuaucauuuuaaa

SEQ ID NO: 25461 - RNA, 64 nt, Human
uugaccaugccccuagaaauaauuccuaaucuuuagaaaauagggcagagaaacauuauuuuac

SEQ ID NO: 25462 - RNA, 64 nt, Human
guuauucuguuuuuuugugagaacuuaguaaacaagaaaauacucuugagugaaaugcaaugua

SEQ ID NO: 25463 - RNA, 64 nt, Human
ugaaggcagagugugaaaaacgugagagaggaagagaaaauagauuuaccugauuccucuuuaa

SEQ ID NO: 25464 - RNA, 64 nt, Human
aaaauauauaccaguucaaguccuuuuaggaagaagaaaauaccuaauuuauguaaaauuuaaa

SEQ ID NO: 25465 - RNA, 64 nt, Human
aucaccaacuuaauuuucuuccauagcaaaacugagaaaauaccuuguuucaguauaacacuaa

SEQ ID NO: 25466 - RNA, 64 nt, Human
uuaacauuuuacuuuuaauuauguaaauuugguuagaaaauaauaauaaaugguuagugcuauu

SEQ ID NO: 25467 - RNA, 64 nt, Human
uguaagaaauuucuuacauguauauuucuuauguagaaaauacuguuucuacucauucaaagca

SEQ ID NO: 25468 - RNA, 64 nt, Human
uugaauacccagagccacuaaaucuuuuuuuacuagaaaauaauugggguccauaugaaagucu

SEQ ID NO: 25469 - RNA, 64 nt, Human
guucauuaguaucuguggcuuaaaauggcaaaaaagaaaauauccuugaguuuguaaucuaguu

SEQ ID NO: 25470 - RNA, 64 nt, Human
aacuuaucuuacaaaguguauuuuauaaaauuaaagaaaauaaaauuaagaauguucucaauca

SEQ ID NO: 25471 - RNA, 64 nt, Human
agaucgaaauguuagguaaucauuuagaaaggacagaaaauauuuaaaguggcucauagguaau

SEQ ID NO: 25472 - RNA, 64 nt, Human
aguauuuaugugugugaauaacaucuuggcaugcagaaaauaauuuuggcugcuuugaacagga

SEQ ID NO: 25473 - RNA, 64 nt, Human
uccuaccaaggacaauuuauuaaucaauugacuuagaaaauagggggagaaaucauucauugga

SEQ ID NO: 25474 - RNA, 64 nt, Human
uugaguuuugcaacaguaccuguguuguuauuucagaaaauauuauuucucucuuuuuaacuac

SEQ ID NO: 25475 - RNA, 64 nt, Human
aauaguuccucauucauuuuuauauugaccacuaagaaaauaauucaucagcauuaucucauag

SEQ ID NO: 25476 - RNA, 64 nt, Human
guucccgcuauguggauaacucuucuuuuuaaaaagaaaauagagaauagcaaaucuucaugau

SEQ ID NO: 25477 - RNA, 64 nt, Human
accacuuuuaaaaaugacacauauuuaaacacuuagaaaauaaaguuaacacuuacugaagugc

SEQ ID NO: 25478 - RNA, 64 nt, Human
ggacgagaaaacaauaacgauaaaagacagugaaagaaaauaacgauaaaagacagugaaagaa

SEQ ID NO: 25479 - RNA, 64 nt, Human
acagugaaagaaaauaacgauaaaagacagugaaagaaaauaacaauaaaagacaaggaaaaaa

SEQ ID NO: 25480 - RNA, 64 nt, Human
agauccaaaaguagccaugcccuuuucucaggauagaaaauauguuuuggcauuugaagcauuu

SEQ ID NO: 25481 - RNA, 64 nt, Human
auguuguagcaacaucauaaaaucaagaguaucaagaaaauaaaugagcauagcaaugcuacuc

SEQ ID NO: 25482 - RNA, 64 nt, Human
guguaacaugaggcccauucuucacucuguuugaagaaaauagucaguguucuuaguagugggu

SEQ ID NO: 25483 - RNA, 64 nt, Human
aaaucaucucacaugcauuuuauaguuuuggggaagaaaauaucauggggaggucuaccuucag

SEQ ID NO: 25484 - RNA, 64 nt, Human
uaccaucugauguuucauauuuaaguguauuuaaagaaaauaaacaccauuauucaagccauau

SEQ ID NO: 25485 - RNA, 64 nt, Human
auuuuguuguauguaaauguuaauuucaugguauagaaaauauaagaugauaaagauaucauua

SEQ ID NO: 25486 - RNA, 64 nt, Human
gauguaaagaaaucagauacaaacuacugcaauuagaaaauaaaauaugaacaacuuucaacaa

SEQ ID NO: 25487 - RNA, 64 nt, Human
ugauuccuauaauacagugcuauaagcuaugcacagaaaauaaaauguuugaaauccaagaaua

SEQ ID NO: 25488 - RNA, 64 nt, Human
ucucagggcuuaugaaauguaauuaaauuuauuaagaaaauagaugaaaaauuaggguacacag

SEQ ID NO: 25489 - RNA, 64 nt, Human
aggacuugcaucagcugccuccagaacaauuuuaagaaaauaacaaagauguuuagaagaaauc

SEQ ID NO: 25490 - RNA, 64 nt, Human
auugagagcccuagaaagcugcugugaucccaguagaaaauaugucccagaaaugucaugagau

SEQ ID NO: 25491 - RNA, 64 nt, Human
cuauaucacaaaaauggcaacaucuuuuacauaaagaaaauaaguuuguaagugauauuucuua

SEQ ID NO: 25492 - RNA, 64 nt, Human
augacuaauaguuuuuugauuaaaaaugugaacaagaaaauacuaaaauaaaaauccuuucgau

SEQ ID NO: 25493 - RNA, 64 nt, Human
cagaaaaaccaguacccuugagccuuaaucagcaagaaaauaacucuggcucauacaguguaga

SEQ ID NO: 25494 - RNA, 64 nt, Human
uauguuucaguuuguuuuccguucuguuuuaaacagaaaauaaaaggaguguaagcuccuuuuc

SEQ ID NO: 25495 - RNA, 64 nt, Human
aaaauacauucuuuuugcucuaaaauauuuaugaagaaaauacuuaaauguuauguauauggug

SEQ ID NO: 25496 - RNA, 64 nt, Human
uuccuauuucagaaguuuaaauauuaagcaugacagaaaauauguauuaacacuacucaaagca

SEQ ID NO: 25497 - RNA, 64 nt, Human
auuucuuuuagaauaugggaguaagaugagcuagagaaaauaaccuggucucacugugguugcc

SEQ ID NO: 25498 - RNA, 64 nt, Human
ugaguauuuccuugauugcgguauauguacuacuagaaaauaccaaauggauauauuuucuuua

SEQ ID NO: 25499 - RNA, 64 nt, Human
uucaguuacuuuucaguuaauuauuccuuuaaaaagaaaauacagcagaaccucacuguagcau

SEQ ID NO: 25500 - RNA, 64 nt, Human
acaccaagcccuucccauaaaacacaacugcugaagaaaauagcagacguuuccccucucucua

SEQ ID NO: 25501 - RNA, 64 nt, Human
gaauaacaacugauggugaaucuuaccgagcuguagaaaauaaaaaauuccucuccaaacaugg

SEQ ID NO: 25502 - RNA, 64 nt, Human
auuuccaaucacuuaguagccccucaaaguaguuagaaaauaaacagauuuuuccaguguugau

SEQ ID NO: 25503 - RNA, 64 nt, Human
auguuuuaucugguucuuaaauguuuguuacuacagaaaauaaaacugcgcuacuauuccaagu

SEQ ID NO: 25504 - RNA, 64 nt, Human
aggccaugcugaguuagguaggugggcgcugcccagaaaauauauuucaauaaaagagagaagc

SEQ ID NO: 25505 - RNA, 64 nt, Human
gcuggaggaggacggcuuacauguuuguuucuguagaaaauaaaacugagcuacgauuccgugu

SEQ ID NO: 25506 - RNA, 64 nt, Human
gcuggaggaggacggcuuacauguuuguuucuguagaaaauaaagcugagcuacgauuccgugu

SEQ ID NO: 25507 - RNA, 64 nt, Human
uucaguaccauugucacugcaauaaguggguuuuagaaaauaagugugaaaagaaucagguguu

SEQ ID NO: 25508 - RNA, 64 nt, Human
aucaccaacuugauuuucuuccauagcaaaacugagaaaauaccuuguuucaguauaacacuaa

SEQ ID NO: 25509 - RNA, 64 nt, Human; identical to SEQ ID NO: 25466

SEQ ID NO: 25510 - RNA, 64 nt, Human
auuuaaacucuggagcccauaauaucuacauaaaagaaaauauaaacugacuaauauugucaag

SEQ ID NO: 25511 - RNA, 61 nt, Human; identical to SEQ ID NO: 23229

SEQ ID NO: 25512 - RNA, 61 nt, Human; identical to SEQ ID NO: 23230

SEQ ID NO: 25513 - RNA, 61 nt, Human; identical to SEQ ID NO: 23231

SEQ ID NO: 25514 - RNA, 61 nt, Human; identical to SEQ ID NO: 23232

SEQ ID NO: 25515 - RNA, 61 nt, Human; identical to SEQ ID NO: 23233

SEQ ID NO: 25516 - RNA, 61 nt, Human; identical to SEQ ID NO: 23234

SEQ ID NO: 25517 - RNA, 61 nt, Human; identical to SEQ ID NO: 23235

SEQ ID NO: 25518 - RNA, 61 nt, Human; identical to SEQ ID NO: 23236

SEQ ID NO: 25519 - RNA, 61 nt, Human; identical to SEQ ID NO: 23237

SEQ ID NO: 25520 - RNA, 61 nt, Human; identical to SEQ ID NO: 23238

SEQ ID NO: 25521 - RNA, 61 nt, Human; identical to SEQ ID NO: 23239

SEQ ID NO: 25522 - RNA, 61 nt, Human; identical to SEQ ID NO: 23240

SEQ ID NO: 25523 - RNA, 61 nt, Human; identical to SEQ ID NO: 23241

SEQ ID NO: 25524 - RNA, 61 nt, Human; identical to SEQ ID NO: 23242

SEQ ID NO: 25525 - RNA, 61 nt, Human; identical to SEQ ID NO: 23243

SEQ ID NO: 25526 - RNA, 61 nt, Human; identical to SEQ ID NO: 23244

SEQ ID NO: 25527 - RNA, 61 nt, Human; identical to SEQ ID NO: 23245

SEQ ID NO: 25528 - RNA, 61 nt, Human; identical to SEQ ID NO: 23246

SEQ ID NO: 25529 - RNA, 61 nt, Human; identical to SEQ ID NO: 23247

SEQ ID NO: 25530 - RNA, 61 nt, Human; identical to SEQ ID NO: 23248

SEQ ID NO: 25531 - RNA, 61 nt, Human; identical to SEQ ID NO: 23249

SEQ ID NO: 25532 - RNA, 61 nt, Human; identical to SEQ ID NO: 23250

SEQ ID NO: 25533 - RNA, 61 nt, Human; identical to SEQ ID NO: 23251

SEQ ID NO: 25534 - RNA, 61 nt, Human; identical to SEQ ID NO: 23252

SEQ ID NO: 25535 - RNA, 61 nt, Human; identical to SEQ ID NO: 23253

SEQ ID NO: 25536 - RNA, 61 nt, Human; identical to SEQ ID NO: 23254

SEQ ID NO: 25537 - RNA, 61 nt, Human; identical to SEQ ID NO: 23255

SEQ ID NO: 25538 - RNA, 61 nt, Human; identical to SEQ ID NO: 23256

SEQ ID NO: 25539 - RNA, 61 nt, Human; identical to SEQ ID NO: 23257

SEQ ID NO: 25540 - RNA, 61 nt, Human; identical to SEQ ID NO: 23258

SEQ ID NO: 25541 - RNA, 61 nt, Human; identical to SEQ ID NO: 23259

SEQ ID NO: 25542 - RNA, 61 nt, Human; identical to SEQ ID NO: 23260

SEQ ID NO: 25543 - RNA, 61 nt, Human; identical to SEQ ID NO: 23261

SEQ ID NO: 25544 - RNA, 61 nt, Human; identical to SEQ ID NO: 23262

SEQ ID NO: 25545 - RNA, 61 nt, Human; identical to SEQ ID NO: 23263

SEQ ID NO: 25546 - RNA, 61 nt, Human; identical to SEQ ID NO: 23264

SEQ ID NO: 25547 - RNA, 61 nt, Human; identical to SEQ ID NO: 23265

SEQ ID NO: 25548 - RNA, 61 nt, Human; identical to SEQ ID NO: 23266

SEQ ID NO: 25549 - RNA, 61 nt, Human; identical to SEQ ID NO: 23267

SEQ ID NO: 25550 - RNA, 61 nt, Human; identical to SEQ ID NO: 23268

SEQ ID NO: 25551 - RNA, 61 nt, Human; identical to SEQ ID NO: 23269

SEQ ID NO: 25552 - RNA, 61 nt, Human; identical to SEQ ID NO: 23270

SEQ ID NO: 25553 - RNA, 61 nt, Human; identical to SEQ ID NO: 23271

SEQ ID NO: 25554 - RNA, 61 nt, Human; identical to SEQ ID NO: 23272

SEQ ID NO: 25555 - RNA, 61 nt, Human; identical to SEQ ID NO: 23273

SEQ ID NO: 25556 - RNA, 61 nt, Human; identical to SEQ ID NO: 23274

SEQ ID NO: 25557 - RNA, 61 nt, Human; identical to SEQ ID NO: 23275

SEQ ID NO: 25558 - RNA, 61 nt, Human; identical to SEQ ID NO: 23276

SEQ ID NO: 25559 - RNA, 61 nt, Human; identical to SEQ ID NO: 23277

SEQ ID NO: 25560 - RNA, 61 nt, Human; identical to SEQ ID NO: 23278

SEQ ID NO: 25561 - RNA, 61 nt, Human; identical to SEQ ID NO: 23279

SEQ ID NO: 25562 - RNA, 61 nt, Human; identical to SEQ ID NO: 23280

SEQ ID NO: 25563 - RNA, 61 nt, Human; identical to SEQ ID NO: 23281

SEQ ID NO: 25564 - RNA, 61 nt, Human; identical to SEQ ID NO: 23282

SEQ ID NO: 25565 - RNA, 61 nt, Human; identical to SEQ ID NO: 23283

SEQ ID NO: 25566 - RNA, 61 nt, Human; identical to SEQ ID NO: 23284

SEQ ID NO: 25567 - RNA, 61 nt, Human; identical to SEQ ID NO: 23285

SEQ ID NO: 25568 - RNA, 61 nt, Human; identical to SEQ ID NO: 23286

SEQ ID NO: 25569 - RNA, 61 nt, Human; identical to SEQ ID NO: 23287

SEQ ID NO: 25570 - RNA, 61 nt, Human; identical to SEQ ID NO: 23288

SEQ ID NO: 25571 - RNA, 61 nt, Human; identical to SEQ ID NO: 23289

SEQ ID NO: 25572 - RNA, 61 nt, Human; identical to SEQ ID NO: 23290

SEQ ID NO: 25573 - RNA, 61 nt, Human; identical to SEQ ID NO: 23291

SEQ ID NO: 25574 - RNA, 61 nt, Human; identical to SEQ ID NO: 23292

SEQ ID NO: 25575 - RNA, 61 nt, Human; identical to SEQ ID NO: 23293

SEQ ID NO: 25576 - RNA, 61 nt, Human; identical to SEQ ID NO: 23294

SEQ ID NO: 25577 - RNA, 61 nt, Human; identical to SEQ ID NO: 23295

SEQ ID NO: 25578 - RNA, 61 nt, Human; identical to SEQ ID NO: 23296

SEQ ID NO: 25579 - RNA, 61 nt, Human; identical to SEQ ID NO: 23297

SEQ ID NO: 25580 - RNA, 61 nt, Human; identical to SEQ ID NO: 23298

SEQ ID NO: 25581 - RNA, 61 nt, Human; identical to SEQ ID NO: 23299

SEQ ID NO: 25582 - RNA, 61 nt, Human; identical to SEQ ID NO: 23300

SEQ ID NO: 25583 - RNA, 61 nt, Human; identical to SEQ ID NO: 23301

SEQ ID NO: 25584 - RNA, 61 nt, Human; identical to SEQ ID NO: 23302

SEQ ID NO: 25585 - RNA, 61 nt, Human; identical to SEQ ID NO: 23303

SEQ ID NO: 25586 - RNA, 61 nt, Human; identical to SEQ ID NO: 23304

SEQ ID NO: 25587 - RNA, 61 nt, Human; identical to SEQ ID NO: 23305

SEQ ID NO: 25588 - RNA, 61 nt, Human; identical to SEQ ID NO: 23306

SEQ ID NO: 25589 - RNA, 61 nt, Human; identical to SEQ ID NO: 23307

SEQ ID NO: 25590 - RNA, 61 nt, Human; identical to SEQ ID NO: 23308

SEQ ID NO: 25591 - RNA, 61 nt, Human; identical to SEQ ID NO: 23309

SEQ ID NO: 25592 - RNA, 61 nt, Human; identical to SEQ ID NO: 23310

SEQ ID NO: 25593 - RNA, 61 nt, Human; identical to SEQ ID NO: 23311

SEQ ID NO: 25594 - RNA, 61 nt, Human; identical to SEQ ID NO: 23312

SEQ ID NO: 25595 - RNA, 61 nt, Human; identical to SEQ ID NO: 23313

SEQ ID NO: 25596 - RNA, 61 nt, Human; identical to SEQ ID NO: 23314

SEQ ID NO: 25597 - RNA, 61 nt, Human; identical to SEQ ID NO: 23315

SEQ ID NO: 25598 - RNA, 61 nt, Human; identical to SEQ ID NO: 23316

SEQ ID NO: 25599 - RNA, 61 nt, Human; identical to SEQ ID NO: 23317

SEQ ID NO: 25600 - RNA, 61 nt, Human; identical to SEQ ID NO: 23318

SEQ ID NO: 25601 - RNA, 61 nt, Human; identical to SEQ ID NO: 23319

SEQ ID NO: 25602 - RNA, 61 nt, Human; identical to SEQ ID NO: 23320

SEQ ID NO: 25603 - RNA, 61 nt, Human; identical to SEQ ID NO: 23321

SEQ ID NO: 25604 - RNA, 61 nt, Human; identical to SEQ ID NO: 23322

SEQ ID NO: 25605 - RNA, 61 nt, Human; identical to SEQ ID NO: 23323

SEQ ID NO: 25606 - RNA, 61 nt, Human; identical to SEQ ID NO: 23324

SEQ ID NO: 25607 - RNA, 61 nt, Human; identical to SEQ ID NO: 23325

SEQ ID NO: 25608 - RNA, 61 nt, Human; identical to SEQ ID NO: 23326

SEQ ID NO: 25609 - RNA, 61 nt, Human; identical to SEQ ID NO: 23327

SEQ ID NO: 25610 - RNA, 61 nt, Human; identical to SEQ ID NO: 23328

SEQ ID NO: 25611 - RNA, 61 nt, Human; identical to SEQ ID NO: 23329

SEQ ID NO: 25612 - RNA, 61 nt, Human; identical to SEQ ID NO: 23330

SEQ ID NO: 25613 - RNA, 61 nt, Human; identical to SEQ ID NO: 23331

SEQ ID NO: 25614 - RNA, 61 nt, Human; identical to SEQ ID NO: 23332

SEQ ID NO: 25615 - RNA, 61 nt, Human; identical to SEQ ID NO: 23333

SEQ ID NO: 25616 - RNA, 61 nt, Human; identical to SEQ ID NO: 23334

SEQ ID NO: 25617 - RNA, 61 nt, Human; identical to SEQ ID NO: 23335

SEQ ID NO: 25618 - RNA, 61 nt, Human; identical to SEQ ID NO: 23336

SEQ ID NO: 25619 - RNA, 61 nt, Human; identical to SEQ ID NO: 23337

SEQ ID NO: 25620 - RNA, 61 nt, Human; identical to SEQ ID NO: 23338

SEQ ID NO: 25621 - RNA, 61 nt, Human; identical to SEQ ID NO: 23339

SEQ ID NO: 25622 - RNA, 61 nt, Human; identical to SEQ ID NO: 23340

SEQ ID NO: 25623 - RNA, 61 nt, Human; identical to SEQ ID NO: 23341

SEQ ID NO: 25624 - RNA, 61 nt, Human; identical to SEQ ID NO: 23342

SEQ ID NO: 25625 - RNA, 61 nt, Human; identical to SEQ ID NO: 23343

SEQ ID NO: 25626 - RNA, 61 nt, Human; identical to SEQ ID NO: 23344

SEQ ID NO: 25627 - RNA, 61 nt, Human; identical to SEQ ID NO: 23345

SEQ ID NO: 25628 - RNA, 61 nt, Human; identical to SEQ ID NO: 23346

SEQ ID NO: 25629 - RNA, 61 nt, Human; identical to SEQ ID NO: 23347

SEQ ID NO: 25630 - RNA, 61 nt, Human; identical to SEQ ID NO: 23348

SEQ ID NO: 25631 - RNA, 61 nt, Human; identical to SEQ ID NO: 23349

SEQ ID NO: 25632 - RNA, 61 nt, Human; identical to SEQ ID NO: 23350

SEQ ID NO: 25633 - RNA, 61 nt, Human; identical to SEQ ID NO: 23351

SEQ ID NO: 25634 - RNA, 61 nt, Human; identical to SEQ ID NO: 23352

SEQ ID NO: 25635 - RNA, 61 nt, Human; identical to SEQ ID NO: 23353

SEQ ID NO: 25636 - RNA, 61 nt, Human; identical to SEQ ID NO: 23354

SEQ ID NO: 25637 - RNA, 61 nt, Human; identical to SEQ ID NO: 23355

SEQ ID NO: 25638 - RNA, 61 nt, Human; identical to SEQ ID NO: 23356

SEQ ID NO: 25639 - RNA, 61 nt, Human; identical to SEQ ID NO: 23357

SEQ ID NO: 25640 - RNA, 61 nt, Human; identical to SEQ ID NO: 23358

SEQ ID NO: 25641 - RNA, 61 nt, Human; identical to SEQ ID NO: 23359

SEQ ID NO: 25642 - RNA, 61 nt, Human; identical to SEQ ID NO: 23360

SEQ ID NO: 25643 - RNA, 61 nt, Human; identical to SEQ ID NO: 23361

SEQ ID NO: 25644 - RNA, 61 nt, Human; identical to SEQ ID NO: 23362

SEQ ID NO: 25645 - RNA, 61 nt, Human; identical to SEQ ID NO: 23363

SEQ ID NO: 25646 - RNA, 61 nt, Human; identical to SEQ ID NO: 23364

SEQ ID NO: 25647 - RNA, 61 nt, Human; identical to SEQ ID NO: 23365

SEQ ID NO: 25648 - RNA, 61 nt, Human; identical to SEQ ID NO: 23366

SEQ ID NO: 25649 - RNA, 61 nt, Human; identical to SEQ ID NO: 23367

SEQ ID NO: 25650 - RNA, 61 nt, Human; identical to SEQ ID NO: 23368

SEQ ID NO: 25651 - RNA, 61 nt, Human; identical to SEQ ID NO: 23369

SEQ ID NO: 25652 - RNA, 61 nt, Human; identical to SEQ ID NO: 23370

SEQ ID NO: 25653 - RNA, 61 nt, Human; identical to SEQ ID NO: 23371

SEQ ID NO: 25654 - RNA, 61 nt, Human; identical to SEQ ID NO: 23372

SEQ ID NO: 25655 - RNA, 61 nt, Human; identical to SEQ ID NO: 23373

SEQ ID NO: 25656 - RNA, 61 nt, Human; identical to SEQ ID NO: 23374

SEQ ID NO: 25657 - RNA, 61 nt, Human; identical to SEQ ID NO: 23375

SEQ ID NO: 25658 - RNA, 61 nt, Human; identical to SEQ ID NO: 23376

SEQ ID NO: 25659 - RNA, 61 nt, Human; identical to SEQ ID NO: 23377

SEQ ID NO: 25660 - RNA, 61 nt, Human; identical to SEQ ID NO: 23378

SEQ ID NO: 25661 - RNA, 61 nt, Human; identical to SEQ ID NO: 23379

SEQ ID NO: 25662 - RNA, 61 nt, Human; identical to SEQ ID NO: 23380

SEQ ID NO: 25663 - RNA, 61 nt, Human; identical to SEQ ID NO: 23381

SEQ ID NO: 25664 - RNA, 61 nt, Human; identical to SEQ ID NO: 23382

SEQ ID NO: 25665 - RNA, 61 nt, Human; identical to SEQ ID NO: 23383

SEQ ID NO: 25666 - RNA, 61 nt, Human; identical to SEQ ID NO: 23384

SEQ ID NO: 25667 - RNA, 61 nt, Human; identical to SEQ ID NO: 23385

SEQ ID NO: 25668 - RNA, 61 nt, Human; identical to SEQ ID NO: 23386

SEQ ID NO: 25669 - RNA, 61 nt, Human; identical to SEQ ID NO: 23387

SEQ ID NO: 25670 - RNA, 61 nt, Human; identical to SEQ ID NO: 23388

SEQ ID NO: 25671 - RNA, 61 nt, Human; identical to SEQ ID NO: 23389

SEQ ID NO: 25672 - RNA, 61 nt, Human; identical to SEQ ID NO: 23390

SEQ ID NO: 25673 - RNA, 61 nt, Human; identical to SEQ ID NO: 23391

SEQ ID NO: 25674 - RNA, 61 nt, Human; identical to SEQ ID NO: 23392

SEQ ID NO: 25675 - RNA, 61 nt, Human; identical to SEQ ID NO: 23393

SEQ ID NO: 25676 - RNA, 61 nt, Human; identical to SEQ ID NO: 23394

SEQ ID NO: 25677 - RNA, 61 nt, Human; identical to SEQ ID NO: 23395

SEQ ID NO: 25678 - RNA, 61 nt, Human; identical to SEQ ID NO: 23396

SEQ ID NO: 25679 - RNA, 61 nt, Human; identical to SEQ ID NO: 23397

SEQ ID NO: 25680 - RNA, 61 nt, Human; identical to SEQ ID NO: 23398

SEQ ID NO: 25681 - RNA, 61 nt, Human; identical to SEQ ID NO: 23399

SEQ ID NO: 25682 - RNA, 61 nt, Human; identical to SEQ ID NO: 23400

SEQ ID NO: 25683 - RNA, 61 nt, Human; identical to SEQ ID NO: 23401

SEQ ID NO: 25684 - RNA, 61 nt, Human; identical to SEQ ID NO: 23402

SEQ ID NO: 25685 - RNA, 61 nt, Human; identical to SEQ ID NO: 23403

SEQ ID NO: 25686 - RNA, 61 nt, Human; identical to SEQ ID NO: 23404

SEQ ID NO: 25687 - RNA, 61 nt, Human; identical to SEQ ID NO: 23405

SEQ ID NO: 25688 - RNA, 61 nt, Human; identical to SEQ ID NO: 23406

SEQ ID NO: 25689 - RNA, 61 nt, Human; identical to SEQ ID NO: 23407

SEQ ID NO: 25690 - RNA, 61 nt, Human; identical to SEQ ID NO: 23408

SEQ ID NO: 25691 - RNA, 61 nt, Human; identical to SEQ ID NO: 23409

SEQ ID NO: 25692 - RNA, 61 nt, Human; identical to SEQ ID NO: 23410

SEQ ID NO: 25693 - RNA, 61 nt, Human; identical to SEQ ID NO: 23411

SEQ ID NO: 25694 - RNA, 61 nt, Human; identical to SEQ ID NO: 23412

SEQ ID NO: 25695 - RNA, 61 nt, Human; identical to SEQ ID NO: 23413

SEQ ID NO: 25696 - RNA, 61 nt, Human; identical to SEQ ID NO: 23414

SEQ ID NO: 25697 - RNA, 61 nt, Human; identical to SEQ ID NO: 23415

SEQ ID NO: 25698 - RNA, 61 nt, Human; identical to SEQ ID NO: 23416

SEQ ID NO: 25699 - RNA, 61 nt, Human; identical to SEQ ID NO: 23417

SEQ ID NO: 25700 - RNA, 61 nt, Human; identical to SEQ ID NO: 23418

SEQ ID NO: 25701 - RNA, 61 nt, Human; identical to SEQ ID NO: 23419

SEQ ID NO: 25702 - RNA, 61 nt, Human; identical to SEQ ID NO: 23420

SEQ ID NO: 25703 - RNA, 61 nt, Human; identical to SEQ ID NO: 23421

SEQ ID NO: 25704 - RNA, 61 nt, Human; identical to SEQ ID NO: 23422

SEQ ID NO: 25705 - RNA, 61 nt, Human; identical to SEQ ID NO: 23423

SEQ ID NO: 25706 - RNA, 61 nt, Human; identical to SEQ ID NO: 23424

SEQ ID NO: 25707 - RNA, 61 nt, Human; identical to SEQ ID NO: 23425

SEQ ID NO: 25708 - RNA, 61 nt, Human; identical to SEQ ID NO: 23426

SEQ ID NO: 25709 - RNA, 61 nt, Human; identical to SEQ ID NO: 23427

SEQ ID NO: 25710 - RNA, 61 nt, Human; identical to SEQ ID NO: 23428

SEQ ID NO: 25711 - RNA, 61 nt, Human; identical to SEQ ID NO: 23429

SEQ ID NO: 25712 - RNA, 61 nt, Human; identical to SEQ ID NO: 23430

SEQ ID NO: 25713 - RNA, 61 nt, Human; identical to SEQ ID NO: 23431

SEQ ID NO: 25714 - RNA, 61 nt, Human; identical to SEQ ID NO: 23432

SEQ ID NO: 25715 - RNA, 61 nt, Human; identical to SEQ ID NO: 23433

SEQ ID NO: 25716 - RNA, 61 nt, Human; identical to SEQ ID NO: 23434

SEQ ID NO: 25717 - RNA, 61 nt, Human; identical to SEQ ID NO: 23435

SEQ ID NO: 25718 - RNA, 61 nt, Human; identical to SEQ ID NO: 23436

SEQ ID NO: 25719 - RNA, 61 nt, Human; identical to SEQ ID NO: 23437

SEQ ID NO: 25720 - RNA, 61 nt, Human; identical to SEQ ID NO: 23438

SEQ ID NO: 25721 - RNA, 61 nt, Human; identical to SEQ ID NO: 23439

SEQ ID NO: 25722 - RNA, 61 nt, Human; identical to SEQ ID NO: 23440

SEQ ID NO: 25723 - RNA, 61 nt, Human; identical to SEQ ID NO: 23441

SEQ ID NO: 25724 - RNA, 61 nt, Human; identical to SEQ ID NO: 23442

SEQ ID NO: 25725 - RNA, 61 nt, Human; identical to SEQ ID NO: 23443

SEQ ID NO: 25726 - RNA, 61 nt, Human; identical to SEQ ID NO: 23444

SEQ ID NO: 25727 - RNA, 61 nt, Human; identical to SEQ ID NO: 23445

SEQ ID NO: 25728 - RNA, 61 nt, Human; identical to SEQ ID NO: 23446

SEQ ID NO: 25729 - RNA, 61 nt, Human; identical to SEQ ID NO: 23447

SEQ ID NO: 25730 - RNA, 61 nt, Human; identical to SEQ ID NO: 23448

SEQ ID NO: 25731 - RNA, 61 nt, Human; identical to SEQ ID NO: 23449

SEQ ID NO: 25732 - RNA, 61 nt, Human; identical to SEQ ID NO: 23450

SEQ ID NO: 25733 - RNA, 61 nt, Human; identical to SEQ ID NO: 23451

SEQ ID NO: 25734 - RNA, 61 nt, Human; identical to SEQ ID NO: 23452

SEQ ID NO: 25735 - RNA, 61 nt, Human; identical to SEQ ID NO: 23453

SEQ ID NO: 25736 - RNA, 61 nt, Human; identical to SEQ ID NO: 23454

SEQ ID NO: 25737 - RNA, 61 nt, Human; identical to SEQ ID NO: 23455

SEQ ID NO: 25738 - RNA, 61 nt, Human; identical to SEQ ID NO: 23456

SEQ ID NO: 25739 - RNA, 61 nt, Human; identical to SEQ ID NO: 23457

SEQ ID NO: 25740 - RNA, 61 nt, Human; identical to SEQ ID NO: 23458

SEQ ID NO: 25741 - RNA, 61 nt, Human; identical to SEQ ID NO: 23459

SEQ ID NO: 25742 - RNA, 61 nt, Human; identical to SEQ ID NO: 23460

SEQ ID NO: 25743 - RNA, 61 nt, Human; identical to SEQ ID NO: 23461

SEQ ID NO: 25744 - RNA, 61 nt, Human; identical to SEQ ID NO: 23462

SEQ ID NO: 25745 - RNA, 58 nt, Human; identical to SEQ ID NO: 23463

SEQ ID NO: 25746 - RNA, 61 nt, Human; identical to SEQ ID NO: 23464

SEQ ID NO: 25747 - RNA, 61 nt, Human; identical to SEQ ID NO: 23465

SEQ ID NO: 25748 - RNA, 61 nt, Human; identical to SEQ ID NO: 23466

SEQ ID NO: 25749 - RNA, 61 nt, Human; identical to SEQ ID NO: 23467

SEQ ID NO: 25750 - RNA, 61 nt, Human; identical to SEQ ID NO: 23468

SEQ ID NO: 25751 - RNA, 61 nt, Human; identical to SEQ ID NO: 23469

SEQ ID NO: 25752 - RNA, 61 nt, Human; identical to SEQ ID NO: 23470

SEQ ID NO: 25753 - RNA, 56 nt, Human; identical to SEQ ID NO: 23471

SEQ ID NO: 25754 - RNA, 61 nt, Human; identical to SEQ ID NO: 23472

SEQ ID NO: 25755 - RNA, 61 nt, Human; identical to SEQ ID NO: 23473

SEQ ID NO: 25756 - RNA, 61 nt, Human; identical to SEQ ID NO: 23474

SEQ ID NO: 25757 - RNA, 61 nt, Human; identical to SEQ ID NO: 23475

SEQ ID NO: 25758 - RNA, 61 nt, Human; identical to SEQ ID NO: 23476

SEQ ID NO: 25759 - RNA, 61 nt, Human; identical to SEQ ID NO: 23477

SEQ ID NO: 25760 - RNA, 61 nt, Human; identical to SEQ ID NO: 23478

SEQ ID NO: 25761 - RNA, 61 nt, Human; identical to SEQ ID NO: 23479

SEQ ID NO: 25762 - RNA, 61 nt, Human; identical to SEQ ID NO: 23480

SEQ ID NO: 25763 - RNA, 61 nt, Human; identical to SEQ ID NO: 23481

SEQ ID NO: 25764 - RNA, 61 nt, Human; identical to SEQ ID NO: 23482

SEQ ID NO: 25765 - RNA, 61 nt, Human; identical to SEQ ID NO: 23483

SEQ ID NO: 25766 - RNA, 61 nt, Human; identical to SEQ ID NO: 23484

SEQ ID NO: 25767 - RNA, 61 nt, Human; identical to SEQ ID NO: 23485

SEQ ID NO: 25768 - RNA, 61 nt, Human; identical to SEQ ID NO: 23486

SEQ ID NO: 25769 - RNA, 61 nt, Human; identical to SEQ ID NO: 23487

SEQ ID NO: 25770 - RNA, 61 nt, Human; identical to SEQ ID NO: 23488

SEQ ID NO: 25771 - RNA, 61 nt, Human; identical to SEQ ID NO: 23489

SEQ ID NO: 25772 - RNA, 61 nt, Human; identical to SEQ ID NO: 23490

SEQ ID NO: 25773 - RNA, 61 nt, Human; identical to SEQ ID NO: 23491

SEQ ID NO: 25774 - RNA, 61 nt, Human; identical to SEQ ID NO: 23492

SEQ ID NO: 25775 - RNA, 61 nt, Human; identical to SEQ ID NO: 23493

SEQ ID NO: 25776 - RNA, 61 nt, Human; identical to SEQ ID NO: 23494

SEQ ID NO: 25777 - RNA, 61 nt, Human; identical to SEQ ID NO: 23495

SEQ ID NO: 25778 - RNA, 61 nt, Human; identical to SEQ ID NO: 23496

SEQ ID NO: 25779 - RNA, 61 nt, Human; identical to SEQ ID NO: 23497

SEQ ID NO: 25780 - RNA, 61 nt, Human; identical to SEQ ID NO: 23498

SEQ ID NO: 25781 - RNA, 61 nt, Human; identical to SEQ ID NO: 23499

SEQ ID NO: 25782 - RNA, 61 nt, Human; identical to SEQ ID NO: 23500

SEQ ID NO: 25783 - RNA, 61 nt, Human; identical to SEQ ID NO: 23501

SEQ ID NO: 25784 - RNA, 61 nt, Human; identical to SEQ ID NO: 23502

SEQ ID NO: 25785 - RNA, 61 nt, Human; identical to SEQ ID NO: 23503

SEQ ID NO: 25786 - RNA, 61 nt, Human; identical to SEQ ID NO: 23504

SEQ ID NO: 25787 - RNA, 61 nt, Human; identical to SEQ ID NO: 23505

SEQ ID NO: 25788 - RNA, 61 nt, Human; identical to SEQ ID NO: 23506

SEQ ID NO: 25789 - RNA, 61 nt, Human; identical to SEQ ID NO: 23507

SEQ ID NO: 25790 - RNA, 61 nt, Human; identical to SEQ ID NO: 23508

SEQ ID NO: 25791 - RNA, 61 nt, Human; identical to SEQ ID NO: 23509

SEQ ID NO: 25792 - RNA, 61 nt, Human; identical to SEQ ID NO: 23510

SEQ ID NO: 25793 - RNA, 61 nt, Human; identical to SEQ ID NO: 23511

SEQ ID NO: 25794 - RNA, 61 nt, Human; identical to SEQ ID NO: 23512

SEQ ID NO: 25795 - RNA, 61 nt, Human; identical to SEQ ID NO: 23513

SEQ ID NO: 25796 - RNA, 61 nt, Human; identical to SEQ ID NO: 23514

SEQ ID NO: 25797 - RNA, 61 nt, Human; identical to SEQ ID NO: 23515

SEQ ID NO: 25798 - RNA, 61 nt, Human; identical to SEQ ID NO: 23516

SEQ ID NO: 25799 - RNA, 61 nt, Human; identical to SEQ ID NO: 23517

SEQ ID NO: 25800 - RNA, 61 nt, Human; identical to SEQ ID NO: 23518

SEQ ID NO: 25801 - RNA, 61 nt, Human; identical to SEQ ID NO: 23519

SEQ ID NO: 25802 - RNA, 61 nt, Human; identical to SEQ ID NO: 23520

SEQ ID NO: 25803 - RNA, 61 nt, Human; identical to SEQ ID NO: 23521

SEQ ID NO: 25804 - RNA, 61 nt, Human; identical to SEQ ID NO: 23522

SEQ ID NO: 25805 - RNA, 61 nt, Human; identical to SEQ ID NO: 23523

SEQ ID NO: 25806 - RNA, 61 nt, Human; identical to SEQ ID NO: 23524

SEQ ID NO: 25807 - RNA, 61 nt, Human; identical to SEQ ID NO: 23525

SEQ ID NO: 25808 - RNA, 61 nt, Human; identical to SEQ ID NO: 23526

SEQ ID NO: 25809 - RNA, 61 nt, Human; identical to SEQ ID NO: 23527

SEQ ID NO: 25810 - RNA, 61 nt, Human; identical to SEQ ID NO: 23528

SEQ ID NO: 25811 - RNA, 61 nt, Human; identical to SEQ ID NO: 23529

SEQ ID NO: 25812 - RNA, 61 nt, Human; identical to SEQ ID NO: 23530

SEQ ID NO: 25813 - RNA, 61 nt, Human; identical to SEQ ID NO: 23531

SEQ ID NO: 25814 - RNA, 61 nt, Human; identical to SEQ ID NO: 23532

SEQ ID NO: 25815 - RNA, 61 nt, Human; identical to SEQ ID NO: 23533

SEQ ID NO: 25816 - RNA, 61 nt, Human; identical to SEQ ID NO: 23534

SEQ ID NO: 25817 - RNA, 61 nt, Human; identical to SEQ ID NO: 23535

SEQ ID NO: 25818 - RNA, 61 nt, Human; identical to SEQ ID NO: 23536

SEQ ID NO: 25819 - RNA, 61 nt, Human; identical to SEQ ID NO: 23537

SEQ ID NO: 25820 - RNA, 61 nt, Human; identical to SEQ ID NO: 23538

SEQ ID NO: 25821 - RNA, 61 nt, Human; identical to SEQ ID NO: 23539

SEQ ID NO: 25822 - RNA, 61 nt, Human; identical to SEQ ID NO: 23540

SEQ ID NO: 25823 - RNA, 61 nt, Human; identical to SEQ ID NO: 23541

SEQ ID NO: 25824 - RNA, 61 nt, Human; identical to SEQ ID NO: 23542

SEQ ID NO: 25825 - RNA, 61 nt, Human; identical to SEQ ID NO: 23543

SEQ ID NO: 25826 - RNA, 61 nt, Human; identical to SEQ ID NO: 23544

SEQ ID NO: 25827 - RNA, 61 nt, Human; identical to SEQ ID NO: 23545

SEQ ID NO: 25828 - RNA, 61 nt, Human; identical to SEQ ID NO: 23546

SEQ ID NO: 25829 - RNA, 61 nt, Human; identical to SEQ ID NO: 23547

SEQ ID NO: 25830 - RNA, 61 nt, Human; identical to SEQ ID NO: 23548

SEQ ID NO: 25831 - RNA, 61 nt, Human; identical to SEQ ID NO: 23549

SEQ ID NO: 25832 - RNA, 61 nt, Human; identical to SEQ ID NO: 23550

SEQ ID NO: 25833 - RNA, 61 nt, Human; identical to SEQ ID NO: 23551

SEQ ID NO: 25834 - RNA, 61 nt, Human; identical to SEQ ID NO: 23552

SEQ ID NO: 25835 - RNA, 61 nt, Human; identical to SEQ ID NO: 23553

SEQ ID NO: 25836 - RNA, 61 nt, Human; identical to SEQ ID NO: 23554

SEQ ID NO: 25837 - RNA, 61 nt, Human; identical to SEQ ID NO: 23555

SEQ ID NO: 25838 - RNA, 61 nt, Human; identical to SEQ ID NO: 23556

SEQ ID NO: 25839 - RNA, 61 nt, Human; identical to SEQ ID NO: 23557

SEQ ID NO: 25840 - RNA, 61 nt, Human; identical to SEQ ID NO: 23558

SEQ ID NO: 25841 - RNA, 61 nt, Human; identical to SEQ ID NO: 23559

SEQ ID NO: 25842 - RNA, 61 nt, Human; identical to SEQ ID NO: 23560

SEQ ID NO: 25843 - RNA, 61 nt, Human; identical to SEQ ID NO: 23561

SEQ ID NO: 25844 - RNA, 61 nt, Human; identical to SEQ ID NO: 23562

SEQ ID NO: 25845 - RNA, 61 nt, Human; identical to SEQ ID NO: 23563

SEQ ID NO: 25846 - RNA, 61 nt, Human; identical to SEQ ID NO: 23564

SEQ ID NO: 25847 - RNA, 61 nt, Human; identical to SEQ ID NO: 23565

SEQ ID NO: 25848 - RNA, 61 nt, Human; identical to SEQ ID NO: 23566

SEQ ID NO: 25849 - RNA, 61 nt, Human; identical to SEQ ID NO: 23567

SEQ ID NO: 25850 - RNA, 61 nt, Human; identical to SEQ ID NO: 23568

SEQ ID NO: 25851 - RNA, 61 nt, Human; identical to SEQ ID NO: 23569

SEQ ID NO: 25852 - RNA, 61 nt, Human; identical to SEQ ID NO: 23570

SEQ ID NO: 25853 - RNA, 61 nt, Human; identical to SEQ ID NO: 23571

SEQ ID NO: 25854 - RNA, 61 nt, Human; identical to SEQ ID NO: 23572

SEQ ID NO: 25855 - RNA, 61 nt, Human; identical to SEQ ID NO: 23573

SEQ ID NO: 25856 - RNA, 61 nt, Human; identical to SEQ ID NO: 23574

SEQ ID NO: 25857 - RNA, 61 nt, Human; identical to SEQ ID NO: 23575

SEQ ID NO: 25858 - RNA, 61 nt, Human; identical to SEQ ID NO: 23576

SEQ ID NO: 25859 - RNA, 61 nt, Human; identical to SEQ ID NO: 23577

SEQ ID NO: 25860 - RNA, 61 nt, Human; identical to SEQ ID NO: 23578

SEQ ID NO: 25861 - RNA, 61 nt, Human; identical to SEQ ID NO: 23579

SEQ ID NO: 25862 - RNA, 61 nt, Human; identical to SEQ ID NO: 23580

SEQ ID NO: 25863 - RNA, 61 nt, Human; identical to SEQ ID NO: 23581

SEQ ID NO: 25864 - RNA, 61 nt, Human; identical to SEQ ID NO: 23582

SEQ ID NO: 25865 - RNA, 61 nt, Human; identical to SEQ ID NO: 23583

SEQ ID NO: 25866 - RNA, 61 nt, Human; identical to SEQ ID NO: 23584

SEQ ID NO: 25867 - RNA, 61 nt, Human; identical to SEQ ID NO: 23585

SEQ ID NO: 25868 - RNA, 61 nt, Human; identical to SEQ ID NO: 23586

SEQ ID NO: 25869 - RNA, 61 nt, Human; identical to SEQ ID NO: 23587

SEQ ID NO: 25870 - RNA, 61 nt, Human; identical to SEQ ID NO: 23588

SEQ ID NO: 25871 - RNA, 61 nt, Human; identical to SEQ ID NO: 23589

SEQ ID NO: 25872 - RNA, 61 nt, Human; identical to SEQ ID NO: 23590

SEQ ID NO: 25873 - RNA, 61 nt, Human; identical to SEQ ID NO: 23591

SEQ ID NO: 25874 - RNA, 61 nt, Human; identical to SEQ ID NO: 23592

SEQ ID NO: 25875 - RNA, 61 nt, Human; identical to SEQ ID NO: 23593

SEQ ID NO: 25876 - RNA, 61 nt, Human; identical to SEQ ID NO: 23594

SEQ ID NO: 25877 - RNA, 61 nt, Human; identical to SEQ ID NO: 23595

SEQ ID NO: 25878 - RNA, 61 nt, Human; identical to SEQ ID NO: 23596

SEQ ID NO: 25879 - RNA, 61 nt, Human; identical to SEQ ID NO: 23597

SEQ ID NO: 25880 - RNA, 61 nt, Human; identical to SEQ ID NO: 23598

SEQ ID NO: 25881 - RNA, 61 nt, Human; identical to SEQ ID NO: 23599

SEQ ID NO: 25882 - RNA, 61 nt, Human; identical to SEQ ID NO: 23600

SEQ ID NO: 25883 - RNA, 61 nt, Human; identical to SEQ ID NO: 23601

SEQ ID NO: 25884 - RNA, 61 nt, Human; identical to SEQ ID NO: 23602

SEQ ID NO: 25885 - RNA, 61 nt, Human; identical to SEQ ID NO: 23603

SEQ ID NO: 25886 - RNA, 61 nt, Human; identical to SEQ ID NO: 23604

SEQ ID NO: 25887 - RNA, 61 nt, Human; identical to SEQ ID NO: 23605

SEQ ID NO: 25888 - RNA, 61 nt, Human; identical to SEQ ID NO: 23606

SEQ ID NO: 25889 - RNA, 61 nt, Human; identical to SEQ ID NO: 23607

SEQ ID NO: 25890 - RNA, 61 nt, Human; identical to SEQ ID NO: 23608

SEQ ID NO: 25891 - RNA, 61 nt, Human; identical to SEQ ID NO: 23609

SEQ ID NO: 25892 - RNA, 61 nt, Human; identical to SEQ ID NO: 23610

SEQ ID NO: 25893 - RNA, 61 nt, Human; identical to SEQ ID NO: 23611

SEQ ID NO: 25894 - RNA, 61 nt, Human; identical to SEQ ID NO: 23612

SEQ ID NO: 25895 - RNA, 61 nt, Human; identical to SEQ ID NO: 23613

SEQ ID NO: 25896 - RNA, 61 nt, Human; identical to SEQ ID NO: 23614

SEQ ID NO: 25897 - RNA, 61 nt, Human; identical to SEQ ID NO: 23615

SEQ ID NO: 25898 - RNA, 61 nt, Human; identical to SEQ ID NO: 23616

SEQ ID NO: 25899 - RNA, 61 nt, Human; identical to SEQ ID NO: 23617

SEQ ID NO: 25900 - RNA, 61 nt, Human; identical to SEQ ID NO: 23618

SEQ ID NO: 25901 - RNA, 61 nt, Human; identical to SEQ ID NO: 23619

SEQ ID NO: 25902 - RNA, 61 nt, Human; identical to SEQ ID NO: 23620

SEQ ID NO: 25903 - RNA, 61 nt, Human; identical to SEQ ID NO: 23621

SEQ ID NO: 25904 - RNA, 61 nt, Human; identical to SEQ ID NO: 23622

SEQ ID NO: 25905 - RNA, 61 nt, Human; identical to SEQ ID NO: 23623

SEQ ID NO: 25906 - RNA, 61 nt, Human; identical to SEQ ID NO: 23624

SEQ ID NO: 25907 - RNA, 61 nt, Human; identical to SEQ ID NO: 23625

SEQ ID NO: 25908 - RNA, 61 nt, Human; identical to SEQ ID NO: 23626

SEQ ID NO: 25909 - RNA, 61 nt, Human; identical to SEQ ID NO: 23627

SEQ ID NO: 25910 - RNA, 61 nt, Human; identical to SEQ ID NO: 23628

SEQ ID NO: 25911 - RNA, 61 nt, Human; identical to SEQ ID NO: 23629

SEQ ID NO: 25912 - RNA, 61 nt, Human; identical to SEQ ID NO: 23630

SEQ ID NO: 25913 - RNA, 61 nt, Human; identical to SEQ ID NO: 23631

SEQ ID NO: 25914 - RNA, 61 nt, Human; identical to SEQ ID NO: 23632

SEQ ID NO: 25915 - RNA, 61 nt, Human; identical to SEQ ID NO: 23633

SEQ ID NO: 25916 - RNA, 61 nt, Human; identical to SEQ ID NO: 23634

SEQ ID NO: 25917 - RNA, 61 nt, Human; identical to SEQ ID NO: 23635

SEQ ID NO: 25918 - RNA, 61 nt, Human; identical to SEQ ID NO: 23636

SEQ ID NO: 25919 - RNA, 61 nt, Human; identical to SEQ ID NO: 23637

SEQ ID NO: 25920 - RNA, 61 nt, Human; identical to SEQ ID NO: 23638

SEQ ID NO: 25921 - RNA, 61 nt, Human; identical to SEQ ID NO: 23639

SEQ ID NO: 25922 - RNA, 61 nt, Human; identical to SEQ ID NO: 23640

SEQ ID NO: 25923 - RNA, 61 nt, Human; identical to SEQ ID NO: 23641

SEQ ID NO: 25924 - RNA, 61 nt, Human; identical to SEQ ID NO: 23642

SEQ ID NO: 25925 - RNA, 61 nt, Human; identical to SEQ ID NO: 23643

SEQ ID NO: 25926 - RNA, 61 nt, Human; identical to SEQ ID NO: 23644

SEQ ID NO: 25927 - RNA, 61 nt, Human; identical to SEQ ID NO: 23645

SEQ ID NO: 25928 - RNA, 61 nt, Human; identical to SEQ ID NO: 23646

SEQ ID NO: 25929 - RNA, 61 nt, Human; identical to SEQ ID NO: 23647

SEQ ID NO: 25930 - RNA, 61 nt, Human; identical to SEQ ID NO: 23648

SEQ ID NO: 25931 - RNA, 61 nt, Human; identical to SEQ ID NO: 23649

SEQ ID NO: 25932 - RNA, 61 nt, Human; identical to SEQ ID NO: 23650

SEQ ID NO: 25933 - RNA, 61 nt, Human; identical to SEQ ID NO: 23651

SEQ ID NO: 25934 - RNA, 61 nt, Human; identical to SEQ ID NO: 23652

SEQ ID NO: 25935 - RNA, 61 nt, Human; identical to SEQ ID NO: 23653

SEQ ID NO: 25936 - RNA, 61 nt, Human; identical to SEQ ID NO: 23654

SEQ ID NO: 25937 - RNA, 61 nt, Human; identical to SEQ ID NO: 23655

SEQ ID NO: 25938 - RNA, 61 nt, Human; identical to SEQ ID NO: 23656

SEQ ID NO: 25939 - RNA, 61 nt, Human; identical to SEQ ID NO: 23657

SEQ ID NO: 25940 - RNA, 61 nt, Human; identical to SEQ ID NO: 23658

SEQ ID NO: 25941 - RNA, 61 nt, Human; identical to SEQ ID NO: 23659

SEQ ID NO: 25942 - RNA, 61 nt, Human; identical to SEQ ID NO: 23660

SEQ ID NO: 25943 - RNA, 61 nt, Human; identical to SEQ ID NO: 23661

SEQ ID NO: 25944 - RNA, 61 nt, Human; identical to SEQ ID NO: 23662

SEQ ID NO: 25945 - RNA, 61 nt, Human; identical to SEQ ID NO: 23663

SEQ ID NO: 25946 - RNA, 61 nt, Human; identical to SEQ ID NO: 23664

SEQ ID NO: 25947 - RNA, 61 nt, Human; identical to SEQ ID NO: 23665

SEQ ID NO: 25948 - RNA, 61 nt, Human; identical to SEQ ID NO: 23666

SEQ ID NO: 25949 - RNA, 61 nt, Human; identical to SEQ ID NO: 23667

SEQ ID NO: 25950 - RNA, 61 nt, Human; identical to SEQ ID NO: 23668

SEQ ID NO: 25951 - RNA, 61 nt, Human; identical to SEQ ID NO: 23669

SEQ ID NO: 25952 - RNA, 61 nt, Human; identical to SEQ ID NO: 23670

SEQ ID NO: 25953 - RNA, 61 nt, Human; identical to SEQ ID NO: 23671

SEQ ID NO: 25954 - RNA, 61 nt, Human; identical to SEQ ID NO: 23672

SEQ ID NO: 25955 - RNA, 61 nt, Human; identical to SEQ ID NO: 23673

SEQ ID NO: 25956 - RNA, 61 nt, Human; identical to SEQ ID NO: 23674

SEQ ID NO: 25957 - RNA, 61 nt, Human; identical to SEQ ID NO: 23675

SEQ ID NO: 25958 - RNA, 61 nt, Human; identical to SEQ ID NO: 23676

SEQ ID NO: 25959 - RNA, 61 nt, Human; identical to SEQ ID NO: 23677

SEQ ID NO: 25960 - RNA, 61 nt, Human; identical to SEQ ID NO: 23678

SEQ ID NO: 25961 - RNA, 61 nt, Human; identical to SEQ ID NO: 23679

SEQ ID NO: 25962 - RNA, 61 nt, Human; identical to SEQ ID NO: 23680

SEQ ID NO: 25963 - RNA, 61 nt, Human; identical to SEQ ID NO: 23681

SEQ ID NO: 25964 - RNA, 61 nt, Human; identical to SEQ ID NO: 23682

SEQ ID NO: 25965 - RNA, 61 nt, Human; identical to SEQ ID NO: 23683

SEQ ID NO: 25966 - RNA, 61 nt, Human; identical to SEQ ID NO: 23684

SEQ ID NO: 25967 - RNA, 61 nt, Human; identical to SEQ ID NO: 23685

SEQ ID NO: 25968 - RNA, 61 nt, Human; identical to SEQ ID NO: 23686

SEQ ID NO: 25969 - RNA, 61 nt, Human; identical to SEQ ID NO: 23687

SEQ ID NO: 25970 - RNA, 61 nt, Human; identical to SEQ ID NO: 23688

SEQ ID NO: 25971 - RNA, 61 nt, Human; identical to SEQ ID NO: 23689

SEQ ID NO: 25972 - RNA, 61 nt, Human; identical to SEQ ID NO: 23690

SEQ ID NO: 25973 - RNA, 61 nt, Human; identical to SEQ ID NO: 23691

SEQ ID NO: 25974 - RNA, 61 nt, Human; identical to SEQ ID NO: 23692

SEQ ID NO: 25975 - RNA, 61 nt, Human; identical to SEQ ID NO: 23693

SEQ ID NO: 25976 - RNA, 61 nt, Human; identical to SEQ ID NO: 23694

SEQ ID NO: 25977 - RNA, 61 nt, Human; identical to SEQ ID NO: 23695

SEQ ID NO: 25978 - RNA, 61 nt, Human; identical to SEQ ID NO: 23696

SEQ ID NO: 25979 - RNA, 61 nt, Human; identical to SEQ ID NO: 23697

SEQ ID NO: 25980 - RNA, 61 nt, Human; identical to SEQ ID NO: 23698

SEQ ID NO: 25981 - RNA, 61 nt, Human; identical to SEQ ID NO: 23699

SEQ ID NO: 25982 - RNA, 61 nt, Human; identical to SEQ ID NO: 23700

SEQ ID NO: 25983 - RNA, 61 nt, Human; identical to SEQ ID NO: 23701

SEQ ID NO: 25984 - RNA, 61 nt, Human; identical to SEQ ID NO: 23702

SEQ ID NO: 25985 - RNA, 61 nt, Human; identical to SEQ ID NO: 23703

SEQ ID NO: 25986 - RNA, 61 nt, Human; identical to SEQ ID NO: 23704

SEQ ID NO: 25987 - RNA, 61 nt, Human; identical to SEQ ID NO: 23705

SEQ ID NO: 25988 - RNA, 61 nt, Human; identical to SEQ ID NO: 23706

SEQ ID NO: 25989 - RNA, 61 nt, Human; identical to SEQ ID NO: 23707

SEQ ID NO: 25990 - RNA, 61 nt, Human; identical to SEQ ID NO: 23708

SEQ ID NO: 25991 - RNA, 61 nt, Human; identical to SEQ ID NO: 23709

SEQ ID NO: 25992 - RNA, 61 nt, Human; identical to SEQ ID NO: 23710

SEQ ID NO: 25993 - RNA, 61 nt, Human; identical to SEQ ID NO: 23711

SEQ ID NO: 25994 - RNA, 61 nt, Human; identical to SEQ ID NO: 23712

SEQ ID NO: 25995 - RNA, 61 nt, Human; identical to SEQ ID NO: 23713

SEQ ID NO: 25996 - RNA, 61 nt, Human; identical to SEQ ID NO: 23714

SEQ ID NO: 25997 - RNA, 61 nt, Human; identical to SEQ ID NO: 23715

SEQ ID NO: 25998 - RNA, 61 nt, Human; identical to SEQ ID NO: 23716

SEQ ID NO: 25999 - RNA, 61 nt, Human; identical to SEQ ID NO: 23717

SEQ ID NO: 26000 - RNA, 61 nt, Human; identical to SEQ ID NO: 23718

SEQ ID NO: 26001 - RNA, 61 nt, Human; identical to SEQ ID NO: 23719

SEQ ID NO: 26002 - RNA, 61 nt, Human; identical to SEQ ID NO: 23720

SEQ ID NO: 26003 - RNA, 61 nt, Human; identical to SEQ ID NO: 23721

SEQ ID NO: 26004 - RNA, 61 nt, Human; identical to SEQ ID NO: 23722

SEQ ID NO: 26005 - RNA, 61 nt, Human; identical to SEQ ID NO: 23723

SEQ ID NO: 26006 - RNA, 61 nt, Human; identical to SEQ ID NO: 23724

SEQ ID NO: 26007 - RNA, 61 nt, Human; identical to SEQ ID NO: 23725

SEQ ID NO: 26008 - RNA, 61 nt, Human; identical to SEQ ID NO: 23726

SEQ ID NO: 26009 - RNA, 61 nt, Human; identical to SEQ ID NO: 23727

SEQ ID NO: 26010 - RNA, 61 nt, Human; identical to SEQ ID NO: 23728

SEQ ID NO: 26011 - RNA, 61 nt, Human; identical to SEQ ID NO: 23729

SEQ ID NO: 26012 - RNA, 61 nt, Human; identical to SEQ ID NO: 23730

SEQ ID NO: 26013 - RNA, 61 nt, Human; identical to SEQ ID NO: 23731

SEQ ID NO: 26014 - RNA, 61 nt, Human; identical to SEQ ID NO: 23732

SEQ ID NO: 26015 - RNA, 61 nt, Human; identical to SEQ ID NO: 23733

SEQ ID NO: 26016 - RNA, 61 nt, Human; identical to SEQ ID NO: 23734

SEQ ID NO: 26017 - RNA, 61 nt, Human; identical to SEQ ID NO: 23735

SEQ ID NO: 26018 - RNA, 61 nt, Human; identical to SEQ ID NO: 23736

SEQ ID NO: 26019 - RNA, 61 nt, Human; identical to SEQ ID NO: 23737

SEQ ID NO: 26020 - RNA, 61 nt, Human; identical to SEQ ID NO: 23738

SEQ ID NO: 26021 - RNA, 61 nt, Human; identical to SEQ ID NO: 23739

SEQ ID NO: 26022 - RNA, 61 nt, Human; identical to SEQ ID NO: 23740

SEQ ID NO: 26023 - RNA, 61 nt, Human; identical to SEQ ID NO: 23741

SEQ ID NO: 26024 - RNA, 61 nt, Human; identical to SEQ ID NO: 23742

SEQ ID NO: 26025 - RNA, 61 nt, Human; identical to SEQ ID NO: 23743

SEQ ID NO: 26026 - RNA, 61 nt, Human; identical to SEQ ID NO: 23744

SEQ ID NO: 26027 - RNA, 61 nt, Human; identical to SEQ ID NO: 23745

SEQ ID NO: 26028 - RNA, 61 nt, Human; identical to SEQ ID NO: 23746

SEQ ID NO: 26029 - RNA, 61 nt, Human; identical to SEQ ID NO: 23747

SEQ ID NO: 26030 - RNA, 61 nt, Human; identical to SEQ ID NO: 23748

SEQ ID NO: 26031 - RNA, 61 nt, Human; identical to SEQ ID NO: 23749

SEQ ID NO: 26032 - RNA, 61 nt, Human; identical to SEQ ID NO: 23750

SEQ ID NO: 26033 - RNA, 61 nt, Human; identical to SEQ ID NO: 23751

SEQ ID NO: 26034 - RNA, 61 nt, Human; identical to SEQ ID NO: 23752

SEQ ID NO: 26035 - RNA, 61 nt, Human; identical to SEQ ID NO: 23753

SEQ ID NO: 26036 - RNA, 61 nt, Human; identical to SEQ ID NO: 23754

SEQ ID NO: 26037 - RNA, 61 nt, Human; identical to SEQ ID NO: 23755

SEQ ID NO: 26038 - RNA, 61 nt, Human; identical to SEQ ID NO: 23756

SEQ ID NO: 26039 - RNA, 61 nt, Human; identical to SEQ ID NO: 23757

SEQ ID NO: 26040 - RNA, 61 nt, Human; identical to SEQ ID NO: 23758

SEQ ID NO: 26041 - RNA, 61 nt, Human; identical to SEQ ID NO: 23759

SEQ ID NO: 26042 - RNA, 61 nt, Human; identical to SEQ ID NO: 23760

SEQ ID NO: 26043 - RNA, 61 nt, Human; identical to SEQ ID NO: 23761

SEQ ID NO: 26044 - RNA, 61 nt, Human; identical to SEQ ID NO: 23762

SEQ ID NO: 26045 - RNA, 61 nt, Human; identical to SEQ ID NO: 23763

SEQ ID NO: 26046 - RNA, 61 nt, Human; identical to SEQ ID NO: 23764

SEQ ID NO: 26047 - RNA, 61 nt, Human; identical to SEQ ID NO: 23765

SEQ ID NO: 26048 - RNA, 61 nt, Human; identical to SEQ ID NO: 23766

SEQ ID NO: 26049 - RNA, 61 nt, Human; identical to SEQ ID NO: 23767

SEQ ID NO: 26050 - RNA, 61 nt, Human; identical to SEQ ID NO: 23768

SEQ ID NO: 26051 - RNA, 61 nt, Human; identical to SEQ ID NO: 23769

SEQ ID NO: 26052 - RNA, 61 nt, Human; identical to SEQ ID NO: 23770

SEQ ID NO: 26053 - RNA, 61 nt, Human; identical to SEQ ID NO: 23771

SEQ ID NO: 26054 - RNA, 61 nt, Human; identical to SEQ ID NO: 23772

SEQ ID NO: 26055 - RNA, 61 nt, Human; identical to SEQ ID NO: 23773

SEQ ID NO: 26056 - RNA, 61 nt, Human; identical to SEQ ID NO: 23774

SEQ ID NO: 26057 - RNA, 61 nt, Human; identical to SEQ ID NO: 23775

SEQ ID NO: 26058 - RNA, 61 nt, Human; identical to SEQ ID NO: 23776

SEQ ID NO: 26059 - RNA, 61 nt, Human; identical to SEQ ID NO: 23777

SEQ ID NO: 26060 - RNA, 61 nt, Human; identical to SEQ ID NO: 23778

SEQ ID NO: 26061 - RNA, 61 nt, Human; identical to SEQ ID NO: 23779

SEQ ID NO: 26062 - RNA, 61 nt, Human; identical to SEQ ID NO: 23780

SEQ ID NO: 26063 - RNA, 61 nt, Human; identical to SEQ ID NO: 23781

SEQ ID NO: 26064 - RNA, 61 nt, Human; identical to SEQ ID NO: 23782

SEQ ID NO: 26065 - RNA, 61 nt, Human; identical to SEQ ID NO: 23783

SEQ ID NO: 26066 - RNA, 61 nt, Human; identical to SEQ ID NO: 23784

SEQ ID NO: 26067 - RNA, 61 nt, Human; identical to SEQ ID NO: 23785

SEQ ID NO: 26068 - RNA, 61 nt, Human; identical to SEQ ID NO: 23786

SEQ ID NO: 26069 - RNA, 61 nt, Human; identical to SEQ ID NO: 23787

SEQ ID NO: 26070 - RNA, 61 nt, Human; identical to SEQ ID NO: 23788

SEQ ID NO: 26071 - RNA, 61 nt, Human; identical to SEQ ID NO: 23789

SEQ ID NO: 26072 - RNA, 61 nt, Human; identical to SEQ ID NO: 23790

SEQ ID NO: 26073 - RNA, 61 nt, Human; identical to SEQ ID NO: 23791

SEQ ID NO: 26074 - RNA, 61 nt, Human; identical to SEQ ID NO: 23792

SEQ ID NO: 26075 - RNA, 61 nt, Human; identical to SEQ ID NO: 23793

SEQ ID NO: 26076 - RNA, 61 nt, Human; identical to SEQ ID NO: 23794

SEQ ID NO: 26077 - RNA, 61 nt, Human; identical to SEQ ID NO: 23795

SEQ ID NO: 26078 - RNA, 61 nt, Human; identical to SEQ ID NO: 23796

SEQ ID NO: 26079 - RNA, 61 nt, Human; identical to SEQ ID NO: 23797

SEQ ID NO: 26080 - RNA, 61 nt, Human; identical to SEQ ID NO: 23798

SEQ ID NO: 26081 - RNA, 61 nt, Human; identical to SEQ ID NO: 23799

SEQ ID NO: 26082 - RNA, 61 nt, Human; identical to SEQ ID NO: 23800

SEQ ID NO: 26083 - RNA, 61 nt, Human; identical to SEQ ID NO: 23801

SEQ ID NO: 26084 - RNA, 61 nt, Human; identical to SEQ ID NO: 23802

SEQ ID NO: 26085 - RNA, 61 nt, Human; identical to SEQ ID NO: 23803

SEQ ID NO: 26086 - RNA, 61 nt, Human; identical to SEQ ID NO: 23804

SEQ ID NO: 26087 - RNA, 61 nt, Human; identical to SEQ ID NO: 23805

SEQ ID NO: 26088 - RNA, 50 nt, Human; identical to SEQ ID NO: 23806

SEQ ID NO: 26089 - RNA, 61 nt, Human; identical to SEQ ID NO: 23807

SEQ ID NO: 26090 - RNA, 61 nt, Human; identical to SEQ ID NO: 23808

SEQ ID NO: 26091 - RNA, 61 nt, Human; identical to SEQ ID NO: 23809

SEQ ID NO: 26092 - RNA, 61 nt, Human; identical to SEQ ID NO: 23810

SEQ ID NO: 26093 - RNA, 61 nt, Human; identical to SEQ ID NO: 23811

SEQ ID NO: 26094 - RNA, 61 nt, Human; identical to SEQ ID NO: 23812

SEQ ID NO: 26095 - RNA, 61 nt, Human; identical to SEQ ID NO: 23813

SEQ ID NO: 26096 - RNA, 61 nt, Human; identical to SEQ ID NO: 23814

SEQ ID NO: 26097 - RNA, 61 nt, Human; identical to SEQ ID NO: 23815

SEQ ID NO: 26098 - RNA, 61 nt, Human; identical to SEQ ID NO: 23816

SEQ ID NO: 26099 - RNA, 61 nt, Human; identical to SEQ ID NO: 23817

SEQ ID NO: 26100 - RNA, 61 nt, Human; identical to SEQ ID NO: 23818

SEQ ID NO: 26101 - RNA, 61 nt, Human; identical to SEQ ID NO: 23819

SEQ ID NO: 26102 - RNA, 61 nt, Human; identical to SEQ ID NO: 23820

SEQ ID NO: 26103 - RNA, 61 nt, Human; identical to SEQ ID NO: 23821

SEQ ID NO: 26104 - RNA, 61 nt, Human; identical to SEQ ID NO: 23822

SEQ ID NO: 26105 - RNA, 61 nt, Human; identical to SEQ ID NO: 23823

SEQ ID NO: 26106 - RNA, 61 nt, Human; identical to SEQ ID NO: 23824

SEQ ID NO: 26107 - RNA, 61 nt, Human; identical to SEQ ID NO: 23825

SEQ ID NO: 26108 - RNA, 61 nt, Human; identical to SEQ ID NO: 23826

SEQ ID NO: 26109 - RNA, 61 nt, Human; identical to SEQ ID NO: 23827

SEQ ID NO: 26110 - RNA, 61 nt, Human; identical to SEQ ID NO: 23828

SEQ ID NO: 26111 - RNA, 61 nt, Human; identical to SEQ ID NO: 23829

SEQ ID NO: 26112 - RNA, 61 nt, Human; identical to SEQ ID NO: 23830

SEQ ID NO: 26113 - RNA, 61 nt, Human; identical to SEQ ID NO: 23831

SEQ ID NO: 26114 - RNA, 61 nt, Human; identical to SEQ ID NO: 23832

SEQ ID NO: 26115 - RNA, 61 nt, Human; identical to SEQ ID NO: 23833

SEQ ID NO: 26116 - RNA, 61 nt, Human; identical to SEQ ID NO: 23834

SEQ ID NO: 26117 - RNA, 61 nt, Human; identical to SEQ ID NO: 23835

SEQ ID NO: 26118 - RNA, 61 nt, Human; identical to SEQ ID NO: 23836

SEQ ID NO: 26119 - RNA, 61 nt, Human; identical to SEQ ID NO: 23837

SEQ ID NO: 26120 - RNA, 61 nt, Human; identical to SEQ ID NO: 23838

SEQ ID NO: 26121 - RNA, 61 nt, Human; identical to SEQ ID NO: 23839

SEQ ID NO: 26122 - RNA, 61 nt, Human; identical to SEQ ID NO: 23840

SEQ ID NO: 26123 - RNA, 61 nt, Human; identical to SEQ ID NO: 23841

SEQ ID NO: 26124 - RNA, 61 nt, Human; identical to SEQ ID NO: 23842

SEQ ID NO: 26125 - RNA, 61 nt, Human; identical to SEQ ID NO: 23843

SEQ ID NO: 26126 - RNA, 61 nt, Human; identical to SEQ ID NO: 23844

SEQ ID NO: 26127 - RNA, 61 nt, Human; identical to SEQ ID NO: 23845

SEQ ID NO: 26128 - RNA, 61 nt, Human; identical to SEQ ID NO: 23846

SEQ ID NO: 26129 - RNA, 61 nt, Human; identical to SEQ ID NO: 23847

SEQ ID NO: 26130 - RNA, 61 nt, Human; identical to SEQ ID NO: 23848

SEQ ID NO: 26131 - RNA, 61 nt, Human; identical to SEQ ID NO: 23849

SEQ ID NO: 26132 - RNA, 61 nt, Human; identical to SEQ ID NO: 23850

SEQ ID NO: 26133 - RNA, 61 nt, Human; identical to SEQ ID NO: 23851

SEQ ID NO: 26134 - RNA, 61 nt, Human; identical to SEQ ID NO: 23852

SEQ ID NO: 26135 - RNA, 61 nt, Human; identical to SEQ ID NO: 23853

SEQ ID NO: 26136 - RNA, 61 nt, Human; identical to SEQ ID NO: 23854

SEQ ID NO: 26137 - RNA, 61 nt, Human; identical to SEQ ID NO: 23855

SEQ ID NO: 26138 - RNA, 61 nt, Human; identical to SEQ ID NO: 23856

SEQ ID NO: 26139 - RNA, 61 nt, Human; identical to SEQ ID NO: 23857

SEQ ID NO: 26140 - RNA, 61 nt, Human; identical to SEQ ID NO: 23858

SEQ ID NO: 26141 - RNA, 61 nt, Human; identical to SEQ ID NO: 23859

SEQ ID NO: 26142 - RNA, 61 nt, Human; identical to SEQ ID NO: 23860

SEQ ID NO: 26143 - RNA, 61 nt, Human; identical to SEQ ID NO: 23861

SEQ ID NO: 26144 - RNA, 61 nt, Human; identical to SEQ ID NO: 23862

SEQ ID NO: 26145 - RNA, 61 nt, Human; identical to SEQ ID NO: 23863

SEQ ID NO: 26146 - RNA, 61 nt, Human; identical to SEQ ID NO: 23864

SEQ ID NO: 26147 - RNA, 61 nt, Human; identical to SEQ ID NO: 23829

SEQ ID NO: 26148 - RNA, 61 nt, Human; identical to SEQ ID NO: 23866

SEQ ID NO: 26149 - RNA, 61 nt, Human; identical to SEQ ID NO: 23867

SEQ ID NO: 26150 - RNA, 61 nt, Human; identical to SEQ ID NO: 23868

SEQ ID NO: 26151 - RNA, 58 nt, Human; identical to SEQ ID NO: 23869

SEQ ID NO: 26152 - RNA, 61 nt, Human; identical to SEQ ID NO: 23870

SEQ ID NO: 26153 - RNA, 61 nt, Human; identical to SEQ ID NO: 23871

SEQ ID NO: 26154 - RNA, 61 nt, Human; identical to SEQ ID NO: 23872

SEQ ID NO: 26155 - RNA, 61 nt, Human; identical to SEQ ID NO: 23873

SEQ ID NO: 26156 - RNA, 61 nt, Human; identical to SEQ ID NO: 23874

SEQ ID NO: 26157 - RNA, 61 nt, Human; identical to SEQ ID NO: 23875

SEQ ID NO: 26158 - RNA, 61 nt, Human; identical to SEQ ID NO: 23876

SEQ ID NO: 26159 - RNA, 61 nt, Human; identical to SEQ ID NO: 23877

SEQ ID NO: 26160 - RNA, 61 nt, Human; identical to SEQ ID NO: 23878

SEQ ID NO: 26161 - RNA, 61 nt, Human; identical to SEQ ID NO: 23879

SEQ ID NO: 26162 - RNA, 61 nt, Human; identical to SEQ ID NO: 23880

SEQ ID NO: 26163 - RNA, 61 nt, Human; identical to SEQ ID NO: 23881

SEQ ID NO: 26164 - RNA, 55 nt, Human; identical to SEQ ID NO: 23882

SEQ ID NO: 26165 - RNA, 61 nt, Human; identical to SEQ ID NO: 23883

SEQ ID NO: 26166 - RNA, 61 nt, Human; identical to SEQ ID NO: 23884

SEQ ID NO: 26167 - RNA, 61 nt, Human; identical to SEQ ID NO: 23885

SEQ ID NO: 26168 - RNA, 61 nt, Human; identical to SEQ ID NO: 23886

SEQ ID NO: 26169 - RNA, 61 nt, Human; identical to SEQ ID NO: 23887

SEQ ID NO: 26170 - RNA, 61 nt, Human; identical to SEQ ID NO: 23888

SEQ ID NO: 26171 - RNA, 61 nt, Human; identical to SEQ ID NO: 23889

SEQ ID NO: 26172 - RNA, 61 nt, Human; identical to SEQ ID NO: 23890

SEQ ID NO: 26173 - RNA, 61 nt, Human; identical to SEQ ID NO: 23891

SEQ ID NO: 26174 - RNA, 61 nt, Human; identical to SEQ ID NO: 23892

SEQ ID NO: 26175 - RNA, 61 nt, Human; identical to SEQ ID NO: 23893

SEQ ID NO: 26176 - RNA, 61 nt, Human; identical to SEQ ID NO: 23894

SEQ ID NO: 26177 - RNA, 61 nt, Human; identical to SEQ ID NO: 23895

SEQ ID NO: 26178 - RNA, 61 nt, Human; identical to SEQ ID NO: 23896

SEQ ID NO: 26179 - RNA, 61 nt, Human; identical to SEQ ID NO: 23897

SEQ ID NO: 26180 - RNA, 61 nt, Human; identical to SEQ ID NO: 23898

SEQ ID NO: 26181 - RNA, 61 nt, Human; identical to SEQ ID NO: 23899

SEQ ID NO: 26182 - RNA, 61 nt, Human; identical to SEQ ID NO: 23900

SEQ ID NO: 26183 - RNA, 61 nt, Human; identical to SEQ ID NO: 23901

SEQ ID NO: 26184 - RNA, 61 nt, Human; identical to SEQ ID NO: 23902

SEQ ID NO: 26185 - RNA, 61 nt, Human; identical to SEQ ID NO: 23903

SEQ ID NO: 26186 - RNA, 61 nt, Human; identical to SEQ ID NO: 23904

SEQ ID NO: 26187 - RNA, 61 nt, Human; identical to SEQ ID NO: 23905

SEQ ID NO: 26188 - RNA, 61 nt, Human; identical to SEQ ID NO: 23906

SEQ ID NO: 26189 - RNA, 61 nt, Human; identical to SEQ ID NO: 23907

SEQ ID NO: 26190 - RNA, 61 nt, Human; identical to SEQ ID NO: 23908

SEQ ID NO: 26191 - RNA, 61 nt, Human; identical to SEQ ID NO: 23909

SEQ ID NO: 26192 - RNA, 61 nt, Human; identical to SEQ ID NO: 23910

SEQ ID NO: 26193 - RNA, 61 nt, Human; identical to SEQ ID NO: 23911

SEQ ID NO: 26194 - RNA, 61 nt, Human; identical to SEQ ID NO: 23912

SEQ ID NO: 26195 - RNA, 61 nt, Human; identical to SEQ ID NO: 23913

SEQ ID NO: 26196 - RNA, 61 nt, Human; identical to SEQ ID NO: 23914

SEQ ID NO: 26197 - RNA, 61 nt, Human; identical to SEQ ID NO: 23915

SEQ ID NO: 26198 - RNA, 61 nt, Human; identical to SEQ ID NO: 23916

SEQ ID NO: 26199 - RNA, 61 nt, Human; identical to SEQ ID NO: 23917

SEQ ID NO: 26200 - RNA, 61 nt, Human; identical to SEQ ID NO: 23918

SEQ ID NO: 26201 - RNA, 61 nt, Human; identical to SEQ ID NO: 23919

SEQ ID NO: 26202 - RNA, 61 nt, Human; identical to SEQ ID NO: 23920

SEQ ID NO: 26203 - RNA, 61 nt, Human; identical to SEQ ID NO: 23921

SEQ ID NO: 26204 - RNA, 61 nt, Human; identical to SEQ ID NO: 23922

SEQ ID NO: 26205 - RNA, 61 nt, Human; identical to SEQ ID NO: 23923

SEQ ID NO: 26206 - RNA, 61 nt, Human; identical to SEQ ID NO: 23924

SEQ ID NO: 26207 - RNA, 61 nt, Human; identical to SEQ ID NO: 23925

SEQ ID NO: 26208 - RNA, 61 nt, Human; identical to SEQ ID NO: 23926

SEQ ID NO: 26209 - RNA, 61 nt, Human; identical to SEQ ID NO: 23927

SEQ ID NO: 26210 - RNA, 61 nt, Human; identical to SEQ ID NO: 23928

SEQ ID NO: 26211 - RNA, 61 nt, Human; identical to SEQ ID NO: 23929

SEQ ID NO: 26212 - RNA, 61 nt, Human; identical to SEQ ID NO: 23930

SEQ ID NO: 26213 - RNA, 61 nt, Human; identical to SEQ ID NO: 23931

SEQ ID NO: 26214 - RNA, 61 nt, Human; identical to SEQ ID NO: 23932

SEQ ID NO: 26215 - RNA, 61 nt, Human; identical to SEQ ID NO: 23933

SEQ ID NO: 26216 - RNA, 61 nt, Human; identical to SEQ ID NO: 23934

SEQ ID NO: 26217 - RNA, 61 nt, Human; identical to SEQ ID NO: 23935

SEQ ID NO: 26218 - RNA, 61 nt, Human; identical to SEQ ID NO: 23936

SEQ ID NO: 26219 - RNA, 61 nt, Human; identical to SEQ ID NO: 23937

SEQ ID NO: 26220 - RNA, 61 nt, Human; identical to SEQ ID NO: 23938

SEQ ID NO: 26221 - RNA, 61 nt, Human; identical to SEQ ID NO: 23939

SEQ ID NO: 26222 - RNA, 61 nt, Human; identical to SEQ ID NO: 23940

SEQ ID NO: 26223 - RNA, 61 nt, Human; identical to SEQ ID NO: 23941

SEQ ID NO: 26224 - RNA, 61 nt, Human; identical to SEQ ID NO: 23942

SEQ ID NO: 26225 - RNA, 61 nt, Human; identical to SEQ ID NO: 23943

SEQ ID NO: 26226 - RNA, 61 nt, Human; identical to SEQ ID NO: 23944

SEQ ID NO: 26227 - RNA, 61 nt, Human; identical to SEQ ID NO: 23945

SEQ ID NO: 26228 - RNA, 61 nt, Human; identical to SEQ ID NO: 23946

SEQ ID NO: 26229 - RNA, 61 nt, Human; identical to SEQ ID NO: 23947

SEQ ID NO: 26230 - RNA, 61 nt, Human; identical to SEQ ID NO: 23948

SEQ ID NO: 26231 - RNA, 61 nt, Human; identical to SEQ ID NO: 23949

SEQ ID NO: 26232 - RNA, 61 nt, Human; identical to SEQ ID NO: 23950

SEQ ID NO: 26233 - RNA, 61 nt, Human; identical to SEQ ID NO: 23951

SEQ ID NO: 26234 - RNA, 61 nt, Human; identical to SEQ ID NO: 23952

SEQ ID NO: 26235 - RNA, 61 nt, Human; identical to SEQ ID NO: 23953

SEQ ID NO: 26236 - RNA, 61 nt, Human; identical to SEQ ID NO: 23954

SEQ ID NO: 26237 - RNA, 61 nt, Human; identical to SEQ ID NO: 23955

SEQ ID NO: 26238 - RNA, 61 nt, Human; identical to SEQ ID NO: 23956

SEQ ID NO: 26239 - RNA, 61 nt, Human; identical to SEQ ID NO: 23957

SEQ ID NO: 26240 - RNA, 61 nt, Human; identical to SEQ ID NO: 23958

SEQ ID NO: 26241 - RNA, 61 nt, Human; identical to SEQ ID NO: 23959

SEQ ID NO: 26242 - RNA, 61 nt, Human; identical to SEQ ID NO: 23960

SEQ ID NO: 26243 - RNA, 61 nt, Human; identical to SEQ ID NO: 23961

SEQ ID NO: 26244 - RNA, 61 nt, Human; identical to SEQ ID NO: 23962

SEQ ID NO: 26245 - RNA, 60 nt, Human; identical to SEQ ID NO: 23963

SEQ ID NO: 26246 - RNA, 61 nt, Human; identical to SEQ ID NO: 23964

SEQ ID NO: 26247 - RNA, 61 nt, Human; identical to SEQ ID NO: 23965

SEQ ID NO: 26248 - RNA, 61 nt, Human; identical to SEQ ID NO: 23966

SEQ ID NO: 26249 - RNA, 61 nt, Human; identical to SEQ ID NO: 23967

SEQ ID NO: 26250 - RNA, 61 nt, Human; identical to SEQ ID NO: 23968

SEQ ID NO: 26251 - RNA, 61 nt, Human; identical to SEQ ID NO: 23969

SEQ ID NO: 26252 - RNA, 61 nt, Human; identical to SEQ ID NO: 23970

SEQ ID NO: 26253 - RNA, 61 nt, Human; identical to SEQ ID NO: 23971

SEQ ID NO: 26254 - RNA, 61 nt, Human; identical to SEQ ID NO: 23972

SEQ ID NO: 26255 - RNA, 61 nt, Human; identical to SEQ ID NO: 23973

SEQ ID NO: 26256 - RNA, 61 nt, Human; identical to SEQ ID NO: 23974

SEQ ID NO: 26257 - RNA, 61 nt, Human; identical to SEQ ID NO: 23975

SEQ ID NO: 26258 - RNA, 61 nt, Human; identical to SEQ ID NO: 23976

SEQ ID NO: 26259 - RNA, 61 nt, Human; identical to SEQ ID NO: 23977

SEQ ID NO: 26260 - RNA, 61 nt, Human; identical to SEQ ID NO: 23978

SEQ ID NO: 26261 - RNA, 61 nt, Human; identical to SEQ ID NO: 23979

SEQ ID NO: 26262 - RNA, 61 nt, Human; identical to SEQ ID NO: 23980

SEQ ID NO: 26263 - RNA, 61 nt, Human; identical to SEQ ID NO: 23981

SEQ ID NO: 26264 - RNA, 61 nt, Human; identical to SEQ ID NO: 23982

SEQ ID NO: 26265 - RNA, 61 nt, Human; identical to SEQ ID NO: 23983

SEQ ID NO: 26266 - RNA, 61 nt, Human; identical to SEQ ID NO: 23984

SEQ ID NO: 26267 - RNA, 61 nt, Human; identical to SEQ ID NO: 23985

SEQ ID NO: 26268 - RNA, 61 nt, Human; identical to SEQ ID NO: 23986

SEQ ID NO: 26269 - RNA, 61 nt, Human; identical to SEQ ID NO: 23987

SEQ ID NO: 26270 - RNA, 61 nt, Human; identical to SEQ ID NO: 23988

SEQ ID NO: 26271 - RNA, 61 nt, Human; identical to SEQ ID NO: 23989

SEQ ID NO: 26272 - RNA, 61 nt, Human; identical to SEQ ID NO: 23990

SEQ ID NO: 26273 - RNA, 61 nt, Human; identical to SEQ ID NO: 23991

SEQ ID NO: 26274 - RNA, 61 nt, Human; identical to SEQ ID NO: 23992

SEQ ID NO: 26275 - RNA, 61 nt, Human; identical to SEQ ID NO: 23993

SEQ ID NO: 26276 - RNA, 61 nt, Human; identical to SEQ ID NO: 23994

SEQ ID NO: 26277 - RNA, 61 nt, Human; identical to SEQ ID NO: 23995

SEQ ID NO: 26278 - RNA, 61 nt, Human; identical to SEQ ID NO: 23996

SEQ ID NO: 26279 - RNA, 61 nt, Human; identical to SEQ ID NO: 23997

SEQ ID NO: 26280 - RNA, 61 nt, Human; identical to SEQ ID NO: 23998

SEQ ID NO: 26281 - RNA, 61 nt, Human; identical to SEQ ID NO: 23999

SEQ ID NO: 26282 - RNA, 61 nt, Human; identical to SEQ ID NO: 24000

SEQ ID NO: 26283 - RNA, 61 nt, Human; identical to SEQ ID NO: 24001

SEQ ID NO: 26284 - RNA, 61 nt, Human; identical to SEQ ID NO: 24002

SEQ ID NO: 26285 - RNA, 61 nt, Human; identical to SEQ ID NO: 24003

SEQ ID NO: 26286 - RNA, 61 nt, Human; identical to SEQ ID NO: 24004

SEQ ID NO: 26287 - RNA, 61 nt, Human; identical to SEQ ID NO: 24005

SEQ ID NO: 26288 - RNA, 61 nt, Human; identical to SEQ ID NO: 24006

SEQ ID NO: 26289 - RNA, 61 nt, Human; identical to SEQ ID NO: 24007

SEQ ID NO: 26290 - RNA, 61 nt, Human; identical to SEQ ID NO: 24008

SEQ ID NO: 26291 - RNA, 61 nt, Human; identical to SEQ ID NO: 24009

SEQ ID NO: 26292 - RNA, 61 nt, Human; identical to SEQ ID NO: 24010

SEQ ID NO: 26293 - RNA, 61 nt, Human; identical to SEQ ID NO: 24011

SEQ ID NO: 26294 - RNA, 61 nt, Human; identical to SEQ ID NO: 24012

SEQ ID NO: 26295 - RNA, 61 nt, Human; identical to SEQ ID NO: 24013

SEQ ID NO: 26296 - RNA, 61 nt, Human; identical to SEQ ID NO: 24014

SEQ ID NO: 26297 - RNA, 61 nt, Human; identical to SEQ ID NO: 24015

SEQ ID NO: 26298 - RNA, 61 nt, Human; identical to SEQ ID NO: 24016

SEQ ID NO: 26299 - RNA, 61 nt, Human; identical to SEQ ID NO: 24017

SEQ ID NO: 26300 - RNA, 61 nt, Human; identical to SEQ ID NO: 24018

SEQ ID NO: 26301 - RNA, 61 nt, Human; identical to SEQ ID NO: 24019

SEQ ID NO: 26302 - RNA, 61 nt, Human; identical to SEQ ID NO: 24020

SEQ ID NO: 26303 - RNA, 61 nt, Human; identical to SEQ ID NO: 24021

SEQ ID NO: 26304 - RNA, 61 nt, Human; identical to SEQ ID NO: 24022

SEQ ID NO: 26305 - RNA, 61 nt, Human; identical to SEQ ID NO: 24023

SEQ ID NO: 26306 - RNA, 61 nt, Human; identical to SEQ ID NO: 24024

SEQ ID NO: 26307 - RNA, 61 nt, Human; identical to SEQ ID NO: 24025

SEQ ID NO: 26308 - RNA, 61 nt, Human; identical to SEQ ID NO: 24026

SEQ ID NO: 26309 - RNA, 61 nt, Human; identical to SEQ ID NO: 24027

SEQ ID NO: 26310 - RNA, 61 nt, Human; identical to SEQ ID NO: 24028

SEQ ID NO: 26311 - RNA, 61 nt, Human; identical to SEQ ID NO: 24029

SEQ ID NO: 26312 - RNA, 61 nt, Human; identical to SEQ ID NO: 24030

SEQ ID NO: 26313 - RNA, 61 nt, Human; identical to SEQ ID NO: 24031

SEQ ID NO: 26314 - RNA, 61 nt, Human; identical to SEQ ID NO: 24032

SEQ ID NO: 26315 - RNA, 61 nt, Human; identical to SEQ ID NO: 24033

SEQ ID NO: 26316 - RNA, 61 nt, Human; identical to SEQ ID NO: 24034

SEQ ID NO: 26317 - RNA, 51 nt, Human; identical to SEQ ID NO: 24035

SEQ ID NO: 26318 - RNA, 61 nt, Human; identical to SEQ ID NO: 24036

SEQ ID NO: 26319 - RNA, 61 nt, Human; identical to SEQ ID NO: 24037

SEQ ID NO: 26320 - RNA, 61 nt, Human; identical to SEQ ID NO: 24038

SEQ ID NO: 26321 - RNA, 61 nt, Human; identical to SEQ ID NO: 24039

SEQ ID NO: 26322 - RNA, 61 nt, Human; identical to SEQ ID NO: 24040

SEQ ID NO: 26323 - RNA, 61 nt, Human; identical to SEQ ID NO: 24041

SEQ ID NO: 26324 - RNA, 61 nt, Human; identical to SEQ ID NO: 24042

SEQ ID NO: 26325 - RNA, 61 nt, Human; identical to SEQ ID NO: 24043

SEQ ID NO: 26326 - RNA, 61 nt, Human; identical to SEQ ID NO: 24044

SEQ ID NO: 26327 - RNA, 61 nt, Human; identical to SEQ ID NO: 24045

SEQ ID NO: 26328 - RNA, 61 nt, Human; identical to SEQ ID NO: 24046

SEQ ID NO: 26329 - RNA, 61 nt, Human; identical to SEQ ID NO: 24047

SEQ ID NO: 26330 - RNA, 61 nt, Human; identical to SEQ ID NO: 24048

SEQ ID NO: 26331 - RNA, 61 nt, Human; identical to SEQ ID NO: 24049

SEQ ID NO: 26332 - RNA, 61 nt, Human; identical to SEQ ID NO: 24050

SEQ ID NO: 26333 - RNA, 61 nt, Human; identical to SEQ ID NO: 24051

SEQ ID NO: 26334 - RNA, 61 nt, Human; identical to SEQ ID NO: 24052

SEQ ID NO: 26335 - RNA, 61 nt, Human; identical to SEQ ID NO: 24053

SEQ ID NO: 26336 - RNA, 61 nt, Human; identical to SEQ ID NO: 24054

SEQ ID NO: 26337 - RNA, 61 nt, Human; identical to SEQ ID NO: 24055

SEQ ID NO: 26338 - RNA, 61 nt, Human; identical to SEQ ID NO: 24056

SEQ ID NO: 26339 - RNA, 61 nt, Human; identical to SEQ ID NO: 24057

SEQ ID NO: 26340 - RNA, 61 nt, Human; identical to SEQ ID NO: 24058

SEQ ID NO: 26341 - RNA, 61 nt, Human; identical to SEQ ID NO: 24059

SEQ ID NO: 26342 - RNA, 61 nt, Human; identical to SEQ ID NO: 24060

SEQ ID NO: 26343 - RNA, 61 nt, Human; identical to SEQ ID NO: 24061

SEQ ID NO: 26344 - RNA, 61 nt, Human; identical to SEQ ID NO: 24062

SEQ ID NO: 26345 - RNA, 61 nt, Human; identical to SEQ ID NO: 24063

SEQ ID NO: 26346 - RNA, 61 nt, Human; identical to SEQ ID NO: 24064

SEQ ID NO: 26347 - RNA, 61 nt, Human; identical to SEQ ID NO: 24065

SEQ ID NO: 26348 - RNA, 61 nt, Human; identical to SEQ ID NO: 24066

SEQ ID NO: 26349 - RNA, 61 nt, Human; identical to SEQ ID NO: 24067

SEQ ID NO: 26350 - RNA, 61 nt, Human; identical to SEQ ID NO: 24068

SEQ ID NO: 26351 - RNA, 61 nt, Human; identical to SEQ ID NO: 24069

SEQ ID NO: 26352 - RNA, 61 nt, Human; identical to SEQ ID NO: 24070

SEQ ID NO: 26353 - RNA, 61 nt, Human; identical to SEQ ID NO: 24071

SEQ ID NO: 26354 - RNA, 57 nt, Human; identical to SEQ ID NO: 24072

SEQ ID NO: 26355 - RNA, 61 nt, Human; identical to SEQ ID NO: 24073

SEQ ID NO: 26356 - RNA, 61 nt, Human; identical to SEQ ID NO: 24074

SEQ ID NO: 26357 - RNA, 61 nt, Human; identical to SEQ ID NO: 24075

SEQ ID NO: 26358 - RNA, 61 nt, Human; identical to SEQ ID NO: 24076

SEQ ID NO: 26359 - RNA, 61 nt, Human; identical to SEQ ID NO: 24077

SEQ ID NO: 26360 - RNA, 61 nt, Human; identical to SEQ ID NO: 24078

SEQ ID NO: 26361 - RNA, 61 nt, Human; identical to SEQ ID NO: 24079

SEQ ID NO: 26362 - RNA, 61 nt, Human; identical to SEQ ID NO: 24080

SEQ ID NO: 26363 - RNA, 61 nt, Human; identical to SEQ ID NO: 24081

SEQ ID NO: 26364 - RNA, 61 nt, Human; identical to SEQ ID NO: 24082

SEQ ID NO: 26365 - RNA, 61 nt, Human; identical to SEQ ID NO: 24083

SEQ ID NO: 26366 - RNA, 61 nt, Human; identical to SEQ ID NO: 24084

SEQ ID NO: 26367 - RNA, 61 nt, Human; identical to SEQ ID NO: 24085

SEQ ID NO: 26368 - RNA, 61 nt, Human; identical to SEQ ID NO: 24086

SEQ ID NO: 26369 - RNA, 61 nt, Human; identical to SEQ ID NO: 24087

SEQ ID NO: 26370 - RNA, 61 nt, Human; identical to SEQ ID NO: 24088

SEQ ID NO: 26371 - RNA, 61 nt, Human; identical to SEQ ID NO: 24089

SEQ ID NO: 26372 - RNA, 61 nt, Human; identical to SEQ ID NO: 24090

SEQ ID NO: 26373 - RNA, 61 nt, Human; identical to SEQ ID NO: 24091

SEQ ID NO: 26374 - RNA, 61 nt, Human; identical to SEQ ID NO: 24092

SEQ ID NO: 26375 - RNA, 61 nt, Human; identical to SEQ ID NO: 24093

SEQ ID NO: 26376 - RNA, 61 nt, Human; identical to SEQ ID NO: 24094

SEQ ID NO: 26377 - RNA, 61 nt, Human; identical to SEQ ID NO: 24095

SEQ ID NO: 26378 - RNA, 61 nt, Human; identical to SEQ ID NO: 24096

SEQ ID NO: 26379 - RNA, 61 nt, Human; identical to SEQ ID NO: 24097

SEQ ID NO: 26380 - RNA, 61 nt, Human; identical to SEQ ID NO: 24098

SEQ ID NO: 26381 - RNA, 61 nt, Human; identical to SEQ ID NO: 24099

SEQ ID NO: 26382 - RNA, 61 nt, Human; identical to SEQ ID NO: 24100

SEQ ID NO: 26383 - RNA, 61 nt, Human; identical to SEQ ID NO: 24101

SEQ ID NO: 26384 - RNA, 61 nt, Human; identical to SEQ ID NO: 24102

SEQ ID NO: 26385 - RNA, 61 nt, Human; identical to SEQ ID NO: 24103

SEQ ID NO: 26386 - RNA, 61 nt, Human; identical to SEQ ID NO: 24104

SEQ ID NO: 26387 - RNA, 61 nt, Human; identical to SEQ ID NO: 24105

SEQ ID NO: 26388 - RNA, 61 nt, Human; identical to SEQ ID NO: 24106

SEQ ID NO: 26389 - RNA, 61 nt, Human; identical to SEQ ID NO: 24107

SEQ ID NO: 26390 - RNA, 61 nt, Human; identical to SEQ ID NO: 24108

SEQ ID NO: 26391 - RNA, 61 nt, Human; identical to SEQ ID NO: 24109

SEQ ID NO: 26392 - RNA, 61 nt, Human; identical to SEQ ID NO: 24110

SEQ ID NO: 26393 - RNA, 61 nt, Human; identical to SEQ ID NO: 24111

SEQ ID NO: 26394 - RNA, 61 nt, Human; identical to SEQ ID NO: 24112

SEQ ID NO: 26395 - RNA, 61 nt, Human; identical to SEQ ID NO: 24113

SEQ ID NO: 26396 - RNA, 61 nt, Human; identical to SEQ ID NO: 24114

SEQ ID NO: 26397 - RNA, 61 nt, Human; identical to SEQ ID NO: 24115

SEQ ID NO: 26398 - RNA, 61 nt, Human; identical to SEQ ID NO: 24116

SEQ ID NO: 26399 - RNA, 61 nt, Human; identical to SEQ ID NO: 24117

SEQ ID NO: 26400 - RNA, 61 nt, Human; identical to SEQ ID NO: 24118

SEQ ID NO: 26401 - RNA, 61 nt, Human; identical to SEQ ID NO: 24119

SEQ ID NO: 26402 - RNA, 61 nt, Human; identical to SEQ ID NO: 24120

SEQ ID NO: 26403 - RNA, 61 nt, Human; identical to SEQ ID NO: 24121

SEQ ID NO: 26404 - RNA, 61 nt, Human; identical to SEQ ID NO: 24122

SEQ ID NO: 26405 - RNA, 61 nt, Human; identical to SEQ ID NO: 24123

SEQ ID NO: 26406 - RNA, 61 nt, Human; identical to SEQ ID NO: 24124

SEQ ID NO: 26407 - RNA, 61 nt, Human; identical to SEQ ID NO: 24125

SEQ ID NO: 26408 - RNA, 61 nt, Human; identical to SEQ ID NO: 24126

SEQ ID NO: 26409 - RNA, 61 nt, Human; identical to SEQ ID NO: 24127

SEQ ID NO: 26410 - RNA, 61 nt, Human; identical to SEQ ID NO: 24128

SEQ ID NO: 26411 - RNA, 61 nt, Human; identical to SEQ ID NO: 24129

SEQ ID NO: 26412 - RNA, 61 nt, Human; identical to SEQ ID NO: 24130

SEQ ID NO: 26413 - RNA, 61 nt, Human; identical to SEQ ID NO: 24131

SEQ ID NO: 26414 - RNA, 61 nt, Human; identical to SEQ ID NO: 24132

SEQ ID NO: 26415 - RNA, 61 nt, Human; identical to SEQ ID NO: 24133

SEQ ID NO: 26416 - RNA, 61 nt, Human; identical to SEQ ID NO: 24134

SEQ ID NO: 26417 - RNA, 61 nt, Human; identical to SEQ ID NO: 24135

SEQ ID NO: 26418 - RNA, 61 nt, Human; identical to SEQ ID NO: 24136

SEQ ID NO: 26419 - RNA, 61 nt, Human; identical to SEQ ID NO: 24137

SEQ ID NO: 26420 - RNA, 61 nt, Human; identical to SEQ ID NO: 24138

SEQ ID NO: 26421 - RNA, 61 nt, Human; identical to SEQ ID NO: 24139

SEQ ID NO: 26422 - RNA, 61 nt, Human; identical to SEQ ID NO: 24140

SEQ ID NO: 26423 - RNA, 61 nt, Human; identical to SEQ ID NO: 24141

SEQ ID NO: 26424 - RNA, 61 nt, Human; identical to SEQ ID NO: 24142

SEQ ID NO: 26425 - RNA, 61 nt, Human; identical to SEQ ID NO: 24143

SEQ ID NO: 26426 - RNA, 61 nt, Human; identical to SEQ ID NO: 24143

SEQ ID NO: 26427 - RNA, 61 nt, Human; identical to SEQ ID NO: 24145

SEQ ID NO: 26428 - RNA, 61 nt, Human; identical to SEQ ID NO: 24146

SEQ ID NO: 26429 - RNA, 61 nt, Human; identical to SEQ ID NO: 24147

SEQ ID NO: 26430 - RNA, 61 nt, Human; identical to SEQ ID NO: 24148

SEQ ID NO: 26431 - RNA, 61 nt, Human; identical to SEQ ID NO: 24149

SEQ ID NO: 26432 - RNA, 61 nt, Human; identical to SEQ ID NO: 24150

SEQ ID NO: 26433 - RNA, 61 nt, Human; identical to SEQ ID NO: 24151

SEQ ID NO: 26434 - RNA, 61 nt, Human; identical to SEQ ID NO: 24152

SEQ ID NO: 26435 - RNA, 61 nt, Human; identical to SEQ ID NO: 24153

SEQ ID NO: 26436 - RNA, 61 nt, Human; identical to SEQ ID NO: 24154

SEQ ID NO: 26437 - RNA, 61 nt, Human; identical to SEQ ID NO: 24155

SEQ ID NO: 26438 - RNA, 61 nt, Human; identical to SEQ ID NO: 24156

SEQ ID NO: 26439 - RNA, 61 nt, Human; identical to SEQ ID NO: 24157

SEQ ID NO: 26440 - RNA, 61 nt, Human; identical to SEQ ID NO: 24158

SEQ ID NO: 26441 - RNA, 61 nt, Human; identical to SEQ ID NO: 24159

SEQ ID NO: 26442 - RNA, 61 nt, Human; identical to SEQ ID NO: 24160

SEQ ID NO: 26443 - RNA, 61 nt, Human; identical to SEQ ID NO: 24161

SEQ ID NO: 26444 - RNA, 61 nt, Human; identical to SEQ ID NO: 24162

SEQ ID NO: 26445 - RNA, 61 nt, Human; identical to SEQ ID NO: 24163

SEQ ID NO: 26446 - RNA, 61 nt, Human; identical to SEQ ID NO: 24164

SEQ ID NO: 26447 - RNA, 61 nt, Human; identical to SEQ ID NO: 24165

SEQ ID NO: 26448 - RNA, 61 nt, Human; identical to SEQ ID NO: 24166

SEQ ID NO: 26449 - RNA, 61 nt, Human; identical to SEQ ID NO: 24167

SEQ ID NO: 26450 - RNA, 61 nt, Human; identical to SEQ ID NO: 24168

SEQ ID NO: 26451 - RNA, 61 nt, Human; identical to SEQ ID NO: 24169

SEQ ID NO: 26452 - RNA, 61 nt, Human; identical to SEQ ID NO: 24170

SEQ ID NO: 26453 - RNA, 61 nt, Human; identical to SEQ ID NO: 24171

SEQ ID NO: 26454 - RNA, 61 nt, Human; identical to SEQ ID NO: 24172

SEQ ID NO: 26455 - RNA, 61 nt, Human; identical to SEQ ID NO: 24173

SEQ ID NO: 26456 - RNA, 61 nt, Human; identical to SEQ ID NO: 24174

SEQ ID NO: 26457 - RNA, 61 nt, Human; identical to SEQ ID NO: 24175

SEQ ID NO: 26458 - RNA, 61 nt, Human; identical to SEQ ID NO: 24176

SEQ ID NO: 26459 - RNA, 61 nt, Human; identical to SEQ ID NO: 24177

SEQ ID NO: 26460 - RNA, 61 nt, Human; identical to SEQ ID NO: 24178

SEQ ID NO: 26461 - RNA, 60 nt, Human; identical to SEQ ID NO: 24179

SEQ ID NO: 26462 - RNA, 61 nt, Human; identical to SEQ ID NO: 24180

SEQ ID NO: 26463 - RNA, 61 nt, Human; identical to SEQ ID NO: 24181

SEQ ID NO: 26464 - RNA, 61 nt, Human; identical to SEQ ID NO: 24182

SEQ ID NO: 26465 - RNA, 61 nt, Human; identical to SEQ ID NO: 24183

SEQ ID NO: 26466 - RNA, 61 nt, Human; identical to SEQ ID NO: 24184

SEQ ID NO: 26467 - RNA, 61 nt, Human; identical to SEQ ID NO: 24185

SEQ ID NO: 26468 - RNA, 61 nt, Human; identical to SEQ ID NO: 24186

SEQ ID NO: 26469 - RNA, 61 nt, Human; identical to SEQ ID NO: 24187

SEQ ID NO: 26470 - RNA, 61 nt, Human; identical to SEQ ID NO: 24188

SEQ ID NO: 26471 - RNA, 61 nt, Human; identical to SEQ ID NO: 24189

SEQ ID NO: 26472 - RNA, 61 nt, Human; identical to SEQ ID NO: 24190

SEQ ID NO: 26473 - RNA, 61 nt, Human; identical to SEQ ID NO: 24191

SEQ ID NO: 26474 - RNA, 61 nt, Human; identical to SEQ ID NO: 24192

SEQ ID NO: 26475 - RNA, 61 nt, Human; identical to SEQ ID NO: 24193

SEQ ID NO: 26476 - RNA, 61 nt, Human; identical to SEQ ID NO: 24194

SEQ ID NO: 26477 - RNA, 61 nt, Human; identical to SEQ ID NO: 24195

SEQ ID NO: 26478 - RNA, 61 nt, Human; identical to SEQ ID NO: 24196

SEQ ID NO: 26479 - RNA, 61 nt, Human; identical to SEQ ID NO: 24197

SEQ ID NO: 26480 - RNA, 61 nt, Human; identical to SEQ ID NO: 24198

SEQ ID NO: 26481 - RNA, 61 nt, Human; identical to SEQ ID NO: 24199

SEQ ID NO: 26482 - RNA, 61 nt, Human; identical to SEQ ID NO: 24200

SEQ ID NO: 26483 - RNA, 61 nt, Human; identical to SEQ ID NO: 24201

SEQ ID NO: 26484 - RNA, 61 nt, Human; identical to SEQ ID NO: 24202

SEQ ID NO: 26485 - RNA, 61 nt, Human; identical to SEQ ID NO: 24203

SEQ ID NO: 26486 - RNA, 61 nt, Human; identical to SEQ ID NO: 24204

SEQ ID NO: 26487 - RNA, 61 nt, Human; identical to SEQ ID NO: 24205

SEQ ID NO: 26488 - RNA, 61 nt, Human; identical to SEQ ID NO: 24206

SEQ ID NO: 26489 - RNA, 61 nt, Human; identical to SEQ ID NO: 24207

SEQ ID NO: 26490 - RNA, 61 nt, Human; identical to SEQ ID NO: 24208

SEQ ID NO: 26491 - RNA, 61 nt, Human; identical to SEQ ID NO: 24209

SEQ ID NO: 26492 - RNA, 61 nt, Human; identical to SEQ ID NO: 24210

SEQ ID NO: 26493 - RNA, 61 nt, Human; identical to SEQ ID NO: 24211

SEQ ID NO: 26494 - RNA, 61 nt, Human; identical to SEQ ID NO: 24212

SEQ ID NO: 26495 - RNA, 61 nt, Human; identical to SEQ ID NO: 24213

SEQ ID NO: 26496 - RNA, 61 nt, Human; identical to SEQ ID NO: 24214

SEQ ID NO: 26497 - RNA, 61 nt, Human; identical to SEQ ID NO: 24215

SEQ ID NO: 26498 - RNA, 61 nt, Human; identical to SEQ ID NO: 24216

SEQ ID NO: 26499 - RNA, 61 nt, Human; identical to SEQ ID NO: 24217

SEQ ID NO: 26500 - RNA, 61 nt, Human; identical to SEQ ID NO: 24218

SEQ ID NO: 26501 - RNA, 61 nt, Human; identical to SEQ ID NO: 24219

SEQ ID NO: 26502 - RNA, 61 nt, Human; identical to SEQ ID NO: 24220

SEQ ID NO: 26503 - RNA, 61 nt, Human; identical to SEQ ID NO: 24221

SEQ ID NO: 26504 - RNA, 61 nt, Human; identical to SEQ ID NO: 24222

SEQ ID NO: 26505 - RNA, 61 nt, Human; identical to SEQ ID NO: 24223

SEQ ID NO: 26506 - RNA, 61 nt, Human; identical to SEQ ID NO: 24224

SEQ ID NO: 26507 - RNA, 61 nt, Human; identical to SEQ ID NO: 24225

SEQ ID NO: 26508 - RNA, 61 nt, Human; identical to SEQ ID NO: 24226

SEQ ID NO: 26509 - RNA, 61 nt, Human; identical to SEQ ID NO: 24227

SEQ ID NO: 26510 - RNA, 61 nt, Human; identical to SEQ ID NO: 24228

SEQ ID NO: 26511 - RNA, 61 nt, Human; identical to SEQ ID NO: 24229

SEQ ID NO: 26512 - RNA, 61 nt, Human; identical to SEQ ID NO: 24230

SEQ ID NO: 26513 - RNA, 61 nt, Human; identical to SEQ ID NO: 24231

SEQ ID NO: 26514 - RNA, 61 nt, Human; identical to SEQ ID NO: 24232

SEQ ID NO: 26515 - RNA, 61 nt, Human; identical to SEQ ID NO: 24233

SEQ ID NO: 26516 - RNA, 61 nt, Human; identical to SEQ ID NO: 24234

SEQ ID NO: 26517 - RNA, 61 nt, Human; identical to SEQ ID NO: 24235

SEQ ID NO: 26518 - RNA, 61 nt, Human; identical to SEQ ID NO: 24236

SEQ ID NO: 26519 - RNA, 61 nt, Human; identical to SEQ ID NO: 24237

SEQ ID NO: 26520 - RNA, 61 nt, Human; identical to SEQ ID NO: 24238

SEQ ID NO: 26521 - RNA, 61 nt, Human; identical to SEQ ID NO: 24239

SEQ ID NO: 26522 - RNA, 61 nt, Human; identical to SEQ ID NO: 24240

SEQ ID NO: 26523 - RNA, 61 nt, Human; identical to SEQ ID NO: 24241

SEQ ID NO: 26524 - RNA, 61 nt, Human; identical to SEQ ID NO: 24242

SEQ ID NO: 26525 - RNA, 61 nt, Human; identical to SEQ ID NO: 24243

SEQ ID NO: 26526 - RNA, 61 nt, Human; identical to SEQ ID NO: 24244

SEQ ID NO: 26527 - RNA, 61 nt, Human; identical to SEQ ID NO: 24245

SEQ ID NO: 26528 - RNA, 61 nt, Human; identical to SEQ ID NO: 24246

SEQ ID NO: 26529 - RNA, 61 nt, Human; identical to SEQ ID NO: 24247

SEQ ID NO: 26530 - RNA, 61 nt, Human; identical to SEQ ID NO: 24248

SEQ ID NO: 26531 - RNA, 61 nt, Human; identical to SEQ ID NO: 24249

SEQ ID NO: 26532 - RNA, 61 nt, Human; identical to SEQ ID NO: 24250

SEQ ID NO: 26533 - RNA, 61 nt, Human; identical to SEQ ID NO: 24251

SEQ ID NO: 26534 - RNA, 61 nt, Human; identical to SEQ ID NO: 24252

SEQ ID NO: 26535 - RNA, 61 nt, Human; identical to SEQ ID NO: 24253

SEQ ID NO: 26536 - RNA, 61 nt, Human; identical to SEQ ID NO: 24254

SEQ ID NO: 26537 - RNA, 61 nt, Human; identical to SEQ ID NO: 24255

SEQ ID NO: 26538 - RNA, 61 nt, Human; identical to SEQ ID NO: 24256

SEQ ID NO: 26539 - RNA, 61 nt, Human; identical to SEQ ID NO: 24257

SEQ ID NO: 26540 - RNA, 61 nt, Human; identical to SEQ ID NO: 24258

SEQ ID NO: 26541 - RNA, 61 nt, Human; identical to SEQ ID NO: 24259

SEQ ID NO: 26542 - RNA, 61 nt, Human; identical to SEQ ID NO: 24260

SEQ ID NO: 26543 - RNA, 61 nt, Human; identical to SEQ ID NO: 24261

SEQ ID NO: 26544 - RNA, 61 nt, Human; identical to SEQ ID NO: 24262

SEQ ID NO: 26545 - RNA, 61 nt, Human; identical to SEQ ID NO: 24263

SEQ ID NO: 26546 - RNA, 61 nt, Human; identical to SEQ ID NO: 24264

SEQ ID NO: 26547 - RNA, 61 nt, Human; identical to SEQ ID NO: 24265

SEQ ID NO: 26548 - RNA, 61 nt, Human; identical to SEQ ID NO: 24266

SEQ ID NO: 26549 - RNA, 61 nt, Human; identical to SEQ ID NO: 24267

SEQ ID NO: 26550 - RNA, 61 nt, Human; identical to SEQ ID NO: 24268

SEQ ID NO: 26551 - RNA, 61 nt, Human; identical to SEQ ID NO: 24269

SEQ ID NO: 26552 - RNA, 61 nt, Human; identical to SEQ ID NO: 24270

SEQ ID NO: 26553 - RNA, 61 nt, Human; identical to SEQ ID NO: 24271

SEQ ID NO: 26554 - RNA, 61 nt, Human; identical to SEQ ID NO: 24272

SEQ ID NO: 26555 - RNA, 61 nt, Human; identical to SEQ ID NO: 24273

SEQ ID NO: 26556 - RNA, 61 nt, Human; identical to SEQ ID NO: 24274

SEQ ID NO: 26557 - RNA, 61 nt, Human; identical to SEQ ID NO: 24275

SEQ ID NO: 26558 - RNA, 61 nt, Human; identical to SEQ ID NO: 24276

SEQ ID NO: 26559 - RNA, 61 nt, Human; identical to SEQ ID NO: 24277

SEQ ID NO: 26560 - RNA, 61 nt, Human; identical to SEQ ID NO: 24278

SEQ ID NO: 26561 - RNA, 61 nt, Human; identical to SEQ ID NO: 24279

SEQ ID NO: 26562 - RNA, 61 nt, Human; identical to SEQ ID NO: 24280

SEQ ID NO: 26563 - RNA, 61 nt, Human; identical to SEQ ID NO: 24281

SEQ ID NO: 26564 - RNA, 61 nt, Human; identical to SEQ ID NO: 24282

SEQ ID NO: 26565 - RNA, 61 nt, Human; identical to SEQ ID NO: 24283

SEQ ID NO: 26566 - RNA, 61 nt, Human; identical to SEQ ID NO: 24284

SEQ ID NO: 26567 - RNA, 61 nt, Human; identical to SEQ ID NO: 24285

SEQ ID NO: 26568 - RNA, 61 nt, Human; identical to SEQ ID NO: 24286

SEQ ID NO: 26569 - RNA, 61 nt, Human; identical to SEQ ID NO: 24287

SEQ ID NO: 26570 - RNA, 61 nt, Human; identical to SEQ ID NO: 24288

SEQ ID NO: 26571 - RNA, 61 nt, Human; identical to SEQ ID NO: 24289

SEQ ID NO: 26572 - RNA, 61 nt, Human; identical to SEQ ID NO: 24290

SEQ ID NO: 26573 - RNA, 61 nt, Human; identical to SEQ ID NO: 24291

SEQ ID NO: 26574 - RNA, 61 nt, Human; identical to SEQ ID NO: 24292

SEQ ID NO: 26575 - RNA, 61 nt, Human; identical to SEQ ID NO: 24293

SEQ ID NO: 26576 - RNA, 61 nt, Human; identical to SEQ ID NO: 24294

SEQ ID NO: 26577 - RNA, 61 nt, Human; identical to SEQ ID NO: 24295

SEQ ID NO: 26578 - RNA, 61 nt, Human; identical to SEQ ID NO: 24296

SEQ ID NO: 26579 - RNA, 61 nt, Human; identical to SEQ ID NO: 24297

SEQ ID NO: 26580 - RNA, 61 nt, Human; identical to SEQ ID NO: 24298

SEQ ID NO: 26581 - RNA, 61 nt, Human; identical to SEQ ID NO: 24299

SEQ ID NO: 26582 - RNA, 61 nt, Human; identical to SEQ ID NO: 24300

SEQ ID NO: 26583 - RNA, 61 nt, Human; identical to SEQ ID NO: 24301

SEQ ID NO: 26584 - RNA, 61 nt, Human; identical to SEQ ID NO: 24302

SEQ ID NO: 26585 - RNA, 61 nt, Human; identical to SEQ ID NO: 24303

SEQ ID NO: 26586 - RNA, 61 nt, Human; identical to SEQ ID NO: 24304

SEQ ID NO: 26587 - RNA, 61 nt, Human; identical to SEQ ID NO: 24305

SEQ ID NO: 26588 - RNA, 61 nt, Human; identical to SEQ ID NO: 24306

SEQ ID NO: 26589 - RNA, 61 nt, Human; identical to SEQ ID NO: 24307

SEQ ID NO: 26590 - RNA, 61 nt, Human; identical to SEQ ID NO: 24308

SEQ ID NO: 26591 - RNA, 61 nt, Human; identical to SEQ ID NO: 24309

SEQ ID NO: 26592 - RNA, 61 nt, Human; identical to SEQ ID NO: 24310

SEQ ID NO: 26593 - RNA, 61 nt, Human; identical to SEQ ID NO: 24311

SEQ ID NO: 26594 - RNA, 61 nt, Human; identical to SEQ ID NO: 24312

SEQ ID NO: 26595 - RNA, 61 nt, Human; identical to SEQ ID NO: 24313

SEQ ID NO: 26596 - RNA, 61 nt, Human; identical to SEQ ID NO: 24314

SEQ ID NO: 26597 - RNA, 61 nt, Human; identical to SEQ ID NO: 24315

SEQ ID NO: 26598 - RNA, 61 nt, Human; identical to SEQ ID NO: 24316

SEQ ID NO: 26599 - RNA, 61 nt, Human; identical to SEQ ID NO: 24317

SEQ ID NO: 26600 - RNA, 61 nt, Human; identical to SEQ ID NO: 24318

SEQ ID NO: 26601 - RNA, 61 nt, Human; identical to SEQ ID NO: 24319

SEQ ID NO: 26602 - RNA, 61 nt, Human; identical to SEQ ID NO: 24320

SEQ ID NO: 26603 - RNA, 61 nt, Human; identical to SEQ ID NO: 24321

SEQ ID NO: 26604 - RNA, 61 nt, Human; identical to SEQ ID NO: 24322

SEQ ID NO: 26605 - RNA, 61 nt, Human; identical to SEQ ID NO: 24323

SEQ ID NO: 26606 - RNA, 61 nt, Human; identical to SEQ ID NO: 24324

SEQ ID NO: 26607 - RNA, 61 nt, Human; identical to SEQ ID NO: 24325

SEQ ID NO: 26608 - RNA, 61 nt, Human; identical to SEQ ID NO: 24326

SEQ ID NO: 26609 - RNA, 61 nt, Human; identical to SEQ ID NO: 24327

SEQ ID NO: 26610 - RNA, 61 nt, Human; identical to SEQ ID NO: 24328

SEQ ID NO: 26611 - RNA, 61 nt, Human; identical to SEQ ID NO: 24329

SEQ ID NO: 26612 - RNA, 61 nt, Human; identical to SEQ ID NO: 24330

SEQ ID NO: 26613 - RNA, 61 nt, Human; identical to SEQ ID NO: 24331

SEQ ID NO: 26614 - RNA, 61 nt, Human; identical to SEQ ID NO: 24332

SEQ ID NO: 26615 - RNA, 61 nt, Human; identical to SEQ ID NO: 24333

SEQ ID NO: 26616 - RNA, 61 nt, Human; identical to SEQ ID NO: 24334

SEQ ID NO: 26617 - RNA, 61 nt, Human; identical to SEQ ID NO: 24335

SEQ ID NO: 26618 - RNA, 61 nt, Human; identical to SEQ ID NO: 24336

SEQ ID NO: 26619 - RNA, 61 nt, Human; identical to SEQ ID NO: 24337

SEQ ID NO: 26620 - RNA, 61 nt, Human; identical to SEQ ID NO: 24338

SEQ ID NO: 26621 - RNA, 61 nt, Human; identical to SEQ ID NO: 24339

SEQ ID NO: 26622 - RNA, 61 nt, Human; identical to SEQ ID NO: 24340

SEQ ID NO: 26623 - RNA, 61 nt, Human; identical to SEQ ID NO: 24341

SEQ ID NO: 26624 - RNA, 61 nt, Human; identical to SEQ ID NO: 24342

SEQ ID NO: 26625 - RNA, 61 nt, Human; identical to SEQ ID NO: 24343

SEQ ID NO: 26626 - RNA, 61 nt, Human; identical to SEQ ID NO: 24344

SEQ ID NO: 26627 - RNA, 61 nt, Human; identical to SEQ ID NO: 24345

SEQ ID NO: 26628 - RNA, 61 nt, Human; identical to SEQ ID NO: 24346

SEQ ID NO: 26629 - RNA, 61 nt, Human; identical to SEQ ID NO: 24347

SEQ ID NO: 26630 - RNA, 61 nt, Human; identical to SEQ ID NO: 24348

SEQ ID NO: 26631 - RNA, 61 nt, Human; identical to SEQ ID NO: 24349

SEQ ID NO: 26632 - RNA, 61 nt, Human; identical to SEQ ID NO: 24350

SEQ ID NO: 26633 - RNA, 61 nt, Human; identical to SEQ ID NO: 24351

SEQ ID NO: 26634 - RNA, 61 nt, Human; identical to SEQ ID NO: 24352

SEQ ID NO: 26635 - RNA, 61 nt, Human; identical to SEQ ID NO: 24353

SEQ ID NO: 26636 - RNA, 61 nt, Human; identical to SEQ ID NO: 24354

SEQ ID NO: 26637 - RNA, 61 nt, Human; identical to SEQ ID NO: 24355

SEQ ID NO: 26638 - RNA, 61 nt, Human; identical to SEQ ID NO: 24356

SEQ ID NO: 26639 - RNA, 61 nt, Human; identical to SEQ ID NO: 24357

SEQ ID NO: 26640 - RNA, 61 nt, Human; identical to SEQ ID NO: 24358

SEQ ID NO: 26641 - RNA, 61 nt, Human; identical to SEQ ID NO: 24359

SEQ ID NO: 26642 - RNA, 61 nt, Human; identical to SEQ ID NO: 24360

SEQ ID NO: 26643 - RNA, 61 nt, Human; identical to SEQ ID NO: 24361

SEQ ID NO: 26644 - RNA, 61 nt, Human; identical to SEQ ID NO: 24362

SEQ ID NO: 26645 - RNA, 61 nt, Human; identical to SEQ ID NO: 24363

SEQ ID NO: 26646 - RNA, 61 nt, Human; identical to SEQ ID NO: 24364

SEQ ID NO: 26647 - RNA, 61 nt, Human; identical to SEQ ID NO: 24365

SEQ ID NO: 26648 - RNA, 61 nt, Human; identical to SEQ ID NO: 24366

SEQ ID NO: 26649 - RNA, 61 nt, Human; identical to SEQ ID NO: 24367

SEQ ID NO: 26650 - RNA, 61 nt, Human; identical to SEQ ID NO: 24325

SEQ ID NO: 26651 - RNA, 61 nt, Human; identical to SEQ ID NO: 24369

SEQ ID NO: 26652 - RNA, 64 nt, Human; identical to SEQ ID NO: 24370

SEQ ID NO: 26653 - RNA, 64 nt, Human; identical to SEQ ID NO: 24371

SEQ ID NO: 26654 - RNA, 64 nt, Human; identical to SEQ ID NO: 24372

SEQ ID NO: 26655 - RNA, 64 nt, Human; identical to SEQ ID NO: 24373

SEQ ID NO: 26656 - RNA, 64 nt, Human; identical to SEQ ID NO: 24374

SEQ ID NO: 26657 - RNA, 64 nt, Human; identical to SEQ ID NO: 24375

SEQ ID NO: 26658 - RNA, 64 nt, Human; identical to SEQ ID NO: 24376

SEQ ID NO: 26659 - RNA, 64 nt, Human; identical to SEQ ID NO: 24377

SEQ ID NO: 26660 - RNA, 64 nt, Human; identical to SEQ ID NO: 24378

SEQ ID NO: 26661 - RNA, 64 nt, Human; identical to SEQ ID NO: 24379

SEQ ID NO: 26662 - RNA, 64 nt, Human; identical to SEQ ID NO: 24380

SEQ ID NO: 26663 - RNA, 64 nt, Human; identical to SEQ ID NO: 24381

SEQ ID NO: 26664 - RNA, 64 nt, Human; identical to SEQ ID NO: 24382

SEQ ID NO: 26665 - RNA, 64 nt, Human; identical to SEQ ID NO: 24383

SEQ ID NO: 26666 - RNA, 64 nt, Human; identical to SEQ ID NO: 24384

SEQ ID NO: 26667 - RNA, 64 nt, Human; identical to SEQ ID NO: 24385

SEQ ID NO: 26668 - RNA, 64 nt, Human; identical to SEQ ID NO: 24386

SEQ ID NO: 26669 - RNA, 64 nt, Human; identical to SEQ ID NO: 24387

SEQ ID NO: 26670 - RNA, 64 nt, Human; identical to SEQ ID NO: 24388

SEQ ID NO: 26671 - RNA, 64 nt, Human; identical to SEQ ID NO: 24389

SEQ ID NO: 26672 - RNA, 64 nt, Human; identical to SEQ ID NO: 24390

SEQ ID NO: 26673 - RNA, 64 nt, Human; identical to SEQ ID NO: 24391

SEQ ID NO: 26674 - RNA, 64 nt, Human; identical to SEQ ID NO: 24392

SEQ ID NO: 26675 - RNA, 64 nt, Human; identical to SEQ ID NO: 24393

SEQ ID NO: 26676 - RNA, 64 nt, Human; identical to SEQ ID NO: 24394

SEQ ID NO: 26677 - RNA, 64 nt, Human; identical to SEQ ID NO: 24395

SEQ ID NO: 26678 - RNA, 64 nt, Human; identical to SEQ ID NO: 24396

SEQ ID NO: 26679 - RNA, 64 nt, Human; identical to SEQ ID NO: 24397

SEQ ID NO: 26680 - RNA, 64 nt, Human; identical to SEQ ID NO: 24398

SEQ ID NO: 26681 - RNA, 64 nt, Human; identical to SEQ ID NO: 24399

SEQ ID NO: 26682 - RNA, 64 nt, Human; identical to SEQ ID NO: 24400

SEQ ID NO: 26683 - RNA, 64 nt, Human; identical to SEQ ID NO: 24401

SEQ ID NO: 26684 - RNA, 64 nt, Human; identical to SEQ ID NO: 24402

SEQ ID NO: 26685 - RNA, 64 nt, Human; identical to SEQ ID NO: 24403

SEQ ID NO: 26686 - RNA, 64 nt, Human; identical to SEQ ID NO: 24404

SEQ ID NO: 26687 - RNA, 64 nt, Human; identical to SEQ ID NO: 24405

SEQ ID NO: 26688 - RNA, 64 nt, Human; identical to SEQ ID NO: 24406

SEQ ID NO: 26689 - RNA, 64 nt, Human; identical to SEQ ID NO: 24407

SEQ ID NO: 26690 - RNA, 64 nt, Human; identical to SEQ ID NO: 24408

SEQ ID NO: 26691 - RNA, 64 nt, Human; identical to SEQ ID NO: 24409

SEQ ID NO: 26692 - RNA, 64 nt, Human; identical to SEQ ID NO: 24410

SEQ ID NO: 26693 - RNA, 64 nt, Human; identical to SEQ ID NO: 24411

SEQ ID NO: 26694 - RNA, 64 nt, Human; identical to SEQ ID NO: 24412

SEQ ID NO: 26695 - RNA, 64 nt, Human; identical to SEQ ID NO: 24413

SEQ ID NO: 26696 - RNA, 64 nt, Human; identical to SEQ ID NO: 24414

SEQ ID NO: 26697 - RNA, 64 nt, Human; identical to SEQ ID NO: 24415

SEQ ID NO: 26698 - RNA, 64 nt, Human; identical to SEQ ID NO: 24416

SEQ ID NO: 26699 - RNA, 64 nt, Human; identical to SEQ ID NO: 24417

SEQ ID NO: 26700 - RNA, 64 nt, Human; identical to SEQ ID NO: 24418

SEQ ID NO: 26701 - RNA, 64 nt, Human; identical to SEQ ID NO: 24419

SEQ ID NO: 26702 - RNA, 64 nt, Human; identical to SEQ ID NO: 24420

SEQ ID NO: 26703 - RNA, 64 nt, Human; identical to SEQ ID NO: 24421

SEQ ID NO: 26704 - RNA, 64 nt, Human; identical to SEQ ID NO: 24422

SEQ ID NO: 26705 - RNA, 64 nt, Human; identical to SEQ ID NO: 24423

SEQ ID NO: 26706 - RNA, 64 nt, Human; identical to SEQ ID NO: 24424

SEQ ID NO: 26707 - RNA, 64 nt, Human; identical to SEQ ID NO: 24425

SEQ ID NO: 26708 - RNA, 64 nt, Human; identical to SEQ ID NO: 24426

SEQ ID NO: 26709 - RNA, 64 nt, Human; identical to SEQ ID NO: 24427

SEQ ID NO: 26710 - RNA, 64 nt, Human; identical to SEQ ID NO: 24428

SEQ ID NO: 26711 - RNA, 64 nt, Human; identical to SEQ ID NO: 24429

SEQ ID NO: 26712 - RNA, 64 nt, Human; identical to SEQ ID NO: 24430

SEQ ID NO: 26713 - RNA, 64 nt, Human; identical to SEQ ID NO: 24431

SEQ ID NO: 26714 - RNA, 64 nt, Human; identical to SEQ ID NO: 24432

SEQ ID NO: 26715 - RNA, 64 nt, Human; identical to SEQ ID NO: 24433

SEQ ID NO: 26716 - RNA, 64 nt, Human; identical to SEQ ID NO: 24434

SEQ ID NO: 26717 - RNA, 64 nt, Human; identical to SEQ ID NO: 24435

SEQ ID NO: 26718 - RNA, 64 nt, Human; identical to SEQ ID NO: 24436

SEQ ID NO: 26719 - RNA, 64 nt, Human; identical to SEQ ID NO: 24437

SEQ ID NO: 26720 - RNA, 64 nt, Human; identical to SEQ ID NO: 24438

SEQ ID NO: 26721 - RNA, 64 nt, Human; identical to SEQ ID NO: 24439

SEQ ID NO: 26722 - RNA, 64 nt, Human; identical to SEQ ID NO: 24440

SEQ ID NO: 26723 - RNA, 64 nt, Human; identical to SEQ ID NO: 24441

SEQ ID NO: 26724 - RNA, 64 nt, Human; identical to SEQ ID NO: 24442

SEQ ID NO: 26725 - RNA, 64 nt, Human; identical to SEQ ID NO: 24443

SEQ ID NO: 26726 - RNA, 64 nt, Human; identical to SEQ ID NO: 24444

SEQ ID NO: 26727 - RNA, 64 nt, Human; identical to SEQ ID NO: 24445

SEQ ID NO: 26728 - RNA, 64 nt, Human; identical to SEQ ID NO: 24446

SEQ ID NO: 26729 - RNA, 64 nt, Human; identical to SEQ ID NO: 24447

SEQ ID NO: 26730 - RNA, 64 nt, Human; identical to SEQ ID NO: 24448

SEQ ID NO: 26731 - RNA, 64 nt, Human; identical to SEQ ID NO: 24449

SEQ ID NO: 26732 - RNA, 64 nt, Human; identical to SEQ ID NO: 24450

SEQ ID NO: 26733 - RNA, 64 nt, Human; identical to SEQ ID NO: 24451

SEQ ID NO: 26734 - RNA, 64 nt, Human; identical to SEQ ID NO: 24452

SEQ ID NO: 26735 - RNA, 64 nt, Human; identical to SEQ ID NO: 24453

SEQ ID NO: 26736 - RNA, 64 nt, Human; identical to SEQ ID NO: 24454

SEQ ID NO: 26737 - RNA, 64 nt, Human; identical to SEQ ID NO: 24455

SEQ ID NO: 26738 - RNA, 64 nt, Human; identical to SEQ ID NO: 24456

SEQ ID NO: 26739 - RNA, 64 nt, Human; identical to SEQ ID NO: 24457

SEQ ID NO: 26740 - RNA, 64 nt, Human; identical to SEQ ID NO: 24458

SEQ ID NO: 26741 - RNA, 64 nt, Human; identical to SEQ ID NO: 24459

SEQ ID NO: 26742 - RNA, 64 nt, Human; identical to SEQ ID NO: 24460

SEQ ID NO: 26743 - RNA, 64 nt, Human; identical to SEQ ID NO: 24461

SEQ ID NO: 26744 - RNA, 64 nt, Human; identical to SEQ ID NO: 24462

SEQ ID NO: 26745 - RNA, 64 nt, Human; identical to SEQ ID NO: 24463

SEQ ID NO: 26746 - RNA, 64 nt, Human; identical to SEQ ID NO: 24464

SEQ ID NO: 26747 - RNA, 64 nt, Human; identical to SEQ ID NO: 24465

SEQ ID NO: 26748 - RNA, 64 nt, Human; identical to SEQ ID NO: 24466

SEQ ID NO: 26749 - RNA, 64 nt, Human; identical to SEQ ID NO: 24467

SEQ ID NO: 26750 - RNA, 64 nt, Human; identical to SEQ ID NO: 24468

SEQ ID NO: 26751 - RNA, 64 nt, Human; identical to SEQ ID NO: 24469

SEQ ID NO: 26752 - RNA, 64 nt, Human; identical to SEQ ID NO: 24470

SEQ ID NO: 26753 - RNA, 64 nt, Human; identical to SEQ ID NO: 24471

SEQ ID NO: 26754 - RNA, 64 nt, Human; identical to SEQ ID NO: 24472

SEQ ID NO: 26755 - RNA, 64 nt, Human; identical to SEQ ID NO: 24473

SEQ ID NO: 26756 - RNA, 64 nt, Human; identical to SEQ ID NO: 24474

SEQ ID NO: 26757 - RNA, 64 nt, Human; identical to SEQ ID NO: 24475

SEQ ID NO: 26758 - RNA, 64 nt, Human; identical to SEQ ID NO: 24476

SEQ ID NO: 26759 - RNA, 64 nt, Human; identical to SEQ ID NO: 24477

SEQ ID NO: 26760 - RNA, 64 nt, Human; identical to SEQ ID NO: 24478

SEQ ID NO: 26761 - RNA, 64 nt, Human; identical to SEQ ID NO: 24479

SEQ ID NO: 26762 - RNA, 64 nt, Human; identical to SEQ ID NO: 24480

SEQ ID NO: 26763 - RNA, 64 nt, Human; identical to SEQ ID NO: 24481

SEQ ID NO: 26764 - RNA, 64 nt, Human; identical to SEQ ID NO: 24482

SEQ ID NO: 26765 - RNA, 64 nt, Human; identical to SEQ ID NO: 24483

SEQ ID NO: 26766 - RNA, 64 nt, Human; identical to SEQ ID NO: 24484

SEQ ID NO: 26767 - RNA, 64 nt, Human; identical to SEQ ID NO: 24485

SEQ ID NO: 26768 - RNA, 64 nt, Human; identical to SEQ ID NO: 24486

SEQ ID NO: 26769 - RNA, 64 nt, Human; identical to SEQ ID NO: 24487

SEQ ID NO: 26770 - RNA, 64 nt, Human; identical to SEQ ID NO: 24488

SEQ ID NO: 26771 - RNA, 64 nt, Human; identical to SEQ ID NO: 24489

SEQ ID NO: 26772 - RNA, 64 nt, Human; identical to SEQ ID NO: 24490

SEQ ID NO: 26773 - RNA, 64 nt, Human; identical to SEQ ID NO: 24491

SEQ ID NO: 26774 - RNA, 64 nt, Human; identical to SEQ ID NO: 24492

SEQ ID NO: 26775 - RNA, 64 nt, Human; identical to SEQ ID NO: 24493

SEQ ID NO: 26776 - RNA, 64 nt, Human; identical to SEQ ID NO: 24494

SEQ ID NO: 26777 - RNA, 64 nt, Human; identical to SEQ ID NO: 24495

SEQ ID NO: 26778 - RNA, 64 nt, Human; identical to SEQ ID NO: 24496

SEQ ID NO: 26779 - RNA, 64 nt, Human; identical to SEQ ID NO: 24497

SEQ ID NO: 26780 - RNA, 64 nt, Human; identical to SEQ ID NO: 24498

SEQ ID NO: 26781 - RNA, 64 nt, Human; identical to SEQ ID NO: 24499

SEQ ID NO: 26782 - RNA, 64 nt, Human; identical to SEQ ID NO: 24500

SEQ ID NO: 26783 - RNA, 64 nt, Human; identical to SEQ ID NO: 24501

SEQ ID NO: 26784 - RNA, 64 nt, Human; identical to SEQ ID NO: 24502

SEQ ID NO: 26785 - RNA, 64 nt, Human; identical to SEQ ID NO: 24503

SEQ ID NO: 26786 - RNA, 64 nt, Human; identical to SEQ ID NO: 24504

SEQ ID NO: 26787 - RNA, 64 nt, Human; identical to SEQ ID NO: 24505

SEQ ID NO: 26788 - RNA, 64 nt, Human; identical to SEQ ID NO: 24506

SEQ ID NO: 26789 - RNA, 64 nt, Human; identical to SEQ ID NO: 24507

SEQ ID NO: 26790 - RNA, 64 nt, Human; identical to SEQ ID NO: 24508

SEQ ID NO: 26791 - RNA, 64 nt, Human; identical to SEQ ID NO: 24509

SEQ ID NO: 26792 - RNA, 64 nt, Human; identical to SEQ ID NO: 24510

SEQ ID NO: 26793 - RNA, 64 nt, Human; identical to SEQ ID NO: 24511

SEQ ID NO: 26794 - RNA, 64 nt, Human; identical to SEQ ID NO: 24512

SEQ ID NO: 26795 - RNA, 64 nt, Human; identical to SEQ ID NO: 24513

SEQ ID NO: 26796 - RNA, 64 nt, Human; identical to SEQ ID NO: 24514

SEQ ID NO: 26797 - RNA, 64 nt, Human; identical to SEQ ID NO: 24515

SEQ ID NO: 26798 - RNA, 64 nt, Human; identical to SEQ ID NO: 24516

SEQ ID NO: 26799 - RNA, 64 nt, Human; identical to SEQ ID NO: 24517

SEQ ID NO: 26800 - RNA, 64 nt, Human; identical to SEQ ID NO: 24518

SEQ ID NO: 26801 - RNA, 64 nt, Human; identical to SEQ ID NO: 24519

SEQ ID NO: 26802 - RNA, 64 nt, Human; identical to SEQ ID NO: 24520

SEQ ID NO: 26803 - RNA, 64 nt, Human; identical to SEQ ID NO: 24521

SEQ ID NO: 26804 - RNA, 64 nt, Human; identical to SEQ ID NO: 24522

SEQ ID NO: 26805 - RNA, 64 nt, Human; identical to SEQ ID NO: 24523

SEQ ID NO: 26806 - RNA, 64 nt, Human; identical to SEQ ID NO: 24524

SEQ ID NO: 26807 - RNA, 64 nt, Human; identical to SEQ ID NO: 24525

SEQ ID NO: 26808 - RNA, 64 nt, Human; identical to SEQ ID NO: 24526

SEQ ID NO: 26809 - RNA, 64 nt, Human; identical to SEQ ID NO: 24527

SEQ ID NO: 26810 - RNA, 64 nt, Human; identical to SEQ ID NO: 24528

SEQ ID NO: 26811 - RNA, 64 nt, Human; identical to SEQ ID NO: 24529

SEQ ID NO: 26812 - RNA, 64 nt, Human; identical to SEQ ID NO: 24530

SEQ ID NO: 26813 - RNA, 64 nt, Human; identical to SEQ ID NO: 24531

SEQ ID NO: 26814 - RNA, 64 nt, Human; identical to SEQ ID NO: 24532

SEQ ID NO: 26815 - RNA, 64 nt, Human; identical to SEQ ID NO: 24533

SEQ ID NO: 26816 - RNA, 64 nt, Human; identical to SEQ ID NO: 24534

SEQ ID NO: 26817 - RNA, 64 nt, Human; identical to SEQ ID NO: 24535

SEQ ID NO: 26818 - RNA, 64 nt, Human; identical to SEQ ID NO: 24536

SEQ ID NO: 26819 - RNA, 64 nt, Human; identical to SEQ ID NO: 24537

SEQ ID NO: 26820 - RNA, 64 nt, Human; identical to SEQ ID NO: 24538

SEQ ID NO: 26821 - RNA, 64 nt, Human; identical to SEQ ID NO: 24539

SEQ ID NO: 26822 - RNA, 64 nt, Human; identical to SEQ ID NO: 24540

SEQ ID NO: 26823 - RNA, 64 nt, Human; identical to SEQ ID NO: 24541

SEQ ID NO: 26824 - RNA, 64 nt, Human; identical to SEQ ID NO: 24542

SEQ ID NO: 26825 - RNA, 64 nt, Human; identical to SEQ ID NO: 24543

SEQ ID NO: 26826 - RNA, 64 nt, Human; identical to SEQ ID NO: 24544

SEQ ID NO: 26827 - RNA, 64 nt, Human; identical to SEQ ID NO: 24545

SEQ ID NO: 26828 - RNA, 64 nt, Human; identical to SEQ ID NO: 24546

SEQ ID NO: 26829 - RNA, 64 nt, Human; identical to SEQ ID NO: 24547

SEQ ID NO: 26830 - RNA, 64 nt, Human; identical to SEQ ID NO: 24548

SEQ ID NO: 26831 - RNA, 64 nt, Human; identical to SEQ ID NO: 24549

SEQ ID NO: 26832 - RNA, 64 nt, Human; identical to SEQ ID NO: 24550

SEQ ID NO: 26833 - RNA, 64 nt, Human; identical to SEQ ID NO: 24551

SEQ ID NO: 26834 - RNA, 64 nt, Human; identical to SEQ ID NO: 24552

SEQ ID NO: 26835 - RNA, 64 nt, Human; identical to SEQ ID NO: 24553

SEQ ID NO: 26836 - RNA, 64 nt, Human; identical to SEQ ID NO: 24554

SEQ ID NO: 26837 - RNA, 64 nt, Human; identical to SEQ ID NO: 24555

SEQ ID NO: 26838 - RNA, 64 nt, Human; identical to SEQ ID NO: 24556

SEQ ID NO: 26839 - RNA, 64 nt, Human; identical to SEQ ID NO: 24557

SEQ ID NO: 26840 - RNA, 64 nt, Human; identical to SEQ ID NO: 24558

SEQ ID NO: 26841 - RNA, 64 nt, Human; identical to SEQ ID NO: 24559

SEQ ID NO: 26842 - RNA, 64 nt, Human; identical to SEQ ID NO: 24560

SEQ ID NO: 26843 - RNA, 64 nt, Human; identical to SEQ ID NO: 24561

SEQ ID NO: 26844 - RNA, 64 nt, Human; identical to SEQ ID NO: 24562

SEQ ID NO: 26845 - RNA, 64 nt, Human; identical to SEQ ID NO: 24563

SEQ ID NO: 26846 - RNA, 64 nt, Human; identical to SEQ ID NO: 24564

SEQ ID NO: 26847 - RNA, 64 nt, Human; identical to SEQ ID NO: 24565

SEQ ID NO: 26848 - RNA, 64 nt, Human; identical to SEQ ID NO: 24566

SEQ ID NO: 26849 - RNA, 64 nt, Human; identical to SEQ ID NO: 24567

SEQ ID NO: 26850 - RNA, 64 nt, Human; identical to SEQ ID NO: 24568

SEQ ID NO: 26851 - RNA, 64 nt, Human; identical to SEQ ID NO: 24569

SEQ ID NO: 26852 - RNA, 64 nt, Human; identical to SEQ ID NO: 24570

SEQ ID NO: 26853 - RNA, 64 nt, Human; identical to SEQ ID NO: 24571

SEQ ID NO: 26854 - RNA, 64 nt, Human; identical to SEQ ID NO: 24572

SEQ ID NO: 26855 - RNA, 64 nt, Human; identical to SEQ ID NO: 24573

SEQ ID NO: 26856 - RNA, 64 nt, Human; identical to SEQ ID NO: 24574

SEQ ID NO: 26857 - RNA, 64 nt, Human; identical to SEQ ID NO: 24575

SEQ ID NO: 26858 - RNA, 64 nt, Human; identical to SEQ ID NO: 24576

SEQ ID NO: 26859 - RNA, 64 nt, Human; identical to SEQ ID NO: 24577

SEQ ID NO: 26860 - RNA, 64 nt, Human; identical to SEQ ID NO: 24578

SEQ ID NO: 26861 - RNA, 64 nt, Human; identical to SEQ ID NO: 24579

SEQ ID NO: 26862 - RNA, 64 nt, Human; identical to SEQ ID NO: 24580

SEQ ID NO: 26863 - RNA, 64 nt, Human; identical to SEQ ID NO: 24581

SEQ ID NO: 26864 - RNA, 64 nt, Human; identical to SEQ ID NO: 24582

SEQ ID NO: 26865 - RNA, 64 nt, Human; identical to SEQ ID NO: 24583

SEQ ID NO: 26866 - RNA, 64 nt, Human; identical to SEQ ID NO: 24584

SEQ ID NO: 26867 - RNA, 64 nt, Human; identical to SEQ ID NO: 24585

SEQ ID NO: 26868 - RNA, 64 nt, Human; identical to SEQ ID NO: 24586

SEQ ID NO: 26869 - RNA, 64 nt, Human; identical to SEQ ID NO: 24587

SEQ ID NO: 26870 - RNA, 64 nt, Human; identical to SEQ ID NO: 24588

SEQ ID NO: 26871 - RNA, 64 nt, Human; identical to SEQ ID NO: 24589

SEQ ID NO: 26872 - RNA, 64 nt, Human; identical to SEQ ID NO: 24590

SEQ ID NO: 26873 - RNA, 64 nt, Human; identical to SEQ ID NO: 24591

SEQ ID NO: 26874 - RNA, 64 nt, Human; identical to SEQ ID NO: 24592

SEQ ID NO: 26875 - RNA, 64 nt, Human; identical to SEQ ID NO: 24593

SEQ ID NO: 26876 - RNA, 64 nt, Human; identical to SEQ ID NO: 24594

SEQ ID NO: 26877 - RNA, 64 nt, Human; identical to SEQ ID NO: 24595

SEQ ID NO: 26878 - RNA, 64 nt, Human; identical to SEQ ID NO: 24596

SEQ ID NO: 26879 - RNA, 64 nt, Human; identical to SEQ ID NO: 24597

SEQ ID NO: 26880 - RNA, 64 nt, Human; identical to SEQ ID NO: 24598

SEQ ID NO: 26881 - RNA, 64 nt, Human; identical to SEQ ID NO: 24599

SEQ ID NO: 26882 - RNA, 64 nt, Human; identical to SEQ ID NO: 24600

SEQ ID NO: 26883 - RNA, 64 nt, Human; identical to SEQ ID NO: 24601

SEQ ID NO: 26884 - RNA, 64 nt, Human; identical to SEQ ID NO: 24602

SEQ ID NO: 26885 - RNA, 64 nt, Human; identical to SEQ ID NO: 24603

SEQ ID NO: 26886 - RNA, 58 nt, Human; identical to SEQ ID NO: 23463

SEQ ID NO: 26887 - RNA, 64 nt, Human; identical to SEQ ID NO: 24605

SEQ ID NO: 26888 - RNA, 64 nt, Human; identical to SEQ ID NO: 24606

SEQ ID NO: 26889 - RNA, 64 nt, Human; identical to SEQ ID NO: 24607

SEQ ID NO: 26890 - RNA, 64 nt, Human; identical to SEQ ID NO: 24608

SEQ ID NO: 26891 - RNA, 64 nt, Human; identical to SEQ ID NO: 24609

SEQ ID NO: 26892 - RNA, 64 nt, Human; identical to SEQ ID NO: 24610

SEQ ID NO: 26893 - RNA, 64 nt, Human; identical to SEQ ID NO: 24611

SEQ ID NO: 26894 - RNA, 56 nt, Human; identical to SEQ ID NO: 23471

SEQ ID NO: 26895 - RNA, 64 nt, Human; identical to SEQ ID NO: 24613

SEQ ID NO: 26896 - RNA, 64 nt, Human; identical to SEQ ID NO: 24614

SEQ ID NO: 26897 - RNA, 64 nt, Human; identical to SEQ ID NO: 24615

SEQ ID NO: 26898 - RNA, 64 nt, Human; identical to SEQ ID NO: 24616

SEQ ID NO: 26899 - RNA, 64 nt, Human; identical to SEQ ID NO: 24617

SEQ ID NO: 26900 - RNA, 64 nt, Human; identical to SEQ ID NO: 24618

SEQ ID NO: 26901 - RNA, 64 nt, Human; identical to SEQ ID NO: 24619

SEQ ID NO: 26902 - RNA, 64 nt, Human; identical to SEQ ID NO: 24620

SEQ ID NO: 26903 - RNA, 64 nt, Human; identical to SEQ ID NO: 24621

SEQ ID NO: 26904 - RNA, 64 nt, Human; identical to SEQ ID NO: 24622

SEQ ID NO: 26905 - RNA, 64 nt, Human; identical to SEQ ID NO: 24623

SEQ ID NO: 26906 - RNA, 64 nt, Human; identical to SEQ ID NO: 24624

SEQ ID NO: 26907 - RNA, 64 nt, Human; identical to SEQ ID NO: 24625

SEQ ID NO: 26908 - RNA, 64 nt, Human; identical to SEQ ID NO: 24626

SEQ ID NO: 26909 - RNA, 64 nt, Human; identical to SEQ ID NO: 24627

SEQ ID NO: 26910 - RNA, 64 nt, Human; identical to SEQ ID NO: 24628

SEQ ID NO: 26911 - RNA, 64 nt, Human; identical to SEQ ID NO: 24629

SEQ ID NO: 26912 - RNA, 64 nt, Human; identical to SEQ ID NO: 24630

SEQ ID NO: 26913 - RNA, 64 nt, Human; identical to SEQ ID NO: 24631

SEQ ID NO: 26914 - RNA, 64 nt, Human; identical to SEQ ID NO: 24632

SEQ ID NO: 26915 - RNA, 64 nt, Human; identical to SEQ ID NO: 24633

SEQ ID NO: 26916 - RNA, 64 nt, Human; identical to SEQ ID NO: 24634

SEQ ID NO: 26917 - RNA, 64 nt, Human; identical to SEQ ID NO: 24635

SEQ ID NO: 26918 - RNA, 64 nt, Human; identical to SEQ ID NO: 24636

SEQ ID NO: 26919 - RNA, 64 nt, Human; identical to SEQ ID NO: 24637

SEQ ID NO: 26920 - RNA, 64 nt, Human; identical to SEQ ID NO: 24638

SEQ ID NO: 26921 - RNA, 64 nt, Human; identical to SEQ ID NO: 24639

SEQ ID NO: 26922 - RNA, 64 nt, Human; identical to SEQ ID NO: 24640

SEQ ID NO: 26923 - RNA, 64 nt, Human; identical to SEQ ID NO: 24641

SEQ ID NO: 26924 - RNA, 64 nt, Human; identical to SEQ ID NO: 24642

SEQ ID NO: 26925 - RNA, 64 nt, Human; identical to SEQ ID NO: 24643

SEQ ID NO: 26926 - RNA, 64 nt, Human; identical to SEQ ID NO: 24644

SEQ ID NO: 26927 - RNA, 64 nt, Human; identical to SEQ ID NO: 24645

SEQ ID NO: 26928 - RNA, 64 nt, Human; identical to SEQ ID NO: 24646

SEQ ID NO: 26929 - RNA, 64 nt, Human; identical to SEQ ID NO: 24647

SEQ ID NO: 26930 - RNA, 64 nt, Human; identical to SEQ ID NO: 24648

SEQ ID NO: 26931 - RNA, 64 nt, Human; identical to SEQ ID NO: 24649

SEQ ID NO: 26932 - RNA, 64 nt, Human; identical to SEQ ID NO: 24650

SEQ ID NO: 26933 - RNA, 64 nt, Human; identical to SEQ ID NO: 24651

SEQ ID NO: 26934 - RNA, 64 nt, Human; identical to SEQ ID NO: 24652

SEQ ID NO: 26935 - RNA, 64 nt, Human; identical to SEQ ID NO: 24653

SEQ ID NO: 26936 - RNA, 64 nt, Human; identical to SEQ ID NO: 24654

SEQ ID NO: 26937 - RNA, 64 nt, Human; identical to SEQ ID NO: 24655

SEQ ID NO: 26938 - RNA, 64 nt, Human; identical to SEQ ID NO: 24656

SEQ ID NO: 26939 - RNA, 64 nt, Human; identical to SEQ ID NO: 24657

SEQ ID NO: 26940 - RNA, 64 nt, Human; identical to SEQ ID NO: 24658

SEQ ID NO: 26941 - RNA, 64 nt, Human; identical to SEQ ID NO: 24659

SEQ ID NO: 26942 - RNA, 64 nt, Human; identical to SEQ ID NO: 24660

SEQ ID NO: 26943 - RNA, 64 nt, Human; identical to SEQ ID NO: 24661

SEQ ID NO: 26944 - RNA, 64 nt, Human; identical to SEQ ID NO: 24662

SEQ ID NO: 26945 - RNA, 64 nt, Human; identical to SEQ ID NO: 24663

SEQ ID NO: 26946 - RNA, 64 nt, Human; identical to SEQ ID NO: 24664

SEQ ID NO: 26947 - RNA, 64 nt, Human; identical to SEQ ID NO: 24665

SEQ ID NO: 26948 - RNA, 64 nt, Human; identical to SEQ ID NO: 24666

SEQ ID NO: 26949 - RNA, 64 nt, Human; identical to SEQ ID NO: 24667

SEQ ID NO: 26950 - RNA, 64 nt, Human; identical to SEQ ID NO: 24668

SEQ ID NO: 26951 - RNA, 64 nt, Human; identical to SEQ ID NO: 24669

SEQ ID NO: 26952 - RNA, 64 nt, Human; identical to SEQ ID NO: 24670

SEQ ID NO: 26953 - RNA, 64 nt, Human; identical to SEQ ID NO: 24671

SEQ ID NO: 26954 - RNA, 64 nt, Human; identical to SEQ ID NO: 24672

SEQ ID NO: 26955 - RNA, 63 nt, Human; identical to SEQ ID NO: 24673

SEQ ID NO: 26956 - RNA, 64 nt, Human; identical to SEQ ID NO: 24674

SEQ ID NO: 26957 - RNA, 64 nt, Human; identical to SEQ ID NO: 24675

SEQ ID NO: 26958 - RNA, 64 nt, Human; identical to SEQ ID NO: 24676

SEQ ID NO: 26959 - RNA, 64 nt, Human; identical to SEQ ID NO: 24677

SEQ ID NO: 26960 - RNA, 64 nt, Human; identical to SEQ ID NO: 24678

SEQ ID NO: 26961 - RNA, 64 nt, Human; identical to SEQ ID NO: 24679

SEQ ID NO: 26962 - RNA, 64 nt, Human; identical to SEQ ID NO: 24680

SEQ ID NO: 26963 - RNA, 64 nt, Human; identical to SEQ ID NO: 24681

SEQ ID NO: 26964 - RNA, 64 nt, Human; identical to SEQ ID NO: 24682

SEQ ID NO: 26965 - RNA, 64 nt, Human; identical to SEQ ID NO: 24683

SEQ ID NO: 26966 - RNA, 64 nt, Human; identical to SEQ ID NO: 24684

SEQ ID NO: 26967 - RNA, 64 nt, Human; identical to SEQ ID NO: 24685

SEQ ID NO: 26968 - RNA, 64 nt, Human; identical to SEQ ID NO: 24686

SEQ ID NO: 26969 - RNA, 64 nt, Human; identical to SEQ ID NO: 24687

SEQ ID NO: 26970 - RNA, 64 nt, Human; identical to SEQ ID NO: 24688

SEQ ID NO: 26971 - RNA, 64 nt, Human; identical to SEQ ID NO: 24689

SEQ ID NO: 26972 - RNA, 64 nt, Human; identical to SEQ ID NO: 24690

SEQ ID NO: 26973 - RNA, 64 nt, Human; identical to SEQ ID NO: 24691

SEQ ID NO: 26974 - RNA, 64 nt, Human; identical to SEQ ID NO: 24692

SEQ ID NO: 26975 - RNA, 64 nt, Human; identical to SEQ ID NO: 24693

SEQ ID NO: 26976 - RNA, 64 nt, Human; identical to SEQ ID NO: 24694

SEQ ID NO: 26977 - RNA, 64 nt, Human; identical to SEQ ID NO: 24695

SEQ ID NO: 26978 - RNA, 64 nt, Human; identical to SEQ ID NO: 24696

SEQ ID NO: 26979 - RNA, 64 nt, Human; identical to SEQ ID NO: 24697

SEQ ID NO: 26980 - RNA, 64 nt, Human; identical to SEQ ID NO: 24698

SEQ ID NO: 26981 - RNA, 64 nt, Human; identical to SEQ ID NO: 24699

SEQ ID NO: 26982 - RNA, 64 nt, Human; identical to SEQ ID NO: 24700

SEQ ID NO: 26983 - RNA, 64 nt, Human; identical to SEQ ID NO: 24701

SEQ ID NO: 26984 - RNA, 64 nt, Human; identical to SEQ ID NO: 24702

SEQ ID NO: 26985 - RNA, 64 nt, Human; identical to SEQ ID NO: 24703

SEQ ID NO: 26986 - RNA, 64 nt, Human; identical to SEQ ID NO: 24704

SEQ ID NO: 26987 - RNA, 64 nt, Human; identical to SEQ ID NO: 24705

SEQ ID NO: 26988 - RNA, 64 nt, Human; identical to SEQ ID NO: 24706

SEQ ID NO: 26989 - RNA, 64 nt, Human; identical to SEQ ID NO: 24707

SEQ ID NO: 26990 - RNA, 64 nt, Human; identical to SEQ ID NO: 24708

SEQ ID NO: 26991 - RNA, 64 nt, Human; identical to SEQ ID NO: 24709

SEQ ID NO: 26992 - RNA, 64 nt, Human; identical to SEQ ID NO: 24710

SEQ ID NO: 26993 - RNA, 64 nt, Human; identical to SEQ ID NO: 24711

SEQ ID NO: 26994 - RNA, 64 nt, Human; identical to SEQ ID NO: 24712

SEQ ID NO: 26995 - RNA, 64 nt, Human; identical to SEQ ID NO: 24713

SEQ ID NO: 26996 - RNA, 64 nt, Human; identical to SEQ ID NO: 24714

SEQ ID NO: 26997 - RNA, 64 nt, Human; identical to SEQ ID NO: 24715

SEQ ID NO: 26998 - RNA, 64 nt, Human; identical to SEQ ID NO: 24716

SEQ ID NO: 26999 - RNA, 64 nt, Human; identical to SEQ ID NO: 24717

SEQ ID NO: 27000 - RNA, 64 nt, Human; identical to SEQ ID NO: 24718

SEQ ID NO: 27001 - RNA, 64 nt, Human; identical to SEQ ID NO: 24719

SEQ ID NO: 27002 - RNA, 64 nt, Human; identical to SEQ ID NO: 24720

SEQ ID NO: 27003 - RNA, 64 nt, Human; identical to SEQ ID NO: 24721

SEQ ID NO: 27004 - RNA, 64 nt, Human; identical to SEQ ID NO: 24722

SEQ ID NO: 27005 - RNA, 64 nt, Human; identical to SEQ ID NO: 24723

SEQ ID NO: 27006 - RNA, 64 nt, Human; identical to SEQ ID NO: 24724

SEQ ID NO: 27007 - RNA, 64 nt, Human; identical to SEQ ID NO: 24725

SEQ ID NO: 27008 - RNA, 64 nt, Human; identical to SEQ ID NO: 24726

SEQ ID NO: 27009 - RNA, 64 nt, Human; identical to SEQ ID NO: 24727

SEQ ID NO: 27010 - RNA, 64 nt, Human; identical to SEQ ID NO: 24728

SEQ ID NO: 27011 - RNA, 64 nt, Human; identical to SEQ ID NO: 24729

SEQ ID NO: 27012 - RNA, 64 nt, Human; identical to SEQ ID NO: 24730

SEQ ID NO: 27013 - RNA, 64 nt, Human; identical to SEQ ID NO: 24731

SEQ ID NO: 27014 - RNA, 64 nt, Human; identical to SEQ ID NO: 24732

SEQ ID NO: 27015 - RNA, 64 nt, Human; identical to SEQ ID NO: 24733

SEQ ID NO: 27016 - RNA, 64 nt, Human; identical to SEQ ID NO: 24734

SEQ ID NO: 27017 - RNA, 64 nt, Human; identical to SEQ ID NO: 24735

SEQ ID NO: 27018 - RNA, 64 nt, Human; identical to SEQ ID NO: 24736

SEQ ID NO: 27019 - RNA, 64 nt, Human; identical to SEQ ID NO: 24737

SEQ ID NO: 27020 - RNA, 64 nt, Human; identical to SEQ ID NO: 24738

SEQ ID NO: 27021 - RNA, 64 nt, Human; identical to SEQ ID NO: 24739

SEQ ID NO: 27022 - RNA, 64 nt, Human; identical to SEQ ID NO: 24740

SEQ ID NO: 27023 - RNA, 64 nt, Human; identical to SEQ ID NO: 24741

SEQ ID NO: 27024 - RNA, 64 nt, Human; identical to SEQ ID NO: 24742

SEQ ID NO: 27025 - RNA, 64 nt, Human; identical to SEQ ID NO: 24743

SEQ ID NO: 27026 - RNA, 64 nt, Human; identical to SEQ ID NO: 24744

SEQ ID NO: 27027 - RNA, 64 nt, Human; identical to SEQ ID NO: 24745

SEQ ID NO: 27028 - RNA, 64 nt, Human; identical to SEQ ID NO: 24746

SEQ ID NO: 27029 - RNA, 64 nt, Human; identical to SEQ ID NO: 24747

SEQ ID NO: 27030 - RNA, 64 nt, Human; identical to SEQ ID NO: 24748

SEQ ID NO: 27031 - RNA, 64 nt, Human; identical to SEQ ID NO: 24749

SEQ ID NO: 27032 - RNA, 64 nt, Human; identical to SEQ ID NO: 24750

SEQ ID NO: 27033 - RNA, 64 nt, Human; identical to SEQ ID NO: 24751

SEQ ID NO: 27034 - RNA, 64 nt, Human; identical to SEQ ID NO: 24752

SEQ ID NO: 27035 - RNA, 64 nt, Human; identical to SEQ ID NO: 24753

SEQ ID NO: 27036 - RNA, 64 nt, Human; identical to SEQ ID NO: 24754

SEQ ID NO: 27037 - RNA, 64 nt, Human; identical to SEQ ID NO: 24755

SEQ ID NO: 27038 - RNA, 64 nt, Human; identical to SEQ ID NO: 24756

SEQ ID NO: 27039 - RNA, 64 nt, Human; identical to SEQ ID NO: 24757

SEQ ID NO: 27040 - RNA, 64 nt, Human; identical to SEQ ID NO: 24758

SEQ ID NO: 27041 - RNA, 64 nt, Human; identical to SEQ ID NO: 24759

SEQ ID NO: 27042 - RNA, 64 nt, Human; identical to SEQ ID NO: 24760

SEQ ID NO: 27043 - RNA, 64 nt, Human; identical to SEQ ID NO: 24761

SEQ ID NO: 27044 - RNA, 64 nt, Human; identical to SEQ ID NO: 24762

SEQ ID NO: 27045 - RNA, 64 nt, Human; identical to SEQ ID NO: 24763

SEQ ID NO: 27046 - RNA, 64 nt, Human; identical to SEQ ID NO: 24764

SEQ ID NO: 27047 - RNA, 64 nt, Human; identical to SEQ ID NO: 24765

SEQ ID NO: 27048 - RNA, 64 nt, Human; identical to SEQ ID NO: 24766

SEQ ID NO: 27049 - RNA, 64 nt, Human; identical to SEQ ID NO: 24767

SEQ ID NO: 27050 - RNA, 64 nt, Human; identical to SEQ ID NO: 24768

SEQ ID NO: 27051 - RNA, 64 nt, Human; identical to SEQ ID NO: 24769

SEQ ID NO: 27052 - RNA, 64 nt, Human; identical to SEQ ID NO: 24770

SEQ ID NO: 27053 - RNA, 64 nt, Human; identical to SEQ ID NO: 24771

SEQ ID NO: 27054 - RNA, 64 nt, Human; identical to SEQ ID NO: 24772

SEQ ID NO: 27055 - RNA, 64 nt, Human; identical to SEQ ID NO: 24773

SEQ ID NO: 27056 - RNA, 64 nt, Human; identical to SEQ ID NO: 24774

SEQ ID NO: 27057 - RNA, 64 nt, Human; identical to SEQ ID NO: 24775

SEQ ID NO: 27058 - RNA, 64 nt, Human; identical to SEQ ID NO: 24776

SEQ ID NO: 27059 - RNA, 64 nt, Human; identical to SEQ ID NO: 24777

SEQ ID NO: 27060 - RNA, 64 nt, Human; identical to SEQ ID NO: 24778

SEQ ID NO: 27061 - RNA, 64 nt, Human; identical to SEQ ID NO: 24779

SEQ ID NO: 27062 - RNA, 64 nt, Human; identical to SEQ ID NO: 24780

SEQ ID NO: 27063 - RNA, 64 nt, Human; identical to SEQ ID NO: 24781

SEQ ID NO: 27064 - RNA, 64 nt, Human; identical to SEQ ID NO: 24782

SEQ ID NO: 27065 - RNA, 64 nt, Human; identical to SEQ ID NO: 24783

SEQ ID NO: 27066 - RNA, 64 nt, Human; identical to SEQ ID NO: 24784

SEQ ID NO: 27067 - RNA, 64 nt, Human; identical to SEQ ID NO: 24785

SEQ ID NO: 27068 - RNA, 64 nt, Human; identical to SEQ ID NO: 24786

SEQ ID NO: 27069 - RNA, 64 nt, Human; identical to SEQ ID NO: 24787

SEQ ID NO: 27070 - RNA, 64 nt, Human; identical to SEQ ID NO: 24788

SEQ ID NO: 27071 - RNA, 64 nt, Human; identical to SEQ ID NO: 24789

SEQ ID NO: 27072 - RNA, 64 nt, Human; identical to SEQ ID NO: 24790

SEQ ID NO: 27073 - RNA, 64 nt, Human; identical to SEQ ID NO: 24791

SEQ ID NO: 27074 - RNA, 64 nt, Human; identical to SEQ ID NO: 24792

SEQ ID NO: 27075 - RNA, 64 nt, Human; identical to SEQ ID NO: 24793

SEQ ID NO: 27076 - RNA, 64 nt, Human; identical to SEQ ID NO: 24794

SEQ ID NO: 27077 - RNA, 64 nt, Human; identical to SEQ ID NO: 24795

SEQ ID NO: 27078 - RNA, 64 nt, Human; identical to SEQ ID NO: 24796

SEQ ID NO: 27079 - RNA, 64 nt, Human; identical to SEQ ID NO: 24797

SEQ ID NO: 27080 - RNA, 64 nt, Human; identical to SEQ ID NO: 24798

SEQ ID NO: 27081 - RNA, 64 nt, Human; identical to SEQ ID NO: 24799

SEQ ID NO: 27082 - RNA, 64 nt, Human; identical to SEQ ID NO: 24800

SEQ ID NO: 27083 - RNA, 64 nt, Human; identical to SEQ ID NO: 24801

SEQ ID NO: 27084 - RNA, 64 nt, Human; identical to SEQ ID NO: 24802

SEQ ID NO: 27085 - RNA, 64 nt, Human; identical to SEQ ID NO: 24803

SEQ ID NO: 27086 - RNA, 64 nt, Human; identical to SEQ ID NO: 24804

SEQ ID NO: 27087 - RNA, 64 nt, Human; identical to SEQ ID NO: 24805

SEQ ID NO: 27088 - RNA, 64 nt, Human; identical to SEQ ID NO: 24806

SEQ ID NO: 27089 - RNA, 64 nt, Human; identical to SEQ ID NO: 24807

SEQ ID NO: 27090 - RNA, 64 nt, Human; identical to SEQ ID NO: 24808

SEQ ID NO: 27091 - RNA, 64 nt, Human; identical to SEQ ID NO: 24809

SEQ ID NO: 27092 - RNA, 64 nt, Human; identical to SEQ ID NO: 24810

SEQ ID NO: 27093 - RNA, 64 nt, Human; identical to SEQ ID NO: 24811

SEQ ID NO: 27094 - RNA, 64 nt, Human; identical to SEQ ID NO: 24812

SEQ ID NO: 27095 - RNA, 64 nt, Human; identical to SEQ ID NO: 24813

SEQ ID NO: 27096 - RNA, 64 nt, Human; identical to SEQ ID NO: 24814

SEQ ID NO: 27097 - RNA, 64 nt, Human; identical to SEQ ID NO: 24815

SEQ ID NO: 27098 - RNA, 64 nt, Human; identical to SEQ ID NO: 24816

SEQ ID NO: 27099 - RNA, 64 nt, Human; identical to SEQ ID NO: 24817

SEQ ID NO: 27100 - RNA, 64 nt, Human; identical to SEQ ID NO: 24818

SEQ ID NO: 27101 - RNA, 64 nt, Human; identical to SEQ ID NO: 24819

SEQ ID NO: 27102 - RNA, 64 nt, Human; identical to SEQ ID NO: 24820

SEQ ID NO: 27103 - RNA, 64 nt, Human; identical to SEQ ID NO: 24821

SEQ ID NO: 27104 - RNA, 64 nt, Human; identical to SEQ ID NO: 24822

SEQ ID NO: 27105 - RNA, 64 nt, Human; identical to SEQ ID NO: 24823

SEQ ID NO: 27106 - RNA, 64 nt, Human; identical to SEQ ID NO: 24824

SEQ ID NO: 27107 - RNA, 64 nt, Human; identical to SEQ ID NO: 24825

SEQ ID NO: 27108 - RNA, 64 nt, Human; identical to SEQ ID NO: 24826

SEQ ID NO: 27109 - RNA, 64 nt, Human; identical to SEQ ID NO: 24827

SEQ ID NO: 27110 - RNA, 64 nt, Human; identical to SEQ ID NO: 24828

SEQ ID NO: 27111 - RNA, 64 nt, Human; identical to SEQ ID NO: 24829

SEQ ID NO: 27112 - RNA, 64 nt, Human; identical to SEQ ID NO: 24830

SEQ ID NO: 27113 - RNA, 64 nt, Human; identical to SEQ ID NO: 24831

SEQ ID NO: 27114 - RNA, 64 nt, Human; identical to SEQ ID NO: 24832

SEQ ID NO: 27115 - RNA, 64 nt, Human; identical to SEQ ID NO: 24833

SEQ ID NO: 27116 - RNA, 64 nt, Human; identical to SEQ ID NO: 24834

SEQ ID NO: 27117 - RNA, 64 nt, Human; identical to SEQ ID NO: 24835

SEQ ID NO: 27118 - RNA, 64 nt, Human; identical to SEQ ID NO: 24836

SEQ ID NO: 27119 - RNA, 64 nt, Human; identical to SEQ ID NO: 24837

SEQ ID NO: 27120 - RNA, 64 nt, Human; identical to SEQ ID NO: 24838

SEQ ID NO: 27121 - RNA, 64 nt, Human; identical to SEQ ID NO: 24839

SEQ ID NO: 27122 - RNA, 64 nt, Human; identical to SEQ ID NO: 24840

SEQ ID NO: 27123 - RNA, 64 nt, Human; identical to SEQ ID NO: 24841

SEQ ID NO: 27124 - RNA, 64 nt, Human; identical to SEQ ID NO: 24842

SEQ ID NO: 27125 - RNA, 64 nt, Human; identical to SEQ ID NO: 24843

SEQ ID NO: 27126 - RNA, 64 nt, Human; identical to SEQ ID NO: 24844

SEQ ID NO: 27127 - RNA, 64 nt, Human; identical to SEQ ID NO: 24845

SEQ ID NO: 27128 - RNA, 64 nt, Human; identical to SEQ ID NO: 24846

SEQ ID NO: 27129 - RNA, 64 nt, Human; identical to SEQ ID NO: 24847

SEQ ID NO: 27130 - RNA, 64 nt, Human; identical to SEQ ID NO: 24848

SEQ ID NO: 27131 - RNA, 64 nt, Human; identical to SEQ ID NO: 24849

SEQ ID NO: 27132 - RNA, 64 nt, Human; identical to SEQ ID NO: 24850

SEQ ID NO: 27133 - RNA, 64 nt, Human; identical to SEQ ID NO: 24851

SEQ ID NO: 27134 - RNA, 64 nt, Human; identical to SEQ ID NO: 24852

SEQ ID NO: 27135 - RNA, 64 nt, Human; identical to SEQ ID NO: 24853

SEQ ID NO: 27136 - RNA, 64 nt, Human; identical to SEQ ID NO: 24854

SEQ ID NO: 27137 - RNA, 64 nt, Human; identical to SEQ ID NO: 24855

SEQ ID NO: 27138 - RNA, 64 nt, Human; identical to SEQ ID NO: 24856

SEQ ID NO: 27139 - RNA, 64 nt, Human; identical to SEQ ID NO: 24857

SEQ ID NO: 27140 - RNA, 64 nt, Human; identical to SEQ ID NO: 24858

SEQ ID NO: 27141 - RNA, 64 nt, Human; identical to SEQ ID NO: 24859

SEQ ID NO: 27142 - RNA, 64 nt, Human; identical to SEQ ID NO: 24860

SEQ ID NO: 27143 - RNA, 64 nt, Human; identical to SEQ ID NO: 24861

SEQ ID NO: 27144 - RNA, 64 nt, Human; identical to SEQ ID NO: 24862

SEQ ID NO: 27145 - RNA, 64 nt, Human; identical to SEQ ID NO: 24863

SEQ ID NO: 27146 - RNA, 64 nt, Human; identical to SEQ ID NO: 24864

SEQ ID NO: 27147 - RNA, 64 nt, Human; identical to SEQ ID NO: 24865

SEQ ID NO: 27148 - RNA, 64 nt, Human; identical to SEQ ID NO: 24866

SEQ ID NO: 27149 - RNA, 64 nt, Human; identical to SEQ ID NO: 24867

SEQ ID NO: 27150 - RNA, 64 nt, Human; identical to SEQ ID NO: 24868

SEQ ID NO: 27151 - RNA, 64 nt, Human; identical to SEQ ID NO: 24869

SEQ ID NO: 27152 - RNA, 64 nt, Human; identical to SEQ ID NO: 24870

SEQ ID NO: 27153 - RNA, 64 nt, Human; identical to SEQ ID NO: 24871

SEQ ID NO: 27154 - RNA, 64 nt, Human; identical to SEQ ID NO: 24872

SEQ ID NO: 27155 - RNA, 64 nt, Human; identical to SEQ ID NO: 24873

SEQ ID NO: 27156 - RNA, 64 nt, Human; identical to SEQ ID NO: 24874

SEQ ID NO: 27157 - RNA, 64 nt, Human; identical to SEQ ID NO: 24875

SEQ ID NO: 27158 - RNA, 64 nt, Human; identical to SEQ ID NO: 24876

SEQ ID NO: 27159 - RNA, 64 nt, Human; identical to SEQ ID NO: 24877

SEQ ID NO: 27160 - RNA, 64 nt, Human; identical to SEQ ID NO: 24878

SEQ ID NO: 27161 - RNA, 64 nt, Human; identical to SEQ ID NO: 24879

SEQ ID NO: 27162 - RNA, 64 nt, Human; identical to SEQ ID NO: 24880

SEQ ID NO: 27163 - RNA, 64 nt, Human; identical to SEQ ID NO: 24881

SEQ ID NO: 27164 - RNA, 64 nt, Human; identical to SEQ ID NO: 24882

SEQ ID NO: 27165 - RNA, 64 nt, Human; identical to SEQ ID NO: 24883

SEQ ID NO: 27166 - RNA, 64 nt, Human; identical to SEQ ID NO: 24884

SEQ ID NO: 27167 - RNA, 64 nt, Human; identical to SEQ ID NO: 24885

SEQ ID NO: 27168 - RNA, 64 nt, Human; identical to SEQ ID NO: 24886

SEQ ID NO: 27169 - RNA, 64 nt, Human; identical to SEQ ID NO: 24887

SEQ ID NO: 27170 - RNA, 64 nt, Human; identical to SEQ ID NO: 24888

SEQ ID NO: 27171 - RNA, 64 nt, Human; identical to SEQ ID NO: 24889

SEQ ID NO: 27172 - RNA, 64 nt, Human; identical to SEQ ID NO: 24890

SEQ ID NO: 27173 - RNA, 64 nt, Human; identical to SEQ ID NO: 24891

SEQ ID NO: 27174 - RNA, 64 nt, Human; identical to SEQ ID NO: 24892

SEQ ID NO: 27175 - RNA, 64 nt, Human; identical to SEQ ID NO: 24893

SEQ ID NO: 27176 - RNA, 64 nt, Human; identical to SEQ ID NO: 24894

SEQ ID NO: 27177 - RNA, 64 nt, Human; identical to SEQ ID NO: 24895

SEQ ID NO: 27178 - RNA, 64 nt, Human; identical to SEQ ID NO: 24896

SEQ ID NO: 27179 - RNA, 64 nt, Human; identical to SEQ ID NO: 24897

SEQ ID NO: 27180 - RNA, 64 nt, Human; identical to SEQ ID NO: 24898

SEQ ID NO: 27181 - RNA, 64 nt, Human; identical to SEQ ID NO: 24899

SEQ ID NO: 27182 - RNA, 64 nt, Human; identical to SEQ ID NO: 24900

SEQ ID NO: 27183 - RNA, 64 nt, Human; identical to SEQ ID NO: 24901

SEQ ID NO: 27184 - RNA, 64 nt, Human; identical to SEQ ID NO: 24902

SEQ ID NO: 27185 - RNA, 64 nt, Human; identical to SEQ ID NO: 24903

SEQ ID NO: 27186 - RNA, 64 nt, Human; identical to SEQ ID NO: 24904

SEQ ID NO: 27187 - RNA, 64 nt, Human; identical to SEQ ID NO: 24905

SEQ ID NO: 27188 - RNA, 64 nt, Human; identical to SEQ ID NO: 24906

SEQ ID NO: 27189 - RNA, 64 nt, Human; identical to SEQ ID NO: 24907

SEQ ID NO: 27190 - RNA, 64 nt, Human; identical to SEQ ID NO: 24908

SEQ ID NO: 27191 - RNA, 64 nt, Human; identical to SEQ ID NO: 24909

SEQ ID NO: 27192 - RNA, 64 nt, Human; identical to SEQ ID NO: 24910

SEQ ID NO: 27193 - RNA, 64 nt, Human; identical to SEQ ID NO: 24911

SEQ ID NO: 27194 - RNA, 64 nt, Human; identical to SEQ ID NO: 24912

SEQ ID NO: 27195 - RNA, 64 nt, Human; identical to SEQ ID NO: 24913

SEQ ID NO: 27196 - RNA, 64 nt, Human; identical to SEQ ID NO: 24914

SEQ ID NO: 27197 - RNA, 64 nt, Human; identical to SEQ ID NO: 24915

SEQ ID NO: 27198 - RNA, 64 nt, Human; identical to SEQ ID NO: 24916

SEQ ID NO: 27199 - RNA, 64 nt, Human; identical to SEQ ID NO: 24917

SEQ ID NO: 27200 - RNA, 64 nt, Human; identical to SEQ ID NO: 24918

SEQ ID NO: 27201 - RNA, 64 nt, Human; identical to SEQ ID NO: 24919

SEQ ID NO: 27202 - RNA, 64 nt, Human; identical to SEQ ID NO: 24920

SEQ ID NO: 27203 - RNA, 64 nt, Human; identical to SEQ ID NO: 24921

SEQ ID NO: 27204 - RNA, 64 nt, Human; identical to SEQ ID NO: 24922

SEQ ID NO: 27205 - RNA, 64 nt, Human; identical to SEQ ID NO: 24923

SEQ ID NO: 27206 - RNA, 64 nt, Human; identical to SEQ ID NO: 24924

SEQ ID NO: 27207 - RNA, 64 nt, Human; identical to SEQ ID NO: 24925

SEQ ID NO: 27208 - RNA, 64 nt, Human; identical to SEQ ID NO: 24926

SEQ ID NO: 27209 - RNA, 64 nt, Human; identical to SEQ ID NO: 24927

SEQ ID NO: 27210 - RNA, 64 nt, Human; identical to SEQ ID NO: 24928

SEQ ID NO: 27211 - RNA, 64 nt, Human; identical to SEQ ID NO: 24929

SEQ ID NO: 27212 - RNA, 64 nt, Human; identical to SEQ ID NO: 24930

SEQ ID NO: 27213 - RNA, 64 nt, Human; identical to SEQ ID NO: 24931

SEQ ID NO: 27214 - RNA, 64 nt, Human; identical to SEQ ID NO: 24932

SEQ ID NO: 27215 - RNA, 64 nt, Human; identical to SEQ ID NO: 24933

SEQ ID NO: 27216 - RNA, 64 nt, Human; identical to SEQ ID NO: 24934

SEQ ID NO: 27217 - RNA, 64 nt, Human; identical to SEQ ID NO: 24935

SEQ ID NO: 27218 - RNA, 64 nt, Human; identical to SEQ ID NO: 24936

SEQ ID NO: 27219 - RNA, 64 nt, Human; identical to SEQ ID NO: 24937

SEQ ID NO: 27220 - RNA, 64 nt, Human; identical to SEQ ID NO: 24938

SEQ ID NO: 27221 - RNA, 64 nt, Human; identical to SEQ ID NO: 24939

SEQ ID NO: 27222 - RNA, 64 nt, Human; identical to SEQ ID NO: 24940

SEQ ID NO: 27223 - RNA, 64 nt, Human; identical to SEQ ID NO: 24941

SEQ ID NO: 27224 - RNA, 64 nt, Human; identical to SEQ ID NO: 24942

SEQ ID NO: 27225 - RNA, 64 nt, Human; identical to SEQ ID NO: 24943

SEQ ID NO: 27226 - RNA, 64 nt, Human; identical to SEQ ID NO: 24944

SEQ ID NO: 27227 - RNA, 64 nt, Human; identical to SEQ ID NO: 24945

SEQ ID NO: 27228 - RNA, 64 nt, Human; identical to SEQ ID NO: 24946

SEQ ID NO: 27229 - RNA, 50 nt, Human; identical to SEQ ID NO: 23806

SEQ ID NO: 27230 - RNA, 64 nt, Human; identical to SEQ ID NO: 24948

SEQ ID NO: 27231 - RNA, 64 nt, Human; identical to SEQ ID NO: 24949

SEQ ID NO: 27232 - RNA, 64 nt, Human; identical to SEQ ID NO: 24950

SEQ ID NO: 27233 - RNA, 64 nt, Human; identical to SEQ ID NO: 24951

SEQ ID NO: 27234 - RNA, 64 nt, Human; identical to SEQ ID NO: 24952

SEQ ID NO: 27235 - RNA, 64 nt, Human; identical to SEQ ID NO: 24953

SEQ ID NO: 27236 - RNA, 64 nt, Human; identical to SEQ ID NO: 24954

SEQ ID NO: 27237 - RNA, 64 nt, Human; identical to SEQ ID NO: 24955

SEQ ID NO: 27238 - RNA, 64 nt, Human; identical to SEQ ID NO: 24956

SEQ ID NO: 27239 - RNA, 64 nt, Human; identical to SEQ ID NO: 24957

SEQ ID NO: 27240 - RNA, 64 nt, Human; identical to SEQ ID NO: 24958

SEQ ID NO: 27241 - RNA, 64 nt, Human; identical to SEQ ID NO: 24959

SEQ ID NO: 27242 - RNA, 64 nt, Human; identical to SEQ ID NO: 24960

SEQ ID NO: 27243 - RNA, 64 nt, Human; identical to SEQ ID NO: 24961

SEQ ID NO: 27244 - RNA, 64 nt, Human; identical to SEQ ID NO: 24962

SEQ ID NO: 27245 - RNA, 64 nt, Human; identical to SEQ ID NO: 24963

SEQ ID NO: 27246 - RNA, 64 nt, Human; identical to SEQ ID NO: 24964

SEQ ID NO: 27247 - RNA, 64 nt, Human; identical to SEQ ID NO: 24965

SEQ ID NO: 27248 - RNA, 64 nt, Human; identical to SEQ ID NO: 24966

SEQ ID NO: 27249 - RNA, 64 nt, Human; identical to SEQ ID NO: 24967

SEQ ID NO: 27250 - RNA, 64 nt, Human; identical to SEQ ID NO: 24968

SEQ ID NO: 27251 - RNA, 64 nt, Human; identical to SEQ ID NO: 24969

SEQ ID NO: 27252 - RNA, 64 nt, Human; identical to SEQ ID NO: 24970

SEQ ID NO: 27253 - RNA, 64 nt, Human; identical to SEQ ID NO: 24971

SEQ ID NO: 27254 - RNA, 64 nt, Human; identical to SEQ ID NO: 24972

SEQ ID NO: 27255 - RNA, 64 nt, Human; identical to SEQ ID NO: 24973

SEQ ID NO: 27256 - RNA, 64 nt, Human; identical to SEQ ID NO: 24974

SEQ ID NO: 27257 - RNA, 64 nt, Human; identical to SEQ ID NO: 24975

SEQ ID NO: 27258 - RNA, 64 nt, Human; identical to SEQ ID NO: 24976

SEQ ID NO: 27259 - RNA, 64 nt, Human; identical to SEQ ID NO: 24977

SEQ ID NO: 27260 - RNA, 64 nt, Human; identical to SEQ ID NO: 24978

SEQ ID NO: 27261 - RNA, 64 nt, Human; identical to SEQ ID NO: 24979

SEQ ID NO: 27262 - RNA, 64 nt, Human; identical to SEQ ID NO: 24980

SEQ ID NO: 27263 - RNA, 64 nt, Human; identical to SEQ ID NO: 24981

SEQ ID NO: 27264 - RNA, 64 nt, Human; identical to SEQ ID NO: 24982

SEQ ID NO: 27265 - RNA, 64 nt, Human; identical to SEQ ID NO: 24983

SEQ ID NO: 27266 - RNA, 64 nt, Human; identical to SEQ ID NO: 24984

SEQ ID NO: 27267 - RNA, 64 nt, Human; identical to SEQ ID NO: 24985

SEQ ID NO: 27268 - RNA, 64 nt, Human; identical to SEQ ID NO: 24986

SEQ ID NO: 27269 - RNA, 64 nt, Human; identical to SEQ ID NO: 24987

SEQ ID NO: 27270 - RNA, 64 nt, Human; identical to SEQ ID NO: 24988

SEQ ID NO: 27271 - RNA, 64 nt, Human; identical to SEQ ID NO: 24989

SEQ ID NO: 27272 - RNA, 64 nt, Human; identical to SEQ ID NO: 24990

SEQ ID NO: 27273 - RNA, 64 nt, Human; identical to SEQ ID NO: 24991

SEQ ID NO: 27274 - RNA, 64 nt, Human; identical to SEQ ID NO: 24992

SEQ ID NO: 27275 - RNA, 64 nt, Human; identical to SEQ ID NO: 24993

SEQ ID NO: 27276 - RNA, 64 nt, Human; identical to SEQ ID NO: 24994

SEQ ID NO: 27277 - RNA, 64 nt, Human; identical to SEQ ID NO: 24995

SEQ ID NO: 27278 - RNA, 64 nt, Human; identical to SEQ ID NO: 24996

SEQ ID NO: 27279 - RNA, 64 nt, Human; identical to SEQ ID NO: 24997

SEQ ID NO: 27280 - RNA, 64 nt, Human; identical to SEQ ID NO: 24998

SEQ ID NO: 27281 - RNA, 64 nt, Human; identical to SEQ ID NO: 24999

SEQ ID NO: 27282 - RNA, 64 nt, Human; identical to SEQ ID NO: 25000

SEQ ID NO: 27283 - RNA, 64 nt, Human; identical to SEQ ID NO: 25001

SEQ ID NO: 27284 - RNA, 64 nt, Human; identical to SEQ ID NO: 25002

SEQ ID NO: 27285 - RNA, 64 nt, Human; identical to SEQ ID NO: 25003

SEQ ID NO: 27286 - RNA, 64 nt, Human; identical to SEQ ID NO: 25004

SEQ ID NO: 27287 - RNA, 64 nt, Human; identical to SEQ ID NO: 25005

SEQ ID NO: 27288 - RNA, 64 nt, Human; identical to SEQ ID NO: 24970

SEQ ID NO: 27289 - RNA, 64 nt, Human; identical to SEQ ID NO: 25007

SEQ ID NO: 27290 - RNA, 64 nt, Human; identical to SEQ ID NO: 25008

SEQ ID NO: 27291 - RNA, 64 nt, Human; identical to SEQ ID NO: 25009

SEQ ID NO: 27292 - RNA, 58 nt, Human; identical to SEQ ID NO: 23869

SEQ ID NO: 27293 - RNA, 64 nt, Human; identical to SEQ ID NO: 25011

SEQ ID NO: 27294 - RNA, 64 nt, Human; identical to SEQ ID NO: 25012

SEQ ID NO: 27295 - RNA, 64 nt, Human; identical to SEQ ID NO: 25013

SEQ ID NO: 27296 - RNA, 64 nt, Human; identical to SEQ ID NO: 25014

SEQ ID NO: 27297 - RNA, 64 nt, Human; identical to SEQ ID NO: 25015

SEQ ID NO: 27298 - RNA, 64 nt, Human; identical to SEQ ID NO: 25016

SEQ ID NO: 27299 - RNA, 64 nt, Human; identical to SEQ ID NO: 25017

SEQ ID NO: 27300 - RNA, 64 nt, Human; identical to SEQ ID NO: 25018

SEQ ID NO: 27301 - RNA, 64 nt, Human; identical to SEQ ID NO: 25019

SEQ ID NO: 27302 - RNA, 64 nt, Human; identical to SEQ ID NO: 25020

SEQ ID NO: 27303 - RNA, 64 nt, Human; identical to SEQ ID NO: 25021

SEQ ID NO: 27304 - RNA, 64 nt, Human; identical to SEQ ID NO: 25022

SEQ ID NO: 27305 - RNA, 55 nt, Human; identical to SEQ ID NO: 23882

SEQ ID NO: 27306 - RNA, 64 nt, Human; identical to SEQ ID NO: 25024

SEQ ID NO: 27307 - RNA, 64 nt, Human; identical to SEQ ID NO: 25025

SEQ ID NO: 27308 - RNA, 64 nt, Human; identical to SEQ ID NO: 25026

SEQ ID NO: 27309 - RNA, 64 nt, Human; identical to SEQ ID NO: 25027

SEQ ID NO: 27310 - RNA, 64 nt, Human; identical to SEQ ID NO: 25028

SEQ ID NO: 27311 - RNA, 64 nt, Human; identical to SEQ ID NO: 25029

SEQ ID NO: 27312 - RNA, 64 nt, Human; identical to SEQ ID NO: 25030

SEQ ID NO: 27313 - RNA, 64 nt, Human; identical to SEQ ID NO: 25031

SEQ ID NO: 27314 - RNA, 64 nt, Human; identical to SEQ ID NO: 25032

SEQ ID NO: 27315 - RNA, 64 nt, Human; identical to SEQ ID NO: 25033

SEQ ID NO: 27316 - RNA, 64 nt, Human; identical to SEQ ID NO: 25034

SEQ ID NO: 27317 - RNA, 64 nt, Human; identical to SEQ ID NO: 25035

SEQ ID NO: 27318 - RNA, 64 nt, Human; identical to SEQ ID NO: 25036

SEQ ID NO: 27319 - RNA, 64 nt, Human; identical to SEQ ID NO: 25037

SEQ ID NO: 27320 - RNA, 64 nt, Human; identical to SEQ ID NO: 25038

SEQ ID NO: 27321 - RNA, 64 nt, Human; identical to SEQ ID NO: 25039

SEQ ID NO: 27322 - RNA, 64 nt, Human; identical to SEQ ID NO: 25040

SEQ ID NO: 27323 - RNA, 64 nt, Human; identical to SEQ ID NO: 25041

SEQ ID NO: 27324 - RNA, 64 nt, Human; identical to SEQ ID NO: 25042

SEQ ID NO: 27325 - RNA, 64 nt, Human; identical to SEQ ID NO: 25043

SEQ ID NO: 27326 - RNA, 64 nt, Human; identical to SEQ ID NO: 25044

SEQ ID NO: 27327 - RNA, 64 nt, Human; identical to SEQ ID NO: 25045

SEQ ID NO: 27328 - RNA, 64 nt, Human; identical to SEQ ID NO: 25046

SEQ ID NO: 27329 - RNA, 64 nt, Human; identical to SEQ ID NO: 25047

SEQ ID NO: 27330 - RNA, 64 nt, Human; identical to SEQ ID NO: 25048

SEQ ID NO: 27331 - RNA, 64 nt, Human; identical to SEQ ID NO: 25049

SEQ ID NO: 27332 - RNA, 64 nt, Human; identical to SEQ ID NO: 25050

SEQ ID NO: 27333 - RNA, 64 nt, Human; identical to SEQ ID NO: 25051

SEQ ID NO: 27334 - RNA, 64 nt, Human; identical to SEQ ID NO: 25052

SEQ ID NO: 27335 - RNA, 64 nt, Human; identical to SEQ ID NO: 25053

SEQ ID NO: 27336 - RNA, 64 nt, Human; identical to SEQ ID NO: 25054

SEQ ID NO: 27337 - RNA, 64 nt, Human; identical to SEQ ID NO: 25055

SEQ ID NO: 27338 - RNA, 64 nt, Human; identical to SEQ ID NO: 25056

SEQ ID NO: 27339 - RNA, 64 nt, Human; identical to SEQ ID NO: 25057

SEQ ID NO: 27340 - RNA, 64 nt, Human; identical to SEQ ID NO: 25058

SEQ ID NO: 27341 - RNA, 64 nt, Human; identical to SEQ ID NO: 25059

SEQ ID NO: 27342 - RNA, 64 nt, Human; identical to SEQ ID NO: 25060

SEQ ID NO: 27343 - RNA, 64 nt, Human; identical to SEQ ID NO: 25061

SEQ ID NO: 27344 - RNA, 64 nt, Human; identical to SEQ ID NO: 25062

SEQ ID NO: 27345 - RNA, 64 nt, Human; identical to SEQ ID NO: 25063

SEQ ID NO: 27346 - RNA, 64 nt, Human; identical to SEQ ID NO: 25064

SEQ ID NO: 27347 - RNA, 64 nt, Human; identical to SEQ ID NO: 25065

SEQ ID NO: 27348 - RNA, 64 nt, Human; identical to SEQ ID NO: 25066

SEQ ID NO: 27349 - RNA, 64 nt, Human; identical to SEQ ID NO: 25067

SEQ ID NO: 27350 - RNA, 64 nt, Human; identical to SEQ ID NO: 25068

SEQ ID NO: 27351 - RNA, 64 nt, Human; identical to SEQ ID NO: 25069

SEQ ID NO: 27352 - RNA, 64 nt, Human; identical to SEQ ID NO: 25070

SEQ ID NO: 27353 - RNA, 64 nt, Human; identical to SEQ ID NO: 25071

SEQ ID NO: 27354 - RNA, 64 nt, Human; identical to SEQ ID NO: 25072

SEQ ID NO: 27355 - RNA, 64 nt, Human; identical to SEQ ID NO: 25073

SEQ ID NO: 27356 - RNA, 64 nt, Human; identical to SEQ ID NO: 25074

SEQ ID NO: 27357 - RNA, 64 nt, Human; identical to SEQ ID NO: 25075

SEQ ID NO: 27358 - RNA, 64 nt, Human; identical to SEQ ID NO: 25076

SEQ ID NO: 27359 - RNA, 62 nt, Human; identical to SEQ ID NO: 25077

SEQ ID NO: 27360 - RNA, 64 nt, Human; identical to SEQ ID NO: 25078

SEQ ID NO: 27361 - RNA, 64 nt, Human; identical to SEQ ID NO: 25079

SEQ ID NO: 27362 - RNA, 64 nt, Human; identical to SEQ ID NO: 25080

SEQ ID NO: 27363 - RNA, 64 nt, Human; identical to SEQ ID NO: 25081

SEQ ID NO: 27364 - RNA, 64 nt, Human; identical to SEQ ID NO: 25082

SEQ ID NO: 27365 - RNA, 64 nt, Human; identical to SEQ ID NO: 25083

SEQ ID NO: 27366 - RNA, 64 nt, Human; identical to SEQ ID NO: 25084

SEQ ID NO: 27367 - RNA, 64 nt, Human; identical to SEQ ID NO: 25085

SEQ ID NO: 27368 - RNA, 64 nt, Human; identical to SEQ ID NO: 25086

SEQ ID NO: 27369 - RNA, 64 nt, Human; identical to SEQ ID NO: 25087

SEQ ID NO: 27370 - RNA, 64 nt, Human; identical to SEQ ID NO: 25088

SEQ ID NO: 27371 - RNA, 64 nt, Human; identical to SEQ ID NO: 25089

SEQ ID NO: 27372 - RNA, 64 nt, Human; identical to SEQ ID NO: 25090

SEQ ID NO: 27373 - RNA, 64 nt, Human; identical to SEQ ID NO: 25091

SEQ ID NO: 27374 - RNA, 64 nt, Human; identical to SEQ ID NO: 25092

SEQ ID NO: 27375 - RNA, 64 nt, Human; identical to SEQ ID NO: 25093

SEQ ID NO: 27376 - RNA, 64 nt, Human; identical to SEQ ID NO: 25094

SEQ ID NO: 27377 - RNA, 64 nt, Human; identical to SEQ ID NO: 25095

SEQ ID NO: 27378 - RNA, 64 nt, Human; identical to SEQ ID NO: 25096

SEQ ID NO: 27379 - RNA, 64 nt, Human; identical to SEQ ID NO: 25097

SEQ ID NO: 27380 - RNA, 64 nt, Human; identical to SEQ ID NO: 25098

SEQ ID NO: 27381 - RNA, 64 nt, Human; identical to SEQ ID NO: 25099

SEQ ID NO: 27382 - RNA, 64 nt, Human; identical to SEQ ID NO: 25100

SEQ ID NO: 27383 - RNA, 64 nt, Human; identical to SEQ ID NO: 25101

SEQ ID NO: 27384 - RNA, 64 nt, Human; identical to SEQ ID NO: 25102

SEQ ID NO: 27385 - RNA, 64 nt, Human; identical to SEQ ID NO: 25103

SEQ ID NO: 27386 - RNA, 60 nt, Human; identical to SEQ ID NO: 23963

SEQ ID NO: 27387 - RNA, 64 nt, Human; identical to SEQ ID NO: 25105

SEQ ID NO: 27388 - RNA, 64 nt, Human; identical to SEQ ID NO: 25106

SEQ ID NO: 27389 - RNA, 64 nt, Human; identical to SEQ ID NO: 25107

SEQ ID NO: 27390 - RNA, 64 nt, Human; identical to SEQ ID NO: 25108

SEQ ID NO: 27391 - RNA, 64 nt, Human; identical to SEQ ID NO: 25109

SEQ ID NO: 27392 - RNA, 64 nt, Human; identical to SEQ ID NO: 25110

SEQ ID NO: 27393 - RNA, 64 nt, Human; identical to SEQ ID NO: 25111

SEQ ID NO: 27394 - RNA, 64 nt, Human; identical to SEQ ID NO: 25112

SEQ ID NO: 27395 - RNA, 64 nt, Human; identical to SEQ ID NO: 25113

SEQ ID NO: 27396 - RNA, 64 nt, Human; identical to SEQ ID NO: 25114

SEQ ID NO: 27397 - RNA, 64 nt, Human; identical to SEQ ID NO: 25115

SEQ ID NO: 27398 - RNA, 64 nt, Human; identical to SEQ ID NO: 25116

SEQ ID NO: 27399 - RNA, 64 nt, Human; identical to SEQ ID NO: 25117

SEQ ID NO: 27400 - RNA, 64 nt, Human; identical to SEQ ID NO: 25118

SEQ ID NO: 27401 - RNA, 64 nt, Human; identical to SEQ ID NO: 25119

SEQ ID NO: 27402 - RNA, 64 nt, Human; identical to SEQ ID NO: 25120

SEQ ID NO: 27403 - RNA, 64 nt, Human; identical to SEQ ID NO: 25121

SEQ ID NO: 27404 - RNA, 64 nt, Human; identical to SEQ ID NO: 25122

SEQ ID NO: 27405 - RNA, 64 nt, Human; identical to SEQ ID NO: 25123

SEQ ID NO: 27406 - RNA, 64 nt, Human; identical to SEQ ID NO: 25124

SEQ ID NO: 27407 - RNA, 64 nt, Human; identical to SEQ ID NO: 25125

SEQ ID NO: 27408 - RNA, 64 nt, Human; identical to SEQ ID NO: 25126

SEQ ID NO: 27409 - RNA, 64 nt, Human; identical to SEQ ID NO: 25127

SEQ ID NO: 27410 - RNA, 64 nt, Human; identical to SEQ ID NO: 25128

SEQ ID NO: 27411 - RNA, 64 nt, Human; identical to SEQ ID NO: 25129

SEQ ID NO: 27412 - RNA, 64 nt, Human; identical to SEQ ID NO: 25130

SEQ ID NO: 27413 - RNA, 64 nt, Human; identical to SEQ ID NO: 25131

SEQ ID NO: 27414 - RNA, 64 nt, Human; identical to SEQ ID NO: 25132

SEQ ID NO: 27415 - RNA, 64 nt, Human; identical to SEQ ID NO: 25133

SEQ ID NO: 27416 - RNA, 64 nt, Human; identical to SEQ ID NO: 25134

SEQ ID NO: 27417 - RNA, 64 nt, Human; identical to SEQ ID NO: 25135

SEQ ID NO: 27418 - RNA, 64 nt, Human; identical to SEQ ID NO: 25136

SEQ ID NO: 27419 - RNA, 64 nt, Human; identical to SEQ ID NO: 25137

SEQ ID NO: 27420 - RNA, 64 nt, Human; identical to SEQ ID NO: 25138

SEQ ID NO: 27421 - RNA, 64 nt, Human; identical to SEQ ID NO: 25139

SEQ ID NO: 27422 - RNA, 64 nt, Human; identical to SEQ ID NO: 25140

SEQ ID NO: 27423 - RNA, 64 nt, Human; identical to SEQ ID NO: 25141

SEQ ID NO: 27424 - RNA, 64 nt, Human; identical to SEQ ID NO: 25142

SEQ ID NO: 27425 - RNA, 64 nt, Human; identical to SEQ ID NO: 25143

SEQ ID NO: 27426 - RNA, 64 nt, Human; identical to SEQ ID NO: 25144

SEQ ID NO: 27427 - RNA, 64 nt, Human; identical to SEQ ID NO: 25145

SEQ ID NO: 27428 - RNA, 64 nt, Human; identical to SEQ ID NO: 25146

SEQ ID NO: 27429 - RNA, 64 nt, Human; identical to SEQ ID NO: 25147

SEQ ID NO: 27430 - RNA, 64 nt, Human; identical to SEQ ID NO: 25148

SEQ ID NO: 27431 - RNA, 64 nt, Human; identical to SEQ ID NO: 25149

SEQ ID NO: 27432 - RNA, 64 nt, Human; identical to SEQ ID NO: 25150

SEQ ID NO: 27433 - RNA, 64 nt, Human; identical to SEQ ID NO: 25151

SEQ ID NO: 27434 - RNA, 64 nt, Human; identical to SEQ ID NO: 25152

SEQ ID NO: 27435 - RNA, 64 nt, Human; identical to SEQ ID NO: 25153

SEQ ID NO: 27436 - RNA, 64 nt, Human; identical to SEQ ID NO: 25154

SEQ ID NO: 27437 - RNA, 64 nt, Human; identical to SEQ ID NO: 25155

SEQ ID NO: 27438 - RNA, 64 nt, Human; identical to SEQ ID NO: 25156

SEQ ID NO: 27439 - RNA, 64 nt, Human; identical to SEQ ID NO: 25157

SEQ ID NO: 27440 - RNA, 64 nt, Human; identical to SEQ ID NO: 25158

SEQ ID NO: 27441 - RNA, 64 nt, Human; identical to SEQ ID NO: 25159

SEQ ID NO: 27442 - RNA, 64 nt, Human; identical to SEQ ID NO: 25160

SEQ ID NO: 27443 - RNA, 64 nt, Human; identical to SEQ ID NO: 25161

SEQ ID NO: 27444 - RNA, 64 nt, Human; identical to SEQ ID NO: 25162

SEQ ID NO: 27445 - RNA, 64 nt, Human; identical to SEQ ID NO: 25163

SEQ ID NO: 27446 - RNA, 64 nt, Human; identical to SEQ ID NO: 25164

SEQ ID NO: 27447 - RNA, 64 nt, Human; identical to SEQ ID NO: 25165

SEQ ID NO: 27448 - RNA, 64 nt, Human; identical to SEQ ID NO: 25166

SEQ ID NO: 27449 - RNA, 64 nt, Human; identical to SEQ ID NO: 25167

SEQ ID NO: 27450 - RNA, 64 nt, Human; identical to SEQ ID NO: 25168

SEQ ID NO: 27451 - RNA, 64 nt, Human; identical to SEQ ID NO: 25169

SEQ ID NO: 27452 - RNA, 64 nt, Human; identical to SEQ ID NO: 25170

SEQ ID NO: 27453 - RNA, 64 nt, Human; identical to SEQ ID NO: 25171

SEQ ID NO: 27454 - RNA, 64 nt, Human; identical to SEQ ID NO: 25172

SEQ ID NO: 27455 - RNA, 64 nt, Human; identical to SEQ ID NO: 25173

SEQ ID NO: 27456 - RNA, 64 nt, Human; identical to SEQ ID NO: 25174

SEQ ID NO: 27457 - RNA, 64 nt, Human; identical to SEQ ID NO: 25175

SEQ ID NO: 27458 - RNA, 51 nt, Human; identical to SEQ ID NO: 24035

SEQ ID NO: 27459 - RNA, 64 nt, Human; identical to SEQ ID NO: 25177

SEQ ID NO: 27460 - RNA, 64 nt, Human; identical to SEQ ID NO: 25178

SEQ ID NO: 27461 - RNA, 64 nt, Human; identical to SEQ ID NO: 25179

SEQ ID NO: 27462 - RNA, 64 nt, Human; identical to SEQ ID NO: 25180

SEQ ID NO: 27463 - RNA, 64 nt, Human; identical to SEQ ID NO: 25181

SEQ ID NO: 27464 - RNA, 64 nt, Human; identical to SEQ ID NO: 25182

SEQ ID NO: 27465 - RNA, 64 nt, Human; identical to SEQ ID NO: 25183

SEQ ID NO: 27466 - RNA, 64 nt, Human; identical to SEQ ID NO: 25184

SEQ ID NO: 27467 - RNA, 64 nt, Human; identical to SEQ ID NO: 25185

SEQ ID NO: 27468 - RNA, 64 nt, Human; identical to SEQ ID NO: 25186

SEQ ID NO: 27469 - RNA, 64 nt, Human; identical to SEQ ID NO: 25187

SEQ ID NO: 27470 - RNA, 64 nt, Human; identical to SEQ ID NO: 25188

SEQ ID NO: 27471 - RNA, 64 nt, Human; identical to SEQ ID NO: 25189

SEQ ID NO: 27472 - RNA, 64 nt, Human; identical to SEQ ID NO: 25190

SEQ ID NO: 27473 - RNA, 64 nt, Human; identical to SEQ ID NO: 25191

SEQ ID NO: 27474 - RNA, 64 nt, Human; identical to SEQ ID NO: 25192

SEQ ID NO: 27475 - RNA, 64 nt, Human; identical to SEQ ID NO: 25193

SEQ ID NO: 27476 - RNA, 64 nt, Human; identical to SEQ ID NO: 25194

SEQ ID NO: 27477 - RNA, 64 nt, Human; identical to SEQ ID NO: 25195

SEQ ID NO: 27478 - RNA, 64 nt, Human; identical to SEQ ID NO: 25196

SEQ ID NO: 27479 - RNA, 64 nt, Human; identical to SEQ ID NO: 25197

SEQ ID NO: 27480 - RNA, 64 nt, Human; identical to SEQ ID NO: 25198

SEQ ID NO: 27481 - RNA, 64 nt, Human; identical to SEQ ID NO: 25199

SEQ ID NO: 27482 - RNA, 64 nt, Human; identical to SEQ ID NO: 25200

SEQ ID NO: 27483 - RNA, 64 nt, Human; identical to SEQ ID NO: 25201

SEQ ID NO: 27484 - RNA, 64 nt, Human; identical to SEQ ID NO: 25202

SEQ ID NO: 27485 - RNA, 64 nt, Human; identical to SEQ ID NO: 25203

SEQ ID NO: 27486 - RNA, 64 nt, Human; identical to SEQ ID NO: 25204

SEQ ID NO: 27487 - RNA, 64 nt, Human; identical to SEQ ID NO: 25205

SEQ ID NO: 27488 - RNA, 64 nt, Human; identical to SEQ ID NO: 25206

SEQ ID NO: 27489 - RNA, 64 nt, Human; identical to SEQ ID NO: 25207

SEQ ID NO: 27490 - RNA, 64 nt, Human; identical to SEQ ID NO: 25208

SEQ ID NO: 27491 - RNA, 64 nt, Human; identical to SEQ ID NO: 25209

SEQ ID NO: 27492 - RNA, 64 nt, Human; identical to SEQ ID NO: 25210

SEQ ID NO: 27493 - RNA, 64 nt, Human; identical to SEQ ID NO: 25211

SEQ ID NO: 27494 - RNA, 64 nt, Human; identical to SEQ ID NO: 25212

SEQ ID NO: 27495 - RNA, 57 nt, Human; identical to SEQ ID NO: 24072

SEQ ID NO: 27496 - RNA, 64 nt, Human; identical to SEQ ID NO: 25214

SEQ ID NO: 27497 - RNA, 64 nt, Human; identical to SEQ ID NO: 25215

SEQ ID NO: 27498 - RNA, 64 nt, Human; identical to SEQ ID NO: 25216

SEQ ID NO: 27499 - RNA, 64 nt, Human; identical to SEQ ID NO: 25217

SEQ ID NO: 27500 - RNA, 64 nt, Human; identical to SEQ ID NO: 25218

SEQ ID NO: 27501 - RNA, 64 nt, Human; identical to SEQ ID NO: 25219

SEQ ID NO: 27502 - RNA, 64 nt, Human; identical to SEQ ID NO: 25220

SEQ ID NO: 27503 - RNA, 64 nt, Human; identical to SEQ ID NO: 25221

SEQ ID NO: 27504 - RNA, 64 nt, Human; identical to SEQ ID NO: 25222

SEQ ID NO: 27505 - RNA, 64 nt, Human; identical to SEQ ID NO: 25223

SEQ ID NO: 27506 - RNA, 64 nt, Human; identical to SEQ ID NO: 25224

SEQ ID NO: 27507 - RNA, 64 nt, Human; identical to SEQ ID NO: 25225

SEQ ID NO: 27508 - RNA, 64 nt, Human; identical to SEQ ID NO: 25226

SEQ ID NO: 27509 - RNA, 64 nt, Human; identical to SEQ ID NO: 25227

SEQ ID NO: 27510 - RNA, 64 nt, Human; identical to SEQ ID NO: 25228

SEQ ID NO: 27511 - RNA, 64 nt, Human; identical to SEQ ID NO: 25229

SEQ ID NO: 27512 - RNA, 64 nt, Human; identical to SEQ ID NO: 25230

SEQ ID NO: 27513 - RNA, 64 nt, Human; identical to SEQ ID NO: 25231

SEQ ID NO: 27514 - RNA, 64 nt, Human; identical to SEQ ID NO: 25232

SEQ ID NO: 27515 - RNA, 64 nt, Human; identical to SEQ ID NO: 25233

SEQ ID NO: 27516 - RNA, 64 nt, Human; identical to SEQ ID NO: 25234

SEQ ID NO: 27517 - RNA, 64 nt, Human; identical to SEQ ID NO: 25235

SEQ ID NO: 27518 - RNA, 64 nt, Human; identical to SEQ ID NO: 25236

SEQ ID NO: 27519 - RNA, 64 nt, Human; identical to SEQ ID NO: 25237

SEQ ID NO: 27520 - RNA, 64 nt, Human; identical to SEQ ID NO: 25238

SEQ ID NO: 27521 - RNA, 64 nt, Human; identical to SEQ ID NO: 25239

SEQ ID NO: 27522 - RNA, 64 nt, Human; identical to SEQ ID NO: 25240

SEQ ID NO: 27523 - RNA, 64 nt, Human; identical to SEQ ID NO: 25241

SEQ ID NO: 27524 - RNA, 64 nt, Human; identical to SEQ ID NO: 25242

SEQ ID NO: 27525 - RNA, 64 nt, Human; identical to SEQ ID NO: 25243

SEQ ID NO: 27526 - RNA, 64 nt, Human; identical to SEQ ID NO: 25244

SEQ ID NO: 27527 - RNA, 64 nt, Human; identical to SEQ ID NO: 25245

SEQ ID NO: 27528 - RNA, 64 nt, Human; identical to SEQ ID NO: 25246

SEQ ID NO: 27529 - RNA, 64 nt, Human; identical to SEQ ID NO: 25247

SEQ ID NO: 27530 - RNA, 64 nt, Human; identical to SEQ ID NO: 25248

SEQ ID NO: 27531 - RNA, 64 nt, Human; identical to SEQ ID NO: 25249

SEQ ID NO: 27532 - RNA, 64 nt, Human; identical to SEQ ID NO: 25250

SEQ ID NO: 27533 - RNA, 64 nt, Human; identical to SEQ ID NO: 25251

SEQ ID NO: 27534 - RNA, 64 nt, Human; identical to SEQ ID NO: 25252

SEQ ID NO: 27535 - RNA, 64 nt, Human; identical to SEQ ID NO: 25253

SEQ ID NO: 27536 - RNA, 64 nt, Human; identical to SEQ ID NO: 25254

SEQ ID NO: 27537 - RNA, 64 nt, Human; identical to SEQ ID NO: 25255

SEQ ID NO: 27538 - RNA, 64 nt, Human; identical to SEQ ID NO: 25256

SEQ ID NO: 27539 - RNA, 64 nt, Human; identical to SEQ ID NO: 25257

SEQ ID NO: 27540 - RNA, 64 nt, Human; identical to SEQ ID NO: 25258

SEQ ID NO: 27541 - RNA, 64 nt, Human; identical to SEQ ID NO: 25259

SEQ ID NO: 27542 - RNA, 64 nt, Human; identical to SEQ ID NO: 25260

SEQ ID NO: 27543 - RNA, 64 nt, Human; identical to SEQ ID NO: 25261

SEQ ID NO: 27544 - RNA, 64 nt, Human; identical to SEQ ID NO: 25262

SEQ ID NO: 27545 - RNA, 64 nt, Human; identical to SEQ ID NO: 25263

SEQ ID NO: 27546 - RNA, 64 nt, Human; identical to SEQ ID NO: 25264

SEQ ID NO: 27547 - RNA, 64 nt, Human; identical to SEQ ID NO: 25265

SEQ ID NO: 27548 - RNA, 64 nt, Human; identical to SEQ ID NO: 25266

SEQ ID NO: 27549 - RNA, 64 nt, Human; identical to SEQ ID NO: 25267

SEQ ID NO: 27550 - RNA, 64 nt, Human; identical to SEQ ID NO: 25268

SEQ ID NO: 27551 - RNA, 64 nt, Human; identical to SEQ ID NO: 25269

SEQ ID NO: 27552 - RNA, 64 nt, Human; identical to SEQ ID NO: 25270

SEQ ID NO: 27553 - RNA, 64 nt, Human; identical to SEQ ID NO: 25271

SEQ ID NO: 27554 - RNA, 64 nt, Human; identical to SEQ ID NO: 25272

SEQ ID NO: 27555 - RNA, 64 nt, Human; identical to SEQ ID NO: 25273

SEQ ID NO: 27556 - RNA, 64 nt, Human; identical to SEQ ID NO: 25274

SEQ ID NO: 27557 - RNA, 64 nt, Human; identical to SEQ ID NO: 25275

SEQ ID NO: 27558 - RNA, 64 nt, Human; identical to SEQ ID NO: 25276

SEQ ID NO: 27559 - RNA, 64 nt, Human; identical to SEQ ID NO: 25277

SEQ ID NO: 27560 - RNA, 64 nt, Human; identical to SEQ ID NO: 25278

SEQ ID NO: 27561 - RNA, 64 nt, Human; identical to SEQ ID NO: 25279

SEQ ID NO: 27562 - RNA, 64 nt, Human; identical to SEQ ID NO: 25280

SEQ ID NO: 27563 - RNA, 64 nt, Human; identical to SEQ ID NO: 25281

SEQ ID NO: 27564 - RNA, 64 nt, Human; identical to SEQ ID NO: 25282

SEQ ID NO: 27565 - RNA, 64 nt, Human; identical to SEQ ID NO: 25283

SEQ ID NO: 27566 - RNA, 64 nt, Human; identical to SEQ ID NO: 25284

SEQ ID NO: 27567 - RNA, 64 nt, Human; identical to SEQ ID NO: 25284

SEQ ID NO: 27568 - RNA, 64 nt, Human; identical to SEQ ID NO: 25286

SEQ ID NO: 27569 - RNA, 64 nt, Human; identical to SEQ ID NO: 25287

SEQ ID NO: 27570 - RNA, 64 nt, Human; identical to SEQ ID NO: 25288

SEQ ID NO: 27571 - RNA, 64 nt, Human; identical to SEQ ID NO: 25289

SEQ ID NO: 27572 - RNA, 64 nt, Human; identical to SEQ ID NO: 25290

SEQ ID NO: 27573 - RNA, 64 nt, Human; identical to SEQ ID NO: 25291

SEQ ID NO: 27574 - RNA, 64 nt, Human; identical to SEQ ID NO: 25292

SEQ ID NO: 27575 - RNA, 64 nt, Human; identical to SEQ ID NO: 25293

SEQ ID NO: 27576 - RNA, 64 nt, Human; identical to SEQ ID NO: 25294

SEQ ID NO: 27577 - RNA, 64 nt, Human; identical to SEQ ID NO: 25295

SEQ ID NO: 27578 - RNA, 64 nt, Human; identical to SEQ ID NO: 25296

SEQ ID NO: 27579 - RNA, 64 nt, Human; identical to SEQ ID NO: 25297

SEQ ID NO: 27580 - RNA, 64 nt, Human; identical to SEQ ID NO: 25298

SEQ ID NO: 27581 - RNA, 64 nt, Human; identical to SEQ ID NO: 25299

SEQ ID NO: 27582 - RNA, 64 nt, Human; identical to SEQ ID NO: 25300

SEQ ID NO: 27583 - RNA, 64 nt, Human; identical to SEQ ID NO: 25301

SEQ ID NO: 27584 - RNA, 64 nt, Human; identical to SEQ ID NO: 25302

SEQ ID NO: 27585 - RNA, 64 nt, Human; identical to SEQ ID NO: 25303

SEQ ID NO: 27586 - RNA, 64 nt, Human; identical to SEQ ID NO: 25304

SEQ ID NO: 27587 - RNA, 64 nt, Human; identical to SEQ ID NO: 25305

SEQ ID NO: 27588 - RNA, 64 nt, Human; identical to SEQ ID NO: 25306

SEQ ID NO: 27589 - RNA, 64 nt, Human; identical to SEQ ID NO: 25307

SEQ ID NO: 27590 - RNA, 64 nt, Human; identical to SEQ ID NO: 25308

SEQ ID NO: 27591 - RNA, 64 nt, Human; identical to SEQ ID NO: 25309

SEQ ID NO: 27592 - RNA, 64 nt, Human; identical to SEQ ID NO: 25310

SEQ ID NO: 27593 - RNA, 64 nt, Human; identical to SEQ ID NO: 25311

SEQ ID NO: 27594 - RNA, 64 nt, Human; identical to SEQ ID NO: 25312

SEQ ID NO: 27595 - RNA, 64 nt, Human; identical to SEQ ID NO: 25313

SEQ ID NO: 27596 - RNA, 64 nt, Human; identical to SEQ ID NO: 25314

SEQ ID NO: 27597 - RNA, 64 nt, Human; identical to SEQ ID NO: 25315

SEQ ID NO: 27598 - RNA, 64 nt, Human; identical to SEQ ID NO: 25316

SEQ ID NO: 27599 - RNA, 64 nt, Human; identical to SEQ ID NO: 25317

SEQ ID NO: 27600 - RNA, 64 nt, Human; identical to SEQ ID NO: 25318

SEQ ID NO: 27601 - RNA, 64 nt, Human; identical to SEQ ID NO: 25319

SEQ ID NO: 27602 - RNA, 63 nt, Human; identical to SEQ ID NO: 25320

SEQ ID NO: 27603 - RNA, 64 nt, Human; identical to SEQ ID NO: 25321

SEQ ID NO: 27604 - RNA, 64 nt, Human; identical to SEQ ID NO: 25322

SEQ ID NO: 27605 - RNA, 64 nt, Human; identical to SEQ ID NO: 25323

SEQ ID NO: 27606 - RNA, 64 nt, Human; identical to SEQ ID NO: 25324

SEQ ID NO: 27607 - RNA, 64 nt, Human; identical to SEQ ID NO: 25325

SEQ ID NO: 27608 - RNA, 64 nt, Human; identical to SEQ ID NO: 25326

SEQ ID NO: 27609 - RNA, 64 nt, Human; identical to SEQ ID NO: 25327

SEQ ID NO: 27610 - RNA, 64 nt, Human; identical to SEQ ID NO: 25328

SEQ ID NO: 27611 - RNA, 64 nt, Human; identical to SEQ ID NO: 25329

SEQ ID NO: 27612 - RNA, 64 nt, Human; identical to SEQ ID NO: 25330

SEQ ID NO: 27613 - RNA, 64 nt, Human; identical to SEQ ID NO: 25331

SEQ ID NO: 27614 - RNA, 64 nt, Human; identical to SEQ ID NO: 25332

SEQ ID NO: 27615 - RNA, 64 nt, Human; identical to SEQ ID NO: 25333

SEQ ID NO: 27616 - RNA, 64 nt, Human; identical to SEQ ID NO: 25334

SEQ ID NO: 27617 - RNA, 64 nt, Human; identical to SEQ ID NO: 25335

SEQ ID NO: 27618 - RNA, 64 nt, Human; identical to SEQ ID NO: 25336

SEQ ID NO: 27619 - RNA, 64 nt, Human; identical to SEQ ID NO: 25337

SEQ ID NO: 27620 - RNA, 64 nt, Human; identical to SEQ ID NO: 25338

SEQ ID NO: 27621 - RNA, 64 nt, Human; identical to SEQ ID NO: 25339

SEQ ID NO: 27622 - RNA, 64 nt, Human; identical to SEQ ID NO: 25340

SEQ ID NO: 27623 - RNA, 64 nt, Human; identical to SEQ ID NO: 25341

SEQ ID NO: 27624 - RNA, 64 nt, Human; identical to SEQ ID NO: 25342

SEQ ID NO: 27625 - RNA, 64 nt, Human; identical to SEQ ID NO: 25343

SEQ ID NO: 27626 - RNA, 64 nt, Human; identical to SEQ ID NO: 25344

SEQ ID NO: 27627 - RNA, 64 nt, Human; identical to SEQ ID NO: 25345

SEQ ID NO: 27628 - RNA, 64 nt, Human; identical to SEQ ID NO: 25346

SEQ ID NO: 27629 - RNA, 64 nt, Human; identical to SEQ ID NO: 25347

SEQ ID NO: 27630 - RNA, 64 nt, Human; identical to SEQ ID NO: 25348

SEQ ID NO: 27631 - RNA, 64 nt, Human; identical to SEQ ID NO: 25349

SEQ ID NO: 27632 - RNA, 64 nt, Human; identical to SEQ ID NO: 25350

SEQ ID NO: 27633 - RNA, 64 nt, Human; identical to SEQ ID NO: 25351

SEQ ID NO: 27634 - RNA, 64 nt, Human; identical to SEQ ID NO: 25352

SEQ ID NO: 27635 - RNA, 64 nt, Human; identical to SEQ ID NO: 25353

SEQ ID NO: 27636 - RNA, 64 nt, Human; identical to SEQ ID NO: 25354

SEQ ID NO: 27637 - RNA, 64 nt, Human; identical to SEQ ID NO: 25355

SEQ ID NO: 27638 - RNA, 64 nt, Human; identical to SEQ ID NO: 25356

SEQ ID NO: 27639 - RNA, 64 nt, Human; identical to SEQ ID NO: 25357

SEQ ID NO: 27640 - RNA, 64 nt, Human; identical to SEQ ID NO: 25358

SEQ ID NO: 27641 - RNA, 64 nt, Human; identical to SEQ ID NO: 25359

SEQ ID NO: 27642 - RNA, 64 nt, Human; identical to SEQ ID NO: 25360

SEQ ID NO: 27643 - RNA, 64 nt, Human; identical to SEQ ID NO: 25361

SEQ ID NO: 27644 - RNA, 64 nt, Human; identical to SEQ ID NO: 25362

SEQ ID NO: 27645 - RNA, 64 nt, Human; identical to SEQ ID NO: 25363

SEQ ID NO: 27646 - RNA, 64 nt, Human; identical to SEQ ID NO: 25364

SEQ ID NO: 27647 - RNA, 64 nt, Human; identical to SEQ ID NO: 25365

SEQ ID NO: 27648 - RNA, 64 nt, Human; identical to SEQ ID NO: 25366

SEQ ID NO: 27649 - RNA, 64 nt, Human; identical to SEQ ID NO: 25367

SEQ ID NO: 27650 - RNA, 64 nt, Human; identical to SEQ ID NO: 25368

SEQ ID NO: 27651 - RNA, 64 nt, Human; identical to SEQ ID NO: 25369

SEQ ID NO: 27652 - RNA, 64 nt, Human; identical to SEQ ID NO: 25370

SEQ ID NO: 27653 - RNA, 64 nt, Human; identical to SEQ ID NO: 25371

SEQ ID NO: 27654 - RNA, 64 nt, Human; identical to SEQ ID NO: 25372

SEQ ID NO: 27655 - RNA, 64 nt, Human; identical to SEQ ID NO: 25373

SEQ ID NO: 27656 - RNA, 64 nt, Human; identical to SEQ ID NO: 25374

SEQ ID NO: 27657 - RNA, 64 nt, Human; identical to SEQ ID NO: 25375

SEQ ID NO: 27658 - RNA, 64 nt, Human; identical to SEQ ID NO: 25376

SEQ ID NO: 27659 - RNA, 64 nt, Human; identical to SEQ ID NO: 25377

SEQ ID NO: 27660 - RNA, 64 nt, Human; identical to SEQ ID NO: 25378

SEQ ID NO: 27661 - RNA, 64 nt, Human; identical to SEQ ID NO: 25379

SEQ ID NO: 27662 - RNA, 64 nt, Human; identical to SEQ ID NO: 25380

SEQ ID NO: 27663 - RNA, 64 nt, Human; identical to SEQ ID NO: 25381

SEQ ID NO: 27664 - RNA, 64 nt, Human; identical to SEQ ID NO: 25382

SEQ ID NO: 27665 - RNA, 64 nt, Human; identical to SEQ ID NO: 25383

SEQ ID NO: 27666 - RNA, 64 nt, Human; identical to SEQ ID NO: 25384

SEQ ID NO: 27667 - RNA, 64 nt, Human; identical to SEQ ID NO: 25385

SEQ ID NO: 27668 - RNA, 64 nt, Human; identical to SEQ ID NO: 25386

SEQ ID NO: 27669 - RNA, 64 nt, Human; identical to SEQ ID NO: 25387

SEQ ID NO: 27670 - RNA, 64 nt, Human; identical to SEQ ID NO: 25388

SEQ ID NO: 27671 - RNA, 64 nt, Human; identical to SEQ ID NO: 25389

SEQ ID NO: 27672 - RNA, 64 nt, Human; identical to SEQ ID NO: 25390

SEQ ID NO: 27673 - RNA, 64 nt, Human; identical to SEQ ID NO: 25391

SEQ ID NO: 27674 - RNA, 64 nt, Human; identical to SEQ ID NO: 25392

SEQ ID NO: 27675 - RNA, 64 nt, Human; identical to SEQ ID NO: 25393

SEQ ID NO: 27676 - RNA, 64 nt, Human; identical to SEQ ID NO: 25394

SEQ ID NO: 27677 - RNA, 64 nt, Human; identical to SEQ ID NO: 25395

SEQ ID NO: 27678 - RNA, 64 nt, Human; identical to SEQ ID NO: 25396

SEQ ID NO: 27679 - RNA, 64 nt, Human; identical to SEQ ID NO: 25397

SEQ ID NO: 27680 - RNA, 64 nt, Human; identical to SEQ ID NO: 25398

SEQ ID NO: 27681 - RNA, 64 nt, Human; identical to SEQ ID NO: 25399

SEQ ID NO: 27682 - RNA, 64 nt, Human; identical to SEQ ID NO: 25400

SEQ ID NO: 27683 - RNA, 64 nt, Human; identical to SEQ ID NO: 25401

SEQ ID NO: 27684 - RNA, 64 nt, Human; identical to SEQ ID NO: 25402

SEQ ID NO: 27685 - RNA, 64 nt, Human; identical to SEQ ID NO: 25403

SEQ ID NO: 27686 - RNA, 64 nt, Human; identical to SEQ ID NO: 25404

SEQ ID NO: 27687 - RNA, 64 nt, Human; identical to SEQ ID NO: 25405

SEQ ID NO: 27688 - RNA, 64 nt, Human; identical to SEQ ID NO: 25406

SEQ ID NO: 27689 - RNA, 64 nt, Human; identical to SEQ ID NO: 25407

SEQ ID NO: 27690 - RNA, 64 nt, Human; identical to SEQ ID NO: 25408

SEQ ID NO: 27691 - RNA, 64 nt, Human; identical to SEQ ID NO: 25409

SEQ ID NO: 27692 - RNA, 64 nt, Human; identical to SEQ ID NO: 25410

SEQ ID NO: 27693 - RNA, 64 nt, Human; identical to SEQ ID NO: 25411

SEQ ID NO: 27694 - RNA, 64 nt, Human; identical to SEQ ID NO: 25412

SEQ ID NO: 27695 - RNA, 64 nt, Human; identical to SEQ ID NO: 25413

SEQ ID NO: 27696 - RNA, 64 nt, Human; identical to SEQ ID NO: 25414

SEQ ID NO: 27697 - RNA, 64 nt, Human; identical to SEQ ID NO: 25415

SEQ ID NO: 27698 - RNA, 64 nt, Human; identical to SEQ ID NO: 25416

SEQ ID NO: 27699 - RNA, 64 nt, Human; identical to SEQ ID NO: 25417

SEQ ID NO: 27700 - RNA, 64 nt, Human; identical to SEQ ID NO: 25418

SEQ ID NO: 27701 - RNA, 64 nt, Human; identical to SEQ ID NO: 25419

SEQ ID NO: 27702 - RNA, 64 nt, Human; identical to SEQ ID NO: 25420

SEQ ID NO: 27703 - RNA, 64 nt, Human; identical to SEQ ID NO: 25421

SEQ ID NO: 27704 - RNA, 64 nt, Human; identical to SEQ ID NO: 25422

SEQ ID NO: 27705 - RNA, 64 nt, Human; identical to SEQ ID NO: 25423

SEQ ID NO: 27706 - RNA, 64 nt, Human; identical to SEQ ID NO: 25424

SEQ ID NO: 27707 - RNA, 64 nt, Human; identical to SEQ ID NO: 25425

SEQ ID NO: 27708 - RNA, 64 nt, Human; identical to SEQ ID NO: 25426

SEQ ID NO: 27709 - RNA, 64 nt, Human; identical to SEQ ID NO: 25427

SEQ ID NO: 27710 - RNA, 64 nt, Human; identical to SEQ ID NO: 25428

SEQ ID NO: 27711 - RNA, 64 nt, Human; identical to SEQ ID NO: 25429

SEQ ID NO: 27712 - RNA, 64 nt, Human; identical to SEQ ID NO: 25430

SEQ ID NO: 27713 - RNA, 64 nt, Human; identical to SEQ ID NO: 25431

SEQ ID NO: 27714 - RNA, 64 nt, Human; identical to SEQ ID NO: 25432

SEQ ID NO: 27715 - RNA, 64 nt, Human; identical to SEQ ID NO: 25433

SEQ ID NO: 27716 - RNA, 64 nt, Human; identical to SEQ ID NO: 25434

SEQ ID NO: 27717 - RNA, 64 nt, Human; identical to SEQ ID NO: 25435

SEQ ID NO: 27718 - RNA, 64 nt, Human; identical to SEQ ID NO: 25436

SEQ ID NO: 27719 - RNA, 64 nt, Human; identical to SEQ ID NO: 25437

SEQ ID NO: 27720 - RNA, 64 nt, Human; identical to SEQ ID NO: 25438

SEQ ID NO: 27721 - RNA, 64 nt, Human; identical to SEQ ID NO: 25439

SEQ ID NO: 27722 - RNA, 64 nt, Human; identical to SEQ ID NO: 25440

SEQ ID NO: 27723 - RNA, 64 nt, Human; identical to SEQ ID NO: 25441

SEQ ID NO: 27724 - RNA, 64 nt, Human; identical to SEQ ID NO: 25442

SEQ ID NO: 27725 - RNA, 64 nt, Human; identical to SEQ ID NO: 25443

SEQ ID NO: 27726 - RNA, 64 nt, Human; identical to SEQ ID NO: 25444

SEQ ID NO: 27727 - RNA, 64 nt, Human; identical to SEQ ID NO: 25445

SEQ ID NO: 27728 - RNA, 64 nt, Human; identical to SEQ ID NO: 25446

SEQ ID NO: 27729 - RNA, 64 nt, Human; identical to SEQ ID NO: 25447

SEQ ID NO: 27730 - RNA, 64 nt, Human; identical to SEQ ID NO: 25448

SEQ ID NO: 27731 - RNA, 64 nt, Human; identical to SEQ ID NO: 25449

SEQ ID NO: 27732 - RNA, 64 nt, Human; identical to SEQ ID NO: 25450

SEQ ID NO: 27733 - RNA, 64 nt, Human; identical to SEQ ID NO: 25451

SEQ ID NO: 27734 - RNA, 64 nt, Human; identical to SEQ ID NO: 25452

SEQ ID NO: 27735 - RNA, 64 nt, Human; identical to SEQ ID NO: 25453

SEQ ID NO: 27736 - RNA, 64 nt, Human; identical to SEQ ID NO: 25454

SEQ ID NO: 27737 - RNA, 64 nt, Human; identical to SEQ ID NO: 25455

SEQ ID NO: 27738 - RNA, 64 nt, Human; identical to SEQ ID NO: 25456

SEQ ID NO: 27739 - RNA, 64 nt, Human; identical to SEQ ID NO: 25457

SEQ ID NO: 27740 - RNA, 64 nt, Human; identical to SEQ ID NO: 25458

SEQ ID NO: 27741 - RNA, 64 nt, Human; identical to SEQ ID NO: 25459

SEQ ID NO: 27742 - RNA, 64 nt, Human; identical to SEQ ID NO: 25460

SEQ ID NO: 27743 - RNA, 64 nt, Human; identical to SEQ ID NO: 25461

SEQ ID NO: 27744 - RNA, 64 nt, Human; identical to SEQ ID NO: 25462

SEQ ID NO: 27745 - RNA, 64 nt, Human; identical to SEQ ID NO: 25463

SEQ ID NO: 27746 - RNA, 64 nt, Human; identical to SEQ ID NO: 25464

SEQ ID NO: 27747 - RNA, 64 nt, Human; identical to SEQ ID NO: 25465

SEQ ID NO: 27748 - RNA, 64 nt, Human; identical to SEQ ID NO: 25466

SEQ ID NO: 27749 - RNA, 64 nt, Human; identical to SEQ ID NO: 25467

SEQ ID NO: 27750 - RNA, 64 nt, Human; identical to SEQ ID NO: 25468

SEQ ID NO: 27751 - RNA, 64 nt, Human; identical to SEQ ID NO: 25469

SEQ ID NO: 27752 - RNA, 64 nt, Human; identical to SEQ ID NO: 25470

SEQ ID NO: 27753 - RNA, 64 nt, Human; identical to SEQ ID NO: 25471

SEQ ID NO: 27754 - RNA, 64 nt, Human; identical to SEQ ID NO: 25472

SEQ ID NO: 27755 - RNA, 64 nt, Human; identical to SEQ ID NO: 25473

SEQ ID NO: 27756 - RNA, 64 nt, Human; identical to SEQ ID NO: 25474

SEQ ID NO: 27757 - RNA, 64 nt, Human; identical to SEQ ID NO: 25475

SEQ ID NO: 27758 - RNA, 64 nt, Human; identical to SEQ ID NO: 25476

SEQ ID NO: 27759 - RNA, 64 nt, Human; identical to SEQ ID NO: 25477

SEQ ID NO: 27760 - RNA, 64 nt, Human; identical to SEQ ID NO: 25478

SEQ ID NO: 27761 - RNA, 64 nt, Human; identical to SEQ ID NO: 25479

SEQ ID NO: 27762 - RNA, 64 nt, Human; identical to SEQ ID NO: 25480

SEQ ID NO: 27763 - RNA, 64 nt, Human; identical to SEQ ID NO: 25481

SEQ ID NO: 27764 - RNA, 64 nt, Human; identical to SEQ ID NO: 25482

SEQ ID NO: 27765 - RNA, 64 nt, Human; identical to SEQ ID NO: 25483

SEQ ID NO: 27766 - RNA, 64 nt, Human; identical to SEQ ID NO: 25484

SEQ ID NO: 27767 - RNA, 64 nt, Human; identical to SEQ ID NO: 25485

SEQ ID NO: 27768 - RNA, 64 nt, Human; identical to SEQ ID NO: 25486

SEQ ID NO: 27769 - RNA, 64 nt, Human; identical to SEQ ID NO: 25487

SEQ ID NO: 27770 - RNA, 64 nt, Human; identical to SEQ ID NO: 25488

SEQ ID NO: 27771 - RNA, 64 nt, Human; identical to SEQ ID NO: 25489

SEQ ID NO: 27772 - RNA, 64 nt, Human; identical to SEQ ID NO: 25490

SEQ ID NO: 27773 - RNA, 64 nt, Human; identical to SEQ ID NO: 25491

SEQ ID NO: 27774 - RNA, 64 nt, Human; identical to SEQ ID NO: 25492

SEQ ID NO: 27775 - RNA, 64 nt, Human; identical to SEQ ID NO: 25493

SEQ ID NO: 27776 - RNA, 64 nt, Human; identical to SEQ ID NO: 25494

SEQ ID NO: 27777 - RNA, 64 nt, Human; identical to SEQ ID NO: 25495

SEQ ID NO: 27778 - RNA, 64 nt, Human; identical to SEQ ID NO: 25496

SEQ ID NO: 27779 - RNA, 64 nt, Human; identical to SEQ ID NO: 25497

SEQ ID NO: 27780 - RNA, 64 nt, Human; identical to SEQ ID NO: 25498

SEQ ID NO: 27781 - RNA, 64 nt, Human; identical to SEQ ID NO: 25499

SEQ ID NO: 27782 - RNA, 64 nt, Human; identical to SEQ ID NO: 25500

SEQ ID NO: 27783 - RNA, 64 nt, Human; identical to SEQ ID NO: 25501

SEQ ID NO: 27784 - RNA, 64 nt, Human; identical to SEQ ID NO: 25502

SEQ ID NO: 27785 - RNA, 64 nt, Human; identical to SEQ ID NO: 25503

SEQ ID NO: 27786 - RNA, 64 nt, Human; identical to SEQ ID NO: 25504

SEQ ID NO: 27787 - RNA, 64 nt, Human; identical to SEQ ID NO: 25505

SEQ ID NO: 27788 - RNA, 64 nt, Human; identical to SEQ ID NO: 25506

SEQ ID NO: 27789 - RNA, 64 nt, Human; identical to SEQ ID NO: 25507

SEQ ID NO: 27790 - RNA, 64 nt, Human; identical to SEQ ID NO: 25508

SEQ ID NO: 27791 - RNA, 64 nt, Human; identical to SEQ ID NO: 25466

SEQ ID NO: 27792 - RNA, 64 nt, Human; identical to SEQ ID NO: 25510

SEQ ID NO: 27793 - RNA, 64 nt, Human
gccauaaugcagacuuucccauuccuucucuuuccacccgcaacuguggggcuaagaauucuua

SEQ ID NO: 27794 - RNA, 64 nt, Human
cgaccacuagaggucagcgucgcgccgcacucuucacccgcauguccagagggcggccgggaug

SEQ ID NO: 27795 - RNA, 51 nt, Human
ggccacccaaacauaaauaaccacccgcaguguccagaggcccucagaucg

SEQ ID NO: 27796 - RNA, 64 nt, Human
aggguccugcauaugcaccuggggaguccccacacacccgcaccaaaggggaaacauucaaagg

SEQ ID NO: 27797 - RNA, 64 nt, Human
gagucacuaacuggcguguuucugcccauuggagcacccgcacacuacuccaaaucaaaaccac

SEQ ID NO: 27798 - RNA, 64 nt, Human
guagagaggcccgcccgcccaccgugggcagugccacccgcagaugacacgcgcucuccaccac

SEQ ID NO: 27799 - RNA, 64 nt, Human
augcggggagaccgacggugcgaaggcccuucuccacccgcaggugggccaagcucugggggca

SEQ ID NO: 27800 - RNA, 64 nt, Human
aauagaugagcaggucaggcuguggcccuuaccucacccgcaguucucgcccagugcugcagcc

SEQ ID NO: 27801 - RNA, 64 nt, Human
ccugagucccuggcaguagccuuggggcagagggcacccgcagagucccagagaugaugugggc

SEQ ID NO: 27802 - RNA, 64 nt, Human
gcuuugcagugagugcugcucauguccuccccuccacccgcacaugggggucgcugcccuucac

SEQ ID NO: 27803 - RNA, 64 nt, Human
caccugcccagccauggcacacacccuuccugcacacccgcacuaccugcacuucucgcacauc

SEQ ID NO: 27804 - RNA, 64 nt, Human
ggaggucucacgguguagagaggagcuuugaggccacccgcacaaaauucacccagagggaaau

SEQ ID NO: 27805 - RNA, 64 nt, Human
guugucauuggauugaauuuacuuuuuuguuucucacccgcaacuugagccaggacagcugguc

SEQ ID NO: 27806 - RNA, 59 nt, Human
gcaucaagcucugcccuugauuauccugccacccgcaggggccccucugucagcacuug

SEQ ID NO: 27807 - RNA, 64 nt, Human
aaaaugcaccauguccugaaagauggcacccucccacccgcagagugcuuccugcaagcuggcg

SEQ ID NO: 27808 - RNA, 64 nt, Human
cucuccgcggucccccacccucaccccggccccccacccgcagccggccacacuggagcagcuc

SEQ ID NO: 27809 - RNA, 64 nt, Human
cugcagccuccgucagcuauguaauguuugccaucacccgcacccuuacuggcucagcccuggc

SEQ ID NO: 27810 - RNA, 64 nt, Human
ggauggccgucaccucagacaucacuccagggagcacccgcaggagcugggcccccucacgccu

SEQ ID NO: 27811 - RNA, 64 nt, Human
ucaucgugucuguccugagaggcuccacaaugcccacccgcaucgccauucuguagucuucagg

SEQ ID NO: 27812 - RNA, 64 nt, Human
gcugucucgagccaagcugugaaaacccuagacgcacccgcagggaggguggggagagcuggca

SEQ ID NO: 27813 - RNA, 64 nt, Human
gcgguauacggugcggggccugggaugcccgcgccacccgcagcccccucacucggcggaaacc

SEQ ID NO: 27814 - RNA, 64 nt, Human
cucugccacugucagggaccagccggccaacgcccacccgcaaaggugucuaaaaacuucagcu

SEQ ID NO: 27815 - RNA, 64 nt, Human
caucugagggcgccaggcaggcgggcgccaccgccacccgcagcgagggcggagccggccccag

SEQ ID NO: 27816 - RNA, 64 nt, Human
gccccuaagcaaccggacuugccugccucggccucacccgcacuucucccaaaaggcagaugac

SEQ ID NO: 27817 - RNA, 64 nt, Human
gagccuugccaccaucccaggacuuugggcaagucacccgcacucccugggccucgguuucccc

SEQ ID NO: 27818 - RNA, 64 nt, Human
acgcccgcgccgcggaggagccggcgcccaucuccacccgcacggcucgccgguccagagccau

SEQ ID NO: 27819 - RNA, 64 nt, Human
ccuguucccucccccaacccuaucccuccuaccucacccgcagggggaaggagggaggcugaca

SEQ ID NO: 27820 - RNA, 64 nt, Human
uggcuuccucuaaaucauuucaccuuucaguccccacccgcacccguccccuagagccauagua

SEQ ID NO: 27821 - RNA, 64 nt, Human
ggaccuaagccuaggccccagagaucagcccgaacacccgcaucccuuccuccucccauggguc

SEQ ID NO: 27822 - RNA, 64 nt, Human
ucucugucuugcugccggccuugauaccaccccucacccgcagagucacugcauucccucccag

SEQ ID NO: 27823 - RNA, 64 nt, Human
uacacaaaggaccuuagaugagaucuggcauaugcacccgcaauagaagggcaccacuuggaug

SEQ ID NO: 27824 - RNA, 64 nt, Human
cccagccccuccaaaggucugaugucuccacuuucacccgcaggccuuaccgcucuguuuauag

SEQ ID NO: 27825 - RNA, 64 nt, Human
cggaccaugcaccaggcugcacccuggugucuuccacccgcaggccucccaugcuccaagcagc

SEQ ID NO: 27826 - RNA, 64 nt, Human
ugucagggguagucccacauacuaaagauugucucacccgcagugccaauaacacuccuaagaa

SEQ ID NO: 27827 - RNA, 64 nt, Human
gcaaggaacagcaaggaauuauuuuccagaaugacacccgcagcagaauguuggaguggaaaug

SEQ ID NO: 27828 - RNA, 64 nt, Human
gauuugccgcacuuggaccuccaugcguggcacucacccgcagucuccuggacaggcgcuguau

SEQ ID NO: 27829 - RNA, 64 nt, Human
caguccccugcuaucccugcagccacucccagcacacccgcacacagccagcaccaccgccccc

SEQ ID NO: 27830 - RNA, 64 nt, Human
caaaccuggcccuuccccacuccucuagcaucgccacccgcauggcccuggaacucccgcggcg

SEQ ID NO: 27831 - RNA, 64 nt, Human
gccaggauggucucgaucucuugaccuugugacucacccgcaucggccucccaaagugcuggga

SEQ ID NO: 27832 - RNA, 64 nt, Human
cgcucaaagcucagacucaggucugaaacccacccacccgcaagccuaccagccuuguggccac

SEQ ID NO: 27833 - RNA, 64 nt, Human
ggccugacugcgaagcugugccuugccccucucccacccgcaguuucucaccccguucugcucc

SEQ ID NO: 27834 - RNA, 64 nt, Human
acgggaggauuccagaacagcagcacugagcucccacccgcagagccucuggacggccuuggca

SEQ ID NO: 27835 - RNA, 64 nt, Human
gccagagccgaggguccucccacacgugcucacccacccgcagccuaggcaggcucugcaugcu

SEQ ID NO: 27836 - RNA, 64 nt, Human
uggcccaggcgcgguugaccugccccugcuguaacacccgcaagaaggaugcaguccuuaccaa

SEQ ID NO: 27837 - RNA, 64 nt, Human
ccgcaguggcugugucagccucacccuucgugugcacccgcaugggagggucggagggugcugc

SEQ ID NO: 27838 - RNA, 64 nt, Human
caaagccauggcccgccgccgagagcccaggccccacccgcaccuccucacccauccagccuga

SEQ ID NO: 27839 - RNA, 64 nt, Human
gcaugucacgacagcuccgccaccccccauugcccacccgcacuuucccgagcaccgcgccccg

SEQ ID NO: 27840 - RNA, 64 nt, Human
ucucguccuuggauagauucagcucccacacacacacccgcacugcccaggucccuccucagac

SEQ ID NO: 27841 - RNA, 64 nt, Human
gcuacuccauccuugcaccccugggggcccagcccacccgcaugcacagagcaggggcuaggug

SEQ ID NO: 27842 - RNA, 64 nt, Human
gcggcaacaccagaaucuuccagaagcccagcuccacccgcacacgcagcuucccauccagucc

SEQ ID NO: 27843 - RNA, 64 nt, Human
gaggccccuccuucugcugccuggccaagccccacacccgcagacccuccuucccauccucuga

SEQ ID NO: 27844 - RNA, 64 nt, Human
cugaaaucaacucucuucggucguauccaccuugcacccgcaagucaagccgccccuuguagaa

SEQ ID NO: 27845 - RNA, 64 nt, Human
ggaagggacuugagcugggcaaguccuggccuggcacccgcagccgucucccuuccguggccca

SEQ ID NO: 27846 - RNA, 64 nt, Human
uggcgggcaccgcccuggccuuccgcacccucgucacccgcaucuccaacgaccucgagcucug

SEQ ID NO: 27847 - RNA, 64 nt, Human
gguccuccggugcagugggagggccggcuugcuccacccgcagccccgggguggcguagggaag

SEQ ID NO: 27848 - RNA, 64 nt, Human
aacucccugcaugcaaaccccuaguacccucucacacccgcacccgcgccucacgaucccucac

SEQ ID NO: 27849 - RNA, 64 nt, Human
cuguauaaauaacgggauuuucauggcgccgccccacccgcauuaucacugugugauggucuca

SEQ ID NO: 27850 - RNA, 64 nt, Human
cucaacuccuggucuccucugcuccuucucacugcacccgcaucucccauguuugcacuggcug

SEQ ID NO: 27851 - RNA, 64 nt, Human
acccccuccugggaagugcccccucaccucagggcacccgcaaccugggcuccucccugagcgc

SEQ ID NO: 27852 - RNA, 64 nt, Human
gccgggauccugagccuaggccucccgauguucccacccgcaugaucccuucccgccacacgau

SEQ ID NO: 27853 - RNA, 59 nt, Human
ccaaucacuacaagaaaugagcccaggcccacccgcagcuggccucacugucccgggug

SEQ ID NO: 27854 - RNA, 64 nt, Human
uccaccugcacaaacauagacagauguggacaugcacccgcauguacaaaaacacaaauacgga

SEQ ID NO: 27855 - RNA, 64 nt, Human
ugcccuggggagcaaucccagcggaucgcuccgggccaccaagccgcaccugugccugagacuc

SEQ ID NO: 27856 - RNA, 64 nt, Human
gccuccuggcuguugacuucccauugcucuuggagccaccaaucaaagagauucaaagagauuc

SEQ ID NO: 27857 - RNA, 64 nt, Human
gcaccucugauguacagccagcagggcccaggcagccaccaagcccaccccaggucaugccagc

SEQ ID NO: 27858 - RNA, 64 nt, Human
auuguagcaugcuugaggaguuuuucccuuacuggccaccaaaguucugaaccacuugcagguu

SEQ ID NO: 27859 - RNA, 64 nt, Human
uucccaccccagcccuugcuggucccuaggccaagccaccaagugaaaccuuccaggauacuag

SEQ ID NO: 27860 - RNA, 64 nt, Human
ucuuaaaaauagcaacccuucauuugcucucugugccaccaauagcuucugaguuuuuuguugu

SEQ ID NO: 27861 - RNA, 64 nt, Human
gauguguuuaaccaaagcuuugaaaugugaugaagccaccaacauaagcacuugccuaacagaa

SEQ ID NO: 27862 - RNA, 64 nt, Human
uucuuacccccagggauuaugauagaaauaugaagccaccaagucuagacuugaugguguucaa

SEQ ID NO: 27863 - RNA, 64 nt, Human
cauucgaaaugcuaugggcucccuggccucccaggccaccaaggacggcaagaaggacaagaag

SEQ ID NO: 27864 - RNA, 64 nt, Human
auugagcuaauggugauguuauuucaaucuaacagccaccaaucugaaauuguauuucaaaugu

SEQ ID NO: 27865 - RNA, 64 nt, Human
aguagaagaaaagccacccccugcacccuccauagccaccaaaccuguuagaacuggaccaauc

SEQ ID NO: 27866 - RNA, 64 nt, Human
uauguguuacguguuuuuuccaguauguuuauuugccaccaaaaaguaaaugcauuuucaccca

SEQ ID NO: 27867 - RNA, 64 nt, Human
gauaugggggucugccaagcugugaggaccaguagccaccaagccacccacaagcccccuccca

SEQ ID NO: 27868 - RNA, 64 nt, Human
guugcagggucgggcuugcggugggugacccagagccaccaaagucacauccacaacuaaugag

SEQ ID NO: 27869 - RNA, 64 nt, Human
gauuugaaugucauaauugcagugacaggacauugccaccaacucuauccuacuaccaucaaug

SEQ ID NO: 27870 - RNA, 64 nt, Human
gggcaccccagacacuggaacucccugccucugagccaccaacuggaccccucuccagcaacac

SEQ ID NO: 27871 - RNA, 64 nt, Human
uguuccaaaagaggguggagaguccugcaucauagccaccaaauagugaggaccggggcugagg

SEQ ID NO: 27872 - RNA, 64 nt, Human
gccugcucaccccacuccagggccuuccccagcggccaccaacugaccuggggcgcugcucccc

SEQ ID NO: 27873 - RNA, 64 nt, Human
cugccauuggucuccucugccucugacuacaucugccaccaacaacccuccccucaccccugcc

SEQ ID NO: 27874 - RNA, 64 nt, Human
gaacauaucaaaucaacagaaaauauaccuuggugccaccaacccauuuugugccacaugcaag

SEQ ID NO: 27875 - RNA, 64 nt, Human
ucagccugcugaguagcugggacuacaggcacaugccaccaaacuuggccauuuuuugucuuac

SEQ ID NO: 27876 - RNA, 64 nt, Human
uuugggggaguaccuuuaguauauuccuaaaauugccaccaaagaaugccaaaucugaauuucu

SEQ ID NO: 27877 - RNA, 64 nt, Human
ugacaugaaaccagaaauccaugugaacuacagagccaccaacuaaauguacaucacaguuuuc

SEQ ID NO: 27878 - RNA, 64 nt, Human
ggccuggaucugcuuauagagcaggaagaauaaagccaccaacuuuuaccuagcccggcuaauc

SEQ ID NO: 27879 - RNA, 64 nt, Human
auucaggugcuuugcuagaugcugugacagguaugccaccaacacugcucacagccuuucugag

SEQ ID NO: 27880 - RNA, 64 nt, Human
cacguaggugcuucuuaguaaaugcuuaaugaaugccaccaacucugcaaaguauucauugauu

SEQ ID NO: 27881 - RNA, 64 nt, Human
aagaaauaacuaaauuuucaaaugaguaagcagugccaccaacuaguguuuugcccgauagaag

SEQ ID NO: 27882 - RNA, 64 nt, Human
ugaacgaagaaagaauaaauuucggcuguuuuaagccaccaaggauaauugguuacagcagcuc

SEQ ID NO: 27883 - RNA, 64 nt, Human
caagugagcagggaugggcuggggaguugcuugugccaccaagacgugccaggucuguacuccu

SEQ ID NO: 27884 - RNA, 64 nt, Human
aaaaauauuuuuauccuagggccaaguguugccugccaccaaucaguaaguuagucuauaacaa

SEQ ID NO: 27885 - RNA, 64 nt, Human
ccaucuccagccggccaccucaggccccuguugggccaccaaugccaauuuuucucgagugacu

SEQ ID NO: 27886 - RNA, 64 nt, Human
ccgucucccaaagugcugggaauuacaggcgugagccaccaaacccggccugauuaaaguuaaa

SEQ ID NO: 27887 - RNA, 64 nt, Human
caaacuugugucugucucuucuuucauuuuccccgccaccaacuuacuuuaccaccuaugacug

SEQ ID NO: 27888 - RNA, 64 nt, Human
guccuuggcuggcccaggcccaguuaagccuguggccaccaagcagcucaucugagcacuuugg

SEQ ID NO: 27889 - RNA, 64 nt, Human
gacugggcuggcugccuucugcggagcuucuccagccaccaaggcugccugccccaucccaucc

SEQ ID NO: 27890 - RNA, 64 nt, Human
uuuggaaauaaagaagugcucugaaaaaauaucagccaccaaaauaguuauguuggcacugugu

SEQ ID NO: 27891 - RNA, 64 nt, Human
cacacggcugcaugaccagucccacccccccguggccaccaauggcuaugacaucauuggagca

SEQ ID NO: 27892 - RNA, 64 nt, Human
gaagcaggccuaguuucuucaucuauguuuaccggccaccaaacaccuuagggucuuagacucu

SEQ ID NO: 27893 - RNA, 64 nt, Human
caguggcccgucucaggcccugcucacucccggggccaccaaacgggccccucucucgggggaa

SEQ ID NO: 27894 - RNA, 64 nt, Human
gguaaugguguggauuggccugcuuugacucucagccaccaacagaaaucuuugucaccuuugu

SEQ ID NO: 27895 - RNA, 64 nt, Human
gagcaucuccucaacucugaguguuaagcguugagccaccaagcugguggcucugugugcucug

SEQ ID NO: 27896 - RNA, 64 nt, Human
gcuguuugggaauuuuccuugcugcuaccgcgcugccaccaaauggaauugaccagcggcuguu

SEQ ID NO: 27897 - RNA, 64 nt, Human
acuguucucucuugagaaccuguggccucaaccagccaccaagcugauguggcccaaguccauc

SEQ ID NO: 27898 - RNA, 64 nt, Human
agaccuuuucuucagaaguugcuuuccuuuugaggccaccaaaguaauuuagggaaacagcaga

SEQ ID NO: 27899 - RNA, 64 nt, Human
agaauguugacuuagaagcaauagggggcagcaggccaccaagagcacaaccccagggcgaggu

SEQ ID NO: 27900 - RNA, 64 nt, Human
uuuccguagaccuuaaaaucucagagguagggcugccaccaaggugaagaugggaacgcagaug

SEQ ID NO: 27901 - RNA, 64 nt, Human
agagagccuggagucugcaccuccuggaaauccugccaccaaccaggacacagcagccaccgua

SEQ ID NO: 27902 - RNA, 64 nt, Human
cuuuuuaugaaacuuagauuuaccucagauccaugccaccaaacaucucccaccgaguuauuug

SEQ ID NO: 27903 - RNA, 64 nt, Human
cccucagaugugcuuauuggauuccaguacaaacgccaccaaagccagcccacugcucuccuac

SEQ ID NO: 27904 - RNA, 64 nt, Human
acauagagaucauccuuuccagcaugaggaacuagccaccaacucuugcaggucucaacccuuu

SEQ ID NO: 27905 - RNA, 64 nt, Human
gucccuguguucugcacauccccacgguggggacgccaccaagccucagacucuuaccaucccg

SEQ ID NO: 27906 - RNA, 64 nt, Human
ugccaggauaauuucugcuugccaugggcaucuggccaccaaggaauuucgcacccugacgauu

SEQ ID NO: 27907 - RNA, 64 nt, Human
cucagccuucucuggugacagaggcucagcuguggccaccaacacacaaccacacacacacaac

SEQ ID NO: 27908 - RNA, 64 nt, Human
ucagggccgcaccgcccagacuggcucagcccaggccaccaacuucaucgccuuugcggcucag

SEQ ID NO: 27909 - RNA, 64 nt, Human
cuccuuugugccugcagcucauauggaggucuuugccaccaaugggagaugagcccaaacuuuc

SEQ ID NO: 27910 - RNA, 64 nt, Human
uuuuuuuuuuugggugauguaaaaccaacucccugccaccaaaauaauuaaaauagucacauug

SEQ ID NO: 27911 - RNA, 64 nt, Human
uucuuuccaggacaacuaaacuaccucggaucaagccaccaaauauggcauauccuugcaguag

SEQ ID NO: 27912 - RNA, 61 nt, Human
augugguugacuguaugugauuugaguucuggccaccaacaauuuagucauaucugauagg

SEQ ID NO: 27913 - RNA, 64 nt, Human
uacgguuuccaaugcgccgucaccaucuccaccugccaccaaaccaccagcagaguagccgccg

SEQ ID NO: 27914 - RNA, 64 nt, Human
caaaccaaacguuacuuagacugcaagcuagaaagccaccaaggccaggcuuuguuaaaagaag

SEQ ID NO: 27915 - RNA, 64 nt, Human
aagguaguuauguaugccagaccuaauaugagcugccaccaacaccccuagaacuuucagccau

SEQ ID NO: 27916 - RNA, 64 nt, Human
gauuucaccagaaguuacagaugaggcacuggaagccaccaaauuagcaggugcaccuucugug

SEQ ID NO: 27917 - RNA, 64 nt, Human
ccuuccuauggcggcccugagugugaguaucccugccaccaagagagcaaugggcagggaagga

SEQ ID NO: 27918 - RNA, 64 nt, Human
cugcguuucucccucccaggcuaggaaccucucugccaccaagggcugccauccaucgccuagu

SEQ ID NO: 27919 - RNA, 64 nt, Human
cacagcuggcagucaagccacagcuggagggucagccaccaagcugggagcugagccagaacag

SEQ ID NO: 27920 - RNA, 64 nt, Human
ggcccucugcccuccgaggccgugcaguggcugugccaccaagcauuccugcucaagcugacuc

SEQ ID NO: 27921 - RNA, 64 nt, Human
acaugccuuaaaaaaggaggggaggaaccacgcugccaccaaagcagccggaagugccuuaacu

SEQ ID NO: 27922 - RNA, 64 nt, Human
cauuguuaaugggagacaagcugaacugccacaugccaccaaaugaaccuuuacuucaaucaaa

SEQ ID NO: 27923 - RNA, 64 nt, Human
uuuaaugauauuugaaacuaaucuuagcauugaagccaccaauguaauuaauggugugcaguua

SEQ ID NO: 27924 - RNA, 64 nt, Human
caccaaagccaaucugcucuagcugcccacagaugccaccaaaaccugcuaucucuucaucacc

SEQ ID NO: 27925 - RNA, 64 nt, Human
uaaaauucagcauucuauuuuuaauaauuuguaugccaccaauuuguauuauuugucucaauaa

SEQ ID NO: 27926 - RNA, 64 nt, Human
auuggccgacugugagcugcagauaaggcuaucagccaccaaagagcaaugaacaauggaaacu

SEQ ID NO: 27927 - RNA, 64 nt, Human
ucccagaucauuuuucauguccaguaacacagaagccaccaaguacaguauagccugauaauau

SEQ ID NO: 27928 - RNA, 64 nt, Human
gaacaagcaagccggggcuaccugcccccagguggccaccaaguuguggaagcacauuucuaaa

SEQ ID NO: 27929 - RNA, 64 nt, Human
cuucacucuccaccaccuggauggcauggcgccugccaccaaacaucuuccuggccugcgcucu

SEQ ID NO: 27930 - RNA, 64 nt, Human
agggcaacugggcuuugccucacguauuccugcugccaccaagagacagcaaugacauguacag

SEQ ID NO: 27931 - RNA, 64 nt, Human
gacuccuggugcccaggcccugggccugcuccuugccaccaaccgaaccgugaauguagggccc

SEQ ID NO: 27932 - RNA, 64 nt, Human
aagcuguuuucccuacaaggugcuugguggugaagccaccaagcugucuuugguacucuuaaag

SEQ ID NO: 27933 - RNA, 64 nt, Human
acuuuuaugacaauauuggauuuguagguccugugccaccaaaacccaaagguuaguguaucca

SEQ ID NO: 27934 - RNA, 64 nt, Human
aaucgugucucuuauucaguaagaugguuacucagccaccaaaauauauuucacucaaggcuug

SEQ ID NO: 27935 - RNA, 64 nt, Human
ccuucucccgcaaaggcggcagaacuacaucggggccaccaaaucaccacucuucagccccauc

SEQ ID NO: 27936 - RNA, 64 nt, Human
ucaggauuugcuauuuaaguggcuugacaacugggccaccaaagaacuugaacuucaccuuuua

SEQ ID NO: 27937 - RNA, 64 nt, Human
uucaauagacuugcccuuguuacugcccagugaggccaccaaggaccaagaacaguugagcucu

SEQ ID NO: 27938 - RNA, 64 nt, Human
uuuggggaucaauauuuauugacuuguaguaacugccaccaauaaagcagucuuuaccaugcuu

SEQ ID NO: 27939 - RNA, 64 nt, Human
uagaagaacacaauauaaauauuuccguguaauagccaccaacuuuucaggcauagguuuuauu

SEQ ID NO: 27940 - RNA, 64 nt, Human
uuucugaguaaaaccagucugaaauaggauaaaagccaccaaauauuuucuuuuuuuuccagaa

SEQ ID NO: 27941 - RNA, 64 nt, Human
auaacauauuagcugcccuaaaugaucuuggagagccaccaaaacuuuaggacuacccaaguca

SEQ ID NO: 27942 - RNA, 64 nt, Human
caaaauaucugucuuugguagugcuucugcugcugccaccaaauugauaagaugcuauuaagag

SEQ ID NO: 27943 - RNA, 64 nt, Human
ggagcuauucaauagcagugacgcgcucuccucagccaccaaaugucccugacacccuccccag

SEQ ID NO: 27944 - RNA, 64 nt, Human
cuguuuuacagcaguuuugaaaaacacauacuaugccaccaauugucauauuauuuuuagauga

SEQ ID NO: 27945 - RNA, 64 nt, Human
uuaguuuuuccaaugauuuuuacacuauauuccugccaccaaggccuuuuuaaauaaguaaaaa

SEQ ID NO: 27946 - RNA, 64 nt, Human
uuacuauuaagaagaccagugauaauuuaauaaugccaccaacucuggcuuaguuaagugagag

SEQ ID NO: 27947 - RNA, 64 nt, Human
ccuucuuuaccuucauuucauccuguuggcugcugccaccaaaucugucuagaauccugcuuua

SEQ ID NO: 27948 - RNA, 64 nt, Human
cgcgagcccacaggacaccggccccuagauuccagccaccaagcggaagcaugagacccgccca

SEQ ID NO: 27949 - RNA, 64 nt, Human
cgaugugaacugccccuccccucgcaucccccaggccaccaacggcaguccuucugccuugucc

SEQ ID NO: 27950 - RNA, 64 nt, Human
cugaaagacccugagaccuggaugaugucuuugagccaccaaaccaagcagccuuguagccacu

SEQ ID NO: 27951 - RNA, 64 nt, Human
gggguaagauuugccuuaacaguacuauuuucucgccaccaaaaaaaaaaaaaaaaaaaaaaaa

SEQ ID NO: 27952 - RNA, 64 nt, Human
gaaagcacugugagacgcacagacggcgucuucugccaccaagagacccgagaacuccagauuc

SEQ ID NO: 27953 - RNA, 64 nt, Human
caauagucaugcuuuaaauauggcuuuaaauuaugccaccaaaauggugcacuucacagauuca

SEQ ID NO: 27954 - RNA, 64 nt, Human
cuuuuuuauuuguaaacuaauaaagguaaucacagccaccaacauuccaagcuacccuggguac

SEQ ID NO: 27955 - RNA, 64 nt, Human
cuguuccccucccccuuaagccaacaaccacagugccaccaagcucacaccuguccuucucagg

SEQ ID NO: 27956 - RNA, 64 nt, Human
ggaaugaggaauuuuaaacacacauuugauuacagccaccaaaaaaauagacguaaaaauaaag

SEQ ID NO: 27957 - RNA, 64 nt, Human
uugugggauggggguuagcgucuauguguggaaggccaccaaucuagggacaggaguccugggu

SEQ ID NO: 27958 - RNA, 64 nt, Human
aauaacuugaaaaaaaaaauuaaaaccguggccagccaccaaauuguggacacuguuuauauac

SEQ ID NO: 27959 - RNA, 64 nt, Human
gaaaauucaagaacucuuuuauuguugauuuggugccaccaaauucuuuuucuuuuuaaaucuu

SEQ ID NO: 27960 - RNA, 64 nt, Human
cuaggggcuguacaguauuguggcaucagauaaugccaccaaaggagacauaucacugcugcug

SEQ ID NO: 27961 - RNA, 64 nt, Human
agaaaaccaaguguccggauggcaggggccagcggccaccaagcucaugggacacccagagcag

SEQ ID NO: 27962 - RNA, 64 nt, Human
cuguccaccacucuaccccacaggagggccgcccgccaccaagccucaccugggggccacaggg

SEQ ID NO: 27963 - RNA, 64 nt, Human
gaauaauacagaguauucaaugcauguuguaugugccaccaaguuacuauuaacuguuuuugga

SEQ ID NO: 27964 - RNA, 52 nt, Human
augggccaaauguggccugagggccaccaauuugugaccucugcauuaguau

SEQ ID NO: 27965 - RNA, 64 nt, Human
uuagccuccugaaaagcugggauuacagggcccugccaccaagcccagcuaauuguauuuuuag

SEQ ID NO: 27966 - RNA, 64 nt, Human
uacugccccaacauagccuugaggaggcuucucagccaccaaaggguucuggccccuucucacu

SEQ ID NO: 27967 - RNA, 64 nt, Human
cauggggcuuugaaaacccuagccugaagucugagccaccaagggcuuggcuggguuggacacc

SEQ ID NO: 27968 - RNA, 64 nt, Human
ugagccuccugaguaucugggacuacagaugcgugccaccaagccuggcuaauuuugucucaug

SEQ ID NO: 27969 - RNA, 64 nt, Human
cugucucaaaaauaaaugaauaaaauaaaaaccugccaccaaauuauuucuggauucucuucac

SEQ ID NO: 27970 - RNA, 64 nt, Human
gcacugcagcaugguggcuuucugaguccuguuggccaccaagugucagccucagcacucccgg

SEQ ID NO: 27971 - RNA, 64 nt, Human
cuggagaggaagccuggggcacguccugugcggugccaccaaggccccaccccugccccuuuuc

SEQ ID NO: 27972 - RNA, 64 nt, Human
ccaacggugcggugguggccgaccccaugcagccgccaccaaucgcggaggagauugaccugcu

SEQ ID NO: 27973 - RNA, 64 nt, Human
ugcugaggagaagcaaaauggcacagggcuaguugccaccaaccaauuuacugaugaaugaagc

SEQ ID NO: 27974 - RNA, 64 nt, Human
ccaggcugguccccgccgguccccuuccaguccagccaccaagaguccacuugucccgggcuuc

SEQ ID NO: 27975 - RNA, 64 nt, Human
caauggacaaaauaugugaaacaacgguuugcaagccaccaaauaccagggagugaaggauagu

SEQ ID NO: 27976 - RNA, 64 nt, Human
ccucugcugcaaaggaaucucuugcugaguccaggccaccaaucaggcaaauagcccauacauu

SEQ ID NO: 27977 - RNA, 64 nt, Human
gaaaaugguauucaaauucuggaauggaaaucuagccaccaaaacggguuaaucaaaagacguc

SEQ ID NO: 27978 - RNA, 64 nt, Human
agguagauggaguugcuucuguugaauuagcucugccaccaauauguaucuucauacacguuug

SEQ ID NO: 27979 - RNA, 64 nt, Human
gagccuggccccauggucagcccuaggguggagagccaccaagagggacgccugggggugccag

SEQ ID NO: 27980 - RNA, 64 nt, Human
uauuuuauuauuucuucuuuuucucuuuuuuagagccaccaauacuggauuuguuuguuuuuca

SEQ ID NO: 27981 - RNA, 64 nt, Human
ggcuuagugccacaugcaccccacucauuccaaagccaccaaacugccaggggcugccguccac

SEQ ID NO: 27982 - RNA, 64 nt, Human
gcugaaccagaggaaguggaagaagagaaagacagccaccaaaaagggcacggcggcccccuac

SEQ ID NO: 27983 - RNA, 64 nt, Human
gaauggcacuggcugucccauaugguauccaggagccaccaaugucuguugaguacuucauaca

SEQ ID NO: 27984 - RNA, 64 nt, Human
acacacuguguuaugccagcucaaaucuacaguagccaccaaaaccaugacuuaauauuuugag

SEQ ID NO: 27985 - RNA, 64 nt, Human
acggaaagacuuacuacagcgaucuacccauauugccaccaagacuuuccaggcucuucgcaua

SEQ ID NO: 27986 - RNA, 51 nt, Human
caccacuuaaugagguuugaggccaccaaaagaucaacagacaaaugcucc

SEQ ID NO: 27987 - RNA, 64 nt, Human
cugugaccgccgaacuccacugcaacagacgggcgccaccaaagccaggcccugaggccuggga

SEQ ID NO: 27988 - RNA, 64 nt, Human
acacauugccaagauuucacacaugugaccaggggccaccaaagucccugugaccuuugugacu

SEQ ID NO: 27989 - RNA, 64 nt, Human
caggcccucauccacccucuggcacaacucugaggccaccaaccucguccacacccggggggcc

SEQ ID NO: 27990 - RNA, 64 nt, Human
agugcucucuccacuaccccacaccagccuuggugccaccaaaagugcuccccaaaaggaagga

SEQ ID NO: 27991 - RNA, 64 nt, Human
gaaacucuugagaucuugguccuguguuuuuucugccaccaaaggccagggucacugaaggccu

SEQ ID NO: 27992 - RNA, 64 nt, Human
gcucuuuugagcagcccucgcuggaacauguccugccaccaagugccagcucccucucugucug

SEQ ID NO: 27993 - RNA, 64 nt, Human
accauauugugcuucacaguagagccagcuuggggccaccaaagcugcccacuguuucucuuga

SEQ ID NO: 27994 - RNA, 64 nt, Human
auauuuaaauuaauuauuuaaauguguauauauugccaccaaauuauuuauaguucugcgggug

SEQ ID NO: 27995 - RNA, 64 nt, Human
guggaggguggaagguccugugcaggacagggaggccaccaaaggggcugcugucuccugcaca

SEQ ID NO: 27996 - RNA, 64 nt, Human
gaucaggaaccucuccaccacacugcaaacaauagccaccaaauuaugucgugagcuauauagc

SEQ ID NO: 27997 - RNA, 64 nt, Human
auguuuauucuaguuaaggaaauguugagggcaagccaccaaauuaccuaggcugagguuagag

SEQ ID NO: 27998 - RNA, 64 nt, Human
uuucagcacaccuauacccccgaucucagagggggccaccaauaucuagcuauggaucgugugu

SEQ ID NO: 27999 - RNA, 64 nt, Human
uuugaugaaugugggggaacucagaggaacuggggccaccaagguuggaaaaggguuugguucu

SEQ ID NO: 28000 - RNA, 64 nt, Human
aaacauuaaaccuuaaccaaagaagaacuuuaccgccaccaaaacagaaacaaccccaaacagc

SEQ ID NO: 28001 - RNA, 64 nt, Human
cagucucccuccauggagacaaaggcuucccagagccaccaaaaaccuucuuagcaggacagcu

SEQ ID NO: 28002 - RNA, 64 nt, Human
ccuuaggauugagcgucccgucugacguggaguugccaccaaccgcuaaaaugcacgccaucau

SEQ ID NO: 28003 - RNA, 64 nt, Human
cucgggcugggggcccaccccucucugugccggcgccaccaaccccacccacacugcugccugg

SEQ ID NO: 28004 - RNA, 64 nt, Human
cguauuuaacagucacaagaagucuuauuuacaugccaccaaccaaccucagaaacccauaaug

SEQ ID NO: 28005 - RNA, 64 nt, Human
cccacaggccuccacugccagccuaugguuguucgccaccaagccaggagugcugcaccgccca

SEQ ID NO: 28006 - RNA, 64 nt, Human
guuuuuccauaagcuuuauuccuucucucuaccugccaccaaaaagaaagaaacccucaagagu

SEQ ID NO: 28007 - RNA, 64 nt, Human
ugaacaaggaaacugaggaaucacccaaaugagugccaccaaguucuaggaccugguucuagcc

SEQ ID NO: 28008 - RNA, 64 nt, Human
accugaagagauaccgggaaaauauuggaaacaugccaccaagcccucuucgauagaagucucc

SEQ ID NO: 28009 - RNA, 64 nt, Human
gccccugaacuuguucccagugaaggucaacagggccaccaaccaggguugaggaaccaucuca

SEQ ID NO: 28010 - RNA, 64 nt, Human
auggugggggcagcgggcuucuccaccuaccccagccaccaaggcccugacgcacugccuccug

SEQ ID NO: 28011 - RNA, 64 nt, Human
ugccccgcugccuggcacugguccuuugcagccagccaccaacggcccccuugcccuugcagag

SEQ ID NO: 28012 - RNA, 64 nt, Human
cccccacccagcccacccauugaagucuccuugggccaccaaaggugguggccaugguaccggg

SEQ ID NO: 28013 - RNA, 64 nt, Human
ugggcaagggauuauaauuaauugcagggcucaagccaccaaucuaugaagaccucaggccagg

SEQ ID NO: 28014 - RNA, 64 nt, Human
ucccaagauuugaauuuauuuuaaaauuuuaauagccaccaagaauguggacauaugaaaauuc

SEQ ID NO: 28015 - RNA, 64 nt, Human
cagaagaauugguccaguuaagugcaugcaaaaagccaccaaaugaagggauucuauccagcaa

SEQ ID NO: 28016 - RNA, 64 nt, Human
aauauugaagucucaacugucucuguucacaagagccaccaaaaguuaggggacuucaguccua

SEQ ID NO: 28017 - RNA, 64 nt, Human
guuagggugucuaaucccuuuacacaagauugaagccaccaaacugagaccuugauaccuuuuu

SEQ ID NO: 28018 - RNA, 64 nt, Human
gaaggauggcagacgccuggugucaggaggggccgccaccaaggagcagcagcuggggcagagg

SEQ ID NO: 28019 - RNA, 64 nt, Human
ccccaagugugcacuauuuaauacuuuguaauaugccaccaagaguacugacauuuagaguugu

SEQ ID NO: 28020 - RNA, 64 nt, Human
gacuaaagaggacgccguccuuaaaaccugacgugccaccaaagccuuccuuuguuccucaaac

SEQ ID NO: 28021 - RNA, 64 nt, Human
agcauuuuuuuuucauguguggcaucuuuuucaugccaccaacaaacuuguugugugugugcgu

SEQ ID NO: 28022 - RNA, 64 nt, Human
uauuaaaaaugugucugaauagcgauuuugcuuugccaccaaaaggcuuuucccugagaacagu

SEQ ID NO: 28023 - RNA, 64 nt, Human
cacaauggaugguucauguucuggcuuagcaagagccaccaagaacuuugggugaagcaagcag

SEQ ID NO: 28024 - RNA, 64 nt, Human
ccugacaccugcucgaugcugacuuaggcuuccugccaccaagcaggaaacuagaaagagaaca

SEQ ID NO: 28025 - RNA, 64 nt, Human; identical to SEQ ID NO: 28019

SEQ ID NO: 28026 - RNA, 64 nt, Human
uauacaagauuauacaaucucuuuauuacugagggccaccaaauagccuaggaagugcccucga

SEQ ID NO: 28027 - RNA, 64 nt, Human
aagcugcuggugccuuagugugaaucaagguagugccaccaaaguguacuuguaguuucuguau

SEQ ID NO: 28028 - RNA, 64 nt, Human
agaugaggugaagaucacugucaucuaaaagcaggccaccaaauuuaaaaaaaaaaaguuaugg

SEQ ID NO: 28029 - RNA, 64 nt, Human
caccucugccccaccccagcccagaggaguuugagccaccaacuucagugccuuucuguacccc

SEQ ID NO: 28030 - RNA, 64 nt, Human
ccgcuguggccugcuuccagggagcaacagagaggccaccaagcagaggcccguggggcugagg

SEQ ID NO: 28031 - RNA, 64 nt, Human
ccugacuaaggccaccuugcagccgcuuuccagggccaccaagggcucugcuccagccucucag

SEQ ID NO: 28032 - RNA, 64 nt, Human
gccuuugcgcagagagcagagaggaugacuugcggccaccaaguuucugucuccgcgggagucc

SEQ ID NO: 28033 - RNA, 64 nt, Human
gaaggcuggguucugauccuaguuccaccaucaagccaccaacauacucccaucugugaaagga

SEQ ID NO: 28034 - RNA, 64 nt, Human
uaggaccugggaugcugcuggagcugaaucggaugccaccaaggcucgguccagcccaguaccg

SEQ ID NO: 28035 - RNA, 64 nt, Human
aggcucagugugccugggacagggcuuaccaccugccaccaagguuuccucucuucccccagga

SEQ ID NO: 28036 - RNA, 64 nt, Human
ccucgagggugaccucccuaccccgccccugccagccaccaagcgcaggugcagcgggggccag

SEQ ID NO: 28037 - RNA, 64 nt, Human
cggcaggaucuccuggcuccuugagugcccaggugccaccaagaggaagggccuugugggauac

SEQ ID NO: 28038 - RNA, 64 nt, Human
guucaccaguguucagcauggcagucgugcuuuagccaccaaagacaugaggaaaucacagggu

SEQ ID NO: 28039 - RNA, 64 nt, Human
ggagucacagcgaauccccgccccgccccgggaagccaccaaaccuugcuuuuucucaucugca

SEQ ID NO: 28040 - RNA, 64 nt, Human
acauuguaccugacccuuuaaucauguuauuuaugccaccaagguuguggaucuuaagguaugu

SEQ ID NO: 28041 - RNA, 64 nt, Human
ugccagcagcgagcucggaugcaucucuccaaaagccaccaaggucggcgcgucugaagagcgu

SEQ ID NO: 28042 - RNA, 64 nt, Human
ggagugggggaguccuggccccugaaucaccagagccaccaagccugccagaggggucucauuc

SEQ ID NO: 28043 - RNA, 64 nt, Human
gaggugcaggggagucaccgcccagaccuccccagccaccaaccgaccccaccucuguuccuaa

SEQ ID NO: 28044 - RNA, 64 nt, Human
gaggcccugcccggggcuggggccuaguccagcagccaccaaagucuggcagacuuucugcauu

SEQ ID NO: 28045 - RNA, 64 nt, Human
ugauuggaccuuauggucacccaacucaaggacagccaccaagaaguggcugccaaagagacug

SEQ ID NO: 28046 - RNA, 64 nt, Human
cugugcagggaguuggccagcugccgcaucaucggccaccaagggcacaagaggcggaggcucc

SEQ ID NO: 28047 - RNA, 64 nt, Human
aaaucaguuuuguguacaguaugugucuagcaaagccaccaagggccucaccuuucccacaguc

SEQ ID NO: 28048 - RNA, 64 nt, Human
ugaaguccgagaauuugaacgagccacucaggaagccaccaacaagaaaaucggcauuuuccca

SEQ ID NO: 28049 - RNA, 64 nt, Human
cgagcauagcgaguggcuguaagaaauuguccaugccaccaauuccacugcuacuugcccaggu

SEQ ID NO: 28050 - RNA, 64 nt, Human
ccggggcaguggggagcccccaucccuucacaccgccaccaacuaaccaagcuuggccucugac

SEQ ID NO: 28051 - RNA, 64 nt, Human
cccaguguagcacggaagaugcccacgugccugagccaccaauccacccagacaauaaaccauc

SEQ ID NO: 28052 - RNA, 64 nt, Human
ccaaauaaggcacuggggcaugggguaggggugggccaccaaguauacugaauucuaaggcuag

SEQ ID NO: 28053 - RNA, 64 nt, Human
gccuccaaggacugucuggcaaugacuuguauuggccaccaacuguagauguauauauggugcc

SEQ ID NO: 28054 - RNA, 64 nt, Human
cuccaccuccuguauauaccaccuaggaggagaugccaccaagcccucaagaaguugugcccuu

SEQ ID NO: 28055 - RNA, 64 nt, Human
uccuucccagguucuccccugggagacucccuuugccaccaaggcccccaccagggccucugac

SEQ ID NO: 28056 - RNA, 64 nt, Human
ugaacuugucaaggugaagggacacaaguugccagccaccaacuuucuugccucaacuaccuuc

SEQ ID NO: 28057 - RNA, 64 nt, Human
gcugggggcugacccaaguguugaggggaccaaagccaccaagacaggcucggagccaucagcu

SEQ ID NO: 28058 - RNA, 64 nt, Human
acauauuuuagugucaaggcagauuaguuauuuagccaccaaaaaaaaguauuguguacaauuu

SEQ ID NO: 28059 - RNA, 64 nt, Human
ugggaguuaggagggagagcagggugccggcccugccaccaaguugagagcuggaggggaggug

SEQ ID NO: 28060 - RNA, 64 nt, Human
uucguuggaagcuuaacuuuuguugccucuuaacgccaccaaauuuuaggguaauuugauuaug

SEQ ID NO: 28061 - RNA, 64 nt, Human
ucagccuccugaguagcugggacuacaggcacaggccaccaaaccuggcuaauguuuaaauuuu

SEQ ID NO: 28062 - RNA, 64 nt, Human
cuccacccaucgaaaccagccaccccuucccugugccaccaagacagccuuuuccaguggccau

SEQ ID NO: 28063 - RNA, 60 nt, Human
ccagcucugucaccuccugaacugaaccuagccaccaauggggcuuccaggcacuggagc

SEQ ID NO: 28064 - RNA, 64 nt, Human
accagugccuuuucuuguugaacuucuuggaaaagccaccaauucuagaucuugauuugaauua

SEQ ID NO: 28065 - RNA, 64 nt, Human
cauaaggggucaaaauuugcugccaaaugcguaugccaccaacuuacaaaaacacuucguucgc

SEQ ID NO: 28066 - RNA, 64 nt, Human
gggauauuguguucaagaaugauuccaaauuugagccaccaaaauacacugcauuacagaaauu

SEQ ID NO: 28067 - RNA, 64 nt, Human
cuugaggagcagagguggcagcagaggauucugagccaccaacugcaguaguggcuccuuuggc

SEQ ID NO: 28068 - RNA, 64 nt, Human
uauuacaaguuuuugucuggagccaaccaagcuugccaccaacauauugagaguaauacacuau

SEQ ID NO: 28069 - RNA, 64 nt, Human
ugauguuucuggugucaaguucucagaaguugcugccaccaacucuuuaagaaggcgacaggau

SEQ ID NO: 28070 - RNA, 64 nt, Human
agagcggcucaucugaacgcuggggccugcugcagccaccaacacugcccaggacugcggguug

SEQ ID NO: 28071 - RNA, 64 nt, Human
cugugcugaggacucccuccauguggccccaggugccaccaauaaaaauccuacagaaaauucu

SEQ ID NO: 28072 - RNA, 50 nt, Human
aagccgaacacacgcugugagccaccaagaccuggggcgacaggagaacc

SEQ ID NO: 28073 - RNA, 55 nt, Human
uggcugaccuucuugucugagccaggccaccaaagccaugccguaagcauacucu

SEQ ID NO: 28074 - RNA, 64 nt, Human
uaagggggagccucaggaccuaucaggacaagaagccaccaacaaugaguacucagagaucaag

SEQ ID NO: 28075 - RNA, 64 nt, Human
gagacccggccugugcugcccugcccgucucagggccaccaagucugacccacacagcgucacu

SEQ ID NO: 28076 - RNA, 64 nt, Human
cccacagaccaggagaucccccuugggugccuaugccaccaaggcccuggguuucaagcacaaa

SEQ ID NO: 28077 - RNA, 64 nt, Human
uccacccaccguuucccugcagugcacgcuggcagccaccaagcuaggaaguggcaggaguuug

SEQ ID NO: 28078 - RNA, 64 nt, Human
cagacaagacccacaaaucucagguggagacucugccaccaagucuggaagaaucguccacguc

SEQ ID NO: 28079 - RNA, 64 nt, Human
cccaaucccccaacacgccugucccucccgcauggccaccaaggagcuggaccuuggaugcgcc

SEQ ID NO: 28080 - RNA, 64 nt, Human
gcaguucaaggauuuccagcggcggauccugguggccaccaaucuguuuggccgggggauggac

SEQ ID NO: 28081 - RNA, 64 nt, Human
guccugcguggguagcccucggccggggagugaggccaccaaccaaagucaguuccuucccacc

SEQ ID NO: 28082 - RNA, 64 nt, Human
caacugucaauccagauuugaccucauuugcauugccaccaaggccuccuaggaaaaauuguag

SEQ ID NO: 28083 - RNA, 64 nt, Human
aggugggggcagggcucgugggacccucuggacagccaccaagauaucugagcaaccaagaguc

SEQ ID NO: 28084 - RNA, 64 nt, Human
gaagcugcccagggcuccggaggugcagcuaaaggccaccaaggcagaacaggcagaagggaug

SEQ ID NO: 28085 - RNA, 64 nt, Human
uacagagcaggccacgcucaggcccggcaugcgggccaccaaguucuggaaaccacgugguguc

SEQ ID NO: 28086 - RNA, 64 nt, Human
ucagccucccaaguagccaggauuacaggcacgcgccaccaagccaggcuaauuuuuguauuuu

SEQ ID NO: 28087 - RNA, 64 nt, Human
cugaaaugaggggacccugacuggagaggugggggccaccaaaaacccacaaaggccccggagc

SEQ ID NO: 28088 - RNA, 64 nt, Human
gcaugaaaaaguauuccgcugggaauugagccaugccaccaaagccaagaggagcgcauggaaa

SEQ ID NO: 28089 - RNA, 64 nt, Human
gauguagugcuuuuuagaggagccacugggcaaggccaccaagaacaaaugcaugacauuuuau

SEQ ID NO: 28090 - RNA, 64 nt, Human
gaacagcugucauggucaccccuggauaacauuugccaccaaguauagaugcuggaucuugggu

SEQ ID NO: 28091 - RNA, 64 nt, Human
uuuuuuuuuuuccccuuuuugucccuuuccccaagccaccaauuggauggaugaauguuugacg

SEQ ID NO: 28092 - RNA, 64 nt, Human
agaaguucagucuauuuuuucagcggauacugccgccaccaagaauccaaaaccuauuuuugac

SEQ ID NO: 28093 - RNA, 64 nt, Human
auccuggguuugcuucugaccuugucaugugugugccaccaaacacguuauuggcaccuuuuua

SEQ ID NO: 28094 - RNA, 64 nt, Human
gucaucagccaggcagcccucccagugcccaagggccaccaaccccagggaaacagggccagca

SEQ ID NO: 28095 - RNA, 64 nt, Human
ggccacugagggaauccuccacguggcugucccagccaccaaaacccaugcacagugcugcaga

SEQ ID NO: 28096 - RNA, 64 nt, Human
ugagaggagagaauguacguuugcuuuacccaccgccaccaagaaagcaguccgaugagauuuu

SEQ ID NO: 28097 - RNA, 64 nt, Human
aaacaaaucagcacgguucccaccagguucuccugccaccaagauguguucuccuuacuccauc

SEQ ID NO: 28098 - RNA, 64 nt, Human
uggcccuccuccuuuuccacagccacucacuggggccaccaaaacccagagauggcaggugugu

SEQ ID NO: 28099 - RNA, 64 nt, Human
gggucagcuggucucaaaacuggccacugccucagccaccaagcuuuuuccuaccacuaccuua

SEQ ID NO: 28100 - RNA, 64 nt, Human
cuuuaacagaaaaaagguauugaaauauuaaauggccaccaaguuuacuuugaagcccauuuuu

SEQ ID NO: 28101 - RNA, 64 nt, Human
cuaugggguucguuaugccaaagugucuacaugugccaccaacauaaaacaaaaccaagccuug

SEQ ID NO: 28102 - RNA, 64 nt, Human
ccccagguugagauccauggagccaggucuguuugccaccaagggguaaagcuccauucccacc

SEQ ID NO: 28103 - RNA, 64 nt, Human
acgagauaagcaguuaugugaccucacgugcaaagccaccaacagccacucagaaaagacgcac

SEQ ID NO: 28104 - RNA, 64 nt, Human
cuucagggccaucugcucccagggcaggggacaggccaccaaggaccuuuggcaaaugaagguu

SEQ ID NO: 28105 - RNA, 64 nt, Human
ggagcgaagagccaagcagaagcuccuggagauugccaccaagcccacguacccggugagccug

SEQ ID NO: 28106 - RNA, 64 nt, Human
agugcuggugucuuucacuggcagcaugaaguuagccaccaaguccucacaagccgugcugcuu

SEQ ID NO: 28107 - RNA, 64 nt, Human
acucuccccaucucgggcccugacccugacccuugccaccaacccaaagacagcugguggguuu

SEQ ID NO: 28108 - RNA, 64 nt, Human
gcuugcccugggucagaggaccggggcagccccugccaccaaaggacuugaucugaguugggag

SEQ ID NO: 28109 - RNA, 64 nt, Human
guggucagggaugccuggaggcauauauccagcugccaccaaggggcacuguuuguucccacuu

SEQ ID NO: 28110 - RNA, 64 nt, Human
ucaggagcauuugcaugcaguggguggagagucggccaccaaaggaccgaguugcgcucggaau

SEQ ID NO: 28111 - RNA, 64 nt, Human
ggccgccaacuuccacccugacggccgcgccauggccaccaaguuugcacacuugaagcuguug

SEQ ID NO: 28112 - RNA, 64 nt, Human
aaugcugcgucucccaucuuaacucuuugccuuugccaccaacuggcccucuucuuacuugaug

SEQ ID NO: 28113 - RNA, 64 nt, Human
ugaacaugaaaauuuucaaauuuugaaucugaaagccaccaaauguaucuuuauguauaaaucc

SEQ ID NO: 28114 - RNA, 64 nt, Human
uaaaauaaauuaaucuauauugguugacaaacaagccaccaaccacugacugcaaaacugccug

SEQ ID NO: 28115 - RNA, 64 nt, Human
aagaaaauagaugaaaaauuaggguacacagcuggccaccaaaugcgaagucaaucugcuacuu

SEQ ID NO: 28116 - RNA, 64 nt, Human
ggggguuggcuuuuacccuuuuucuugaauauuugccaccaagugaaaaauguuaggacauaaa

SEQ ID NO: 28117 - RNA, 64 nt, Human
uaaugccaagugucccuaaagauggaggaauaaagccaccaauucuguuguaaauaaaaauaaa

SEQ ID NO: 28118 - RNA, 64 nt, Human
guuuucaaaggaagguaucagcugugggcuaauugccaccaauuucagccugccacgauucuug

SEQ ID NO: 28119 - RNA, 64 nt, Human
agaggagggagaguggggucagaagauucuccuggccaccaagugccagcauugcccacaaauc

SEQ ID NO: 28120 - RNA, 64 nt, Human
auagaaagccagcaccagccucgggagcugcugagccaccaacucccaaagccagccugccucc

SEQ ID NO: 28121 - RNA, 64 nt, Human
cuguccuauuggagcaaagauuggagugaguguugccaccaacaggauuuuaucguuugacucc

SEQ ID NO: 28122 - RNA, 64 nt, Human
uugcugucagguuuuuauuuucaccuuuuucugugccaccaauucaaaaguuauaggauuagga

SEQ ID NO: 28123 - RNA, 60 nt, Human
ggcaagcaggcgaaucuuaaacaggcaugugccaccaauaucuacuguacauucuacaag

SEQ ID NO: 28124 - RNA, 64 nt, Human
agucagagcugugagcggggggcgccguccaggccgagcgcagacuguuuaggacucagcagac

SEQ ID NO: 28125 - RNA, 64 nt, Human
agagagagaauaugugugugugugugugcgucugcgagcgcacacacaugcacaagugcgaagg

SEQ ID NO: 28126 - RNA, 64 nt, Human
cccacagcccguguucccgaaguugcuaagugcccgagcgcagcgcguuaaguagagaagucuu

SEQ ID NO: 28127 - RNA, 64 nt, Human
acagcuuucuugcgucucauuugucgccgagccccgagcgcacggugaugcucgggucugcccc

SEQ ID NO: 28128 - RNA, 64 nt, Human
ccgagcugcuggcccagggccacaccaagccacccgagcgcagugccacaggcgccaagagcaa

SEQ ID NO: 28129 - RNA, 64 nt, Human
augaguguuccagagggagaagcaucgcugaccccgagcgcagguuuugcuagcagauugcccu

SEQ ID NO: 28130 - RNA, 64 nt, Human
cuggaguccccaugggggcgguagcugaaguuggcgagcgcagcgguggaugcagagcuggcug

SEQ ID NO: 28131 - RNA, 64 nt, Human
cuggcaagcaucaacaggagucuucuucccaacacgagcgcauccauguccugagaaaaagucu

SEQ ID NO: 28132 - RNA, 64 nt, Human
cguagccaccaaccgcuaaaaugcacgccaucaucgagcgcacggccagcuucgugugcaggca

SEQ ID NO: 28133 - RNA, 64 nt, Human
ggugggcacugcagaggaucacuggaauccagaucgagcgcaguucaugcacaaggccccguug

SEQ ID NO: 28134 - RNA, 64 nt, Human
cuacuuagcaguguuggucucuggggcuggaagccgagcgcaugcugggagcgguacugucaga

SEQ ID NO: 28135 - RNA, 64 nt, Human
gucuuccccacuggcaguggcagcagccccaccccgagcgcacacugugauggaggagacugag

SEQ ID NO: 28136 - RNA, 64 nt, Human
ugccacacgcccgcggugaucccagccagggccccgagcgcagaggcggagcugugcucagcac

SEQ ID NO: 28137 - RNA, 64 nt, Human
uguagauaagcaugagaguguggagcagagucggcgagcgcaagccgagcccaucaaccuggac

SEQ ID NO: 28138 - RNA, 64 nt, Human
cuguaguccugguagcuguugugcuuggaaauaacgagcgcauccuugccucagcuaccugcuc

SEQ ID NO: 28139 - RNA, 64 nt, Human
acucgacaagcuggacccccugcucccgggggggcgagcgcaugacccccccgcccucgcgcug

SEQ ID NO: 28140 - RNA, 64 nt, Human
gugaagcgugcucauuucaugcuggguaugacgccgagcgcacaccacuggcgugagacagcgc

SEQ ID NO: 28141 - RNA, 64 nt, Human
uucuuauuuuauuuccuccuuaacaguauuuuuggcauuagacauucuuauugugaagaaauaa

SEQ ID NO: 28142 - RNA, 64 nt, Human
guauuuaagaugcuggugaagagcuuuugcucuugcauuagauuugaagauguuuacauuguug

SEQ ID NO: 28143 - RNA, 64 nt, Human
gucugaauuauaaaccagccugaccuuuccuuuagcauuagauguaauaaaauaacuuuggaaa

SEQ ID NO: 28144 - RNA, 64 nt, Human
ccucaagucuggucuccuggcagagagcacaugggcauuagauaccaucaacauccugcuguau

SEQ ID NO: 28145 - RNA, 64 nt, Human
ucugagcuccauggggcacaugaggcauccugaagcauuagaaugauuccaacacugcucuucu

SEQ ID NO: 28146 - RNA, 64 nt, Human
guaucugagggaugugcuguaauuugauuuacaugcauuagagcacacaguagaaaaacuuuag

SEQ ID NO: 28147 - RNA, 64 nt, Human
cuucugaaauucaaacaguaaugcaaaagugucugcauuagaauuuacggugucuaaaauucau

SEQ ID NO: 28148 - RNA, 64 nt, Human
uggagaggccgagcagcagccggccgggaugggggcauuagaggccugagguucucuaggacuc

SEQ ID NO: 28149 - RNA, 64 nt, Human
uuuaauucuuucgggcuugcuaagcauuucuaaagcauuagacuaacagauuccugugaaguuc

SEQ ID NO: 28150 - RNA, 64 nt, Human
aaaagucucucucaacaccucguucaugcaaucagcauuagaauuuguaaggaaggaagggggg

SEQ ID NO: 28151 - RNA, 64 nt, Human
cagaugugguugcauccuaacuccaugucucugagcauuagauuucucauuugccaauaauaau

SEQ ID NO: 28152 - RNA, 64 nt, Human
aauuguuuaaguguuguaaauauuuauguaaacugcauuagaaauuagcugugugaaauaccag

SEQ ID NO: 28153 - RNA, 64 nt, Human
guuuccucuugaauguacaugaaccacuguaauagcauuagacuuuuaauugagugugcaaucg

SEQ ID NO: 28154 - RNA, 64 nt, Human
uucugugacauauacaaaaaaaucuaguggauaggcauuagaugaauagagaauauuaauuuug

SEQ ID NO: 28155 - RNA, 64 nt, Human
acacugucgauguuuccaaugcaucuuccaugaugcauuagaaguaacuaauguuugaaauuuu

SEQ ID NO: 28156 - RNA, 64 nt, Human
auuuaauuuggaaauuucuuuuuacuuuuguggagcauuagagucacaguuuaccuuauugaua

SEQ ID NO: 28157 - RNA, 64 nt, Human
cugugggugaauaacuuuaguaaguuagcugccagcauuagaaccuuccaggaagaauuuuaac

SEQ ID NO: 28158 - RNA, 64 nt, Human
guuuuugugggugauugcaauuuuuuaaugaaaugcauuagaacaucuaagcacgucaccuaca

SEQ ID NO: 28159 - RNA, 64 nt, Human
gguacuaugaacgugagugggguauuuuguucuggcauuagaagaaaaacaagcaagcaaacaa

SEQ ID NO: 28160 - RNA, 64 nt, Human
guaaaguuugcacagucaucugacuucugaucaagcauuagauuuuaacuuguuuagauuuugu

SEQ ID NO: 28161 - RNA, 64 nt, Human
uuucuauucaucuuuauaauggacuuucagaagugcauuagacaaggccccuaaccacuuuggg

SEQ ID NO: 28162 - RNA, 64 nt, Human
aaguagacauaggaacuagaggaaagcucaggcugcauuagaguaugaauuuagcauugggaaa

SEQ ID NO: 28163 - RNA, 64 nt, Human
gacagaaaacuugcccaauacugagaagcaacuugcauuagagagggaacuguuaaauguuuuc

SEQ ID NO: 28164 - RNA, 64 nt, Human
uugaauauaaaaaaucaugccaguauuuuuaaaggcauuagagucaacuacacaaagcaggcuu

SEQ ID NO: 28165 - RNA, 64 nt, Human
gucugugcgugugcguguguguuucauacagcuagcauuagaugggugauguuucuuacuuauc

SEQ ID NO: 28166 - RNA, 64 nt, Human
uacuuuauaaacugugaauaugaguaugccagcugcauuagauguaacuaaucauauuuaaaua

SEQ ID NO: 28167 - RNA, 64 nt, Human
uuucaggaugaacuguuccaccucagaucaucaggcauuagauucucuugaggaacauggcacu

SEQ ID NO: 28168 - RNA, 64 nt, Human
aagcaucagagcaaugcuacaguccaacaauggagcauuagauccccagcuaggugaccugaug

SEQ ID NO: 28169 - RNA, 64 nt, Human
aauacauuugauuuguucaugaauauauuaaucagcauuagagaaaugaauuauaacuagacau

SEQ ID NO: 28170 - RNA, 64 nt, Human
auaugugauaguaugauaugcauuuauuuaaaaugcauuagacucucuuccauccaucaaauac

SEQ ID NO: 28171 - RNA, 64 nt, Human
caguaaaguuauuaagguugguuuaaaaacaacugcauuagaaauaaugcguguuuggggggca

SEQ ID NO: 28172 - RNA, 64 nt, Human
uucucuucaguccucugaguacaucugguggugugcauuagaugugagggcuauguugacaugg

SEQ ID NO: 28173 - RNA, 64 nt, Human
uuucuuugauauacaguuuuuucuucuuaguucugcauuagaaauggcaucuguuuuaggucuc

SEQ ID NO: 28174 - RNA, 64 nt, Human
ccuuuugcaacaagacaaagcaaagccacauuuugcauuagacagaugacggcugcucgaagaa

SEQ ID NO: 28175 - RNA, 64 nt, Human
uuuaaaaauaaaaucugaaaaccucagaaaauuugcauuagaaauuggucuuucuuagaauggu

SEQ ID NO: 28176 - RNA, 64 nt, Human
accgauugcauaggaauugcacaauccaugaacagcauuagaauuuacagcaagaacagaaaua

SEQ ID NO: 28177 - RNA, 64 nt, Human
ugcauuaaaaggugaaugauugaagaguguuaaagcauuagacuuagcacauucaauaaccuuu

SEQ ID NO: 28178 - RNA, 64 nt, Human
uccugcugguucacucuaauuggucauuccuaaugcauuagauuaucaaaaaguauaaauucgc

SEQ ID NO: 28179 - RNA, 64 nt, Human
gagagugguccuaagcaguaaacuggaugauguugcauuagaaaaacaucaauaauucauauuu

SEQ ID NO: 28180 - RNA, 64 nt, Human
cuaggcuaggauuucuaaauuggugaaaaaagcagcauuagagugccagaauuagcacugggga

SEQ ID NO: 28181 - RNA, 64 nt, Human
uucccuaauccuccaagucuucagcgagacccuugcauuagaaacugaaaacuguaaauacaaa

SEQ ID NO: 28182 - RNA, 64 nt, Human
gccucaguuaaugcaucugcggaaugagaggauugcauuagaagauaggcaaugauucuuucac

SEQ ID NO: 28183 - RNA, 64 nt, Human
ggguggccagccagcuagcccauaacugauagaugcauuagaagucagccagcgcauaggugcu

SEQ ID NO: 28184 - RNA, 64 nt, Human
gaaguuaguucuauuuagcagguuaaaaaaugcugcauuagaauuaaagcaaguuauuuucuua

SEQ ID NO: 28185 - RNA, 64 nt, Human
ugacuugauuauucccuuucucuuaaaaaccauggcauuagacugcacuaaauuaacaagcaug

SEQ ID NO: 28186 - RNA, 64 nt, Human
ggaauuuuuuaaauaaauugaaaagcugugaacagcauuagaacuuugucuauuucuuaauuuu

SEQ ID NO: 28187 - RNA, 64 nt, Human
cuucuuauacauauacuaucaaauuauguugugugcauuagaaaucaguugcuugauaguagcu

SEQ ID NO: 28188 - RNA, 64 nt, Human
uagagauggcguagaagugaaagucuuaaagggagcauuagagauccuuuuaauacacgacuga

SEQ ID NO: 28189 - RNA, 64 nt, Human
augaaauuguccagauguguucaggaacaugauugcauuagagcaaugacuguauuuuguuguc

SEQ ID NO: 28190 - RNA, 64 nt, Human
ccuugguaucguguuaucaugugucgucaucuaugcauuagaguugauguguuuuguacuagug

SEQ ID NO: 28191 - RNA, 64 nt, Human
acugacauuauacucuaaaagaugguguauuugugcauuagauuugccugaaaaacuuuaucca

SEQ ID NO: 28192 - RNA, 64 nt, Human
gaaguauagaugugguuguggucuuagauugacagcauuagagaagacugguuagaacaucugg

SEQ ID NO: 28193 - RNA, 64 nt, Human
uccaaaguucccacuccuucaggacagcugcugugcauuagauauuaggggggaaagucaucug

SEQ ID NO: 28194 - RNA, 64 nt, Human
auucuaaccaauguaaaaugaccauuuuucuguugcauuagaccuuuacagguaauggaacaug

SEQ ID NO: 28195 - RNA, 64 nt, Human
uuugagagugcucaaucauacuacacuguugccagcauuagaucuuaucacauuuaagucauug

SEQ ID NO: 28196 - RNA, 64 nt, Human
cguugcuucuuugaccuuacaauauccucaacaagcauuagaacaacuucugccaucuucuggg

SEQ ID NO: 28197 - RNA, 64 nt, Human
ugaauggaggaaggauauguccucauuccauagagcauuagaagcugccaccagcccaggaccc

SEQ ID NO: 28198 - RNA, 64 nt, Human
aaggcuugcuuuucccucgccuuuccugaaggucgcauuagagcgagucacauggagcauccua

SEQ ID NO: 28199 - RNA, 64 nt, Human
uugacaaaaagcucuuacacuacauuagaacacugcauuagagcccauuucaauucucaaaaga

SEQ ID NO: 28200 - RNA, 64 nt, Human
aacugauauuuaauuucagucuucagacuggucagcauuagaaaauucuuggcuuuauuguacu

SEQ ID NO: 28201 - RNA, 64 nt, Human
uaguacuuuuuaaaucuuuacucucuaucuugaagcauuagauguuaagacuaauguguaaaaa

SEQ ID NO: 28202 - RNA, 64 nt, Human
aauuaacuuguuaagcaaguauggucuugauaaugcauuagaaaaauuaaaauuaauuuuucuu

SEQ ID NO: 28203 - RNA, 64 nt, Human
uagcuucagccucauguccauuuccagucugucagcauuagacauggucacuguucaaguuuca

SEQ ID NO: 28204 - RNA, 64 nt, Human
gaugaccuaauguauccuuuagaaauuuaaaauagcauuagagcaaguugcuugucauggcuug

SEQ ID NO: 28205 - RNA, 64 nt, Human
cauacccuggccgcccccugccccccagccucuggcauuagaauuauuuaaacaaaaacuaggc

SEQ ID NO: 28206 - RNA, 64 nt, Human
auccuguggaaccucuucuaguucaggggugugagcauuagacugccaguugucuagugacauc

SEQ ID NO: 28207 - RNA, 64 nt, Human
aauauauucgcacauuaagaaaaaaaagacuuaagcauuagaaagcaaaauuuaaaugacuaaa

SEQ ID NO: 28208 - RNA, 64 nt, Human
ccuuauauggcaaucaggcagaggcguuccuuaagcauuagagaguucugaagcuuaagauuug

SEQ ID NO: 28209 - RNA, 64 nt, Human
gaguucguguuccugaacggugagaagcauuuaggcauuagagucauuuuaauccaaauuuuca

SEQ ID NO: 28210 - RNA, 64 nt, Human
augccuccuuguauuauaaaaucuuucugauaaugcauuagaagguuuuuuugucgauuaguaa

SEQ ID NO: 28211 - RNA, 64 nt, Human
acugguaaccugcagcaguuggguccuaaugauggcauuagacuuucauaauguccuguauaaa

SEQ ID NO: 28212 - RNA, 64 nt, Human
uuauuuucuguaaauuuugacguaaauaguuugagcauuagaaaucaacuugaaacaauaaaau

SEQ ID NO: 28213 - RNA, 64 nt, Human
uaguauuuuuccauguuuauuguguuaucagagugcauuagaaagauuagugauucaucuucac

SEQ ID NO: 28214 - RNA, 64 nt, Human
uauuauguauccaaacugaaauuaucugcuuucugcauuagaauguaagcccccugaggguuga

SEQ ID NO: 28215 - RNA, 64 nt, Human
augugggaaaauguaaaagcagggauaucagugggcauuagaauaaaaacuagggauacaauaa

SEQ ID NO: 28216 - RNA, 64 nt, Human
cauauuaaauaacauuccucuauguaucucaauggcauuagacauuaggagaagcauuuugugg

SEQ ID NO: 28217 - RNA, 64 nt, Human
acuauaaacgggugcaucccaccacucccuggaggcauuagacacccaaguggaaggugcuaca

SEQ ID NO: 28218 - RNA, 64 nt, Human
guguauucauacugacauuagauugaugugcacugcauuagaaaugagguagcugacacagaaa

SEQ ID NO: 28219 - RNA, 64 nt, Human
agcuguuuucuaguuauugcuaguauauagaaaugcauuagacuuguacauugaucuuguauca

SEQ ID NO: 28220 - RNA, 64 nt, Human
aaaagauaacaagaucuuucaggaaagacggauugcauuagaaauagacaguauauuuauaguc

SEQ ID NO: 28221 - RNA, 64 nt, Human
ugcaauauuuuggauggagaauuugaaguuaaaugcauuagaaaacuaccugaugaacuaccac

SEQ ID NO: 28222 - RNA, 64 nt, Human
ccccaaagaaaucugcuuucuacuauaucuuucagcauuagagauuuuucuguucuugaaaaua

SEQ ID NO: 28223 - RNA, 64 nt, Human
cuuuuuuaaacaucaaauaauugaagagacaauagcauuagaaauaagugauuaaaggccucug

SEQ ID NO: 28224 - RNA, 64 nt, Human
ugguuucccucucaggcccagcagcccauugacagcauuagacuggcggcauggugcuuuucug

SEQ ID NO: 28225 - RNA, 64 nt, Human
acaguguacguaugcaacaaagauauuccaucaugcauuagagucaguucuggcucugccuagc

SEQ ID NO: 28226 - RNA, 64 nt, Human
uguauccuuacuugauauuuuguuccuaucaacagcauuagaaaggaaaggagacagaaugagc

SEQ ID NO: 28227 - RNA, 64 nt, Human
caagcuaccaggaacugugaggcuuugucauuuagcauuagacuuuaaacaagaauuaaaauca

SEQ ID NO: 28228 - RNA, 64 nt, Human
uagagcuuccuaaugcauguguugcauuauugcagcauuagaaaaggagagguagcauuuuugc

SEQ ID NO: 28229 - RNA, 64 nt, Human
cguggccucaggugccaggguuugauggacaguagcauuagaauuguggaaaaggaacacgcaa

SEQ ID NO: 28230 - RNA, 64 nt, Human
ugccaguaaauggggguugagggugaccuaggcagcauuagaaucacuuauuuauuucuuuccu

SEQ ID NO: 28231 - RNA, 64 nt, Human
gaauaaucugagcaaagguaugaaacagccuaaugcauuagagaaaaaaguucuuuuaguaagg

SEQ ID NO: 28232 - RNA, 64 nt, Human
acuuuuaugggaaaaguuauuuuaugucuccuaagcauuagaguuuuucuauuacucuauguag

SEQ ID NO: 28233 - RNA, 64 nt, Human
ccagggccggggaccgguguuucacugaggaccugcauuagaaacauuuuuuaaauuguuguac

SEQ ID NO: 28234 - RNA, 64 nt, Human
agcucaggucagccuguugguagaugcugggacagcauuagaagagggucuuuuugaucuggga

SEQ ID NO: 28235 - RNA, 64 nt, Human
ggcuugauuucuuuuuucccuuugcuuauaucuagcauuagaauuuugucuuaaaauaacagcg

SEQ ID NO: 28236 - RNA, 64 nt, Human
uaggaaugaggagagcuagaaaaccuggaguguggcauuagaauagaacucauaucuuuuaaau

SEQ ID NO: 28237 - RNA, 64 nt, Human
ucggccucugcaaaaacuguacugucuuguuucugcauuagacuuaaguagucaugugaauaua

SEQ ID NO: 28238 - RNA, 64 nt, Human
gaagaaauugguuuuaaggaaacuucggagaaaggcauuagaucuggaaagcuugagccuccuu

SEQ ID NO: 28239 - RNA, 64 nt, Human
uugcaaauauuuuucuccuauagcaguaaguacagcauuagaaggugauuagagagucuguuga

SEQ ID NO: 28240 - RNA, 64 nt, Human
ccagcacuaugagauacugaagaccaaggauucagcauuagaacaucuauacauauggugaucu

SEQ ID NO: 28241 - RNA, 64 nt, Human
auuuuuuauuacaacuuuguacugguuguaacuugcauuagaaaaaaaagagauauauacacca

SEQ ID NO: 28242 - RNA, 64 nt, Human
guagauacuuguaguguuugaauaaaugaaaccagcauuagagcuuuauauacuuucucuuaag

SEQ ID NO: 28243 - RNA, 64 nt, Human
ucauuauuuuuucuuucuguacagaaauagaaaagcauuagaaauaacuucuaaccauccucug

SEQ ID NO: 28244 - RNA, 64 nt, Human
uauaguuagcaaauacugaacuuucucagauauggcauuagaugcaagacaaccuccuagggau

SEQ ID NO: 28245 - RNA, 64 nt, Human
ucaacccaaaguaagauugaguccccuuugagaugcauuagagcaguccaacccagaauggcac

SEQ ID NO: 28246 - RNA, 64 nt, Human
auucuuuugcugcuuaauaaagugaccucuaggugcauuagaaugcgaaggcaaauaguugcaa

SEQ ID NO: 28247 - RNA, 64 nt, Human
gucuuaucacucuuucaugucacaauagcguggagcauuagagaaaagccuagacuuuuaguug

SEQ ID NO: 28248 - RNA, 64 nt, Human
caccugaacuccaccucuugucagcucaguggcagcauuagauucucauaggagcacaaauccu

SEQ ID NO: 28249 - RNA, 64 nt, Human
ucccugccccuugccucaccuccucuucuagacugcauuagauucauucaucucauuugccagg

SEQ ID NO: 28250 - RNA, 64 nt, Human
aaccacaauuguaugugccuguuuuuuacucuuagcauuagaugaauucaaauuuggaaacaga

SEQ ID NO: 28251 - RNA, 64 nt, Human
gagaaaaaaauucaccuuacagugcuaagaaagugcauuagaauggaauugcccuuuccuuaag

SEQ ID NO: 28252 - RNA, 64 nt, Human
aaaggaacguugcagaagcaaucgggauaaaacagcauuagauagucaugcugcuagaucuuua

SEQ ID NO: 28253 - RNA, 64 nt, Human
gcagcucuuuauuuggacuaaagugucaggauaugcauuagauucucuccugaaccaaaaacac

SEQ ID NO: 28254 - RNA, 64 nt, Human
ugauuuugugcaaaagcuucaaauuaaaacagcugcauuagaaaaagaggcgcuucuccccucc

SEQ ID NO: 28255 - RNA, 64 nt, Human
uguuccaaauuguugauugcaugugguuaauguugcauuagagcacuuugcaauugcauaauuc

SEQ ID NO: 28256 - RNA, 64 nt, Human
acauuuaauauggaaaggugggaagaauauuacugcauuagauguaauucuucauucuagacuu

SEQ ID NO: 28257 - RNA, 64 nt, Human
gugcucauucugagaccuaaauuuaaagggucaggcauuagaaacaaaaguguuucuucauauc

SEQ ID NO: 28258 - RNA, 64 nt, Human
agaucaacaaauggucauugaaaacacuuguuuagcauuagaauaaaauuauauauguccuugg

SEQ ID NO: 28259 - RNA, 64 nt, Human
aaauucagucuuuucaaaacaaaucacaaaagcagcauuagacauugccuuguuucauuaaucu

SEQ ID NO: 28260 - RNA, 64 nt, Human
accaucggcaggcagugguucgguuuaagagauggcauuagagggagcccagucuggaugugga

SEQ ID NO: 28261 - RNA, 64 nt, Human
uuuaggguccuguggcgagcugugagcaccgccagcauuagacgucacauccagguggccccac

SEQ ID NO: 28262 - RNA, 64 nt, Human
aacaaacuguuuuacauuccuuucauuuuauuaugcauuagacguugagacagcgugauacuua

SEQ ID NO: 28263 - RNA, 64 nt, Human
augccgccuccgggaaugagacccccuccaccaggcauuagagguccaccucccccaggaaugc

SEQ ID NO: 28264 - RNA, 64 nt, Human
cuugaagaacugcugguguuacauguuccaaaaggcauuagaccuaucagcuuuguuucgccug

SEQ ID NO: 28265 - RNA, 64 nt, Human
aauauauuaauuaucauuaaguauuaaauaauaggcauuagaugucuaaugugaguauaauuuc

SEQ ID NO: 28266 - RNA, 64 nt, Human
aaaauuuuguguugacauuccauaagaugaguuggcauuagaauuggaaguccaguuuauuucu

SEQ ID NO: 28267 - RNA, 64 nt, Human
gagauugcagagagagagcgucgagagcgagaacgcauuagaauaauucgugaacgggaagaac

SEQ ID NO: 28268 - RNA, 64 nt, Human
aucaccaauaguaaaugaagauguuuaugaacuggcauuagaagcuuucuaaacugcgcugugu

SEQ ID NO: 28269 - RNA, 64 nt, Human
uaauaaugugaaauacaguuuuccugcaaaauuagcauuagagaauugauuuuagauaacagau

SEQ ID NO: 28270 - RNA, 64 nt, Human
cuuuacuuugcauuugauugcugugaagaugaaagcauuagacuuuuauccccuucaugucacu

SEQ ID NO: 28271 - RNA, 64 nt, Human
augggagugaugggagacagugacagaucaucaggcauuagauucucauaaggagugcacaauc

SEQ ID NO: 28272 - RNA, 64 nt, Human
cuaagucugggcagugggcuggccccuggugugagcauuagaccagccacagugccugauuggu

SEQ ID NO: 28273 - RNA, 64 nt, Human
gugucccuaauuugagaaguaaccuuuuggaauagcauuagacccuggcuguccccuccccacc

SEQ ID NO: 28274 - RNA, 64 nt, Human
ucguucugcuggccaagaaguuaaacuauuuugagcauuagaauggaggaaauccggucagcca

SEQ ID NO: 28275 - RNA, 64 nt, Human
ggugucauuuauaggaagcacugccaguuaaagagcauuagaagaggugguuggauggagccag

SEQ ID NO: 28276 - RNA, 64 nt, Human
guuaaaagagagagagacagagacagagaaauaagcauuagagaccugcaaucaccaagcugag

SEQ ID NO: 28277 - RNA, 64 nt, Human
uaugaaucugguguugaugcaaugccucagugaugcauuagaucucuaauaaagucuguauaua

SEQ ID NO: 28278 - RNA, 64 nt, Human
aggaauaaaauggauguaaacauuuacaugggaugcauuagaauucugcuguguguacugucuu

SEQ ID NO: 28279 - RNA, 64 nt, Human
guuagaauuggaaaucugucuugucauuuuacaagcauuagauuccuuuccugugugaagaaag

SEQ ID NO: 28280 - RNA, 64 nt, Human
cccaucccugcauuccugucuggaaccagugaaugcauuagaaccuuccauaggaaaagaaaag

SEQ ID NO: 28281 - RNA, 64 nt, Human
auuugcagugaauuauuuauugugauaauaaauagcauuagaauacaagauuuuuaaugucugc

SEQ ID NO: 28282 - RNA, 64 nt, Human
aaggaccagacugccuauucguaaccuuucugcagcauuagagccaucguucaugggggacaca

SEQ ID NO: 28283 - RNA, 64 nt, Human
agacuuuaauuuacaaauuaaauugcaaaugggagcauuagauuuaguuuuagacuuagguggg

SEQ ID NO: 28284 - RNA, 64 nt, Human
aaaacuauuauuuauauugggaaagguaacuauugcauuagagcauguuggcagacugguaggu

SEQ ID NO: 28285 - RNA, 64 nt, Human
ccuuucugugguuuuauuuaaugggcuugaauuugcauuagaucagauuuuugccgcaucacau

SEQ ID NO: 28286 - RNA, 64 nt, Human
gaucuacuuucacauucucaaguuuuucucaucugcauuagaggugcccaguagguucccaggu

SEQ ID NO: 28287 - RNA, 64 nt, Human
cuuccggaggcucccuguguccuggaggagaaaagcauuagagggggcagcuggacaagcuccc

SEQ ID NO: 28288 - RNA, 64 nt, Human
gacucuugauaacuuguuaaucuguugcugacuagcauuagacuguuacacgaagauaaacuga

SEQ ID NO: 28289 - RNA, 64 nt, Human
ggggagcuggccagaggaggaccccuuucccguggcauuagaagggggagggguggcuggggcc

SEQ ID NO: 28290 - RNA, 64 nt, Human
uagugaauguaggaaguucuucagcacuugagcugcauuagaaauuucaugccaaaaaugaauu

SEQ ID NO: 28291 - RNA, 64 nt, Human
uaaucuauuuugcuccauacaugcaacugcguuggcauuagagguuuuauaccauuaaaagagu

SEQ ID NO: 28292 - RNA, 64 nt, Human
ucagaaauuuuaauacucugcauaaccaguauuagcauuagaaauuagccacuuuuaaaaugag

SEQ ID NO: 28293 - RNA, 64 nt, Human
gaaauaaauauuuauuugugcacuacaauucaaagcauuagaaacauugagaguucaagugcug

SEQ ID NO: 28294 - RNA, 64 nt, Human
gcagaaaaaccagggcaggacaguuaucgacaaugcauuagaacuuggugagcauccucuguag

SEQ ID NO: 28295 - RNA, 64 nt, Human
ucuuguacugugaccuaagaacaaaacuguaacugcauuagaaaccaugaaaaaauuagauauu

SEQ ID NO: 28296 - RNA, 64 nt, Human
uuacguacaacauagcugugguggcuuaauggcugcauuagauaggauccucacaucccauuca

SEQ ID NO: 28297 - RNA, 64 nt, Human
accaggauuccuuaaaccugaacucagaccacuugcauuagaaccaucuggagcacuuguuuua

SEQ ID NO: 28298 - RNA, 64 nt, Human
gcauuaaagucuacaauggaaaaaaagcagugaagcauuagaugcugguaaaagcuagaggaga

SEQ ID NO: 28299 - RNA, 64 nt, Human
gaaugugggauccacucccgcuuuuaacaugaaagcauuagaagaugugugguguuuauaaaag

SEQ ID NO: 28300 - RNA, 64 nt, Human
gucagcucagcucccugccuugucacauuugucugcauuagaaacuacugaagaaauaaaaguu

SEQ ID NO: 28301 - RNA, 64 nt, Human
uaaaaccacuauacaaacuuacgaaacaugcauagcauuagaagacaagaauguaucaagacac

SEQ ID NO: 28302 - RNA, 64 nt, Human
aauaaagaaaaauaauuuagcuguguuuuagacagcauuagaauauauuguucagcacaguaaa

SEQ ID NO: 28303 - RNA, 64 nt, Human
aacuaaauccucgacugcugcuguuaaaaaacaugcauuagaaucucuagaacacgaggaaaaa

SEQ ID NO: 28304 - RNA, 64 nt, Human
aaaucacuuuuguaauccaggacaagaaaauguggcauuagaguagaaauaucuuuggaaaugu

SEQ ID NO: 28305 - RNA, 64 nt, Human
aaacauugaagaggcaguucgcuuguaucguaaagcauuagaagucuucccagaguuugcugcu

SEQ ID NO: 28306 - RNA, 64 nt, Human
acauuuuaaaagcaaugauguaaacuuuguucuugcauuagacugaccaguuuaaaaauaugaa

SEQ ID NO: 28307 - RNA, 64 nt, Human
ugcaaacucacuucugaggggggacccuggcaccgcauuagagcucgaaauaaaggcgauagcu

SEQ ID NO: 28308 - RNA, 64 nt, Human
gcuggugguggggagacucuucaaguuaauaucugcauuagaggcaccuaugaguuaaaaaauu

SEQ ID NO: 28309 - RNA, 64 nt, Human
uuucuuacaaaaaagaguugaaugagguaaaauggcauuagauggcucuauauuuuuuaaagcu

SEQ ID NO: 28310 - RNA, 64 nt, Human
guauguucugguuuuggcccucuugcagaaagaagcauuagaaaaauuacuuuaaaaguagcua

SEQ ID NO: 28311 - RNA, 61 nt, Human
ugcaagcucaggccuuuaaggacugcugaugcccccucaggccucccccaaguuugcuggg

SEQ ID NO: 28312 - RNA, 61 nt, Human
auggccaucuuuucuuuccuauccuuucuuccccccucacugugaaaaauaacaguccacc

SEQ ID NO: 28313 - RNA, 61 nt, Human
ugacagaugccaacuucccacacggcagccccccccucaaggggcagggaggugggggccu

SEQ ID NO: 28314 - RNA, 61 nt, Human
gcccccuccccagcccccaguucucuccccacccccucaccccacccggggcucacucagc

SEQ ID NO: 28315 - RNA, 61 nt, Human
aauuuuuagaugucaguuuggaggcucuuuccccccucaauugagagcucuuguuauucag

SEQ ID NO: 28316 - RNA, 61 nt, Human
ugaaacucucaagccucucaucucugcccagcccccucaguggcgcugcuaugcaaggcuu

SEQ ID NO: 28317 - RNA, 61 nt, Human
ccagcgucuggcugccuguggccuggagggacccccucaagaggagacaaagccuaaguuu

SEQ ID NO: 28318 - RNA, 61 nt, Human
agcgcugagggaacaaaugguuggcaugcagcccccucaggcgccccgagaccucaucuuc

SEQ ID NO: 28319 - RNA, 61 nt, Human
acagaaggcaggacguuccaugccgaggcugcccccucacccagaagucugagcccagccu

SEQ ID NO: 28320 - RNA, 61 nt, Human
uucuucuggugauguuuacuuaaaaagugaucccccucaacaacggauacagcgugcuuau

SEQ ID NO: 28321 - RNA, 61 nt, Human
gagcuuuuggggcacaacaucccaccgcagucccccucacccgacaacaccuccuaccugg

SEQ ID NO: 28322 - RNA, 61 nt, Human
uuuaaaaauguauuuauuugagugucuuucccccccucacccucaccaucugaggggcucc

SEQ ID NO: 28323 - RNA, 61 nt, Human
uagcauuuuucaccuucauagcauacuccuucccccucaggugauacuaugaccaugagua

SEQ ID NO: 28324 - RNA, 61 nt, Human
ggaaguuugggauauaccccaaaguccucuacccccucacuuuuauggcccuuucccuaga

SEQ ID NO: 28325 - RNA, 61 nt, Human
uccucuauucccuucuuccgaauuaaaaauacccccucagagcgaucuagccucccgaauu

SEQ ID NO: 28326 - RNA, 61 nt, Human
gggucuauaugcugggugcugagacacugaucccccucauuugaugagcaaaugagcuacu

SEQ ID NO: 28327 - RNA, 61 nt, Human
gcucccacgcuuuguccgugaugccccccuacccccucacucuccccgucuccaugguccc

SEQ ID NO: 28328 - RNA, 61 nt, Human
aaauaauauaaaauguuucaagcgcuuaacucccccucauucacaaaguauaacaauuaaa

SEQ ID NO: 28329 - RNA, 61 nt, Human
uuucuauccuuuuauauuuuucccuuccccacccccucacucaaugguauaaaagcuagga

SEQ ID NO: 28330 - RNA, 61 nt, Human
cggcacuugagauaugugcaguggguggucucccccucagucuuacuuugagcugcuguua

SEQ ID NO: 28331 - RNA, 61 nt, Human
caacauggagggcugacuugaagcucccugucccccucacucuugccccaagaaaagaggc

SEQ ID NO: 28332 - RNA, 61 nt, Human
guccccugcccaugcugggagcccacgcucacccccucaccccuccaagcucacuccccaa

SEQ ID NO: 28333 - RNA, 61 nt, Human
uguccacugccuacacaugacagacaaguaacccccucaugggggauggggaccuaccugg

SEQ ID NO: 28334 - RNA, 61 nt, Human
uguccugagauggaaaaguguccuucuugcucccccucaauagaucuccagcgucagcugc

SEQ ID NO: 28335 - RNA, 61 nt, Human
aguccuccugaggcccugaggguggcccugacccccucagggcucauuccuggugggcaug

SEQ ID NO: 28336 - RNA, 61 nt, Human
aucauaggguucugaucacauugcacgccuccccccucacuuguccuccugauccugacac

SEQ ID NO: 28337 - RNA, 61 nt, Human
ccucugagaccaaaauuuugucccaucucuacccccucacaacugcuuacagaauggauca

SEQ ID NO: 28338 - RNA, 61 nt, Human
uucuuuccuugugaucugaaugucuccuuuucccccucagagggcaaagaggugaacauaa

SEQ ID NO: 28339 - RNA, 61 nt, Human
uuugcuuccuccaagacuuacccaacuccuucccccucagagaaccaaauagccugaggaa

SEQ ID NO: 28340 - RNA, 61 nt, Human
auagcacuggaggaggaaaacaaauucuugucccccucagaaugagaguggcucuuucuga

SEQ ID NO: 28341 - RNA, 61 nt, Human
auuccauccacacaguuuccacccucaccugcccccucauacggaguuggaugggggccga

SEQ ID NO: 28342 - RNA, 61 nt, Human
gcuuguguccccaggcaccaguaguuugagccccccucaaaagacaugaaggggguugggg

SEQ ID NO: 28343 - RNA, 61 nt, Human
ggaggcugcagccaggauugccucagcuccucccccucaggcugggaggauagcacaggcu

SEQ ID NO: 28344 - RNA, 61 nt, Human
cccaccaccucaguggaacacaccauucucccccccucaacagcacacucagugcagcaag

SEQ ID NO: 28345 - RNA, 61 nt, Human
ggguugaugcaggucugcaggucuucugcaccccccucaaugaggagucccucccagaaag

SEQ ID NO: 28346 - RNA, 61 nt, Human
ugucauuucucauccacauacccugaccuggcccccucaguguugucaccagaucugauuu

SEQ ID NO: 28347 - RNA, 61 nt, Human
ugauaugguaaaaguuacuuauucuagauuacccccucauuguuuauuaacaaauuauguu

SEQ ID NO: 28348 - RNA, 61 nt, Human
guugagggggcuagagggagaaugggaaccacccccucaguccccugcacugacucacucc

SEQ ID NO: 28349 - RNA, 61 nt, Human
ccuuucucuuucacucucuaguuauuuccuucccccucaccuuuuggccauggggagaauu

SEQ ID NO: 28350 - RNA, 61 nt, Human
cuccgagcccacugucacgcugccugguguucccccucagcagcaagcacuucucuuaggg

SEQ ID NO: 28351 - RNA, 61 nt, Human
gccuggggcggccucacccuggcuggugcugcccccucaccuugguacugaucagcgcccc

SEQ ID NO: 28352 - RNA, 61 nt, Human
ggauuucuggaguuguuuaccuuaccccacacccccucaacauguagacuaaugcagccau

SEQ ID NO: 28353 - RNA, 61 nt, Human
uacuauccaaugucaguuaauuggugucuuccccccucauuugcucucuucccuaaaaugu

SEQ ID NO: 28354 - RNA, 61 nt, Human
aaauacugcuuuacaaagcauuucagccuuucccccucaguuuugcauugauuuuuugaca

SEQ ID NO: 28355 - RNA, 61 nt, Human
cuugaggccuugacuguugugucacccagagcccccucaagccuucugcuccccaauucuc

SEQ ID NO: 28356 - RNA, 61 nt, Human
cugaguacuugauuucaggucaauaacgguccccccucacuccacacuggcacguuuguga

SEQ ID NO: 28357 - RNA, 61 nt, Human
guaagaaugguguuuacaugcaguguguuuucccccucaccuucaauaagguuuuucaaaa

SEQ ID NO: 28358 - RNA, 61 nt, Human
uaagaaggcugcuguacugguugaauugugucccccucaaauucacauccuucuuggaauc

SEQ ID NO: 28359 - RNA, 61 nt, Human
caguauauaaggcuguaaaaugagaauucugcccccucaccucuuaccccaguacuauucu

SEQ ID NO: 28360 - RNA, 61 nt, Human
cccaugcgcugggaggggacccuccauuucucccccucacccaugcugaguguagagccgg

SEQ ID NO: 28361 - RNA, 61 nt, Human
ccacccugccuccucuguucugaaauuccaucccccucagcuuaggggaaugcaccuuuuu

SEQ ID NO: 28362 - RNA, 61 nt, Human
cuucauuugagaauaaguuucacuuuaaagacccccucaauauccuccucagauuugcccu

SEQ ID NO: 28363 - RNA, 61 nt, Human
cuguugguacuguuccagaaaaacuguuacucccccucacccacucccuccuuccccaguu

SEQ ID NO: 28364 - RNA, 61 nt, Human
ucuaucccugggccccaaacccucaccgguucccccucaccugguguucagacaccccaug

SEQ ID NO: 28365 - RNA, 61 nt, Human
ccaggaaccgcgcugcgccaccugcacucaccccccucacauucucuuaagcacccggugg

SEQ ID NO: 28366 - RNA, 61 nt, Human
aacccucccucuuucugcccauuuccucccacccccucacucccauuuccuagcaaaauca

SEQ ID NO: 28367 - RNA, 61 nt, Human
gauaacugagcggucgcauggcagaggacaucccccucagagugggcacaagugcccucua

SEQ ID NO: 28368 - RNA, 61 nt, Human
ugagacagggcugccacggcaaccgccaagccccccucaaggugggacaguaccccggacc

SEQ ID NO: 28369 - RNA, 61 nt, Human
cuggacccucaaccccugcaaccuucccuagcccccucaauagaugagcaggucaggcugu

SEQ ID NO: 28370 - RNA, 61 nt, Human
gaugccugugccuguuccaccuggacgguggcccccucagccuggcagccucuggacagag

(The sequence listing continues in the following parts.)

The invention claimed is:

1. An isolated nucleic acid, wherein the sequence of the nucleic acid is selected from the group consisting of:
   (a) SEQ ID NO: 906;
   (b) a DNA encoding (a), wherein the DNA is identical in length to (a);
   (c) a sequence at least 80% identical to (a) or (b), wherein the identity is over the length of (a) and the sequence is 70-150 nucleotides in length; and
   (d) the complement of any one of (a)-(c), wherein the complement is identical in length to (a).

2. An isolated nucleic acid, wherein the sequence of the nucleic acid is selected from the group consisting of:
   (a) SEQ ID NO: 3107;
   (b) a DNA encoding (a), wherein the DNA is identical in length to (a);
   (c) a sequence at least 80% identical to (a) or (b), wherein the identity is over the length of (a) and the sequence is 18-24 nucleotides in length;
   (d) the complement of any one of (a)-(c), wherein the complement is identical in length to (a).

* * * * *